United States Patent 9,029,636 (ISOLATED NOVEL NUCLEIC ACID AND PROTEIN MOLECULES FROM SOY AND METHODS OF USING THOSE MOLECULES TO GENERATE TRANSGENIC PLANTS WITH ENHANCED AGRONOMIC TRAITS) - sequence listing, part 11

SEQ ID NO: 42213 - DNA, 2492 bp, Glycine max
  Peptide Sequence Number=SeqID_158991
ctttctgcaatcctgccgatgttgaagtatttactgaagagaagaaacaatctcttgccaaacgtccaggaagaggtggtgaatttgctcgtgcagtaaaggagattattgaatgttatgaaaaattgaggactgagaatcaggatggtgacacagggtcaaaggagcagatggatgagtcatattcacctgatccatctgccaacacaggggcaaaggagcagatggatgctcctttcacaattaattcacaaatgaaatcttcaaattgtgtgattgacagacctgaggatgctgttgcattgaaggatgaatcttataatatagaagcatcattggaggaagctactgataatgctattatgactgcaactgtaaaatcacttttttcaacaacccagagaaatgcaccagttcaaaggtctagaagcacattacaggtccaaaactttgttttaccttatagtgatggtggaaataatggcagcaatagtaatgacaacatatcagctgatgcaattgaggatacatctataagaaggagaaaacatatcaggaaatcacctgaccttttaggttgtgatgatactgattcacctgcatttgctccaaatgttagcatggaggacaatggttctgaaattattacaatcatttctgatgccttcactttaaatgagggaagtacgatagattctaatttaaaacttgaacagtctgagcctattgagtgccctgaaggtgaagatgatttgaacaaaggtcttgatctagaaataaaggctgtaatcaacaagaagaaaagaaaaccaaaccggaaaaaggaaactaatgattctggtgctcagaatgccagccaaagtttgcagaatatgggtggaaattctaaagaaagatgccctgatcaagatggagatgaacacttgcccctggtgaaacgagctagagttagaatgggtaaatcatccgcagaggcagaactcaatagcattgcacaagttcaggttaaatgtggcgaggaagatattactgactcaccacatcagataatcacatcctcaaattgtgaaaatggtagccttgctgaaggaggcacatcagtgttgaatagtgctttggttagtgtttctccttctaacttaatagctctgtgttctgaaaatgggtctcagatttgtaaaattaaaaaggaccaaatgtttggctgctctgtggatgatgaagctgctttacctccatctaaacgcatccatcgtgctttagaagcaatgtctgccaatgctgctgaagaaggtgaagcttgcatggaatcctcctctataatgacatcaagtggtagatgctgtatatctaccattaagagatgtccttgtatgaccgttaacaatcaaggaggtaatgatttagaactgcaaaggttggattcttgtggcattgattcatctcatgttagtatgtatagtttctcaactcgttcgaatacaattatttccacagagaatgagtcatctacagaagtggataagcatttggccaagttccaatgtgaaactgggaaggatgtcatcccaggtgatagacagcaaggtggtgaagatcttagtgattctgttgtctgtcatcctgccaaaatagattcacaaatacaatcacatggaaaaatttctcctgatcttgatgtaaaatgttgccaagttggaaacagtaaggattcaccatgtccatcattgttaccaaatggtgattacaatgtcagaccttcaaaccattcagatgcatctgatacattagagcatggtggaataagtcttgatcctgtggcaggtgacggtgaaagtgataaattggtacctcaaaatagtattaatgtgccacagaatgtggtggttgcttgtgaggatatggggaagcaagcagttggtggcagcagcaaaattaatgacacgcatgaggttgtcaaagaggtaaaatttaaaggacaagaggaggatatgaattctgtttcaatatcaaatgattattcaggtgaaaagggtaatttggtcattctgtcaagtccatccttgactgatgggagagttttccttccactaggttcacctccaaatacatcagtttgcaatatttctacatcagacagtagtaatatccttcaaaatggaagttgtagccctgatgtacaccagaagaacactttatctggtcctactgatggatggaaagatgggattgtggaaaatggacgatcaagatctgtgggcaagtcaactgaagcaggagatgctgcattgttgtactttgaagcaacgcttaggacattgaaaaggacaaaggaaagtattggtcgagcaacacgcatagctattgactgtgcaaagtttggcattgcaactaaggaaactgctccccttgaaaaaccagaccatttcaatgtatccaattctgaatatggctcaaagtcatttgatgggttggacttcggtgatcgatag

SEQ ID NO: 42214 - DNA, 423 bp, Glycine max
  Peptide Sequence Number=SeqID_158992
atgggtgcttcggcatcggtcacagaaaaatccatccatgaattcatggtcaaggatgctaagggcagagacgtgaacctcagcacctacaaagggaaggttcttcttgtagttaacgtcgcttcaaaatgtggatttacaaattccaattacacccagttaactgagctttacagcaaatataaagacagaggtcttgagatactggcatttccatgcaaccagtttctgaaacaagagcccgggagtagccaggaggcagaggaatttgcctgtacaaggtacaaggctgagtatcccatttttggaaagttactgctggtggctatgtcattattcactgttggagaggtgcattcatggtcaagatatgacagagcatgggcttaccttaccaagaggaacaaggttgggatggaataa

SEQ ID NO: 42215 - DNA, 135 bp, Glycine max
  Peptide Sequence Number=SeqID_158993
atgggaagtggaggcttcttcgtctctgtgacaatccacctccttagagtaaagattgaggtatctcagaattttaagttacttgagacatcaaaacagataggcaagctcaagagttgctattatctgagttaa

SEQ ID NO: 42216 - DNA, 270 bp, Glycine max
  Peptide Sequence Number=SeqID_158994
atggactgtggcagcgatggaggccttgggtttaagaaaaaggaaggacagttgcaccagagcttatgtaaaggctctgataagttgcacgataaagaattaaggtggcaaatttctacctacttgatgatagatgacaaaaatcaaatagggaaagaatatacagaattgcagataatattaggggttttaaatagcatgctacagtggtgtagcagtgctgactggcccctatctgccataggggctgccatagcggagcaattgtag

SEQ ID NO: 42217 - DNA, 273 bp, Glycine max
  Peptide Sequence Number=SeqID_158995
atgccgcctagtcgtagaaagggcggaaagaaaagcgccggcggtgccgccgcctgccggcagtttaagctcggcgatctcgtgctcgctaaggttaaggggttccctgcttggcctgcgacggtgagtgagccgcagaagtggggttactctgctgatcggaagaaagaattgaatggacatgaagttgctattggtatgcatatggtgttcttgtttgataaggaattgaatggacatgacaaaatttcaaaacctggttgcttgaaatga

SEQ ID NO: 42218 - DNA, 222 bp, Glycine max
  Peptide Sequence Number=SeqID_158996
atggagaagaaacaagacgtgatagcaagatcaagtgcaaaagcagagttcagaactatgggtctagatatttgcgggttattgcggttacagataattgtggatgatttgcgaattgagagaaagaagttagtagatggcatacttgatctccgaagtattcgatcagaagatcaaatagcagatgaaattactaaaaggcctctcaacttagatgtttaa

SEQ ID NO: 42219 - DNA, 804 bp, Glycine max
  Peptide Sequence Number=SeqID_158997
atgagcactgctttgttgatggctgctgcctccaagaaagatcatgaaagtggagagagaataggtgcaaattttgctttctgcggagcagatccatctgctcaacattcacagcatgggcggacagctttgcatacagctgttatgactgacgatgttaaattggttaaggttattcttgctgctggtgttgatgtgaacattcgtaatgtgcacaatggcattcctcttcacatagccttagctaggggtgctaagtcatgtgttgaactacttctatgtattggggcagattgtaatttgcaggatgatgatggtaacactgctctccatatagcagcaggaacagcaaaaatgatacgtgaaaatcttgattggctcattgtatgcttgggaatcctaatgctgattggcaagactctaggtgacatcttggatgcccttccccgagaatggatatcagaagatctgatggaggcactcatgaagaaaggagtttgtctctctcctgcaatatttgaagtgggagactgggtgaagtttagaaaaacttccatgactccaacaaatgggtgggaaggtgatcggcagaagcaggtgggctttgtgcaaagagttccagacaaagataatctcattgtttcattttgttctggagagtattatagtgttttggccaatgaagttgtaaaagtcattccattagacaagggacaacatgtgcagcttaaagaggattatgaattacaagaggaaccatcttctaaatcagaactaattagccctggcaccaatcatccatga

SEQ ID NO: 42220 - DNA, 366 bp, Glycine max
  Peptide Sequence Number=SeqID_158998
atgacgacaataatgatgatgatgatagtgtcgatagcgataacgatagagatatcaatagtgataatgttgatgattgtgttatccaatgttggtgattacatagatgatattgatggtgacaatgacattggtggtgatggtaataataatgacaatgacaatgataatggtgatgagagtggcattcataatggtgtcaatgatgatgacaatgacaatggtgttggtggtaatagttgtggtgatggtaatggaggtgatattggtattagtggtggcgacaatgatggactagtggtggaggtaaaggtggtgacaagtacgatggtcaaatttaaaaaatatgtattttttaaaagctaa

SEQ ID NO: 42221 - DNA, 785 bp, Glycine max
  Peptide Sequence Number=SeqID_158999
atgggcacccagttctacagcggcaccacgctgaagaacctgcaggcgcagcagccggagaaaatcgacgaggcgtggatccggcgactgctgccgccgctgttcagcgccatcaacaccatccatcaggaaggttacctgcaccgcgacatctcgctggataacatccaaatccaggagagccagctaccggtgctgctggacttcgggtcggtgcgcaaagagatcggcaacctgtcggacgaaacggagatcatgctgaaaccgggtttcgcgccgatcgagcagtacaccgagaacagcgacggcgaacaggggccctggaccgatatttatgcactgggcgccgtgctgcacacgctgatcgtcggttcgccgccgccggtcagcgtggtgcgcagcatcgaagacagctatcagccgctggccgagcgccgtcccgccggctactcgccggagctgctgcgcaccgtcgaccgcgcgctggcgctgaaaccggaagaccgcccgcagaccatcgatgaaatggccgagctgttgcatctgccgatcgccgatgaaaatgaaatcatcagcaccccggccgccgcgccggagaacctgctggtggccgccaacccggctgcggccgccgcggccgccggcgccgttaccgcgcgcagcacccaattctcgcggccgatgatggccggcgccggcgtcgcggcgctgctggcgatcggcgccgtcgcctggctgagcggcggcgaggatgataccccggccgtagcgcaaaacagcgaagc

SEQ ID NO: 42222 - DNA, 321 bp, Glycine max
  Peptide Sequence Number=SeqID_159000
ggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatcccgaaagtcaggttgaaggagctcccacttgccaagatgtaatgaaaagaacacaggggcgcctgcgtggctcagtggttgagcgtctgccttcagctcaggttgtgatcccagggtcctgggatcgagtcccgcattgggctccctatggggagcctgcctctccctctgcct

SEQ ID NO: 42223 - DNA, 168 bp, Glycine max
  Peptide Sequence Number=SeqID_159001
atgccacaagtgccagacattcacggacaatgtcaatgctccgcccaggcccttgaacgttttagcagcgccatggcccttctcaatgtggggaatagattttaccctggaaaattatcacggacaatgccactgatcgagcccgtactcgaatcaaataaacattaa

SEQ ID NO: 42224 - DNA, 322 bp, Glycine max
  Peptide Sequence Number=SeqID_159002
atgatcgaaagttttcaacaacaacaacaaatgtcagttctagaattgtacgtagaaaaggatgttgctggtggttcgatgtttcatgctgcaaattctgttacgtcatgtggacgtaatgtatctcatcatgaatcggaactgccaagaaatataagtaatttacatgatgatgaagatgatgatgatgacgattaccttgcatctaactcatacgttgaagagtctttcaatgaagatgatagtgatgatggaatatctgatacagacgatgaagtcactgacatcgttgaaccagtttcaattgttcacccaaccgaag

SEQ ID NO: 42225 - DNA, 1357 bp, Glycine max
  Peptide Sequence Number=SeqID_159003
atggtttccatcgccaacgacgacgccacgccccagatgccgcccatcgcaacgccgtacaacacccgcaacagcaagaagaccgtcagcgagggcgcggcggcggagagcagctcaaacaccgagaagaagacgatattcagcatcaggatcggcttgcggccatatttttccgccgcccgcccgaagatcagcgcgccaatcgggcgcaccgccagcgtgagcagaatcgccaaccggggtccaaccaaacatagtgttatccctaccgtagagtacgaagtcaggaggtttagcggctgccgggcagaatgcggcggcggtcgggccttcagcgaattgttaatgggtattgccgcaggttgcgaggcggctcgcacaacctcatttatttcgatgaaaatcagcgattactctgctaaatgcatcgaaaaaccaccaataccgccgcgcaatgcccagatgaatcacgcatcatgtcgccctcagcaaggagagcgatatgtcactggcggccccttccgtgacggtggaggtgcatatcagcaatggcctgcccggcctgacgctggtcggcctgccggaaaccacggcggacgttacgatctgccgatagcgctggcgatcctcgccgcctccgagcaattgcccctcgcaccgttggcgcgctacgagtttcttggcgagctcgcgctgtccggctcactgcgcgcggtcaggggcgcgatccctgcggcgctggcggcggctgatgccgggcggcaactgattctctcaacggacaacgccgccgaagtcggcctgatcgcgcagtcgcactcccataccgcccggcacctgttggaagtctgcgcctttctgctcggccagggcgaactgccggtggcggccacgcctcccgctgcggacaccgcctgcgacagcgccgatctgcgcgatatcatcggccaggagcaggccaagcgggcactggagatcgccgccgccggcgggcataacctattgctgattgggccgccgggcaccggtaaaaccatgctggccagccgcctcacgggcctactaccaccgctcacggagcctgaggcgctggaaagtctggcggtcgccagcttgcagcatcacattcccgctgccctaccatggcgccagaggccgtttcgcgcaccgcaccacagcgcctcgatggcggcattggtcggcggcggctcactgccgcgaccgggcgagatctcgatggcgcataacggcgtgctgtttctggatgaactgccggaattcgagcgtaaggtactggatgcgctgcgtgagccgttggaatccggcgagatcgtgatttcacgcgcccaacgccaag

SEQ ID NO: 42226 - DNA, 480 bp, Glycine max
  Peptide Sequence Number=SeqID_159004
atgtttggttggaccccgctgcaacgcaacgcggcaatcgccagcttttcaagctggacgctcgacgctttcgattttttcgtgctggtattcttactcagtgacatcgcgcaatcctttcacgtcggtctggaacaggtgacgttggcgattctgctcacgctggcggtgcgcccgattggcgcgctgatcttcgggcgggcggcggaaaaatatggccgcaagccgatcctgatgctgaatatcgtcttcttctcggtgtttgagctgctctccgccgccgcgccctcgctgacggtcttcttgctgttgcgggtgttgtacggcgttgcgatgggcggcatctggggcgtggcgtcgtcgttggcgatggaaaccataccggaccgctcgcgcggcctgatgtcgggtattttccaggccggctatccgttcggttatctgctggcggcggtggtgtacggcctgctgttcgaaacg

SEQ ID NO: 42227 - DNA, 1203 bp, Glycine max
  Peptide Sequence Number=SeqID_159005
atgccgcactatccgcagcaggatggccaggtgaagctggccgccggatggcttatcgatcaatgcgaactgaaaggatatcgtatcggcggcgctgcggtacaccgtcagcaggcgctggtgctggtgaacatcgacaacgcccacagccaggatgtggtggcgctggcgcgccacgtacgcaagacagtggccgataaatttggcgtctggctggagcctgaggtgcgttttattggcgcgaccgataccaaggttccgttaaaactgatcgcgctgctggccgacggtgaatttcattccggggaacacctgggtgagtcactgggcatgagccgtgcggcgatcaataagcatattcagaccattcgcgaatgggggctggatgtctttaccgtgcccggcaaaggctacagcctgcctggcgccatccagctgttggaagccgagcgcatcctcagcctgctggaagacaagcgtgtaagcgtgttgccggtggtcgattccaccaaccaatacttgctggaccgcattgccgaattgcactctggtgacgcctgtgtcgctgaataccagcaggcagggcgagggcgccgcgggcggcagtggatctcgccattcggcgctaatttatacctgtcgatgttctggcgactggagcaggggccggctgcggccatggggcttagcctggtgatcgggatggtgatggcggaagttctgcagcgtctcggtgcggccgatgtgcgcgtgaagtggcctaacgatctctacctgaacgatcgtaaattggcggggatcctggtcgaactgacggggaaaaccggcgatgcggctcaactggtcatcggtgccggcatcaacctggcgatgcgtgataccaatgccagcgccattactcaaggatggattaacctacaggaagcgggaattcagatcgatcgcaatgagctggctgcaaccctgcttaatgaactgcgtcagtcgttgaaacagtttgagatagacggactggcgccctttatcggtcgctggcgtaccctggataactttatcgacaggccggtcaagctgcttatcggcgagcggcagattgtgggtatcgcccgaggaatcgattcgcagggcgcgctgctgctggaacaagacggggagatcaagcccttcatcggtggagagatatcgctgcgcagcgcagaatag

SEQ ID NO: 42228 - DNA, 354 bp, Glycine max
  Peptide Sequence Number=SeqID_159006
atgacttatgaggtgcgatgcacttatgttttatgtgtaaatgctgatgaactactggacctgggagaggcagttgggactcaaagccggggtctttcccaagaacttattgatatgcttccaacctcaaagtacaaatttgatgaaaacgtggatactaaaaagttgaatggtggccaagcagtgtattgcatttttgaggaagatgagatgacatacagaagaggtgaccaacaaatgaaattaccatgcagccatgtctatcacggtgaatgcatcaccaagtggcttagcattaacaagaaatgtcctgtttgcaacaccgaggtttttggcgaggaatcaacgcattag

SEQ ID NO: 42229 - DNA, 1231 bp, Glycine max
  Peptide Sequence Number=SeqID_159007
atggcgaaagagaagctgcaggaaaataatatcaacctggatgatttgcaaaatgaattgcaaaccacgctgcgtcaaaccggcaaaccggaactgcagccggaaaatttacagcaggatgtaaatagcgaagcgaataatgcgcaaaaccaggcgaaacagacggcacagaatccacagaatgccgacaatgatattgccaattggatccgtggtgtactgagtcgtcatgccgatacgctgcaggctgcagaccgcgatgcgctgaaaaacattattaaagcgcggaccggaaaaagcgatcaggaagcggagcagatcgttaatcagactgagcagagctatcaacaggcgatgcagaaatatcagcagctgaagcaggaagcggagcagaaagcgcgtgaagccgcagagaaagccgcggcggcaacggcgaaagccagctggtttgccttcttcatgatgctgatcgaggcggtgctggcggcggtcctcggcggtgtcgcgcttcagcgcttcgctcagttcttcgcgcatgctggccagcatcgccttcaccacacgcgggttaccggccaccaggttgccagacagcatatagccgtggttaccggtgaaatcggtcaccagaccgcccgcttcacgcaccagcagttcaccggcagcgaaatcccatggcttcaggccaatctcaaagaaaccgtcaacgcgacctgcggccacataggccaaatccagcgcagcagagccggtacggcggaaatcagcgcactgggtaaacagttttgccacgatgttgatgaacggcgtggcgtgctgcttcagcttgaacgggaagccggtagccagaatggtgccgtcgaggtcacgcgccgtgctgccgcgcaggcgatagccgttaagctgcgcaccctgaccgcgtaccgcggtgaacagttcgttacgcattggatcgtaaaccaccgccacttcggtgcggcctttgatgcgcacggcgatagaaacagcaaagtggggcagacgtttgatgaagttggtggtgccatccaggggatcgattacccattgaacatcctgatcgtcgcccgccagctcaccgctttcttcggtgatgatggtgtgttgcgggtaggatttgcgaatcacttcgacaatcagacgttctgcgtcgcggtcaacattggtaacgaagtcgttgctgcctttctggctggcttcgacggcgtccggg

SEQ ID NO: 42230 - DNA, 162 bp, Glycine max
  Peptide Sequence Number=SeqID_159008
atgaagagggccactcattacctatcgtcactacagactagtgatggtcattggcctgctcatcttggaggttccctcttttttactccaccgttgaaattactcaataaatatgttcatttagaatggcttcataatctcgttatgttttcaaatgggtga

SEQ ID NO: 42231 - DNA, 432 bp, Glycine max
  Peptide Sequence Number=SeqID_159009
gacttgtaggaaagcttgggcagagcaaatgagaccttggggacgtcagggtgatagggcactggtaatcgattaccagttgggtgtaatcgattacacagtgttacctgctactgagaggaaatcccttgaaaaagacattatgactatgcgtagccgttatgcgcagttgatccatgatcgtgttgtgatggagtgcctagagggtgtttgggagaccctcgaaggcaatgagaggtgccgattccgtggcacaattcgactcactgctacttcattagtacatccggaggaacccgcatgcacacttcagcagcctatggagtggatactacctacacctactccatatcaactagttaagccggttcaagtgatagaggtgtcatcctctgaagaggatcatgaagaggacccagaggagttacctcc

SEQ ID NO: 42232 - DNA, 435 bp, Glycine max
  Peptide Sequence Number=SeqID_159010
cggcaaaagcaccgccggacatcagcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttggattaaatctatgaaggaaagttacttgcccgagttgaatgaaatgtaccaaaaaatagctagtaaacttcagcagcatgattcccttccacaacaaccaaagtcagatcagcttgaaaagctgaaggtttccaagagcaacatctcacctaatttcaaggagatcaagcttatcgataccgtcgacctcgagggggggcccggtaccagcttttgttccctttag

SEQ ID NO: 42233 - DNA, 1007 bp, Glycine max
  Peptide Sequence Number=SeqID_159011
cctacaaagggctacacgccctcgccttcaaaggattatacgtcctcaccttcagcgggttgcacgccctcgccttcagaggactacacgtcctcgccttcagagggctacatgccctcgccttcagaggattacacgtcctcgcctttagaggactatacgtcctcgccttcagaggactacacgtcctcgccttcagaggactatacgtcctcactttcagaggactacacatcctcgccttcagaggactacacgtcctcgccatcagaggactacacgtcctcgccatcagagggctgcacgccctcaccttcagaggactacatgtcctcaccttcagaggactacatgtcctcactttcagagggctacacgtcctcaccttcagaggactacacgtcctcacctttagagggctgcatgccctcgccttcagaggactaaacgtcctcgctgtcagaggactagacgtccttgcctttagagggctgcagcccctcgccttcagagggctgcagcccctcgcctttagatggctgcatgccctttccttgagaggactatgtgtccttaccttcagaggactacacgtcctcgccctcagaggactacacgtcctccacttcagaggactacatgtcctcgccttcagagggctacatgctctcgccttcaatgggctccacatccgcaccttaagagaatttaaggggtcgcgcccacaagacacccagtggacccgaagaagtccacagggccctggggtttccagtttggtttacgggcctctgtcagtcctacagggtgcccgtcccccccagcaagggatcgcgcccgcaagacacccagtggacccaaagaagtccagcagggtcttggggtttctagctctgattacgggcctttgtcagttctacgaagtgcccgtcgcccccaacaaggtcactaggccccccattaaacgggctttcatcaagaagtactgcgcccccaggcaggcgtag

SEQ ID NO: 42234 - DNA, 150 bp, Glycine max
  Peptide Sequence Number=SeqID_159012
atggcatcctacttggcacttaaagacacgtgtcaacccgccatgtcaactctgctacaggagtgcagacgcctgacccttagcagtcgggctccccaaccagcaggtattaatttatctataagcccacacattatctacaaggtatga

SEQ ID NO: 42235 - DNA, 264 bp, Glycine max
  Peptide Sequence Number=SeqID_159013
atggggtggggtggggtagctgggggcgaggacgaggagcgtgggagtactccttgccctattgacatccttagtccgcaacacaaagggtccaaacaaactaatagccttcttgttagatggaagagaaaaagtgtcagaagatcacatgtcaagaaggagaaagagaaaaagaagaagtgtaagaaaagatcagaggttaagaaggagaaagagaaaaagaagtgtaagaagatgaaagtgtcagcaatagttgcaacatga

SEQ ID NO: 42236 - DNA, 291 bp, Glycine max
  Peptide Sequence Number=SeqID_159014
atgtttagtgacctcacagtcttgctcccaagccgaacacaactcgtagtcttgcactcggtgcagcagccaatactcgagcttgctcatccttggcccgagtgggtccaactcatgaagtgcttgctcgacaagggatacttctttcgtgaagagggaaaaatgttatgcaatgctggtatgggcatgaaggatttcaatgtcattagaaccgtgtgcctcaattttggtagagaccactttcatcttttaaggtttggccgtgatttagaactctgtgacagactgtga

SEQ ID NO: 42237 - DNA, 465 bp, Glycine max
  Peptide Sequence Number=SeqID_159015
atggccaacaatcataacactattgttgagattgatgctactagagaaaactggaaaatatgtgttagggttgttcgtttgtggttggttcctgatttcaaaaataaaaaactatcacactccttggagatgggagatagaatccacgccattgcgaagaggacactgatttacaattttcaaaatgaaatcaagaaaggaaaatgttattccttccatctgatgggtgttgcttctaatactggtggtttcaagactaaccaccatccttacaaactcatatttcaatttagcaccaaggtcatattgttagatgatggtgtagtccaaaacattgtgtatgatttggtgcctatttctacaatcatggatggtgatcttgatgttgattatttagtggcaaagaaattagagagagaacgaaaaggatggcaagaagaccaagatgaatgtgattcaacttga

SEQ ID NO: 42238 - DNA, 733 bp, Glycine max
  Peptide Sequence Number=SeqID_159016
atggctcagtataataccatcaagggaaaatacccggatgctcttttattattcagagtgggagatttttatgagacttttggacaggatgcaatccgtgcttctcaggtgcttggaattgtgcttaccaaaagagcgaacggagaaggtcatattgaactggcaggatttccacaccactcagtagattcttatctgcctaagctagttcgtgcaggacttagagtggctatctgcgatcagctggaagatcctaaaatggtaaaaggtattgtaaaaagaggagtgacagaactggtaaccccgggagttacttttaatgatcaggtacttagctccaagaagaacaatttcttgctttcaatccataaagaaaaggaaaagtttggaatcgcactggttgatatctctaccggagaatttttggtaagtgagggaactctcgaaaagcttttgcatatcgtaagcactttcgatcccagcgaaattatctatcagagaagtgttcagatccctgaacagttgaaaaataaaagtgctttcaaactggaagattgggcttttcaatacaattttgcatatgagaagttaacggggcagttcaaaaccaattcattaaagggatttggtatagaaaatctctccctggcaattacagcggcaggagctatatttgcgtaccttgtagaagatactcatcataacttacttgcccacatcactaaaaatcaag

SEQ ID NO: 42239 - DNA, 575 bp, Glycine max
  Peptide Sequence Number=SeqID_159017
atgggtcctccaagcttctccatgatcagaaggctccttagccacccaaatctccaagacctttctactgctgccaccatgggattactctcccggtgcttctctgggactaccagtatctcatgcccttatccttccagaatccctctcgatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 42240 - DNA, 944 bp, Glycine max
  Peptide Sequence Number=SeqID_159018
atggctaaggattgcaatgtgacactaaatatgaagccaacagttaagacggtaaagttgaacaaggttagagttaagaacaagtacctgttgcctaggatagctgaccttatggatcaattgaaaggtgttctagtcttttcaaagatagatttgagctcgggctatcaccaaataagagtgagagataatgatatatctaagactgctttccaaactaggtatggacattatgagtatgttttgatgccttttgaaatgcaacataggaaagtagtggcttatgctttaaggaagttgaaggttcatgaaaggaattatccgatgcatgaccacctagagttccctccaatagtgtttgcattcaaaatatatagacactatttgtatggagcaaggtttgatctgtttagtgttcacaagattcttaagtatttgtttgatcaaaaagagttgaacatgaaacaaagacgatggttagagtttattaagggttatgattttcaattgatgtatcacccaggtaaggctaatgtagctattgatgctcttagtaggaagatgattcatatgtctagtttgatggtcaaggagctagaattaatagagaaatttagagatttgaatctatatgtaatcagaggatccaattgtcttagatgtggcatgattaaagtgaataacaattttctagatatgattaaggagaaacaattgttagatcatcatctttgtaggaatgtatacacacctaagggtcaagagttggagaagatgattctaaatgaaggtgataagacaaaagtagaacatatgaggccaggaggtatgttacaaccattagaagttcccaaatggaaatgggaaagtatctccatggactttgtagttaggttacctaagacaacaaggaactttgatgctatattggttattgttgatag

SEQ ID NO: 42241 - DNA, 1137 bp, Glycine max
  Peptide Sequence Number=SeqID_159019
atgaattgctcgccgagcaagttcggcagcatagacgccggttgcaccctgtacgtagttgccgttgatggtcagcgtgccgatcgaattgccgggcgcgatgatgccgtcgacgtgggtgctgccgagcgtaccgacacccttcagcaggccgttggcaccgaccgtggtggtgccgccggtctgcgtaccgttgaaggacaccacgccaccgttgacggtcaggttgctgtccttcagcaggccgctgctgctgaccgtgctcacgcccccggtggtgttcagcgcggtggagaccaggctgccattgagcaggaactggccaccctggacctcgaccgcagacgtgagcgtgttggcgccattcaattccagcgtaccgtcctgcagtaccgcgccgttgaaagtgttgtcaccgctcaggcgcagccagccgatgccggacttggtcagcttgccggggccaccgatgtcgttggtccagtcgtcccaggcatcgccttcccagaccttcaggccaccggccttctggttcatcaccacgttggtatccacgcgcagcgagccgtagccttcgatggccttgcgcaggtcgaccatgccccagccgtagatcggatcgatgcctgctgcacccaggtcgcgtgcggtggtcagcaacacgtcgcggacctgggcgttgtccagataggggaagcgctccatcagcaggccgagcgcaccggtgatgtgtggcgccgccatcgacgtgcccgtcttggtgccatagacgtactgggtgttctcgctgtcgatgatcaggcggacataggcggaagtgttctcgacgcgaccctggatatcaccggacacaatggtgctcaggatgtcggtgccgggtgccgagatgcaccagttggcggcaacgccgcagatgctggaactgccatcgatcacgtagtcggtttcgcccgcagcagcgttgggccggcggacgttggccacggccagccagtacggttcaagttccggcttccagcgcggcatggcggccgtgattccggcgacggcgccactgccgttaccagccgaccacacctggatgagggtggaggagggggcatcgccatcgttggcgtagatgctgccatacacgcc

SEQ ID NO: 42242 - DNA, 453 bp, Glycine max
  Peptide Sequence Number=SeqID_159020
atgagcacccagtccaccatcgaacatcgcctcaacgacctgatcgagattgcgcgggacggaaagtcgttctacgaagaagctgcgaccaaggtgaaggatgccgaactgtcggccctgttcacccgcattgccggcgtcaagggccgcatcgtcgccgcgttgagcagttcggtcgccgccagcggcggcaagcccgccgagcacggcaccatggtcgggtcgatgcagcagttctacggcaaggtgcgcgctgcattcggcgacaccaactatggttacgtggccgagctggaagagtcggaagaccggctgcttggcgcgttcaaggacgtgctgaaggacaacgaactgccgccggccgtgcgccaggaagttacccagctgctgcccgaagtgcaggaatgccacaacgtgatgcgggcgcgcaagcacgccatgaaggcggcctga

SEQ ID NO: 42243 - DNA, 816 bp, Glycine max
  Peptide Sequence Number=SeqID_159021
atgggtgaagtagaggaggtgcaagagcaaatgaaggccgacacggaggccttgaaagagaaaatggccacaatgatggaggtcatgatgaccataatggaggtcagtgcggcctaccaaacccatgctagagctagagtaatgggtgaagtagaggaggtgcaagagcagataaaggccgacatggaagagaaaatggccacgatggtggaggccatgatgagcatgaagaagataatggaagccaatacggttgcagttgccgctaccagtgctgttgctaaggtgaaccagatgcccccatctgatctcaaaccaaatgaatcatccaacctcagatatggtgggcaaagatttgggaagtacggacgaccccatgatgtgcaaattcgaaacaagcacgccttcccgccatatggctcgcctcccaaggaggatgtcaataactccgctcccatactcattgaaagccaacaacctcaagttgatcatgcacatgtctctcaacccatgggggagacacatgaaattccccaccacaatctagccgacttcgagccttgcctcggatatgccactggagggcaagcagttggtggtatacccatgccaaacactttggagggccctcagtatcacccacaaccacaccccttgcattccacagcgattaaaaaccttcatgctatgacggaaatgggaaagttggatcatatagaggaaaggctcaaggacattgaaggaggcgaagattgtgcctttgctaacctagaagagttgttcccagtacccgacatggtcattcccaagttcaag

SEQ ID NO: 42244 - DNA, 394 bp, Glycine max
  Peptide Sequence Number=SeqID_159022
tgatcttccgtcacagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatggccgtcttggtgaccgacatggctggcgtgccctgcacggtggtcgatgccgttgcgctgttgttgcccgttgagggttccgccaccgtggtatcggtggtggccaactgcacggtcgcg

SEQ ID NO: 42245 - DNA, 455 bp, Glycine max
  Peptide Sequence Number=SeqID_159023
tctccaccggaagacgcctatatctctggggaaggtgcagatgacgactctcgacctgaagatgcctatatctctggggaaggtgcagatgacaacgttcgtcactacatactgttaggctttaagtctgaccgatcgcaaatgagactttttcgcagtctttgtcgaaagacgcagacatcgcaagggaagtctcaactggaagacgcctatatctccgggaaaggtgcagatgacgactctcggccagaagacactgacatctccagaaaaggtacacatgacgacattagtcgctgcatgctaccgaacttggagtctgatggatcgcaactgagactttgtcgcagtcacggccgtaggacgttgacatctccaggaaagtctcggctggaagacgctgacatctccgggaaaggtgcaaatgacgacgttagtcactacatgctatcaag

SEQ ID NO: 42246 - DNA, 654 bp, Glycine max
  Peptide Sequence Number=SeqID_159024
atgagactttttcagtctcaaccgaaagaggcctatatcatcggggaaggtgcagatgacgatgacactgacatctctaggaatgttgcacgtgacgatgttagtcactgcatgctatcgggctttgagtctaacggatcgcaaatgagacattgtcgcagtctcggccagaagatgctgaaatctccgggaaaggtgctggtgacgacattagtcatagcatgctatcgggctttaagtcttacggattgccaacgagacttttttgcactctcgaccggaagacgcctcatctctagggaagctgcagatgacaatgggcacatgacaaatgacaccctattacagtctcggccggaagacgctgacatctccaggaaaggtgcaaatgacgactgtcaaccggaagatgcctacatctccggggaagaagatgttgacatctccataaaaggtacagatgacgacgttagtcgctgcatgctaccggacatgaaatctgacggatcgcaaaagagacttcttcgcagtatcggctggaagacgctgacatctccgggaaagtctcaaccggaagacgcctatatctccggggaaggtgcagatgacgacgtgaatcactacatgctattgcgatttgagccttacggatag

SEQ ID NO: 42247 - DNA, 246 bp, Glycine max
  Peptide Sequence Number=SeqID_159025
atgactaacgttgtcatctgcaccttccccgaagatgtaggtgtcttccggttgagactgctaaaaagtctcatttgctatccatataggcgtcttccggtcgagactgtgaaaaagtctcatttgcgatcggtcagactgaaagcccgataccatccagtgactaacgttgtcatcttcaccttcctcagggatgtaggcatcttccgatcgagactgcaaaaacgtctcatttgctatccataa

SEQ ID NO: 42248 - DNA, 237 bp, Glycine max
  Peptide Sequence Number=SeqID_159026
atgacaacgttagtcatagcatgctatcgggcattgagtcttaccgataggaaatcagatattttcgcagtctcagccgaaagacacagacatctccggaagacgttgacatctccagaaaaggtcgcaaatgagactttttcgcagtatcggctagaagacgctgacatctccgggaaaggtgcaaatgacgacgttagtcactacatgctatcaagcttggagtcttacggatag

SEQ ID NO: 42249 - DNA, 886 bp, Glycine max
  Peptide Sequence Number=SeqID_159027
agctgtagctatgagtgcgacagaaggtctaatgagaggaatggaagtgattgacacaggagctgccctaagaataaaagtagtagatcttttagctccttatcgtcgtggaggaaaaataggacttttcggtggagctggagtgggtaaaacggtactgattatggaattgatcaataacattgccaaagctcatggaggtgtatctgtatttggcggagtaggtgaacgtactcgtgagggaaatgatctttatatggaaatgaaagaatctggaatgtcaatgaacaagatgtacttctatttatcgacaatatctttcgcttcgtccaaagcaggatctgaagtatctgccttattgggtcgaatgccttctgctgtgggttatcaagccactcttagtactgaaatgggttctttaccagaaagaatcacttctaccaaagagggaggattagcggccaaaggtatctatccagcagtagatcctttagattcaacctcaactatgctccaacctcgaatcgttggtgaagaacattatgagactgcgcaaagagttaaacaaactttacaacgttacaaagaacttcaagacattatagctatccttggcttggacgaattatccgaagaagatcgcttaaccgtagcaagagcacgaaaaattgagcgtttcttatcacaaccttttttcgtagcagaagtttttaccggttcgccggggaaatatgttagtctagcagaaacaattagagggtttaaattgattctttctggagaattagatggtcttcctgaacaagccttttatttggtaggtaatatcgatgaagctactgcgaaagctacgaacttagaaatggagagcaatttgaagaaatga

SEQ ID NO: 42250 - DNA, 574 bp, Glycine max
  Peptide Sequence Number=SeqID_159028
acctcagatgaatggcgcagttgaagctgcaaacaagaatatcaagaagatagtgcagaagatggtggtcacatacaaagactggcatgagatgctaccgtatgctttgcatgggtatcgtacttcagtgcgtacttcaacaggggcaacccccttctctttggtgtatggtatggaagcagtactccctgtggaggttgagattccatcgatgagagttctaatggaggcccagttatcagaagctgaatggtgccaaagcagatatgatcagttgaatctaattgaagaaaaacgcatgaaagccttgtgccacggacaactttatcaacagaggatgaagcaagctttcaacaagaaggttcgtcctcgtgtgtttcaagaaggagatcttgtgctcaagaaggttttatctttccaacccgattctaggggcaagtggacgcctaattacgaaggcccatatgtcgtcaagagagctttctctggtggtgcactgactcttacgactatggatggggatgagctccctcgtcccgtgaatgcggatgcagtcaagaaatactttgtctaa

SEQ ID NO: 42251 - DNA, 540 bp, Glycine max
  Peptide Sequence Number=SeqID_159029
ctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccaggaacttcttgttcgcatccaaggatgagagctcaaagctgaaggccatagactttgggttgtcagattttgttaaactagatgaaagacttaatgatattgttggcagtgcatactacgtggctcccgaagttctatcaagcttatcgataccgtcgacctcgagggggggcccggtaccagcttttgttccctttagtgaggtcgggaaacctgtcgtgccagctgcattaatgaatcggccaacgcgcggggagaggcggtttgcgtattgggcgctagcggagtgtatactggcttactatgttggcactgatgagg

SEQ ID NO: 42252 - DNA, 393 bp, Glycine max
  Peptide Sequence Number=SeqID_159030
atggttgtgattgatgtcttccattatgaattagtgtatgaaactaaggtgtcttttgttaatcctgatggctcaggaaatttgaatccaaggcctccttttaagatcaagcttccccgaacactcaaaccaaacaatggtgctcttactgggcatgcaatatctaattctggtgcaacaaatgaaatcaatgtggttgatgctaattatcagaaagaagcactaattattgagacatatactcctccagatcctggcccctatcctcaagatcagcctaaacaaaattcagttcgatttactcccacccagttgaggagagcaaggaaaaaagcacttggttcacacattttaaaaaattttgaggccttcctgttcttcctttctctctag

SEQ ID NO: 42253 - DNA, 615 bp, Glycine max
  Peptide Sequence Number=SeqID_159031
atggcgcactttgactccccctttgtctctccatgtcttcaccggcatcctcctctctgtcgtcaccgagatccacaacacgcggtggttctggaggcactccaaaactcccttacagtggctcctcggcacgcgcccttcgtgggattggagcaacatgagcagagacagctggagttccatgaggagccgaatgatttatgtcaattgtcagatttaaagtcagatgattctagagtggagttgtctgcggaagctgcgctacaggcaaagccaaaaagactagataaatatgtgaaacaaacctcaaaatttgttggagaagagggtgcttcccgtaatattggaggtcacacaaacaatgatgatttagggaaaattgttgatatgtcagatttccaggaaagcgaagatgctgattggaccaggacacgagatttgattaagactggagatagagaagatgtggaactagtaagctgcaataccaaagggttcattgtttcttttggttccttggcaggatttctgccataccataatcttgcttccaagtggaagttcttagcttctgagtcatggttaaaacagaagggcttagatccatcaatataa

SEQ ID NO: 42254 - DNA, 204 bp, Glycine max
  Peptide Sequence Number=SeqID_159032
atggaagagatggagcgcgtggtgctggcagtgcttggagaggaaggtgatgagggtgttaaagaccgtactaaattagttggcgcatggtattctaagacggttatgataaaaccgccatcgaagacctcattctggagtgcttatatttataataatgccactgtactgctttctaagacggttttctcacgaccgtcgtag

SEQ ID NO: 42255 - DNA, 465 bp, Glycine max
  Peptide Sequence Number=SeqID_159033
atgctcacaaagaagggagtggaaggtggaagagcaatatctgatgaagatagagatagagttccactctggaagacacctctaacgaaatattacacacaccaagcaaatgaggctaactggaaagactctgcaatgaggaaacgaaactttcactgggatgagttcctgcattgcacgagttgcaggaaggagtgcaggttccatctcaagagcatactagacattaagaactaccatgaagctttggacaacaaatcctggacttgttctctttggccttaccaaaaaataatctgcgatgatgatgaagagagaccaagtatgagagtaagcaggggctgttctcgttcttcaacttgccaaggctgctcaacttgttactgcgaagggtgcatcaagttccgctttgaggattgcaattgccaagaatgcatagactttatgctttatgctgaaccttaa

SEQ ID NO: 42256 - DNA, 183 bp, Glycine max
  Peptide Sequence Number=SeqID_159034
atgaacaaagcacggttacttcaattcatcgtcttcgttgacattggagttgtggtgttccattgtccatgctggtggcgagagcatagagtgggaactaggacagcgagagcaaaaagtgggataaaggtattgccggtggtgatggtggcagtgagagtgggagaacaagattttgattag

SEQ ID NO: 42257 - DNA, 516 bp, Glycine max
  Peptide Sequence Number=SeqID_159035
atggcttcttcttctcttctcccttctcgtcactcccctcaattcacccgtgagttccttctttcattctcttattataatgagcgtgaatttgacgagttgagtagccaagacagaataagccactccagaagcaccccaaacccccaccctccaacccccattgtccacaagcacactaaatccaagaaaaagagatcagatttcgagaaagatggctttgtctcttgcaacaagtgtagaccacactcctgcgacaaaatcttcatccttcccttggatcccataattatggctagtgggtatcttgtttatttgctctctactatctttcttccctttattttatatgctctgttgcttcacaaatttgtcatgaaaaaggagttctggaggatggcaaaggcagtgcaaaatcagtattttaatgaagttagacaattggaagcagagagattcaaggcgcttcgcatccagtgggcacaatattatctaaaagttagaaatcaaacatag

SEQ ID NO: 42258 - DNA, 147 bp, Glycine max
  Peptide Sequence Number=SeqID_159036
atggagaattggcgaacagcgctacgcaataacttcgcggggctccagactcgaagagaatggagaattggcggacagcgctacgcaataacttcgcggggctccagactcgaaggtggaggacacatgaacagcgctaggcaatga

SEQ ID NO: 42259 - DNA, 813 bp, Glycine max
  Peptide Sequence Number=SeqID_159037
atggacttgctctacgacatgaagtcgctgccggagcacctgatcgtcttcggctccggagtgacgggcgcggaattcgcgtcggcctacatgaacctgggcgcgaaggtcactcttgtctccagtcgggatcaggtgctccccggtgaggacaaggacgcggcgagcgtgctggagaaggtcttcaagcgcggcgggatgcaggtgctctccaagtcacgcgccgacaaggtcgaagtcacgaaggacggcgtgaccgtaaccctctccgacggccgaacggtcgacggcagtcactgtctgatggccgtcggctccatcccgaacacggcagggatcggcctcgaggaagccggcgtcgagcttgacgactcgggccacgtgcgggtgaacaaggtcgcccgcacgtccgtgccgaacgtgtacgcggtcggagactgcacgaacttcttcccgctcgcctccgtcgcgtccatgcaaggtcgcacggcggtgttccacgccttgggtgacatcgtgatcccgctggagctgatcaagatcacgtcgaacatcttcactgcgccggagatcgcgaccgtcggctacggggtcaaggacgtcgaggacggcgtctccgacggcatggtctacaagctcccgctcgcggcgaacccgcgggcgaagatgatgggcatcaaggacggcttcgtcaagctcatcgcgcgcaagggttccggcaccgtgatcggcggcgtgatcgtggccccgaaggcgtccgagctcatctacccgatcgccgtcgccgtggagcgtcggctcacggtcgaccag

SEQ ID NO: 42260 - DNA, 285 bp, Glycine max
  Peptide Sequence Number=SeqID_159038
gcccttccaaaatattttcgaagcagggttgcttatggaggaagcaacccagctcgcctgggcgagctgggcggaaacctcctcccccattttcctataaataggcgaagggaggttgttccgaatatccctaacccccttggctatgcatttcagctgttttgggtgaaaaaaattatttccgtgaagaaaatccaagtcgaggtgcttccgagacgtttctgtgagaaaatccgtgaaggttttccgtcgttcttcattcgttcttcgttcttcaatgggtaa

SEQ ID NO: 42261 - DNA, 237 bp, Glycine max
  Peptide Sequence Number=SeqID_159039
atggtccatgttgcgacagatggcgactccattgggaacgctggcctcggaataattaagaagggggttgaattaattattaatgagttcagggctgaggttgcatggcccgaagattggcctgagacccaggcaggggaggcgcctgcagaggctcccggtgatgtagaggaggcccgcatggatgaggagatgacatatttactcagtttcttgggagggagtggagccacgtga

SEQ ID NO: 42262 - DNA, 681 bp, Glycine max
  Peptide Sequence Number=SeqID_159040
atgggtgaagtagaagaggtacaagagcggatgaaggccgacatggaggccatgaaagagcaaatggacacaatgatggaggccatgatgagcatgaagaagataatggaagtctatgcggctgtagtttccgctaccagcaccgttgctgtggtggaccggaatcccctatctggcctcaaccaaataaatcctctagccttggatatgatagctcaaggaggcaaagagttaggaagtacgggtggcccccattttgtgccaattcagaacaagcatgtcttcccgccatatggcttgcctcccaactatacaccacccaatgtggcgcacactcccgatgagaattttctcccacaaccacaacccttgcattttgcactggggagagtccttcttgctttggcagaaaagggaaaattggatcatatagaggaaaggctcagggccattgaaggaggcagagatcatgcttttgctaacatgactgagttatacctagtgcctgacatagtcatccttctgaagttcatggtaccggatttcgataagtacaaggggaccacttgccccaagaatcatctgaaaatgtactatcagaagatgggggtgtacgtgaaagatgaaaaactgttgatgcatttcttccaagaaagtcttactggggcagctgtcacctga

SEQ ID NO: 42263 - DNA, 588 bp, Glycine max
  Peptide Sequence Number=SeqID_159041
atgtgttgccccctgtgtcagaaaggagtgaacatgcaggactttttacagcaaaccctgtcaggcaggccgcccgcgcagcggcagggcagtaacgcccacctgcactggcagtggcatgatgagggcatactatccctgacaccgcatacgcccacgcagcaggcgctggtcctctccgccgggattcacggcaacgagaccgccccggtggagatcctcaacctgttgctgacgccgctgctgcagggggaaaaaccgctggccgtgcgcctgctggtgatcctcggcaacccggcggcgctgcgcagcggcaaacgctaccagcattatgatatcaaccggctgttcggtggacgctggcaacaggtggccgacgtgccggaggcgcagcgcgcgctccagctggagcaggcgctggagaacttctggtgcgagtgcctcgatcacgaaattcgctggcatctcgatttgcacaccgcgattcgcggttcgtggcatacgcgctttggcgtgatgccgctcaacagccagccgtggccagcagattttttacactggctggcagcggccgaactggaagcgctg

SEQ ID NO: 42264 - DNA, 315 bp, Glycine max
  Peptide Sequence Number=SeqID_159042
atggcaaggacgtgtagtcctctgaagatgagtgcgtggagccgtctgatggcaaggacgtgtaatcctctgaaggtgagggagtacagccctctgatggcgaggacgtacagccctctgatggcaaggacgtgtagtcctctgaaagtgagggcgtgcaaccctttgattgtgaagacgtgtagtcctttaaaggtgggggcatgcaggcctctgatggcaaggacgtgtagtcctataaaggcgaggatgtctagtcctctgaaggtgagcgcgtgcagccctttgatggcaaggacctgtactcctctttag

SEQ ID NO: 42265 - DNA, 213 bp, Glycine max
  Peptide Sequence Number=SeqID_159043
atggtgaacgacattttaacactatctaggcacaaggaaaacatggtgcagcccaaaccaagtgctggccttaaggggaaaccttaccaacatgctctcactcatcatgctttcttgtatttcaaaaaacaaaagcttgggccccctaggcctaagtcatgttttggcatttatcctaattctcgcaagctggccgcatccaaaaaatggtaa

SEQ ID NO: 42266 - DNA, 408 bp, Glycine max
  Peptide Sequence Number=SeqID_159044
cctcgtgctaagccgagtctacctgagctaagcgcatttcatcacggaaactactgggctaagcgagcttggctccagcgaagtcgatatatggcatcgagaaaaagagctagaacggaggacatcccttcatcatccactccagctcctctgtcagtaaccgtaggacaggatcaagtagcctgtcctgaagctcaacttccattggtgagacccaacgagactgctctgcctgagcccacacctgtgcaggttgatccagagccaactgacccacaatctctagtggtgaatccactatcttctcctgagtgtgaagtagttcccccatctccacctctgattatcatctttgatgcatcatcagatgagcggctgcccctcctaattcaccagccggagaaatag

SEQ ID NO: 42267 - DNA, 573 bp, Glycine max
  Peptide Sequence Number=SeqID_159045
atgtttggcgttcacgcgctgctgctgtcgatcaacggtatcaacccgctgcgcttcttccgtaaagtctggccggtgattacctttgccttcaccagccgttccagcgccgccagtattccgctgaacgtggagacgcagacgcgtcgtctgggcgtaccggaatccatcgccagcttctcggcctcatttggcgcgaccatcggccagaacggctgtgccggcctctatcccaccatgctggcggtcatggtagcgccgaccgtgggtatcaacccgtttgacccggtatggatcgccacgctggtcggtattgtcacgctgagctcagccggtgtggcgggcgtcggtggcggcgcgaccttcgccgcgctgatcgtcctgccggcgatgggactgccggtcacgctggtggcattgctgatctccatcgaaccgctgattgatatgggccgtaccgcgctcaacgttaacggctcgatgaccgccggttcactgaccagccgctggctgggtatgaccgacaaaaaagtgctggagagcgacgaacacgcggaactggcgcaccgctaa

SEQ ID NO: 42268 - DNA, 857 bp, Glycine max
  Peptide Sequence Number=SeqID_159046
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggaattcgattggcgccggcgttgcgtagcacggcggcaaattcgggggtgagccactctgggtcacgcacctccacggcaatcaccccatcgggtgcacggctggccaggggcggcagggcctgtagatcaagcttatcgataccgtcgacctcgagggggggcccggtaccagcttttgttccctttagtgaggtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 42269 - DNA, 443 bp, Glycine max
  Peptide Sequence Number=SeqID_159047
caatcactacgcatagctccaaactcgaaggtggaggacacatgaacgaaaacgcaattcatggggctccgaaaagtttgagaatggagaattgcactaagcaatcactacgcatcgctccaaactcgaagggtgagaatggagaattgcacttagcaatccctacgcatagctccaaactcgaatgtggaagacagatgaacgaaaacgcaattcatgggactccgaaaagattgagaatggagaattgcactaagcaatcactacgcatagctccaaactcgaagattgagaatggagaattgcacttagcaatcgctacgcatagctccaaactcgaatgtggaagacagatgaacgaaaacgcaattcatggggctccgaaaagattgagaatcgagaattgcactaagcaatcactatgcatagctccaaactcgaag

SEQ ID NO: 42270 - DNA, 117 bp, Glycine max
  Peptide Sequence Number=SeqID_159048
atggccccctacaggatactaggctgccttgcagcgacgttttccgcttgtccagcgccgggaagggacgacgatctgtcggtcgtgaccccatcctccatttgcatccgtccctaa

SEQ ID NO: 42271 - DNA, 336 bp, Glycine max
  Peptide Sequence Number=SeqID_159049
atggctccaaaaaagctttccacgaagaggtctagaagagacaccgcagcggaagggtccaatgttgcccccgagtttgatagccaccgtttccggagcgtcgagcaccaacagcgcttcgaggccatcaaaggatggtcattccacagagagaggcgcgtccagctcagagaggatgagtatacggactttcaagaggagatagctcgcagacattggacgtcactggtgactcccatggctaagtttgacccagagatagtcttggagttctatgctaatgcttggcccacagaggagggagtgcgagacatgtattcatgggtgaggggttag

SEQ ID NO: 42272 - DNA, 252 bp, Glycine max
  Peptide Sequence Number=SeqID_159050
atgggagatttcatcagcagactctccttccccgaaaacaccgagactttttcaagtctcacaagttatccagaactacgtaggtctgagttcctcattgggggatacgtaggagcaagagcctcgcttttgtcgaccacaccgccttttgtcgccatgactcaagagctggtagcccgcggagataccttacggttattcgcacccttttgtcatccagaggcggcgggcccgatgacaagcagagaccaa

SEQ ID NO: 42273 - DNA, 363 bp, Glycine max
  Peptide Sequence Number=SeqID_159051
atggtggtagagatacgagtagagatgatggtggcgatagtgatgatgtcaatggtgacatttgtggtagtgatggaggtggtagcagtgatgggggtagtggtggtagcggtgacaatgttggtagtggttgtggcagtaacattggtggcgatggccataataggtgatattagtggtggttgtagtagtattgttggtggtgatagtagtggaagtgatggtggtagtagcggtaatggtaatgatagcggtgatagaagtggtattgattgtggtagtagtaataacgatcacaatgacattaacagtagtggtagtggtggtgatgaggtggtgatagtagtattgtcaaagatgatg

SEQ ID NO: 42274 - DNA, 399 bp, Glycine max
  Peptide Sequence Number=SeqID_159052
atgcgccatccactagggaataagccatggaagaaggagcttcaccaccaagatgagccttggataagaagcttggagatgatgcttcaatggaggaaaagaaagagggagagaaagagagaggggggagcacgaaagaaaggcctttcattggaagtgtgttggggggtaggattgcatcagctgcgcacatcacatatgaaaacttgttttttttgcgttgtgactattcatgaccctgttccgcatcacgcatcgacctcacacagattattaagatctacattaatgtggcattgttccgcatcatgcaccgagcctatgcgaattattgagatccgcattaatgcggttgttaatgcatcttctgctccatctctgcctagcttaggtcattaa

SEQ ID NO: 42275 - DNA, 399 bp, Glycine max
  Peptide Sequence Number=SeqID_159053
atgggacatccgagtaaaacgttattgtcatttgaatttgctcagagcttctgttttcaattgggagcgtctcgatatattacgggactcagtcggacatccgagttaaaagttattgcggtttgcatttgctacgagcatccgttttcaatttcgagcgtctcgatatataacgggactcaatcagaaatccgagtaaaaagttattgtcgtttgaatttgatacgagcttccgttttcaatttggagcgtctcgatatattacgggacgcaatcgaacatccgagtaaaatgttattgtcgttggaatttgatacgagcttccgatttcaatttggagcgtctcgatatattacgggactcgattggacatccgagaaaaaagttattgtcgtttga

SEQ ID NO: 42276 - DNA, 680 bp, Glycine max
  Peptide Sequence Number=SeqID_159054
atggcaggcagcgacgcgctggctgtctcggtcaagttggatctttccgatctcccgtttttgcttgatcaatacaggagacttttcgaagccgaactaaacgcagaggactatcaatgggtcaacaacatctcgacaaccaagagtgcagcggtcataagcgtcctcgagaacgcgctcgaagcaaaaatggccgcaggccaattcgacggcatctggctgtcgattccggaaatcatcgaatggacgatggtcaagggattcatgtactcaccctacggcggcggcattcttcatcctgacatcaatatggaagggtttcgcggcactgtcgatggacccatcactcttgaggtcctgcgtgcgcgccatgttcattgcgccgacgcggaccataagaaggttttcaagtcatggtcagtattcaaatgcctctatgctgagatcgaactcaacggtgtcacacatgtcctgaacgacggcaagtggttcagtatcgccaaggatttcgtcgaacggacgaaccacgactatgcggcgatcccaccgtcgaatatcaagctgcccgaataccaggggggcggagaaggggcgtataacgcacaggtagcagcgctcgaaccggcgatctacgacttgctcgatgacaagaagaaagttatgcacggcggcggtcatgg

SEQ ID NO: 42277 - DNA, 234 bp, Glycine max
  Peptide Sequence Number=SeqID_159055
gccggagtttttagcagtggatttccgacagtttctgatcctgtggaggcatacacttaccctgaatatttgaaatctggatggaacttgaataatatactttcactctcaggatcccttctttgttttgaaagctctgaagcttcacgaaaatttgctattaactttgaaacaatttggaagaagtatctccctgatttgcaagcaggacagcctgatatgcatgataatatg

SEQ ID NO: 42278 - DNA, 351 bp, Glycine max
  Peptide Sequence Number=SeqID_159056
atgtgtatttcaccttacacttgtactccaacacatctccccctcaagtgtgagtttcttccacatgatagtcttcccctcgagcagaagtcattatcattcacgagtatagtcattttggccacttgcggtacttgcaccaccactctatctgtggagcacgctaccattctggccacctgcggtacttgcaccaccgctaaatctgcgggacatgctgcaccgctatcttactcgtttgagccggttaccaagttaaccattgactttgatacgaattgttggggagattcgagggtacacctgtggactatgaggtaccacataaggagacctgacactatactctaa

SEQ ID NO: 42279 - DNA, 237 bp, Glycine max
  Peptide Sequence Number=SeqID_159057
atgggggggggggggggggagggcacaaaagtcggacaaggagaggaactagaggaggacatggtagagaaggaagtcagcgaggacggccagggagtggtgatggtgggagaagtagtcgtcggaggcaaggtaggcgttggggacgatgagaatggagaaaggggagtagtccaagagatcgatggcgaggggtgtgatggagacaaggagggagatgaattgggagagttctga

SEQ ID NO: 42280 - DNA, 559 bp, Glycine max
  Peptide Sequence Number=SeqID_159058
atggattcaaatattcaagactttatagacacatgtaactctgacaacacctgcaatctcatcaccaatagcaccaccaccaacttaaccgcagctagtgctgcctcttcctctcctgcttccacctccatcaccagcagcagccgctacgagaaccagaagcgccgtgactggaacaccttcggtcaatacctcaagaaccaccgtccccctctctccctctccaggtacctggatcaatttgggaagaccaaagtgcacacaccgatctgccccttttacgggcacccgaaccctccggcgccatgtccatgtcctcttaggcaagcttgggggagccttgacgcactcatagggcgtttgcgtgcagcttttgaggagaatggagggaagcctgaggcaaacccttttggagcacgagctgtgagactctaccttcgtgaggttcgtgatctgcagtccaaagccagaggaattagctatgagaagaagaaaaggaagcgtccaccacctcagcaacaacccatgccaataccccatcaccctcttcctcctccag

SEQ ID NO: 42281 - DNA, 150 bp, Glycine max
  Peptide Sequence Number=SeqID_159059
atggtggggacggcggcgcaaggtgtccccagtgcgaagtatgacgatggagatccagacttggcggaagagggaaagggatttgggagtcgcgggagaagcaatttctggcggtttaggccgtcagaaatgaatgccgcaaagtattaa

SEQ ID NO: 42282 - DNA, 2448 bp, Glycine max
  Peptide Sequence Number=SeqID_159060
atgactgcttacaagggtttcctactcatgcacaaaggtttatgtgtttgtttgttatttggtctaactgaagcaggtcaaataaatacatcttcagtgaaatgtcttgtcaacagcatttctcgattcatgcatctagtttgttgtcaagcagtgaaacctatgccccttcagaagaactgtaataatatggttggtgtgttaaagcggttgaaaccagtgctcgatgatattgtggatttcaaaatccctttggatgaaaatttgcatagagaatgtgaagaattggatatgcaggttcttcaaagtggggaattgttgatcaagttacagaactcttcatataagatttgtcacatgatagttaaatccctaaaggcacctgcatctgttttggttttgggtaatcttcaggaacttcagtgtcttaagaaggaacctgcaatggtctatatagaagaagcactgagaaatcaaagggacaatattgaaccttgctatgattctctaaaggaaattatagggttactcaaattgacgtcaaaccaggagctcctgaaagaaagtattgctgtggaaaaggaaaggtcaaatgctgaagtcaataaaacaaaagggaacctggatgaaattaaccaaattgtgaatcttgtgtgcaatttgcgtgattatgtgatgaaatttgagtgccctgaagtcaaaagtggtgtttcaattcccccatattttcgatgtcctttatcattagaactcatgtcagatcctgttattgtggcttcaggtcaaacatatgaaaggcaatccattcaaaagtggcttgatcatgggctaactgtttgtcccaacactcatcacagacttgtccatacaaatctcattcccaattatactgttaaagctatgatagcaaattggtgtgaggaaaataatgtcaaacttccctgtaactctaagcaaagtaattcaactcgtatttcatccccctcagatcatttattacatcaagatttagatcgtcagtgtagctttcagtcttcagatagtagcaattcctattcaaatcaaactgcaaatgcatttgagaagcaaaaggatgataactcttttggatcaggcaggggatcccatagaagccggaatggacagacagaaaagtttgagcaacaatcccctgcaccttcatgtagtaaccgcagaagtgaatcattttcaagttctatttctagtactgattatgtacttcctgtttcaaaagaggtgtcagtcatatccaataagcatcacaatgtggagttgtctggagagattactaatgggtgtcctgcttctcctgcatataaagaatcagtgatttatccttggttatctggaaagcaatttcatagccctggatcaaaaattggaaggatggaggatgaaaataagtatgagagtaacaataatattattactagtcattcaaaagttgcttcccatcctgtttccaacttaggatctgatgaattgatcaccacatcccatgtccatgagttgattgaagatctccagagtcaatcgaatgaaacacgaactgctgctgcagaacaattgaggttctgtaccaagcataacatggagaaccgcatcattgtagggcagtgtggggctattatgcctttactttcactgctatattcagacatgaagataacacaagagcatgctgtgacagctctactgaatttgtcaatcaatgaaggaaacaaggccttgattatggaagcaggggccatagaaccacttatccatcttttggagaaagggaatgatggtgcaaaggagaattctgctgctgctctgttcagcctctctgtaatagataacaataaggcaaaaattggccgttctggtgctgttaaagctttggtgggtcttctagcctcaggaactcttaggggaaagaaggatgctgccactgctttattcaacctatcaatattccatgagaataaagctcgtatagttcaagctggagccgtgaagtttctggttctgctattggatcctactgataaaatggttgacaaggctgttgctcttttggcaaacctgtcaacaattgcagagggccgaatagaaattgcaagggaagggggcattccctcacttgttgaaattgttgaatcaggttctcagaggggaaaggaaaatgctgcttccatcctcttgcaaatgtgtcttcatagtcaaaagttttgtaccctggttctccaagaaggagctgtacctcccctagttgcattatctcagtccggtactccaagagctaaggaaaagggttacagaatcagtttgttgaaagataaaaaaatcttgcattctaacatgctctccagtgcatttttcacccaaccatgccccccaaaaaacgaggaagttttgactctttttgtttggggtggttgttaa

SEQ ID NO: 42283 - DNA, 305 bp, Glycine max
  Peptide Sequence Number=SeqID_159061
ctacacatgagccggagcttggtggacatcaacgtgaagggctcgtcctaggaatcggtgttgtgagagtgcgacaagggttccacaaagtcggggaagctaaggtgcggcggtggagcagtcgagggggttggaacccaaacttttcgcctccaaagcgagctcgttatggtcgcatgccatcgtggggtgtgattacctcgacttctttagcgagccccaaaacgatcatcgagacgacacattcgtcatctttgcctgcggcttcttctccaaacttgtcacgcaccataactacaacctaa

SEQ ID NO: 42284 - DNA, 725 bp, Glycine max
  Peptide Sequence Number=SeqID_159062
atgcggagacaaaatttggtcattccgcacccctttgccattcagacacagtcgtgttcgatggcacgcagagacaaaatttggtcattctgcacccttttgtcatccagaggcggcgggcccgatgacacgcggagacaaaattttggtcattccgcacccctttgccattcagacacagttgtgtccgatgacacgcagagacaaaatttggtcattctgcaccctttgtcatccagaggcggcgggcccgatgacatgcggagacaaaatttggtcattctgcacccctttgccattcagacacagtcgtgtccgatggcgcgcagagacaaaaattggtcattctgcacccttttgtcatccagaggcggcgggcccgatgacatgcggagacaaaatttggtcattccgcacccctttgccattcagacacagccgtgtccgatggcgcgcagagacaaaaattggtcattctgcaccctttgtcatccagaggcggcgggcccgatgacatgcggagacaaaattggtcattccgcacccctttgccattcagacacagccgtgtccgatggcgcacagagacaaaaattggtcattctgcaccctttgtcatccagaggcggcgggcccgatgacatgcggagacaaaacttggtcattccgcacccctatgccattcagacacagccgtgtccgatggcgcgcagagacaaaaattg

SEQ ID NO: 42285 - DNA, 673 bp, Glycine max
  Peptide Sequence Number=SeqID_159063
atgttgcaagcaatgcatttgatggccaacaacgttgccggttacgatgttgcaagcaatgcagatgtggagtgtcagaaggtaggtttcttccgtgttcgggtgtttctagaagaacagcttctgcgttttcttgctcctctcaggcaaggaggacccctgaatctttttccaggcaaaacaagcattgattttccagaagcaggaagtggctcaatgaagagagagacagctttgagaacattgaagaagacatgttatcgtccaaaaatggttcaggctcgactaagaaaaagagctactattgaagaaataaagaaagttgaagcatcccaagcacagtctaaagacaatggttctgttgattctctcctcaagctacttaggaaacactcagttgagcaatatcagtctgtctctaatgatgataaagatgtgaaggcagtcccactgagtaatgtgattatagagaaagatcaggatcaattaggtgtaaagcttgatcctgagccagagcatgactctgaactggaacttgatccaaaggatgaactcttattccccgaagaccagcaagtggaacaacatcaggatttgagtacaatgaagctgtctcaactaagggcacttgcaaagtctaggggcctcaaagggttttcaaaaatgaagaagg

SEQ ID NO: 42286 - DNA, 828 bp, Glycine max
  Peptide Sequence Number=SeqID_159064
atgggatggctgtggtcatgcgtggaaagaccttggaaactgggagcaaaatggacaaataaacacattgcctctgatgaaaagatagaaacttttgaacttgactatgatggcaaacgggacagatggaatggttatgatgcatcaacttatgctcgagtcattgagaggtacgaagctcgaaagaagtacttaaaagaacagaagctgaagaagtcggagaagagcaaccaaaatgatgaggatgaagaggaagaaaatctaatgttagatgaggcgaaagttgatgagagcaaacaaatggaatttgcaaaggttgagaagcgtgtgagtacaacaggtggtaggagcacaggaactgaactgaatttatttttcttcaggaatcaacttattcgagaggatactgcaaaatatcctattaatgctgcggtcaattctgcacactgtgatcccaagaccaggttcacgcgtgaagatccacttccggatgcagatccaaatgaaaagttttatgggggagataaccaacatagaaatagtggggtagctttggaattcaatgaaatttacatcatgctcgggaagcatttgagaaaggacaagatgttcacatgcaagcagctccatccaaagctgaattttcactataagaatttcaagaccgagaaggagaaattgaagtctcaaatgaaggaaaccattatcgagaagtatatggcaatgcagctgatgaggacaaccctccaagagaacttctgcagggtcaaagcgaaatgcaagttgagtatgatcatgctggtagaattattaggggccaggcactga

SEQ ID NO: 42287 - DNA, 354 bp, Glycine max
  Peptide Sequence Number=SeqID_159065
atggggactattagcaaaatagtcatggataaccattcatggtgttatccagcctgtgttcaatgtcataggaaaactgacatccaaacaggaccattcacatgcggatgtgggaaggaaaataatcagcctgttctgaggtatagagttgaagtcatggttactcaaaacaataagagtagcaaatttttgctctgggaccgtgaatgtgctgaattgattggtgaaacagctgatgatgtgaatagggtcaagattgaagatggtgatcttgatttaaatgcttcccctcaagcacttgacaaattgttgggtcatgtgcttgcttttaaggtcaggattcaatcaaaataa

SEQ ID NO: 42288 - DNA, 215 bp, Glycine max
  Peptide Sequence Number=SeqID_159066
gggatggtgctcgcgagctcggtgatggtgtccgatatggtggacaacggcctgctggtggcgtaccggccggaggtgcgcgtaccgggcgccgcgtacagcgtgctgtgcgcgccggggcgcgagcggcatccgccggtcagggcgtttctcgcctggctgcagcaggaactgccgcagggcaatggcacgaaataaaagttttatcgtcctaa

SEQ ID NO: 42289 - DNA, 104 bp, Glycine max
  Peptide Sequence Number=SeqID_159067
caagggtggatatacgtcgatagtgggaatgaaatggagcatgaaacattccttgcaacttggttggcagagattgatttctctcccaatggcttggtgagcaa

SEQ ID NO: 42290 - DNA, 471 bp, Glycine max
  Peptide Sequence Number=SeqID_159068
atgtctttcagaggcctcagccgggcttttgacccagatgcgtttgaattccagccaaatgcctcatcaggcatgggtgttgctgatcacagcaagaacaccttcatggaattgaagcagaagaaggttcaccgttatctgatctttaaggttgatgagaagaaaagggaagttgtggttgagaagactggtgacccggctgagagctatgaggatttcgctgcatctttgcctgagaatgattgcagatatgctgtctttgactatgatttcgtcacttctgagaactgtcaaaagagcaaaatcttcttcattgcatggtccccttcaacgtctcgaatccgagccaagatgctctatgccactactaaagacaggtttagacgagagctagatggtgtccattatgaaattcaggctactgaccccacagaaatggatcttgaagtactgagagaccgtgcacattga

SEQ ID NO: 42291 - DNA, 274 bp, Glycine max
  Peptide Sequence Number=SeqID_159069
atggcaatgcttgatccaatcattttcgaacgtgtgccaatgtctcattcaatcctatttgcattgaaaacccatggactgaaaaagtgtctaatgatcttcacctatgcgtgtaaggtttgtccacaaagggaattctccaagagagaactcggtgaaatcaccgaaataagttggagtgaaactccgaacgccatttgggagcaagacaaagtccttcagttcttcgatgacgccgctgatgttgaagagagcgatttcaacgacgatgatg

SEQ ID NO: 42292 - DNA, 762 bp, Glycine max
  Peptide Sequence Number=SeqID_159070
atggatttagacttcgattccacttttttcttgaaccaaaaccttagcttcttctcagaaaactcctctgtttgtggagaccctttttcttgggacaacaactttgtcttggatgatatcttcaacttgagcgacaattcgtcacaatcacaaaccaaggaaacatcctcggcgtccaatgtttccagttctattggtagcgtcgagttacaagaagtctcatccaacacgacttatgaagaagtgaaagaaggacaatcagtatcattatcattgtcgtcatcatcatcgttgtcactaccgttgtcactaccgttgctgccttcgcaacaagcgaaggaacaaaggatgtacagaggagtgaggaagaggccgtgggggaaattcgcggccgagataagggattccactcgaaacggcgttcgagtgtggattggaacctttgacacagccgaagccgcagctctggcttacgaccaagccgcgttctccacgagagggtctctcgcggtgttgaatttcccagaggaagtggtgagtgagtccctcaaagacatgccaagtaagccatgggaagaaggttcctcccctgttttggctcttaagagaaaacacactatgaggagaaagtccaattctaagaagaagagcaagattgatcagagggaacaattagatttcagcagcagttcgcaaaatgtgctggtgttcgaggatttgggtgctgagtacctagaacagctcttgagtttgacttcttag

SEQ ID NO: 42293 - DNA, 201 bp, Glycine max
  Peptide Sequence Number=SeqID_159071
atgggtctgagagacattggtgcttcactgcctcctgggtttcggttttatccgagtgatgaggaattggtctgccattacctctacaaaaagatcgcaaatgaggaagttctgaagggtaccttggtcgaaattgacctccacatatgcgaaccttggcaacttcctgctattctgaattatacatcttctaaaggttga

SEQ ID NO: 42294 - DNA, 321 bp, Glycine max
  Peptide Sequence Number=SeqID_159072
atgtgttgtctggttgttgaggtggctaagctgaatgcgaatgagtggtacttcttcagtttccgggaccgcaaatatgcgacggggtttcggaccaaccgggcaactacatcggggtactggaaagcaacggggaaggatcgtacggtggtggatccagccacgcaagaagttgtagggatgaggaaaacactggtgttctacaggaacagagctccaaatggcatcaaaaccggttggatcatgcatgagttccgtttggagaccccacatatgcctccaaagctttgctcgtggggtacaacttgtttagttgtttga

SEQ ID NO: 42295 - DNA, 644 bp, Glycine max
  Peptide Sequence Number=SeqID_159073
gctcgaggaagtcatgaaccgcctaacccaagggcataacaacttaactcaggggcaaaataccttgacccagaaccatgtagccctggcccaagctcaatccctcacaaatagcaaaatagactccatcttggagcgactcgctgctctcacaatgattccctcctcgccgaaatcaccacccacttccccaccatcaacatcccctccatcacccttttggcctcatatgaagctcgacatcccacgattcgatggccaggatccactttggtggattttcaaaattacacagttcttcgactaccagaatggtttcctgacatcatggctagccatgctacaggccctcgaatcctgctttgcctcgtcgtattacgatgaccctcaaggagccatttttaaactccaacacctaggtacaattaatgattaccttagtgaattcgagaagctcgtgaatcgtgtcgccaaattagcccttcaattcttgctcagttgtttcatttctggattgaaccctgagctttgtagggaggtacaagccttccagccaatgtcgctttcgcaagcagttgctcttgaaaagttacaagaagacaaactcaacgataaacgccgtagccttcgctccttcactcacg

SEQ ID NO: 42296 - DNA, 150 bp, Glycine max
  Peptide Sequence Number=SeqID_159074
atgatgtaccttaaaattgtctacgttgagccctcccggagaggaaattggaagtactcgaacatgaatgaagctgaggctgctgagatggggtgtgaggtgaaggaagcaaattggaagatgcaggaagtaaaagcccacgctgaataa

SEQ ID NO: 42297 - DNA, 348 bp, Glycine max
  Peptide Sequence Number=SeqID_159075
atggcgagaagcctgctgagctggagggtgccgccagtggcacaggcgagatgcactccatcactgatctcgtcagttcttcctgcgagacacgagcccatgccgccagtacgaatggcgggacatgccaacatggacaatcccgtcattggctcctgcgagaccaaggtggccatgactcaggctaagctagggcacgttcttgttttggaggagactagggaactgttgttgcattggttagggcaatcagaagcatgcagcagagcacttgcaatgacactcagcacttgcaaaattttgacactgaagagagtaacaaatagtgtgaagagaggaagaaagtag

SEQ ID NO: 42298 - DNA, 104 bp, Glycine max
  Peptide Sequence Number=SeqID_159076
atggcgaaactgccccttgcaaacacgtggcagtggactcgccactgcaactggcgagaaaggcaaaccgtccctgctgatggcgagatagccatgcggcagta

SEQ ID NO: 42299 - DNA, 1539 bp, Glycine max
  Peptide Sequence Number=SeqID_159077
gtatttcatagagtggatgaaacagagaggcacaacaccaacaccactgtcggtgaaatatttagctccaaggactcagaggcacctctagccatgactatggtcgtgtggttgttgaagtcaagaaccaaaactgagaggtactactttggtcatattaccaagatgaataatgatgaaaacacagaaaaacatgaaagaggaggtgaaaaatataaagccgggattcaggttggaaacgcctgctgggagctttactgcctcgaacacggcattcagcctgatgggcagatgccaagtgacaagaccgttggtggaggtgatgatgctttcaacaccttcttcagtgaaactggggcaggaaagcacgtgccccgcgcgatttttgtagatcttgagcccactgtgattgatgaggttaggactgggacataccgccaactattccatcctgagcagctcattagtggaaaggaggatgcagcaaacaactttgcccgtggccactataccattggaaaggagattgttgagctttgcttggaccgcatcagaaagcttgctgacaactgcacaggtctccaaggttttctggttttcaatgctgtgggtgggggaactggctctggacttggttcccttttgctggaacgcctttcagtggactatggcaagaagtccaagcttggtttcactgtctatccttcaccccaagtttcgacctctgttgttgagccttacaacagtgtcctctccactcattctcttcttgagcacactgatgtggctgtcctgctcgacaatgaagccatttatgacatctgcaggcgttcactggacattgagaggccaacctacaccaaccttaatcgtttagtttctcaggtgatatcatcactgactgcttccctgaggtttgatggagccttgaatgttgatgtcaatgaattccagaccaaccttgtgccataccccaggattcattttatgctttcatcttatgctcctgtaatttcagccgagaaggctcaccatgagcagctatcagttggtgaaatcaccaacagtgcattcgagccatcatctatgatggccaagtgtgatccccgccatggcaaatacatggcgtgctgtctcatgtacagaggtgacgtagtgcctaaagatgttaatgcagctgttggaattatcaagaccaagcgcactattcaatttgttgactggtgccccaccgggttcaagtgtggaatcaattaccagcctccgactgttgttccaggtggtgatcttgccaaggttcagagggccgtgtgcatgatctccaattccaccagtgttgttgaggtcttctctcgcatcgaccacaaatttgacctcatgtatgccaagagggcgttcgttcattggtatgttggtgagggtatggaagagggggagttctctgaggcccgtgaagatcttgctgccctggagaaggattatgaggaagttggtgcagaggcaactgaagatggtgatgaaggagaggattatgattag

SEQ ID NO: 42300 - DNA, 104 bp, Glycine max
  Peptide Sequence Number=SeqID_159078
atggcaaaaccgtcccgtgcaaacacgtggcagtggactctccactgcagctggcgagaaaggcaaaccgccactgctgatggcgagatactcatgcaccagtg

SEQ ID NO: 42301 - DNA, 216 bp, Glycine max
  Peptide Sequence Number=SeqID_159079
atgaacccctgctacactgcgctgaatccctgctccttctgccctctagaacacgcctgtcctactagcggtaacaatgagcaaaaacgcaaggcccactggcggaatcagtgcaacctggatgcatgctgcatgggtcattggctggatggatggcatggatggatgacatgtgtatcccgccagtgccagcagccagaatctttatgttggtaa

SEQ ID NO: 42302 - DNA, 1101 bp, Glycine max
  Peptide Sequence Number=SeqID_159080
atgacccatgcagcatgcatccaggttgcactgattccgccagtgggccttgcgtttttgctcattgttaccgctagtaggacaggcgtgtatagggttagggttctagaacatacatgcaatgattccgccattggaaaaattgattaccaacgaaaagattctgctgctggcactgaagggatgcacatgccatccatccagccaatgatccatgcagcatgcatccatgtattgattcttccattgggaaaagcgattaccaaccaaaacattccggctgctggcactggcgggatacacatgccatccatccagccaatgacccatgtagcatgcatcaaggcagcatgcatccaggttgcactgattccgccagtgggcttggcgtttttgctcattgataccgccagtaggacaggcgtgttccagagggcagagggagcagggattcaacgcagtgtagcagggcgggatacacatgccatccatccagccaatgacccatgccgcatgcacccaagtactgatttcgccattgggaaaagcgatcaccaacctaaagattccggctgggtacatctacttgggttgttgactgagaacaagagagggtacatctcttgtggatcagttctagtggagggtacatccactaggttgttcaaagagaacaagggagggtacatcccttgcggatctttgcttgtaaaggaattttacaaggttgaaaagaaatctcaaggaccgcaggtcgcttggggattggatgtagccacaggcatgtaccagagggcagagggagcagggattcagcgcagtgtagcagagggttcagaacatacatgcactaattccgtcattggaaaaagtgattaccaaccaaaagattctgctgctggcactggcgggatacacatgtcatccatccagccaatgacccatgcagcatgcatccagccagtggcctatgcagcatgcatccagatactgattccaccattgggagaagcaattaccaaccaaaagattctagttgctggcattggtgggatacaaataccatccatccatgtcatccatccagccaatgacccataa

SEQ ID NO: 42303 - DNA, 348 bp, Glycine max
  Peptide Sequence Number=SeqID_159081
atgacccatgcagcatgcgtccaagttgtactgattctgcttgtgggcctggcgtttgtgctcattgataccgccagtaggacaaacgtgttccagaaggcagagggagcatggattcagcgcagtgtagcaggggttcctgcatgctgcatgctttgtagtttttttagggtttcaggtactgattccgccattgggaaaagtgattaccaaccaaaagattctgctgctggtactggcgggatacacatgtcatccatccatgccatccatccagccaatgacccatgcagcatgcatccaggttgcactgattccgccagtgagcctggtgtttttgctcattga

SEQ ID NO: 42304 - DNA, 234 bp, Glycine max
  Peptide Sequence Number=SeqID_159082
atggcttcttcttcgtcatgttcgtcaaatatttcaattaattctcgtctcgttgatggtgacgtgttgtggatgcaagataagcacatttcacagcatatttggaatggggaagaagatagaaaactgcatattagaagagttgtccccgtatatcaaggtcaagaagaaataccagaagagattattcctttacttcgtcaatctggtttttactggattatgaagatgtga

SEQ ID NO: 42305 - DNA, 294 bp, Glycine max
  Peptide Sequence Number=SeqID_159083
atggacactccattctcaaaaatcacccatgccacgatgagaaacaagaaaaatcggaaaaagagtgaacaaatgaacgagaaaaacaaatggaatgaaggagggtggtttgggatttctagatccgtgaaagggagtgtggtgttgtccgttgtcgtcgtcggcttggaaaggagcgtaattgcggtggaggtgttgtcgttgccatttgccatcgccgccgtggtggttgtggatgtattttcctcgttgggttgttgtgatggtgtcgctgccgttgactcttggtggtga

SEQ ID NO: 42306 - DNA, 264 bp, Glycine max
  Peptide Sequence Number=SeqID_159084
atgactgcaattaaggtagtatttcaacactcctcatgctcaaggctaccggcctggagcgtggcaaatgcaagtggcccagcaatagatctatgggactgttttcttataacaagtatctttgcttctaataaggagcgtacatgccactggctgactagtgaagaagaacagctcttgtgtatagtttatgagcattcaattagaaaagcttggatattatggggatcagttctcgaaggtcgaatcttcagtgatgactaa

SEQ ID NO: 42307 - DNA, 252 bp, Glycine max
  Peptide Sequence Number=SeqID_159085
atgacgtctcttgactctccgctacgctcacagaaatcgacccctttcagcgctaaggctcgcatgtgcaaattgtgtcgaaccttaaactttgcaccaacaccgaagcatagtgacgtgaaacacacgtcgttgaggtggagacttgtgagtgaggtggcaaggcgcaacgagggcgggaagaagggaggtgaaagggcgaggtctgggcagagcgcgacaacatcagagaggagcttgagcatgtggtga

SEQ ID NO: 42308 - DNA, 192 bp, Glycine max
  Peptide Sequence Number=SeqID_159086
atgaattctaaaaactgtaaaagacaatcgagaggggagaaagaggagagcacctggaacaacaggaagcaagatctggcagagagagtgggttttgagaagagaaatggccagaatttcatgcagccacaaaaatgtgactgcagagaattcccatctataattgtcagtgcgggaattgaagcggaataa

SEQ ID NO: 42309 - DNA, 177 bp, Glycine max
  Peptide Sequence Number=SeqID_159087
atggcggtggggtgcatcagcttcactgccatgctcggcgacggcaccatcatgcactgctcctcgcaatacggcagtggaacaacttcctctcgcccctcatgcgccacttcaacgtccagattggttctcaaagcacagtcaatagataatgatatttcacaaatattcatctaa

SEQ ID NO: 42310 - DNA, 270 bp, Glycine max
  Peptide Sequence Number=SeqID_159088
atggcgataaccgaagtccaagaagtcaaagatgcagctcccagcctgcacctgcacccctacccctggagctcctgcacccgtagcctgctgccctcactgaagttgccagtcaaaccaacgggttacgtagaaaagagcacccttacgaaattagttttaaaagggtcctattatgggaataagtttgcaaaagtgctcccttttgggcaatttgccgctagatggttattgggatgtcagcctagctggatgccattagccatctag

SEQ ID NO: 42311 - DNA, 555 bp, Glycine max
  Peptide Sequence Number=SeqID_159089
atgaagaaggagtttggaggtttgggtttcagacatttgcatacctttaacctctccacgctagggaagcaagatgctcaattagggcataacccaagttttgtatggcgtagtatccacgcttcatgggtagtggtgaaagaagtccaccaaactcatcaaccaagcacatcgaagaacaacactcaatggactcctcctccccacaatttcttgaagtgtaatcttgatgcggcaattttcaatgataacaacttgtttggtgttggtatatgtttgagagacaacaatggttgcttcttcaaagcaatcacattaaccgcaaatggcaagccaaccctgaaggaagtagaagcttgggccctccataaagcaattaaatggacacaacaactcaacattcacaatatcattttcgagatggattgtaaatcgattgttgataatttggttgtaaacttcaaaggctctattgattaccatgctttattacaaaaatgtaaagcaaatttatctaatctcttaaactctaaggtgagctttgttaagatgtaa

SEQ ID NO: 42312 - DNA, 2016 bp, Glycine max
  Peptide Sequence Number=SeqID_159090
atgtccaaaccctggggcaacatcggagcctgggccgccgattccgagcgggccgaagccgaagaggccgaggcccaggctgcggccgcggcggttgagccccaaagctttcccagcctcaaggaggccgtgaactccaagcccaagaagaagaagggaaccaccatcacgctttccgagttcaaccgtggcggtttcgaccagggccttacgcgcgacgagatgctcacccttccgaccgggcccaaggagcgttccgccgaggaaatgcagttcaaccgcctcggcggcggtttctcctcctacgaccgctccggcggtcgctcgcgcgaccgcgacggtggcaacaacgaaggttcgtggggcggaggaggcagaagatcctacggtggattcgacgaggagcgcaggggtccgaatcctagggtttcggaactcgatcagccgtccagggctgatgaggttgataattgggcgtccgtgaagaaatctctcctgcctacgattccggtcgccagaatcgctatggtggtggcggaggcggcggtttttggtggtagttctggtggtggtggttttggtggtagttctggtggtggtggttttggtggtggcggcggttttggtggtggtggtggtgggggcggatttggaggcgcgtctagggctgatgatgtggacaattgggcggttggtaagaagcctgctcctgttagatcttccaatttcggttccagttttcgcgattccggcgtggagcctgatcgttggacgagaggggatccgccgcgtgaggttgagcagcggacggagaggccaaggctggtgttggatccgcctcgaggcgatggtttggtgaatgagtctccggtgaaggcgatggataaggcgaatccgtttggggcggcgaggccgcgggaggaggtgttggctgagaagggtttggattggaaaaagctggattcggagattgagactaagaagacgagccgtcccacgagttcgcactctagcaggccttccagtgctcagtccaatcgttctgagggtcccgggttgcaggggaccgatgctgtggttaaatccaggcccaaggtgaacccctttggggatgccaagcctagggaggctgtgctgggcgagcgaggcatggattggaggaaaattgatcttgaattggagcgtcgctctgttgccagcgctcttcaaagtggtgctttgctgagctcttcaaggtggccaaggggtggttgctggagtttgcaagtcacttttggtcagcctgttggaagtagccagagacaaaatgttagagtaccactggaactggagtcccttggggagttgatgttgatggtgaaaggcaccagtttgcctctccagcttatgtcaaggggtatccttaaggagaaaggtcaaaagcttctagcagctgtctaccttggagctgaagtgcttaagcttgagggagagtgtcagagtattaggattactaagtttcagtgttatttgcctgggcttgtagtagttttaccagtactagacacaatttctagtataaatagaagtattggattgtggcctgagacaatggaggaaaaattattaaaagaagaaattgataatttaaagaaggaacttgagaaagagtctacaataaattcaaataaggaatctgtggatgaggctggtggagaccaaaccagtagacatgcaatattacaacagaaagaaaaggagctggaacttcttatccatgatttggacggcaaagttcgttttgggcagaaagccgttgaaaggccaggttcatcggcagggaagtcttctactttttctgatcggccaccttctagatctggttcctttgaggattctagaagtgtggattttacagacagacctcgatctcgtggtacaggagatatgtggatgcgtcctagtgatgacagaagacagtttcaaggtggtagcagggaaaggggatggttttcttctggcagcagaaataggtga

SEQ ID NO: 42313 - DNA, 129 bp, Glycine max
  Peptide Sequence Number=SeqID_159091
atggagttagccggggctccgctagtggagccggagctccgagaacatgaagaggaagaggaagaggattacgagaggcgtgcgttagtgcgaaatgagaatgaagggcaaaggagcattagcgtttga

SEQ ID NO: 42314 - DNA, 2352 bp, Glycine max
  Peptide Sequence Number=SeqID_159092
atggagttggtgggagagaaatggatagaaattgtgacgtgtttggtaatttcaacaacattaatgcggagtgtaagtggaagtgaaagcgagtgcattttcccagcgatattcaacttgggagactcgaattcagacactggcggtctctcagcagcgttcggacaagctcctccccccaacggaatcacttatttccactcccctaacggacgcttctccgatggtcgtctcataatcgattttatagccgagagctccgggttggcatatctgagggcttacttggactcggtggcctccaacttcactcatggagccaatttcgcaacggccggatctactgtcagacctcagaacacaaccatatctcagagcggatacagtcccatttccctagacgttcagttcgtgcagttctctgatttcaaaaccagatccaaactcgttcgccaacaaggaggggtttttaaggaattgttgccaaaggaggagtatttttctcaggctttatatacctttgatattggccaaaatgatctcactgctggctacaaactcaacttcaccacagaacaagtcaaggcatatataccagatgtattgggccagttctccaatgtcataaagggtgtgtatggggaaggtggaaggtcgttttggatacacaacacaggaccattggggtgcctgccatacatgctggatcgctatcccatgaaaccaactcaaatggatgagtttgggtgtgccaaaccattcaacgaggttgcccaatattttaaccgtaaattaaaagaagttgttgagcaactgcggaaagaattgccaggagctgcaatcacctatgttgatgtgtatacggtcaagtacaccctcatcagccatgcccaaaaatatggttttgagcagggggtgatagcatgctgtggacacggtgggaaatacaacttcaataatacagagagatgtggagcaaccaagagggtgaatggaacagagattgtgatagccaattcatgcaaagatccaagtgtgaggattatttgggacggaatccattacaccgaagctgctaataaatggatcttccaacaaatagtcaatggttccttttcagatccacctcactctttaaaaagggcttgttatgggattaaattggcatttcttaaatttgaactgagtgatgtggaggcagaggcagagggcattgtcattcttgtgggtcattttaatattcctgcaggcttgcgtgctgccaaggccacgctttccaattcgcaagttaatgttgtccctgaatgtaaggctgtggttcttccgatggtgaaacacccatttgttgttggtttcttggttgctgagcttccattggtggaggaaaagtgccagaaatctaaaagtgatgggccagaaaatctcatgactgttgaggaaccttattcatttcctccctttttggatttagacaagaagtcaagggaaattcagaatcttcaggtcaaggatgaggcagttggtatgcataatttcacttctgagcaaagatcaaatactgtcaacatttcagtctctagctatggcatatgtcatggatcaggggatgtctctgcaaataaaatgaaaaaatctagtgagtcactttctctaagtgctgctgtccaggatatagagatgccactgccacctttggcccttgctccattgcaacatggaatcagatcatgcaatgtttctcaagtattggaagacttggtggattcagtgagaccacttgcccagggtaaaaaacgtgtagtagaactaagtgaactctcatcatcacctttgctagctgctgtagaagaacctgcattgcaccaggctttcagcaatcttattgaaggtgctttactaatcacacatgttggaggaaaggttgaaattgtatctaaggcagcaccagctggtggtacccttgtacttattgatgatgatggacctgttctcaaaatcatgttctcgaacccgcaactcttccctcaagtcgatgatcctcttcttcgaataacaccgtccaagctcacggagcgtcgatcaggtacgggcgtaaggggacacatggaactgcacccgccagttaggagagcagccatcgctgcctatcacacggtggagactcggatgcactcactcacacctcatggacgagaactgttgtctgataatatgattgaagacagtatgacttggaagtttgttgctgggttgactgttgcttatgctcctcttggagctgggggaactcgtgtggaactctggcttccttcatcaattgtacagtctgatttgagcagccacgtccaagag

SEQ ID NO: 42315 - DNA, 213 bp, Glycine max
  Peptide Sequence Number=SeqID_159093
atggcggaaccagcttttttttttttcttttccttcacgaatctcgccagaccaactggcggatccatgtggatcagcatcagcaattccgccactttgactggcggaaactgcatgatgatggatgcgttgatggatgcatgggtaaaaaagcatgtgggcatgtgggcatggggtatctcgccaatgggagtagcggaaccctatgcatga

SEQ ID NO: 42316 - DNA, 396 bp, Glycine max
  Peptide Sequence Number=SeqID_159094
atggtagaaataccagtgatggttgcggtagcaataacaatagtagtggtagtgaaggtggcattggtggtagtggtaaaggtggcattggtggtgatgacgatcaacgacattggtggtattagtggtggtggtggtagcaatgtcggtggcgatggtgggatggtggtggcgatgacaataatagtgatggaggtggtattgttgttgttgatggtggtggtgatagtgatgctaacaatggtggtagcaatgttgatggtgatgatggttgtggcaccaagtggtagcaatgtggtgattgtggttgtggttgcgataactttggcggtggttgtggtggcgacggtggtggtagcaatgcctgtgatgatgatgatgttggtggcgatgatg

SEQ ID NO: 42317 - DNA, 273 bp, Glycine max
  Peptide Sequence Number=SeqID_159095
atggcatgttcttcttgtacaccggtaattgattttttccgtgttgtttgcattgcctgggctgctgctattaatctaatgctactgtgtctgcctttgtcttcaaattatattgttggatggagatttcaggtcccgatggactatttgaaacgaagcaccatgaagagcattagtggtttaatgaaggtatttgtggcactggtgggcattcgttttgtcaatgttcaacgaatagtgataatgatgattattgtgatttttgaaatgtga

SEQ ID NO: 42318 - DNA, 1744 bp, Glycine max
  Peptide Sequence Number=SeqID_159096
atgttcaggttatctccccggaggagccaaagatccaaaggcttcaaggtgaagcatgctctacagttatgtgttctgcttggagtttgtatctggctgatttaccaactcaaacactctaatgagaagaaatcgtcctatgtagaaagcacaaaaactaccagtgaggttgtcaagtttgggaggaaggacctccatcctcgcgcggaggaaacttctgtggtagatgcaaggcacaaggaagaggacgaggaggaagaacaacaagaaaataagcaagaagagcaacacaaactagatgatgttaatggtgtgcaagatgaggtcctaaagcatgagcagaatgacaatgaagagaattctgagcatagacaggattcggtagaccaagaaactgaagaaaattctgaaaatgtaacgacacaagtggaaggcgaacagcataatgagaaatttggtgaagagaatgacaatatagacaacaaggagaatgaggagaacaaaagtgaaggggaggacaaggaaactggagagaataaagaagaaaagattgagcaggagaatgacaatatggataacaaggagagtgacaatacagtgaaggagaatgaagtggagaacaaagaaactgaagaaactaaagaagagaagaatcagcaagagaatgaagaggtgaagcagaatgaaactgaagggatggacaatggggaggaaaatcatgagaaagatagtaaagaaataacagatgagagcaatcaaagagaagctgagagagaagaacatgacaagattcaggaagggacttcatctgagaatcaagttcaggatggggggaaaaatgaggaagagcatagagaggaaaattatgcaggagataatgcctctagtgctgtagacaataaatcacaggacgcctcagatgaaagttccaagacagaagaagaatctgacaaaaaggaaaagaatgagtttgagttggagtctcagaaaaatggtactgaaactacagaagtggctgattctactgccacaacaaacagccaaggaaatgaaaatgatgctgaaaatcagacacagtcagagaatgattcacagaaaagtgttatgttggagtcagaatcacagcagcaagagcagaatgactccacaaaggatggtgtagaaactcatagaactgaagcatctgaaaatgaaaataaccccaaggtagaagactccagtgcacagagtacgacccaaaaaactgaagattcttcttctaactcagatgcctggaaggattctgcaacgaacggtgaatacaaggacacctcgagtaattcggctcaggatgaaaacatcaacaacaattctgtccaagaaggaaatgctgcatcatccaataatgacaacaaagatgctagccaagatgttcaactcacttcctctgatacttcttcagaacaaaagaaagatgaatctgcgaatatggaaactaacactggctctgcgcagaatgacaatgtaaactctgatcaaagcaacacaaacagtgatggaagtgctaatgacaaaaaagatgctagccaatccgatacttcatctgaacaaaacaaagagggatcctcaaactcagataacagcaacgatgctaaccagaatggctctaacagcaatgaaaatgcaaatgacaatgagaatgatagtcaggaagcacaaaacagtgctgatgcgggacagggtgacaatgaggtcactgttgaga

SEQ ID NO: 42319 - DNA, 1089 bp, Glycine max
  Peptide Sequence Number=SeqID_159097
atgatttccttagcagatgtctatcatgtagtcactgccactgttccattatatgtcaccatgtttctagcctacatctctgtgaaatggtggaagctcttcacaccggaacaatgttcaggcataaacaaatttgtggccaatttctcagtcccaattttgtcattccaagtcatttcttccaataacatttacaagatgagcctcaaactcgtatatgccgacgttgttcagaaattgcttgcatttttagtcttcacggcaatcattaggatcaaggacagggggggtttgaagtggatcataactggtctctcactatcaacacttcccaacactttgatcctaggaatcccactcatgaaggctatgtatagggatgaagcttctcttctcctaccccagattatcttccttcagagcatggtgtggtacaatttgttattgtttcttcatgagctagatgcagcaattcctgcaaggaccatgcctgttgttgcaccaccatcacaagacacgggagactctgagacttctctggagatacaatcaaaagaagaagaagaagaagcagaacacagaacgcagagtaaaacgagaatgttgctcattcttatgaaagtggggaataaattaatcattaatcctaatacctatgcaactttcataggtcttatttgggcaagcatacacttcaggtggggagtagatatgccagatgttgttaatcagtcaatagaaatattggccagtggaggtctaggcatggcaactttcagcttaggtctatttatggcatcaagcaacagaatcatagtatgtgggccaaggatgacactggtggcaatgggcctaaaatttcttgccgggcctgccataatggctgtagcctccattgtgattggattaagagatagaatgctcaaagtggcaattattcaggcagctctaccacaaggaattgttccttttgtttttgctagagagtataatgtcaatccaggcattttaagcactggggtcttgctaggaatgctcatggccttgcctgtggcattgacctactatctcctcttatcactctattga

SEQ ID NO: 42320 - DNA, 2862 bp, Glycine max
  Peptide Sequence Number=SeqID_159098
atgaagttagaagttccgcgttttgatggcacagagcctctcgactggattttcaaaattaatcaatatttcgaataccatggcacccctgaccgcgaccgcctcaccatagcctccttttacatggaaggcagggtgcttgcttggttccaatggatgtcaagcaatgcccagttcacttcatggccatgggaggtccaagccaaccaacctctcactttggttcaggccgcgggcctcgcaaaactccaggaagaaaagctcatcgatagccggaaccctccgcgagctagagcgccaccactagctccaaatctcattcgcgccaacaacccaaatgctgacgttcacgcccttcttccgccgttactaccagctccgcctcgcccaccacaacctgtgatgaagcgtctcaccccggaggagataaccttacgccaagaacatgggttatgcttcacctgcgacgagcgatatcatcagggccatcactgcgccgctagggctttcctccttgtgactgaagaagaggagccaactgaccctaaaatagatgcaaatgacccaccccccgacccaccagatgaacctgacccatacccagcccaaataagtcttaattcattatcagaccacttggcacccgaggcactacgcttagtgggaatcatggccaaccaccgcgtggtgttgctcgttgacggggtatctattcaaattcaagatgtccacttcaccatggacttgcacgtcttacccattgtcggcgccaacgtcgtcttgggcgtccaatggcttaagactttaggtcccattctcacagattatggctctctacgcttgcaattcttctatcaggaccgcttgattgaattgaaaggggacagcacaactgattcaggcctcatcacccaccaccaactccggtggctctatcggacacaaacccaagcttcttattttcatattgcgatgctctctgataattgggatcctcctccacaccaggccctgccccagacaattcaagcattgcttgaacgtttttccttcctgtttcagagtccacacgggctccctccaaccagagacatagatcatcatatccatctgctaccacaatccaatcctgtcaatgtgcgcccctaccagtacccgcactaccagaagcaggaaatcgagcagcaggatgggacgtggcgcttctgcgtggactatagggccctgaacatcgtcaccgtccgggatagattccctattccaacaattgatgagttattggacgagttaggaggagcgcaatatttttcaaagcttgatttgttgcagggttaccaccagatccgcatgcatgactctgacatacccaagaccgccttcagaacccaccatggacattacgagtttaaagtaatgtcatttgggctctgtaatgctccatcctctttccaggccaccatgaacagtatatttcggcagcatcttcgccagttcatcatcatcttcttcgatgatatcttagtttatagaacctcacttgaagctcatctccagcacctggcaacagcgttccagacacaggtggagtatcttggccacgtggtatcgcagaagggtgtggaaccagtagcttcgaaggtcaaagccattcaacaatggctgacaccacggtcaacgaaggctataaaaagcttcctgggactcgcggcagtcctcacccaaaaaggccatcctgttgcgtttttcagcaaaccgttcacgcctaagctcattggtgcctcgacatatgtccgcgaattatttgcgattaccacggcgcgcttcaccataatcacagatcatcgaagtctcaaagaattactgactcaagtaattcaaacacctgcacagcacaaatacttggctcgcttgatggggtatgattatgtcatccaataccgctcaggtcaccacaaccaggtcgctgatgctctatcccggcagccgaaacatgagccctcgcagtgtatgattctctctgtcccttctctaaccttcttggaagaactacgtcatcaattggaggatcacccagaatatcgccgccgccggcaagagattatggaagctccaaccaaccaccctactttctcggtgtcgatggatttggtgttgaccgaggggcatatttggttacctcgaggaatcccaattgcgtcaacactgcttaaggagtatcacaccaccccagtggggggggggcatgctggagtcgcaaaaacaatggccaggatttcggaaaacttcacttggtcgggtcttcgagaagatgtaaagcaatttgtggccaattgtattgaatgccaagttacaaagtatgagatgcagaaggtggcagggctgttgtgcccccttccggtaccacatcgaccatgggaagatctttctttagattttatcgtaggcttgccagcataccatggcaacaccacaatcctcgtggtggtggaccgtttttcaaagggaattcatttgggcatgttaccggcatcccacacagcacacatggtggcatcgttattcatcgatatggtggtcaagatacatggagttcctcgcaatttggtttttgacagggacccccttttcattagcaaattctggcaagagcttttcaaggccagtggaacccatttgcgaatgaactctgcttaccatcctcaaagtgatggtcaaacagaagtgttgaacaggattgttgaacagtatctaagggcctcgtccaccgacgaccgaaccagtggggcaagcttctaccttggatcgaatggtcacataacacctcttggaacgccggcacaggcacaactccttatgaggtga

SEQ ID NO: 42321 - DNA, 219 bp, Glycine max
  Peptide Sequence Number=SeqID_159099
atgaagcagccaaggaggaaggttgggggaatgtcgacgatcctgttcgcgagatcctcgaactccgataggattgtggtacacgcgaggcagagaagaggaaatggaaggtgtggggtgggcgagatgttggataaggttgtcgattttgtgagacaaggacaattgttgagtggtgagggctacgagaatttcttcgagcttggtcgaagaggataa

SEQ ID NO: 42322 - DNA, 225 bp, Glycine max
  Peptide Sequence Number=SeqID_159100
atggtcgggttgtggttgaggggaagaaaatggggaaggacggtggaggagttcatcgagtttcagattcatggtttgcatggtgtcagtgaggcgggtaaggatggcctcaaggttacccgaggtggtaggcagcatcaagcaggaagatttgtggaagatttgaagatgagctggcaattccatttcctttgtcgctatcctcagacgaagtcattcaaataa

SEQ ID NO: 42323 - DNA, 360 bp, Glycine max
  Peptide Sequence Number=SeqID_159101
atgggagatcgcttggaggacatgattcgtgaccttggacaagagtcttttcagcaagcacacgcccctgtgtatgaaggattgcagagtgattcaaagaagcctttgtatacagggtgcaagaattccttaaccctattgtctgcggtgttaagtctggttaatgtgaaggccaggtatgggtggagtgacaaaagttttacctcactgcttgaggtagtgcacaatctgcctccagaggacaacatgctgcctaaaacttactataaggcaaaaaagatattgtgtctgatgggtatggagtatcagaagattcatgcttgccccaatgattgcatattgtacaagcatgaattctaa

SEQ ID NO: 42324 - DNA, 372 bp, Glycine max
  Peptide Sequence Number=SeqID_159102
atgggccgggtcaaaagacgggtccgggtcagggtccaaactggttataagaggggagtcaggtatgggtatggtgtcacggtcttcagcgagaaggaggaatacccgagaggcacactggtgtcctcgatggtatttctcatcacagttgaagcaaagacctcgttcccggcgaaaggcaatctcgtccgagagggtgagggaaaagaaggtgggcaaggagaacggagaggtggggcagagaaaaaaggggcagagggtggtcgcggacggctggacaaccctaacagagcaaccagaggaggaagagctctagagagcaccagaaaagccacaattgctaacggagaacgattgagggactacgtcgag

SEQ ID NO: 42325 - DNA, 516 bp, Glycine max
  Peptide Sequence Number=SeqID_159103
atggctggccacctggcccctgaaacacttcgtttcatcgccactattgccagcaacaacgtagtgctccttgtagatggcgggagcactcataacttcattcaactgcagctcgtgacccaattgagccttccttgcagaaccacaactcccctgcgtgtcatggttggcaatggccaccaactagagtgcaacaccatctgcgaggaaattccggtcaccattcaggctcacaattttcacgttgacttatatgttctccccatttcgggtgcgaatgtggtgttgggagttcagtggttgaagtcactgggaccagtattgactgattacaatacgctgctcatgaagttctttcataatggtggtctgatcacattacagggagacatggatgcttccttgacttccctatcctctttccgccgtttatcccaaaagcctgataatgccatgtattatcacattaccttattactagacctcaattccgcaacccacctccatttcaaatga

SEQ ID NO: 42326 - DNA, 189 bp, Glycine max
  Peptide Sequence Number=SeqID_159104
atgctccaaccatgtgggatcggcacaggcttacaagagcactcaaaccggatgacccccaaggcatacactccgaagagtccgtcagggcctctccctcctgattcagtgcgcctcaagtggttaactcgtcgggttcccacagtggatctcatcacaactcatcgcgcattaactcgtcgcccttaa

SEQ ID NO: 42327 - DNA, 726 bp, Glycine max
  Peptide Sequence Number=SeqID_159105
atgtccaaatcttgtggatttgggatgaccagccctctcgaggagccctcgccttgggtacttgttaccctcatcttcagaggactacacgtcctcaccttcagagggctacgcgccctcaccatcagaggactgcacgtcctcacctttagaggactacacgtcctcgccaacagagggatgcacgcccttacctttagaggactacacatcctcgccaacagagggctgcacgtcctcaccttgagaggactacacgtcctcgcctacagagggctgcacgtcctcaccttgagaggactacacgtcctcaccatcagagggctggttgcccacacctccagaggactatacatcctcgccttgagagggctacacgccctcaccatcagaggactgcacgtcctcaccttcgtagggctacacgccctaacctttagaggactacacgtcctccccaacagagggctgcacaccctcaccttgagaggactacacgtcctcgcaaacagagggctgcacgccctcacctttagaggactacacgtcctcatcatcagaaggctgcatgccctcacctccagaggactacacatcctcgccttgattgggctacacgccctcgccttgggtactagttaccctcatcttcagaggactacacgtcctcaccttcagagggctacgcgccctcaccatcataggactgcacgtcctcacctttag

SEQ ID NO: 42328 - DNA, 714 bp, Glycine max
  Peptide Sequence Number=SeqID_159106
atggaaatagggcccctggacccaatgacttttgtgggttttttatcagagggatggatattgccatatttaaattctgatgtcattgttcttattcctaagttgctgaatgttgataaaattgaaaattacaggcctatcgccttggtgaactttcagttcaagatcatcaccaaagtgttgacaaatagactttccaacattgcccctagaataatctcttcgttccatagaggattcataaaaggcaagcacttctcttattatatagcatgcttcgatctttcggcttttgtgaaacttttgcagttggatccactctattcttcttttggtcaagctctcaatcttaataaatggaaagaagccttgagtaaaggcctctctgccttagtggattcacatgatttggggcctatgacaggtcccaaacaattccaaatgccctcacatggtacctctgttcaaatcataaatgcaataaaatcatccttctatgatggagccattcctttagcccgagttatgagtattgccaatttgttgggttttcgagttggcatcactctttttgattacttgggagtcttggtgtttaaaggaaaaccttcaaagacaaccctccaaccattggcggacaaaatcgggcacaaattgggcatttggaaaggtcacctcttgtctctcatgggacatgttcagcttgttaaataa

SEQ ID NO: 42329 - DNA, 153 bp, Glycine max
  Peptide Sequence Number=SeqID_159107
atggcaacttacattttgcctaaatcgccaaagccagtgtggaagtggcgagatgccatgtgtctcatcgctgtgaagttgccagtgtcgctggtggtttgcgtgccacgtgtgacgtccgcagcaaatgcgccagtggagctggcggtttag

SEQ ID NO: 42330 - DNA, 459 bp, Glycine max
  Peptide Sequence Number=SeqID_159108
atggagctgatagagaacatagcggtcaatgatcatgccatctttcatgatcgagcatacacgccaacaaagaggagacttctggaactcacaacccaagatgcaacactggcccaaaacaagctattggcccgacagatagaggccttgacggagaccctcaacaagttccctcaacaactacaagtggtaagtccctctcactcttcaatcatgcaaatagggggatgccacatctgcggtggagaacacgagccagggcaatgcttagcccaagaagattcttcgagggagatattcatgtctaactatagaagcatagagtcatccatcaagaacctggagatacaagtgggacaattagccaaacaaatggctgaaagacccactagcagctttggagccaacatagagaagaacccgaatgaggaatgcaaggcaatgttaactagaagctag

SEQ ID NO: 42331 - DNA, 645 bp, Glycine max
  Peptide Sequence Number=SeqID_159109
atggaagagaccaaatccaagttcaagaggatttgtgtgtactgtggaagcagttctggtaacaaagccagttaccaagaagctgctgtggaacttggcaaggagatggttgagagaagaattgatttggtctatggaggtggtagcgtgggcttgatgggtctagtttctcaggcagttcatgatggtgggcgccatgttctgggcgttatcccaaaaagcctcatgccaagagagataactggtgatcctattggggaagtgagagcagtatccgatatgcatcaaagaaaagctgagatggctcgtcaagctgatgcattcattgcccttcctgggggatatggaacactcgaagaactgcttgaaatcattacatgggctcagcttgggatccacagcaaaccggtgggcctattgaatgtggaaggattttacaattccttgttgtctttcattgacaaggccgttgatgaaggctttatttcaccaaaagcacgtcgcattatcgtgtcagcacccacagccaaagatttggttagagagctagaggaacatgtacctgagagagatgaagttgtatccaagttggtgtgggaagacaggctaaattatgtggtgcctgaatcagaagttgccatgtga

SEQ ID NO: 42332 - DNA, 1755 bp, Glycine max
  Peptide Sequence Number=SeqID_159110
atgtcaaatgctggaagcccaagtctggttaatttggagaatgtgtcatctcaaaatatatctgagagtgggctacagcaagctagcctcccaccaagaggttggaattcctatgattccttttgctggacaatttctgaagacgaatttttacaaagtgctgaaatggtttctcaacgtctcaaggctcacggatatcagtttgtcgtggtggattacctctggtataggaagaaagtcaagggtgcttaccctgattctcttggatttgacgtgatcgatgaatggggaaggatgatccctgacccaggaaggtggccttcttccataggtgggaagggattcagtgaagtagctaataaagtacatagtttaggtttgaagtttgggattcacgttatgagagggataagcacgcaagctgtcaatgcaaacacccctatcctagatataacaaagggaggtgcttatcaagaatctggtcgagtgtggcatgcaaaagacatagcaatgccagaaagggcttgtgcatggatgcctcacggtttcatgagtgtaaatacgaagttgggagctgggagagcttttttgaaatccctttatgagcactatgttgatagattttctgctgtccctgcagtgaaacatgactgtgtgtttggagatgacttggatttaaatgaaataagctatgtgtcggaggttctcagtgtgcttaatcgccctattgtgtattctctgtctcctggaaccagtgtgacaccagccatggccaaggatgtcagtggactagtcaacatgtatcgaataacaggagatgactgggataaatgggaggacgtcaaggctcattttgatgtaacaagggatttttctacagctaatatgataggagggaaaggtttgaagggaaattcctggcctgatttggacatgctaccatttggatggctaactgatccaggatcaaatgaaggtccacacagatttagtaaactcactctagaagaaaaaaggacacagtttccttacatcacaagctcaattaacttgaagcaccctggagggaaagaaagaagacttaagaaaggaatacattcattgggtttgactagctgcagtgaatcaaaggcgaggggttggtctattgaaagtcttaaccaagatcttgaaagaatctgttggaaaaagggtttagaaaacaagcatcaggcccctttctgcgtacacaaaagagaacttcaattcagattagacggggtgagtatgtatcaagaggactatcgagggaaacatcaattagttgcaactgacagaatgaaattttgcttggacgcttctccaagacgaaaggttacttctaaagagttcaagagaggtacattttctccatgcagatgggattcaaatcagatctgggaactgaactccaatgggaccatggtaaatagttactccggtctttgtgcaactgtagagtatattgaagctaatgttaattctggtgggattcgctcttggatcgcaacaggaagaacaggggaaatctatcttgctttcttcaatctaagcgaacagaagacggagatatatgcaaagacatcatatctggctaaggttcttcctgacaaaagcatcacttcatgcaagggcgaggaagtgtggagtggaacagatgtaataacaacgcaagggacgatatcaatgaacgtggaaattcatggatgtgcactatttgttctaaattgcaactag

SEQ ID NO: 42333 - DNA, 216 bp, Glycine max
  Peptide Sequence Number=SeqID_159111
atggttgcatacctcagagaaaagagagcaaggagaacccataaagaggctaaggacaccgagaaacacttcatcattgcgggcagaggagcaaacgtatctaccacctccaaaattgtggcaattcattccaaaattcggatttgtatgcatgtcagcgacgatcaacgaagaacggtttgggtgattaaaaagtgcacgaaagttgtagtttga

SEQ ID NO: 42334 - DNA, 1053 bp, Glycine max
  Peptide Sequence Number=SeqID_159112
atgtgttgcaatgcaagatcagcggctgctcaggttgttcggtatgagagggcaacggagaagattgttagtgtgtttgaggatgaagagcctaaggagttttggattgctctttctaccaaggaagtggtggtggtggagaatggagaggtgaagaatgtggtggagagaattgagattgatgtggggattcgtcccaggagagttgaggagtatgatttggattttgggatttttcataaggcgcttgctggtggggttgttccacctttttctttgtctaatgctggatcggaaaattgccttcctgccagggaaaatgggtgggggagattgacaaggaagcttgctagtggtatcatgaaagggttgttcacatcctctaagtgctgtgagtctagtgtgaacatcattgaagagggaaatcaacataagaatgttgatcctcctttgccaccatcttctaacaatgtgggtggttcgtggagttcctttgagtgttttgtagataatggcttagagaggggaaaggatagtgttcaacaagtcagggatcagtttgttgttcctagcgttgggtcatcaatgccgccaccatcgcctcatagtcgagcagcatcggattcttttgcttgttttctaagtaacagctccaaattcagttccaaatctccaccactttcacccgccagttcggattatgcaagttcctttacattttcgccttcatcgactgatttgtcaatcgtgtcttctcggcagtcatcgccttccggtctggaatcagctgaacccaatcatgtgaaagatgcatcttcctcagagagtcgctctttagttcagaaagaaggtgaggcatttctggctaatcacaccttggtaggggcaaagtccagtttgccgcgcaaaggatcttccctctccattgcagagcgcagagggagtaacccgccacctcgcatgatgctacccttggccagtgaatcatcccgtgtcagcaaggtccgggtaagatccaggtctttctcattgcctgccttggatgatacttag

SEQ ID NO: 42335 - DNA, 550 bp, Glycine max
  Peptide Sequence Number=SeqID_159113
gttctttggtgacatccgtttatatgttctggcccaaggtgcatcatgcattgccatacctctcatggctactttattgcctccaatgtacacgcattcagcatattggctctgggcttcaggattttatgttctagctatgctgcaagaggccgccgatagagtgatttatttactgacgtttcacattgtcagtggtcacacacttaagcatttgtctgctgcaatggttcctatcatcctaacagtcatgcttgcaaagagaagtgtttactcggagaagcttttgcattcctgtcccgatcttcaatttatagccagtattaaaatagaagaggtagtccaagtagatgaagaatggaatcttgactcattcagtcactgttctctgatttgtatggaagaacctttctctgatttgtatggaagaacctttgtctggcaaatatttaaggttgactataagcactgcaatcaagattggtcttgcattcagaatgctgaagagaagcatgctagccatttagaccttgataagcttatcgaatag

SEQ ID NO: 42336 - DNA, 192 bp, Glycine max
  Peptide Sequence Number=SeqID_159114
atgacgaatgtgcacgccctgaggcgaaaggaaaaaggaaaggctagtgcagtttcaatggtccaagtgttgtccatcgatgagctagagatttccattgacgaagacgagcatgtcagtgttgacgataaagggttgggaataaaaaatggtaatggagtgcagtcattgttggaaggtgataactgttaa

SEQ ID NO: 42337 - DNA, 261 bp, Glycine max
  Peptide Sequence Number=SeqID_159115
atgcctaaatcatctcccaacatgcatgtgaaccaagaagtatcaacaagagtcaagccaaggctattgtgcaagaaatcaatggggcaaaacacaccgaataaaatagatgatgatggctcaaaatctcaccaaggcataatcataagatcaagtgcaatcagaacaatcaataaatttggcaagtgcaataaaagtaaagaaggagacagaaaaagaaaactccttaagtcatggcggaagagaagtagggtgaagtaa

SEQ ID NO: 42338 - DNA, 1029 bp, Glycine max
  Peptide Sequence Number=SeqID_159116
atgtctcgtcgagaaaccaaccctcatttttctagatcatcacagcctgaatatgtagatgatcatgataccgaaccttatccacttgtgccacgacgaaaacgccatggcaaaccatccacacaagtagctgcacctataccagttgcattaccacctgagcatgaagaccgtgttccattacgaacacgacctcagcacgaagatcatgttccattgcaacctgccaccaaacctattccccaagatcatccacacccaccaccacctattccccaagagccacgccatggcaagcaaagaagtccacgtagacagccaacaaaccaaggcttccggccggttaagccaaaggtaaattttcaagaacctcctccctcggccgatgtccctcccgagcctcgacagcagcctcaccgcgatccccgcctcagcggtataaagttgcctaaggaacagaagtctcaacccttgacatggttaggtgcttgcttgtgtgtaatattttggctcatcataatcataggaggcttaatagtccttatagtgtacttggtttttcgcccccaaagtcctcattttgatgtgtctagtgtgaccttaaatgctgcataccttgaccttggatatctactcaatgctgatctaacaatgctggctaacttcacaaatccaaacaagaaggtgcatgtggacttcagctcagtgatcatttatctctactatggaagtacccttattgcgactcaatatgttgagcctttcaatgctgcaaggcttcaatcaaggtttgcatatattcatttggtatctagtcaagttcagcttccattaagagagagccagaggcttgtgaaacaaatggaaggcaatggggttatacttgaagtgaggggagttttcagggcacggtccaaattgggaagcatcttaaggtattcatataatctttatggccgttgcagtgtcatgctaacacgccctcctgatggcattttgctcaaaaagaaatgcagaacaaagcgctga

SEQ ID NO: 42339 - DNA, 1566 bp, Glycine max
  Peptide Sequence Number=SeqID_159117
atgtatcagagcagcattggcgcacaccgcctcgcataccgctctcaaatatcaaaactggtcaaagccggtctcatcaaccaagccatctacctgttcgaccaaatgaccgaatcaaattgccgcgtcttcagcgtcgactacaaccgcttcattggcgtcctcctccgccactcccgcctccatctcgcccaccactactaccgccgccacgtcatcccccgcggcttttccctcctccccttcacctactcccgcttcatctccgccctctgctccgcccccaacaacattaacctccccctcatccacagcctcctcctcgacatggactccctcggtttcgtccccgacatttgggccttcaacacttacctcaacctcttatgccgccaaaatcgcttagaaaccgccctcgaactcttccactccatgccctccaagggaagagaccccgacgtcgtttcctacaccatcatcattgacgcgctgtgcaatgctaaacgctttgacgaggctgctaaggtttggcgtcgtttgattgacaaagggttaagccctgattataaagcctgtgttgctcttgttgttgggttgtgcagtggagggcgcgttgatttggcttatgagcttgttgttggtgtgatcaagggtggggtgaaggttaatagcttagtttataatgctttgattgatgggttttgtaggatggggagggttgacaaggccatgaagattaaggcgtttatgagccgcaccgggtgtgtgccggatttggttacttataacatactcttgaattactgttgtgaggaagggatggtggatgaggccgtgaggttggtggagaccatggagaggagcggggtggagccggatttgtatagctataatgagctcttgaagggtttttgcaaggcgaatatggtggacagggctcatttgatgatggtggagaggatgcagacaaaagggatgtgtgatgttgtttcgtataataccgttattacggcgttctgtaaggcgcgccggactaggaagggttatgagttgtttgaggagatgtgtgggaaggggattaggccagacatggtgacatttaatatacttatagatgcgtttctgagggaaggaagtacccatgtggtgaagaagctgcttgatgaaatgacaaagatgcgtgttcttcccgattgtatattctatacagcagtagttgatcatctgtgtaagaatgggaaggttgatgtggctcatagtgtttttcgtgacatggtggagaatggggttaatccagatgttatctcttacaatgcacttctaaatgggttttgtaagacttctagagttatggatgccatgcatctatttgatgaaatgcagagcaaaggtttgtaccctgatgaggtaacttacaagttgatagttggagggcttataaggggaaaaaagatttcactggcctgtagggtatgggatcagatgatggagagaggctttacacttaacagacatctctctgagactctagtcaatgccattcaatcaagtgatggcacaacatga

SEQ ID NO: 42340 - DNA, 530 bp, Glycine max
  Peptide Sequence Number=SeqID_159118
gagcccatcctatacatcctgagaacagaactaggactcgcgggcatggcgtgcacgcgcttctgacactgcaacagctggcacgcgaagcccatgttggggttcgttacgccacgcgcgatcttgacatagtgaaaggcgtcctcgaagctctggccttccctccacatgagatacgcgatgacgagcgaggtagagcgcgacacgccctggcagcagtggacgaacacgcgcccaccctggttccggacatcctcgaagtaatcgaagacgtcgtagagaatgctggtgatgtcctccgaggaagctcgacgctcttcgccaccgtgtcactccccaggggtcggtggaagagaccaatcaccgagatcgtcgcagccggcgctgggccactccaaaacgctgcgtttgtggatggcgagaggctgaagcggacgcggcggtttccgggtaaccggagaccgggagaagagagaaagcggtgtaaaacagaagaggcagagggacgtgaagaatttggagtttgctga

SEQ ID NO: 42341 - DNA, 786 bp, Glycine max
  Peptide Sequence Number=SeqID_159119
atgttaggagaagagagtaacaacaacaacgaccgcgccggcggtcaccggagaacaacacattcccggtcagtttcctggaccgaccggtctccggttacccggaaaccgccgcgtccgcttcagcctctcgccatccacaaacgcagcgttttggagtggcccagcgccggctgcgacgatctcggtgattggtctcttccaccgacccctagagggtccaccaaaacaccagattcgggttcgggtcaagttttccagttcaagaaagactattacgcgttctacgacaaggaatgttcgagaatcgcggagcacgtgtacctggggagtgacacggtggcgaagagcgtcgagcttctgcggcggcacgggatcacgcacgtgctcaattgcgtcgggttcgtgtgccccgagtatttcaaaaccgacttcgtctacaagaccctctggctgcgtgactcaccctcggaggacatcaccagcattctctacgacgtcttcgattacttcgaggatgtccggaaccagggtgggcgcgtgttcgtccactgctgccagggcgtgtcgcgctctacctcgctcgtcatcgcgtatctcatgtggagggaaggccagagcttcgaggacgcctttcactatgtcaagatcgcgcgtggcgtaacgaaccccaacatgggcttcgcgtgccagctgttgcagtgtcagaagcgcgtgcacgccatgcccgcgagtcctagttctgttctcaggatgtataggatgggctcctcattctccttatga

SEQ ID NO: 42342 - DNA, 120 bp, Glycine max
  Peptide Sequence Number=SeqID_159120
atggcaatggtaggcgtgagcccaggggattattggagtgatggtaggaaacttcgtttgcaagggatgacgagtggcgacatggagacagacagagactcggattttagtcctttatag

SEQ ID NO: 42343 - DNA, 1296 bp, Glycine max
  Peptide Sequence Number=SeqID_159121
atgcggatccagtggtggctaaacacatgctcctcggccaactgcgccaccgccacccaccattcaacaatctcactccccaaacaaaaagaacatgcatgtgatgattccatcagctactcctccatttccgaagcacctgcatcttccacaacctccaacaacagcacttcctctctcgaaagcaacctctccatacaaaccctcccatccgttccatctctccaaagcctctctccacaaaacttcaccttctccgtctcccaccattgcgtcaccaccctcgagccacacctttctcgccccgtcacctccctcgctgtcaacaacaacctcctctacgccgcaaccgaccacgaaatcaacgtctacgaccgccacacctgcaccaccatccacgccttcaacacccagcccacctccacctccaactccaccaaaaccatcgccttctccaacaacaacaccgtcatcaccacccaccaagactgcaagatccgcgtgtggcaaaaccacaagaatattcaccaccgcatgttagccactctccccaccgtcaacgaccgtctccaccgtttcctcctcccgaagaactacgtcgcaatccgtcgtcacgagaaacggctctggattgagcatgcggacgccgttacgggactcgccgttagtaacggtgctatatactccgtttcgtgggacaggactctcaagatatggcggttatctgattttcgctgcgtggagtcgttgaaggcgcacgaggacgcggtcaacgcggtggcagtgtccaacgatgggaccgtctacacaggatccgcggacaagcgcatacgcgtgtgggcgaggcccgcgggagagaagcggcacgtgctggttgccacgttggagaagcacaagtccgcggtgaatgctttggcgttaaacgacgacgcttcggtgctgttttcgggtgcgtgtgaccgttcaatattggtgtgggagagggaggacagtgcgaaccatatggtggtgagtggagctctgagggggcaccagaaggcgatactgtgtttggtcaacgtctctgatttgcttttcagtggatccgctgatcgtacggttaggatttggaagcgcgcttatgatggacggtatggatgccttgctgtcctcgacggtcaccggaaaccggttaaatccttggcggcgattccggaggagtatgatcaaacttcacctaaatgtagcgtctcggttttcagtggctctcttgatggagagatcaaggtttggcaggtttctatcacgagtcagtaa

SEQ ID NO: 42344 - DNA, 174 bp, Glycine max
  Peptide Sequence Number=SeqID_159122
atgtcaaggggtttgttttggtcagatttcgccatcactataagcgaatcacatccacgtggcaataggtataactttgtcactgacgttggcgaaacccctccaaagctgcgtccatggcatgcatttcgccaaccgtgtgtgcgaaataggtataacttttcaagagcttag

SEQ ID NO: 42345 - DNA, 2040 bp, Glycine max
  Peptide Sequence Number=SeqID_159123
atggtgccccggaagatgcaatcgaggcctagccgccatattttttcagcatcagatgacactacaatgaccaaaaatattcgtgccactcatgctcccgttgatggacacattggcgttagacctcttcttcatgttgttcaagacatttttcaccgcgctgcctctctcatccctggcattgttcagggaaaacaagtgcagatggatgccatgaaggacagtgcataccaatctgatttagctaacatatgttgcaagtgttcaagcggtggagatgtacatgccacaaccatgggaatactgggcatgctctcaagctattcatgggatgccaaggtggtgatagcattggcagcatttgcagccaactttggggagttttggctggtggctcagctttatgccaccaaccgtcttgctaagtctgttgcaaagttgaagcacatccatgaaacactggaacaagtggatgatttgggaccaaagtttcaaacagtcaacaaccttctcaaggcaatgttggatgtaaccaataacattgtccaattccatgagcttccctctcaatacattgaccctgaggcaccagagatgttgactgcctccaatcttattcctggtgctgtctattggaccattcggagtattgtgtcctgtgcatcgcatattttaggcataactggcttgggtcaaggtttggcccataagcttgataacataaatagtcaccttcgaaagcaactcaccgtttgtcgtcagcatttagatgataacagacagagagaagcatttgcaacacttcggctcctttttgagacaccccatcaagataattcgaaggttctcaaagctatgttttgcagcaaggatgatccgttgccactgtttgatggttcttccaaacaaagggttagcattgaggtgctgaggaggaaaattgtgctgctctatataacagacgtacataatgtccccgatcaagagcttgtgatttttgaacaaatgtaccaagagtcacgtcaagattcaaccagattagagagtcaatacgaactcgtttggattccagttgtggacaaagcaatcccgtggaatgacgtgaaaccgaagtttgagaagctgcaatcaatgatgtcttgttactctctttatgacccttctctattggagcccgcaaccatcaggtacattaaagaggtatggcttttcaaaacgaagcctattcttgtagtgttggatccccaagggaaggttgtgaatctgaatgcaatacccatgatgtggatttggggaagcttggcttatcctttctctagctcaagggaggaagcactgtggaatgcagaaacatggggacttgtactattggcagattcaattgatccatcgcttttggaatggatatcggaaggcaaatatatatgcttgtacggaggtgacgatattgagtggatccgtaaattcacaaacactgcatattccctcgcaagaactctgcaactaccactagagatgatttatgtggggaaaagcaatccaggaaagaaagttcaagaaatcaacaatgccgtacaaacagaaaaattgagcaacgtacttcctgaccttgccataagttggttcttctgggttaggctagagagcatgtggcactctaaatcacagcagagcaaaacagtagagaacgaccacataatgcatgaagtaatgagaatcctaacctatgatagcggtgacccgggatgggccgtgattagtcaaggcacgggaaagatggcacagggcaaaggagacacatttctaaagtgcctgaatgaacatgaacaatggaaagacgcagcaaaagataaaggacttttgccagcaatggatgattatataaaagaactccaaacccctcaccactgcaatcgcttgatactccccggaaccagtggcgggataccagacaaagtgtcatgtgctgaatgtggccaaacaatggaaaaattctacatgaaatctagcgcactcatgccaattgaaactattggatga

SEQ ID NO: 42346 - DNA, 1725 bp, Glycine max
  Peptide Sequence Number=SeqID_159124
atgggtaggtggaggccgagcacgttggttttcactattctctctgcgccaataataataataatagcattgctctcctccggaggaaccaccacggtggaagacgtcgacaatgatcacacaatggctgtgacgggtctgcttcacacggattcccgatggatcctcaaccaaggtgggcaaagggtgaagcttgcatgtgtgaattgggtatcccatttggaagttgcggtggccgaagggctcagcaaaaagcccgtagatgcgatttcaaagggaataaagtccatgggcttcaactgtgtcaggctcacttggcccacacttttggccaccaacgactctctcgcttctctcagcgttagacgttcttttcagagccttggcctccttgaatccgttgctggtgtccaaaccaacaacccctccatcatcgaccttcccctcatccaagcttttcaggcagtggtgaagagtctcggggacaacgatgtgatggtgattttggacaaccacctgaccaacccaggatggtgctgtggttactccgacggcaatggcttcttcggtgacaaatttttcaacccagaccagtggatattcggcctcaccaagatggccacccttttcaatggtgtcactaatgtcgtgggcatgagcttgaggaatgagctccgggggcccaaacagaatgtcaacgattggtacaagtacatggtgaagggagcagaagctgttcatgcagcaaatccagatgttctagtcattctatctgggataaattttgacacaagcttgtcattcattcgggacagaccagtgagcctcacgttcaaagggaagctagtatttgaggtgcacaggtatggcttcactgatggtggagcttgggctgatgggaacccaaaccaagtatgtggaaaagtgactgcagatataaagcaaacatctaccttcttagtggaccaaggatggccattgtttgtgagtgaatttggtggagacttgagaggtaccaatgtgaatgacaatcgataccttaactgttttctggcactggtagctgagcttgacttggattgggcctattggactcttgttggtagttactactttagagaaggggttataggaatggaagagttttatggccttctcacttgggattggactcaggttaggagtaccagtttcttaaatagaatctctgccctccaaattccatttcgaggaccaggcatcatagaaggcagtgcatacaaactgatattccaccctttgacaggtctctgtgtcataagtaaatcacagctaacatcactaacgttgggtccttgctcttcttctgatgcctggacatacacacctcaaaagaccctattgataaacaatacaaatttctgcatacatgcagagcaagaaggaaagcctgcaacacttagcataacatgctcagatgctaactctaaatgggaaatgatctcagattcgaacatgcacctttcatctaaactaagcgacggttctaatttatgtctagacgtagatgataacaacatcattgtgaccactgcttgtaaatgcttgaaccaagataagacatgtgaccctgcaagccaatggttcaaacttattgatagcggaaggaggtcaatctcgacaacctcaacattatccatgctgaattcaccggacattttgtggcaaccattgagctctatataa

SEQ ID NO: 42347 - DNA, 276 bp, Glycine max
  Peptide Sequence Number=SeqID_159125
atgtggatagtaagtgaggacaagtatggttatcttcccattctcctcttttgcctccgtgtccggaagggattttttactttaaggggggtggagggtgggcaaatgttaaaaaaggcagaacccactgttttcttcgatgaagggataaaccctagcgccgcgaggccaaggcaacactcatctgaatttctgaactctcaagcgttgcgttctttgtcagttactaatgccgaaggacgtgtcaacgaaagcgtatacgaattgcaatgttga

SEQ ID NO: 42348 - DNA, 1146 bp, Glycine max
  Peptide Sequence Number=SeqID_159126
atggggtttgctggtaatgttgagccatgttttattgttcccacagtggttgcaattaacgagtcttttcttaatcaatcgaggaactcctctaaaggcaattgggttgcccagcataatgctggcgtaatggcagatcttgatttcttcattggggatgaggcactttccaagtctcgatctagcagcacttataatctcaactacccaattcagcatggccaggttgagaattgggacgccatggagcgcttctggcagcagtgcatattcaactatttgaggtgtgatccggaggatcactattttctcttgactgagagtccgttgacttcgcctgagagtcgcgagtatactggggaaatcatgtttgagacttttaacgtacctgggctttacattggtgtgaattctgtgcttgctcttgcagctggttacacaacatctaagtgcgagatgacaggagttgtagtcgatgttggagatggggctgctcatgttgtacccgttgcggacggctatgttattggtagtagcatcaaatcaattcctatttctggaaaggatattactctttttgtacagcagcttatgcgggaaagaggagagaatgtaccactagaggactcttttgaagtggcacggaaagtgaaggaaatgtattgctacacctgctctgacattgtgaaggaatttaataagcatgacaaagaaccagccaagtatatcaagcattggagaggcattaaaccaaggacaggggcaccatattcctgtgatattggctatgaacgatttctaggccctgagattttctttaatcccgagatatatggcagtgactttaccacccctttgccagttgtaatagacaagtgtattcagtctgcgccaattgacacaaggagatcattatacaagaatgtagtgttgtctggaggttcaaccatgttcaaggattttcacaggaggttgcaacgtgatctaaaaaaaatagtggatgctcgtgtacttttatctgaatcacgcttgaatggggagataaaatcgcagccagtggaggtaaatgtactcagcaatccaatccagagatttgcagtttggtttggaggatcagtgcttgcatcaacacctgaattttttacg

SEQ ID NO: 42349 - DNA, 216 bp, Glycine max
  Peptide Sequence Number=SeqID_159127
atgattgggacaattactcataccacaaggttctctgaacagggcatgggaaggacagaacagcctgcaaagtgtaaacagaggcaggccagaacagagaagagaatgcaaactgaagtgctgaccttggccagaaaatacaaggccactatccacacgatgctaggagttccatgtagtgactggcagctacaatgctcaaccatagcacaataa

SEQ ID NO: 42350 - DNA, 413 bp, Glycine max
  Peptide Sequence Number=SeqID_159128
atggaggattcaatcgggaaaataacaaagatcacatttcccagtcaagagggtctgctcttgacggtgaagaacacattggagaatggaggattcaatcgggaaaataacaaagatcacatttcccagtcaagagggtccgctcttgacggtgaagaacacattggagaatggaggattcaatcgggaaataacaaagatcacatttcccagtcaagagggaacacattggagaatggattcaatcgggaaaataacaaagaccacatttcccagtcaagagggtctactcttgacagtgaagaacacattggactggaagattcaatcggaaaaataacaaagatcacatttcccaatcaagagggtccactcttgacggtgaagaacacattggagaatggattcaatcg

SEQ ID NO: 42351 - DNA, 147 bp, Glycine max
  Peptide Sequence Number=SeqID_159129
atgactacagctggacgagaagtagagggatccatgagaaagaatgaaagggtgagtgagcgtgaagcagaggatcatggtcgtgaaaagcggaacaaggaagaaggtaaatatgatgacggtgagagaggctttaatcccaagtga

SEQ ID NO: 42352 - DNA, 432 bp, Glycine max
  Peptide Sequence Number=SeqID_159130
atgactgaagcacgtcaaaagggggtacggaaagtaaatgaaaacgagaataaaattgaagatcgaagaaaacgaagaatgaatgctaaatatcgaagaacagttgaaaatcttcgcataattacccacgaaaacattacggaagcacctcggcttggtttttcttcacggaaacaattttccttagcaattttaagagaatacgaagtgccaagaaggctagcccctttcctcttcactcctcctatttatagcaaaataggggaggagcttgccacccagctcgcccaggcgagcaaggttgcttcctccagaagcaaccgccttctgaggaagaaactggaaggcccaagtgggcctgatggctattcacaccccccctttttactaaatgcaccccctgtactttttttggtgattctttttccataa

SEQ ID NO: 42353 - DNA, 1572 bp, Glycine max
  Peptide Sequence Number=SeqID_159131
atggatgccactacaagcgaaaccccaactatccaattccataacatccctgatcagccaattactaccattgttgccacccaattgccaacacttcaaggccagcaagagcagcaacaccattgcttcggggactccagtccaggagagtttcccttgtctgctaatccctccatcgtccttcatgcaacatgctccttcttcaagcagccggcaaactttgctccagattttgacttgtccttgtcagagcttgctgcattggacatgtgccagaagagagccatttttaagccaatgacaacagaacaacggcaacatttgaagcaaagatgtggtggctcttggaaattggttctgaggtttttgcttgctggagaagcatgttgcagaaggagggagaaatcgcaggtaatagcaggtcctggtcatagcattgccgtgacatcaaaaggagttgtttattcatttgggtccaatagttcaggacaacttgggcatggcaccactgaagatgtatggcaacctcggccaatcagagctttgcaaggcatccgaattatacaagctacagctatgactgggaggacaatgttgatcagtgattctgggcaggcttatgtctttggaaaagaatcttttggtgaagttgagacgattgtaaatcgaggatctaaaattgttacaactccacagttagttgaatctttgaaaaacatatttgttgtgcaagctgcaatgggaaactatttcacggccgtattgtcaagagaaggcagggtttatacattttcttggggttgtgttggcaaactctgtcaccagactgatcaaaatgatgtggaaccccgtcctttattaggagctctggaacacataccagtagtgcaaatagctgctggattctgctacctgctttgtttggcttgtcaaccaagtggaatgtcagtgtactcggttgggtgtggtttgggtgggaagcttggacatggtacaaaaacgaatgaggagtatcctcgtttgattgaacaattccagctgttaaaccttcagcccatggcgattgctgctggttcttggcatgcagctgtggttgggcaggatgggcgtgtttgcacatggggttggggcagttatggctgcttgggtcatggaaatgaagaatgtgaattagtacctaaggtggtggaagagctgagaaatgtcaaagcagttcatgttgctacaggagatttcactacttttgtagtgtctgatagtggtgatgtttattcatttggttatggagaatctggtagtcttggccatgtccctgaaaatcatgagcaggaagacatgcatgaaaatgtgttaactccaaagctagtcacttggatgaaacagatcaatgaacgggtggtacagattagcctgaccaatttcatatattggaatgctcatacctttgctctaactgaatcagggaagctgtatgcctttggggctggggacaaaggacaactaggtgtagagcttggtgcccaccagactgaaaaaggaaagccagagcgggttgatattgatctgggttaa

SEQ ID NO: 42354 - DNA, 318 bp, Glycine max
  Peptide Sequence Number=SeqID_159132
atggcacgtgcaagccgtgttgtggttcttgccctggtgatgttcgccatgattgggttggcctgtgctgcacccgcaccagaggcctctgacgatgactatgaaggcgatgattactccatcggagccctaaccagcggcgcggcttcttcacccaacggtgtcgccgctgcacccattggtggacccgtgcctcccggtgctttcgacaatgctaagggtggtttagctcccagcgccgcctcttcctccctcgctcacttctccaccgtcgccggagctgcctctgctgctcttgccggcttcttctacttctga

SEQ ID NO: 42355 - DNA, 402 bp, Glycine max
  Peptide Sequence Number=SeqID_159133
atggctccattgtcgtcactccaaaatggtcaaggtggacccttgggtactagaaccctcaccttcagagggctacacgcctcgccttcagaggactacacgtcctcgccttcagagggctacatgcacgccctcagaggactacgcgtcctcaccttcagagggctacacgccctcaccttcagagggtttcatgccctcaccttcaaagggttgcatgccctcaccgtcagaggactacacgtcctcaccttcagaggactagatgtcctcgccgtcagaggactagacgtcctcgccttcagaggactacacgtcctcgccttcagagggctacgctctctcactttcagtgggatccatatccgcaccttaagagaatttaaggtcctctgcccttaa

SEQ ID NO: 42356 - DNA, 126 bp, Glycine max
  Peptide Sequence Number=SeqID_159134
atgttgagtgaagtgtcaccgtgtgaagatgaaccaagcgaaaaatggtgggcatgtaacaactcgatcgaatcacatcagaatgaaagggatccagagttgtacatgtatgagactatacagtag

SEQ ID NO: 42357 - DNA, 315 bp, Glycine max
  Peptide Sequence Number=SeqID_159135
atggctgaccccacaaaccaacacgatacttttcagtgtgctttgtcctcactcacatgctttttgggagatttcccaaaaggtcacccatcacacaattactccaagccaagcatgcttaactatgaaattcttagggtgttacatgcccaccaacttctacctggtttgtcctcgagtcacatcgtactgggagagaggtttgctctgataccatttgtaaccccccctgattttcaacttcttagaggttctcacactactacatgtggtgatacttcactcaacatccttgttggtcagaacactccgtag

SEQ ID NO: 42358 - DNA, 306 bp, Glycine max
  Peptide Sequence Number=SeqID_159136
atgacaggagttgtagtggatgttggagatggagctactcacgttgtgcctgttgcagacggctatgttattgggagtagcatcaaatcgattcctattgccggaaaagatattactctttttgttcagcagcttatgcgggaaagaggagaaaatgtaccaccggaagactcttttgaagtggctcggaaagtgaaggaaatgtattgctacacctgctctgacattgtgaaggttgtctttatttcaatactcagtactttgacagcattatttgaggagtttgtggtgtgcctctgccaatag

SEQ ID NO: 42359 - DNA, 747 bp, Glycine max
  Peptide Sequence Number=SeqID_159137
atgaacatctcactcacaaaaccattcatcctaagatgcttcctcatctccctcttcctctccctacccttcctcttcctcttcctccacctcctctctccgccgccacacgtcaccaccaccaccaacgacctaagaatccgacccggttactcctcctacgactcctacatccaacgccagctcaacaagaccctcaacccgcgcctccgaaaaatatggacaacccgcgactggaaccgcaaaatcccggttttcgcgcgcttcttcgaggaccttaaggataaaaaacttctcaataacgcgtccaaggcactctgcataggcgcgcgcgtgggccaagaggtggaggcgctgaggcgaatcggcgttagtgactccgttggaatggacctcgttccataccctccgcttgtcgttaagggtgactttcacaaccagccgtttgatgacggcacgttcgatttcgaattctcgaacgtgttcgatcacgcgctgtacccggaacgattcgtgggcgagatcgaacgcacgttgaagcccaacggcgtgtgcgtgctgcacgtggcgctgtcgagacgcgcggataagtactccgctaacgacctcttcagcgtggagcccctcgtagcgatgtttaagaactccgctctggttcacgttcgtagcgtcgatggttttggattggacaccgaggttgcgtttcgtaagaaccggtgtggtggtggtcgttgcggtgggttatga

SEQ ID NO: 42360 - DNA, 360 bp, Glycine max
  Peptide Sequence Number=SeqID_159138
aatatcgtgttgtctggaggttcaacaatgttcaaggattttcacaggaggttgcaacgtgatcttaagaaaatagtggacgcccgtgccctttcatctgaagcacgcataaatggggagataaaagcttgtcatacaaaggcagaatatgaggagtatggagctagcatttgccgtacaaatccgttacttgataaacagttgaatgaatatccggttattttgatcctcaattcccctcctggtctttcttctcacccgtattcgtggtggcaggacttagagattgatgaagttctgtattttttgtcattcagtgttgggactgacaattccattaaggacagtttcggagcatga

SEQ ID NO: 42361 - DNA, 625 bp, Glycine max
  Peptide Sequence Number=SeqID_159139
tgttgttgatgggtgctacctcacactactcataatctcatgcctcggtttgatcgtcacactcaaccgcttcatctccttcttcacatggatcttccgaacctgtttccgatccgagaagaatctcctccgaagctacggttcgtgggctctggtcaccggagccaccaacggcatcggaaaagccttcgctcaccaactagcgcagagaggactcaaccttattctcgtgagtagaagcttccagaagctcaaaaccgttgccggtgaaataaaagcaaaacaccccggcacgcgcgtgaagatcgttgagatggacttcgccggcgacctgacggagggtctccggcgcgtggaggaggcgagtgagggtttggatgttggcgtcttgatcaacaacgtggggataacgtatccgagggcgatgttctttcatgaggtggaggagaaagtttggaggaacattgttagagtgaacatcgaaggaaccacgagagtaacgaaaattgttttacgtgggatgttacaaaggagaaagggtgcgattgttaacattggatccggtgcttctgtggttgtgccttctcatcctctctttaccatctatgctgcttcaaaggcgtaa

SEQ ID NO: 42362 - DNA, 543 bp, Glycine max
  Peptide Sequence Number=SeqID_159140
atgaagtcaggtggcaggcggagatacccaagtggttatccgtataaatactctttcgctatccgtcagactcagaactcagagttcggtagcatgcagagactaacgtcgtcttctgcatcctttgtcatcctgacccgtgaagtcaagcggagatacccaagtggttatccgtataaacactctttcactatctatcagactcaaagtccggcggggtaccgtatggttatctgcacctttcgtcaaccaggggctaacgagcccgttgacgcacagagagtaacgtcgtcttctgcaccttttgtcatccagggacagcgagttaggtggcaggcggagataccttttggttgtccgcacctttcgtcaaccaaggcgaacgagttcgacggtatcaggatgatacattcaagcccaacgacgcacgagattcttctctgttgggcggggacgatcaagttcgatagcgtgtggaaacgtcatggtcccactgattgggatattggtcggccgaatgatgttccactagaacgaaattag

SEQ ID NO: 42363 - DNA, 204 bp, Glycine max
  Peptide Sequence Number=SeqID_159141
atgaaaaacaaagggaagcatgttcagcttatggattcttcttactctgattcatccaagaaccagtcagagtcttggtaccctcattataccaaaaagcgtttgattccagattccactgtcatttctacccgccctgcctctttgagatcagcaaagaagcttattgaaactagaggaacatctgtgcaggcccaagtttga

SEQ ID NO: 42364 - DNA, 966 bp, Glycine max
  Peptide Sequence Number=SeqID_159142
atggctacgctctctctcactctcaactgttggagtaccgtggaacttgctcacaccagattttcttctaccttcacctccctcggtcgcaggagtagatatagcatatgttcttttgccaagaagtcattgaagaaatccagaagagatgtaacagaggcagctggagatctcttagatgataagtttgttcagaatgacaacttggacacttctcttaatccagctgccccgaattctaaccctttaccttccaggagtgctgtgcttcaagcttgcataataacttgtggtctcatagctgctttgggaatagtgattcggcaggtgtctcatgttgcgtcagtggaaggattgccagtctttgactgctctacagaagtatcatttggctttgaaatgtggcatcttgagttgattacaggacttgtagtattaatatcatcatgtcgctatttgctattgaagacgtggccagattttgccaagtctagcgaagcagccaatcaacaggtccttagctcacttcagcctttggattatattgttgttgcatttttgcctggtattagtgaggaactacttttccgaggagcgattcttccacttttgggaatgaactggaatagtattgggattgctgccttgatttttggtgttttacacctaggcaacggtcgaaagtattcctttgccatctgggcaacctttgttggtcttgcttatggatatgctacaattttatcctctagtgttgcggttcccatggcttctcatgcagtgaacaacctgattggagggcttttatggcgtcaccacatctctatacatctaaccctccctgccccgagtttaatgttgtataagaattgtgatacagaagtcatagagttagagaccaatccaagaagtatgtttgcaaatgcagcaactaatggcagcactgctctctcctccattgtttaa

SEQ ID NO: 42365 - DNA, 2934 bp, Glycine max
  Peptide Sequence Number=SeqID_159143
atgcagaagcggttgaggaagtttgaactaactgcgaccgagggaggtgaaggtagaagaaaatctggtgtgagcaagttccacggtactccaacagttgagagtgagagagagcgtagccatacatacaacgagtatgagagcattgaccttcgacgcactggtgaaggaagggaagactttgtcgcactagtgacgcagaacggaaaggaagggaagatgattttagggttcgtcaccgtggattcggatccgcagaatttgcgtgacagtgctgcaattgcacccgtcatgcttcgcagatccctcatcgtagtaccctttctcttacacttgttgttctcgttcggatatgcggatcctgctcccaattgcactcgcctcagctccatcgtcaattcggagtctgagttcgaaatggttcaacaccaactccgaggatcgctcaaaatcaacgacgattgctcctttagggtttcccaattcgacatgcttcccggttccgacgtccactggtggggcgcgcaggcttccgatttcgttaatctcaccgctggattcattgtttccaacgacggattgaacggaacctacaacaactccaccttcgatgtgcatttgttgagcaatgtttcctggagcaagatcaacgtcctcgccgtctgggatcgcgccaccgcctctgatttcggccacgtcgtgctccgcaacgaggccccggcaacgacgccacctccgacggtgttcgagaattgcaaggttttatcgaagaatttcaggttgaggtggactttgaatgtgtccgaggattcaattgaaattgggttggaggctgcgactgggatcaccaattatatggcttttggttgggctaattccagtgctgaagattctgatctcatgattggtgctgatgttgctgttgcagggtttatggaagatggtatgccatttgtggatgattttttcattaccaagtatagtgagtgtgtgagaaatagtgatggagttgctcaaggggtttgtcctgattccttttatgaaggccctgatggggtgggtttagtcaacaattcaatgttgatttatggtcataggaaggatggggtgacctttgtcagataccgcaggcatttgactaaggtcgatgaaaagtatgatcatcctgttaaccattcggcgaatatgaaggttatttgggctttggggcgcattaagcctcctgattctattaatccctactatcttccccagaatcatggggctgtgaattatggtcatttggttctgaatgtctcggagcacgtgaatgaatgtacaggtcccttggatgctgaagataaagaagatcaaagtctcatcactgcagatgcaaaagttccattggtggtttcttctgctccagcaatgcattaccccaaccctccaaatcctgaaaaggttctttacatcaacaaaaaggaagctcctgtcttgagagtggaaagaggggtgcctgtcaagtttttgatccaagccgggcatgatgttgcactttatattacttcggatccgcttggtggaaatgctaccacgaggaatctgactgagactatttatgctggaggtccagaggcccacggagttcaagccagccctactgaattagtttgggctcctgacaggaacactcctgatcacgtctactatcattccttgtatgaccagaaaatgggttggaaggtcgaggtggttgatgggggtttatcggacatgtataataacagtgttattttggatgatcaacaggttaccttcttttggacattgtcaaaggattccatatctatcgctgttcgtggcgagaaaaaaagtggttatattgccgtaggatttggaagtggaatggtgaacagctatgtgtatgtgggttggattgatgatactggtataggacatgtaaacagttattggattgatggaaaggatgcttcaagcatacatcgcacaaaggaaaatttgacacatgtgagatgtaaaacagaaaatggcatcattacttttgagtttactcgtcccttggacccatcttgtaggctggaaaagagggtggaatgtaaaaatattattgatcccacaacttcactcaaagttgtttgggcaatgggtgctaaatgggctaatgatcatcttactgacaggaatatgcattctagtacaagtaataggcctatcctcgtacacctgatgcgtgggtcagcagaagcagagcaggatctgcttcctgttttggctgtgcatggatttatgatgtttattgcatggggtatcctgcttcctggagggatattggcagccaggtacttaaaacatctcaagggtgatggatggtaccggattcatgtttacttgcaatactcagggttagtaattgttctacttgcccttctttttgccgtggctgagctccggggattttatttcagctcagcacatgttaaatgtggatttgctactatattgttggcttgtatacagccagtaaatgctttcctaaggcctcaaaaaccagcaaatggggagcaggcatcctccaagagggttatttgggaatatttccatggaattgttggtagatgtgctgttgttgttggcattgctgcactttttactgggatgaagcatctaggagacagatatgacgtggaaaatgtccatggactcaaatgggctatggcaatttggttcttaattggtgcattgattgttatttatttggaataccatgaaagacagcgaatagagcggcagatatctggaagaggcaattgggtgcttggtaatcttgaggaagatgattcagttgatctcttgaggccaaccagaacaactgcagataaacagttacaaccctctgcgaggatggaagtccagttagaaccgctgaacagataa

SEQ ID NO: 42366 - DNA, 147 bp, Glycine max
  Peptide Sequence Number=SeqID_159144
atgtctacttctagcaattcgtctataattccggtgtttaaagcgtcactttatgttgatgacatgcttgtgataagaagtaattttacttttgctggccagttgaaaatggaaatgcaagatatatttgactttgacatgtcttaa

SEQ ID NO: 42367 - DNA, 345 bp, Glycine max
  Peptide Sequence Number=SeqID_159145
atgttgggtacaccagcaataatgctgggtgcacctagcaacaccctaaaactggaagtccagcctggtcgcataggttgcaccgattatgcaacatgcaacaatgacccagaacccgcacttactgctatagctcgattggttcatcatggaatgttatttgttccaattggatacacattcagtgctggaatgttcgagatggaggaactgaaaggtggtagtccatatggttccgtggttcagaaacttatgctggtgatggttcaagacactcaactaagcttgagctggagcaagcattccaccaaggcaagtacatcgcctacatcacaaagaagctga

SEQ ID NO: 42368 - DNA, 1062 bp, Glycine max
  misc_feature (845)..(845): n is a, c, g, or t
  Peptide Sequence Number=SeqID_159146
atgggggatgtttctgaccggataggacgtcccacagataatggtcagattggcattattgatcctgattgtaggttgattggactccacttgtatgatggtttgtttaaagttattcccttcgacaataaaggacagctcaaggaagcatttaatataagtgctagtaactatgagcctatgaccttgattaaggattaccagttaccattgccaaagccctggcttgaggagctccaagttttggatatcaaatttctttatggttgttcaaagccaactattgtggttctttaccaggataataaagatgctcgtcatgttaaaacatatgaggttgcactgaaggataaagattttgttgaaggtccatggtcccagaacaatctcgataatggggctgatttattgataccagttcccccacctctttgtggtgtgcttattattggggaagaaaccatagtgtactgcagtgctaatgctttcaaggctatcccaatcagaccttcaattacaaaagcctatggaagagttgatcctgacggttctcgatatttacttggtgaccatacaggggttacgggactcaaaattgagccccttggggagacttccattgcatctacaatatcataccttgataatgcattcgtctacgttggttcaagttatggagattcacaggtgggacataacatattgacaatctctgatggtaaaatgcagctaataaaactaaatctacagcctgatgcaaaaggttcttatgtggaagtattggaaaggtatgtcaatttggggcctattgttgacttctgtgtggtagacctcgaaaggcaggnccaaggtcaggttgtaacttgctctggagcttacaaggatggttctcttcgtgtcgttcgtaatggaatagggattaatgaacaggcatcggtagaacttcaaggtatcaaaggaatgtggtcactgagatcctcaacagatgatccttttgatacttttctggttgtgagttttataagtgaaacaagaatcttagcaatgaatcttgaggattag

SEQ ID NO: 42369 - DNA, 354 bp, Glycine max
  Peptide Sequence Number=SeqID_159147
atgcatcatcactatggcaccaaaagggaaaggatgctccgtagacatcaaaacaaaaatggcaaagagctgttgaaagcaaaggatgcatgggaaactagtgtatctggttcaaaacatggtccaccatgttggatggctgtgcaatctgccattccaagtccacaagcccaatcaagagcattctgcaagtcagcttgggaaacaccagcaagagccacacaccaagttgtgccatcaatgaatgtagtgttgccttcaggtggtgacaatgttgtcactgggattgcagcttctgacttttgttgcaccacaattccccttgccgtggctatatatttttgccagacttag

SEQ ID NO: 42370 - DNA, 1647 bp, Glycine max
  Peptide Sequence Number=SeqID_159148
atgaaagacagatttcctgaagactcctccaaagggtggagaactccagattctgatatcttaaagctacagactacagtctacaaagttttgttggccacaggaggagggcatttggtttaccttgaaattggagatggcatattacaggaagtaaagcatgcccagctagagtatgagatttcatgcctggacataaatcccattggtgaaaaccccaatcacagtaatctagcagcagttggaatgtggacagacataagtgttagaattttttctcttcctgatctgagtctcatcacaaaggaacaattaggaggggagatcatacctcgttctgttcttctttgtgcctttgaagggatatcgtacttgctatgtgccctcggtgatggccatctcttaaactttatgttgaatactagtaccggtgaattaacagataggaaaaaggtatctctagggacacaacctataacactacggactttctcctccaaaaatactactcatgtatttgctgcatctgatcggccaactgtaatttatagtagtaacaaaaaattactttatagtaatgtgaatctgaaggaagtgagtcacatgtgtcctttcaattctgctgcttttccagacagtttggcaattgcaaaagaaggtgagcttactattggcactattgatgatatacaaaaacttcatattcgctctattccgctgggggagcacgcacgacgtatctgccaccaggagcaatctaggacttttgctatttgtagtttgaaatacaacccagctagtggtgaagactcagaaatgcactttgtccgcttgctggatgaccagacttttgagttcatatcaacttattctcttgacacttatgagtatgctattaatcaaaaaattcagctgtataagtgggtgctccgggatgatggtactcatgaattgcagtctgaatgtggacatcacggacacatcctagcactttatgtgcaaactagaggagattttattgtagttggtgatctgatgaagtcaatttccttgttaatctacaagcatgaagaaggtgctattgaggaaagagctcgtgactacaatgcaaattggatgtcagccgttgaaatcgttgatgatgacatatacctaggtgcagaaaacagttttaatctgttcactgttcggaaaaatagtgaaggtgctactgatgaagagcgaggtcgtcttgaagtggttggtgagtatcacctaggagaatttgtcaatcggttccggcatggctcccttgttatgcgcttgccagattctgatgtgggccagattccaactgttatctttggcaccattaatggtgttattggggtaattgcgtctcttccacatgagcaatatgttttcttggagaaacttcagtcaaatttgaggaaggtaattaaaggcgttggagggctcagccatgagcaatggagatcatttaacaatgagaagaaaactgttgaagccagaaactttttagatggagatttgatcgaatcatttctggatcttaaccgcagtaagatggatgaaatttccaaggcagtggacgtttcagtagaggagttatgcaagagagtagaagagttgacaaggttgcactga

SEQ ID NO: 42371 - DNA, 653 bp, Glycine max
  Peptide Sequence Number=SeqID_159149
atgcgatcagagaagaaaccatggtcgccactcctctgtgacgaactcatcgaggaaatcttgtctcgtcttcccgtgaaacctttgatccaattcaagtgtgtgtgcaaaggatggaactccctgatgtcagatccctatttcatcaaattgcaccttagtaaatctgctgcgaaggacgatttggaacaccttcaactgatgaaaaatgtatgcctcggatccatccctgaaatccacatggaatcgtgtgatgtaagttcgttattccattccctacaaattgaaacgttcttgttcaatttcgcaaacatgccaggctaccatctggtcggttcatgtaatgggttgcactgtggggttagcgaaataccagaaggataccgtgtttgtttctggaacaaggcgacaagggtgatatccagagaatcaccaacgctgtctttttccccgggcattggtcgtagaacaatgtttgtgtttggctatgatccgtcaagtgacaaatacaaggttgtagcaattgcattgactatgctctcacttgacgtatctgaaaagactgagatgaaagttcatggcgcgggtgacagtagttggagaaaccttaaaggttttcctgttcttgggactttacctaaagttggtggagt

SEQ ID NO: 42372 - DNA, 309 bp, Glycine max
  Peptide Sequence Number=SeqID_159150
atgaatgaagaacggacgaatggtgaagaacaagggaaaatcttcacatattggctcacggaaatgtctcggaagcgttacggaagcacctcggcttggattttcttcacggaaacacgaaaagttacggaaatactacagaagcctattagacttgtgtcataccctaatttcgtccggggattattacttgataatatgcaacctttgatcggtcgctttgagatacttggcatcctttgtttcacaatatgtgaagtcccgagacatgccggaaatcaaaaggaagcaggcttacgcgatccgtga

SEQ ID NO: 42373 - DNA, 330 bp, Glycine max
  Peptide Sequence Number=SeqID_159151
atgccgatctccccctgtggaagtatcagttggtctgtgtcgttccgacatagggatcgcgcccgcaagacacccagtggacccggagaagtccaacagggtcttggggtttctagctctgattacggacctttttcagttctacggagtgcctgtcgcccccagcaaggtcatcaggcccctactaatcaagctttcatcaagaagtactgcgcccccaggcaggcgcagggcgaaacaccacagcagcatggggatggctggcagcgggcaacaaacgcaccgccaccacctctagagttcatctcagctcatccacaaaaaggttag

SEQ ID NO: 42374 - DNA, 591 bp, Glycine max
  Peptide Sequence Number=SeqID_159152
atgagtattaccgagcggatcgcagtccgtttgcagcaactgcggtctttatttagcaataaggagaaaattatgagcgatcaaactgtcatcaatccaaccagcgctgcggcgcaacaggcattatcaccgctggagagttttgccaacgaaacggccagcacgtctgctgtgccggctgccgctgacagcgcagctgatagcgttgcccagccagcaacgccgccggcagccgcaacgccagctgcgcaaccggcagcgcccgccagcgctgagcaaccgtttcatgcggatgctccggtcgatctcgatcagcagctggcaacgcaggatacgctggcgaacggctcggccagcgcaggcgcctcggcggccgccacacctggcgtgcgcaacgcgcagaccgccgcaccggttgttgcccctgacgcgccggtggctgcgaccgccgccagcgatgcggtggcgcaggatatcagcgccggggtgaaggactttgtccaggccttcagctttgttgaacagggcgtgctgaagctgggcagcgccgcaaaggatgaactgattgcgctggcgaagaagtatctgtaa

SEQ ID NO: 42375 - DNA, 804 bp, Glycine max
  Peptide Sequence Number=SeqID_159153
atgtgtgtggattaccgtatagggcgtctccgcatgctatcgaacttaatcgtctctgatgataaaagggatttcgatagtcttcggataggaagggtgtgggcgaccatatgttgtctccacgcgtcatcggacttgtcgtctctggatgacgaaggtgcggataactatgaggtatctccacatgctatcggaccctcgagtcacgatagcagaattgagacttttttgcggtctcggccggaagacgttgacatctccgggaagggtgcagatgaccacattggtgcggataaccataaggtgcgtccgcgtgctaccggacccttgggccacgatagcagaattgagactttttcgcggctcgcttgcctttggttaacaaaggtgcagatagccacaaggtgtgtccgtgtgctaccgaacccttgggtcacgatagcagaattgagactttttcacggtctcagccgaaagacgctgacatctccgggaagggtgcaaatgaccacattggtctctgcgtgtcaacgggctcgcttgcctctggttgacaaaggtgcggataaccatgagatgaccacattggtctctgcgtgtcaatgggctcgcttgcctctggttgacaaaggtgcggataaccaagaggtatctccacatgctatcggaccctcgagtcacgatagcagaattgagacttttttgcggtctcggctgggagacgctgacatctccgggaatggtgcagatgaccacattggtctctgcgtgtcaacgagctcgcttgcctctggttgtcaaaag

SEQ ID NO: 42376 - DNA, 348 bp, Glycine max
  Peptide Sequence Number=SeqID_159154
atgaaggaggtggttcaccgtctcttgtgcatttgtacacatgttataaagagaaacagaagaaacatgtctaaagacacgaaaaatgttagttgggaggctgccatgaaggctccattggagcttgaaggcctaggatcttcttcatcaatgtattcctttgcttcttggaagataaggaagagagagatgagacaccacttcaaggagaagatgagtctaaaagaagctcactaccataggaggtcacagataagagcttggaggaagaaggaaatgaatgaagcgagagggagagaagagcacgaaattttgtgctccaaaagagctctaaaatctgaagtttaa

SEQ ID NO: 42377 - DNA, 306 bp, Glycine max
  Peptide Sequence Number=SeqID_159155
atgaatagcttcacatctcaggatcaaaatttttctctgatagcaatgataaaacaagaagaggacacaatagggacaaactctggtgctgaaagagtttatacaaagtatatgcctggagctagtgagaaagtagttgatcctaccctgtctgatgaaatggatgaagacaaactcaataggatggaagatgagtatagagttccagagtatgtatccattgatacaatgaccaagagtctggagaaaaagaagaaggttgatcttgctattggatggtccagtgctaacaaacttggtccttag

SEQ ID NO: 42378 - DNA, 591 bp, Glycine max
  Peptide Sequence Number=SeqID_159156
atggcaagtataggaggaagccatactagtagccaaagcaaccagaaccaaggcataatcaacacgcatgaggatgttgcaagtctgaagcgattgtttgaagatgaacacatcgagcgagagaaactgaaggcacaaatggcgaagctaatggcggcggtgtcaaacttatcgagcaccgatcatggaagcgaaaatcatgaccatgcaggatgtcataatcacgattatatcgatcgagagttaaagtggcagaatcttgagattccaatttttgacggagaagatccttcgatgaaccaaagcccctatgagttactacttagtctaaaacatgaaggaatggtagaagaatattgcaagaagtttgaattgtatgaaagtccactgagaggaatagaacctgagtatttgaaagggatatttctgaatgggcggaaaaaggtgggtacatcctttgtggtacaagtagagggtacatctacttgggttgttgtgactgagaacaagagagggtacatctcttgtggatcagttcaagtggagagtgtagaagcaaagcttcatggtgaatcaaaaggtgattcaaag

SEQ ID NO: 42379 - DNA, 306 bp, Glycine max
  Peptide Sequence Number=SeqID_159157
atggtggcgtctttggtgctctctagagctcctcctctgattgttctgttagggttcttgtgcgaggcactggaaggtgcacttgagagagggggtgtggtagtaactgaaattattgaggccgaggatgtcgttgccataatgcttgagggagagggagacatgggagccgacaaagacagtaaagtcgatgacgaggatggagaggttggaaagggaggagcgacgagcaaacttggcaacgcgcttctcctagtgggagtcaccccaaaagttgcagatggagcaacgataaggggaagctaa

SEQ ID NO: 42380 - DNA, 1809 bp, Glycine max
  Peptide Sequence Number=SeqID_159158
atggggagagacggtgagattgacggcggagtgcggcggagaggatgcacgttcaggcggaacgacttcttcccggaggagtcgttcaagagttggggaaactacgctcgagcggtgctggagacgccgtggaggctgaaggatcgtgtggtgacgcgatcggaggaccagacggagttggtggagatgaaggctcgtagcaaccacgagatgaagaaaacgctgaactggtgggacctcatgtggttcggaatcggtgccgtcattggctccggcatattcgtcctcactggcctcgaggcaaggacggcggtcggacccgccgtcgtgctctcctacgtcgtttccggcgtctccgccttgttctcggtgttctgctacaccgagttcgccgtcgaaattcccgtcgcaggcggatcatttgcgtacttaagagtcgaactgggagactttgtggcctacatagctgccggaaacatcctcctcgagtatgtaataggcggcgctgctgtggctcggtcatggacctcttatttcgccaccctttgtggcaaacaccctgatgactttcgtataatagcccacaacatgaaccccaactatggccatcttgaccctatagccattggagtcctcatagccataactatccttgcagtgtacagcaccaaaggctcttccatcttcaacttcattgccacaatctttcacttaattgtcattgtcttcatcatcatcgcaggcctcaccaaggccaacaccgaaaactacgccaactttactccttttggagttcgtggtgtgttcaaagcttcagctgttcttttcttcgcttatgtgggctttgatgctgtctcaaccatggctgaagaaacaaagaaccctgccagggacattcccattggtcttgtgggctcaatggtaattaccaccttggcatattgcttgctagcagtgacactatgcctcatgcaaaactacactgacattgacaaggatgctccctactctgttgcgtttagtgctgtgggaatggattgggctaagtacattgttgcatttggggctttgaagggaatgaccactgtgttattggtgagtgcagtgggtcaagctcgttacctaacccacattgcacgtacccacatgatgcccccatggtttgctcatgttgatgagagaactgggacacccatgaatgccacaatctcaatgcttgcagctacagctgtgattgctttcttcactgatcttggaattctctccaaccttttgtcaatttctactcttttcatctttatgcttgtggctttagcgcttctagtgcggcgctattattcaagtgggttaaccacaaaagagaaccaagtgaagctcattgtgtgccttatgctgattttggggtcttcatgtgctatttctgcatactgggcaagcagtgatggttgggttgggtatgcagtttctgtgccgttgtggattttagggactgggggtctttggctttttgttccacaggcaaagcaaccgaaactttggggggtgcctttggttccatggctaccttctttatctattgctattaacatattccttcttggctctattgataaagattcatttatcaggtttggggtctggacagggtttctcttggtatactatgtgctattggggttacatgcttcttatgacacggcaaaagtgttcgagagcaagaaaagttctgtggatgttgacaagcagtggaataaggtggaagaaggagcaaaaggggaagtatctcttacagcagtttcaaatgattga

SEQ ID NO: 42381 - DNA, 231 bp, Glycine max
  Peptide Sequence Number=SeqID_159159
atggagcttgaacgggcccaaacgacgaatggattgggggttctgggtggcaaggtgcacaacgtgggtgaaggggacgacatcgaagagcttgcaaaggagagtagagtcgttaaggtcgaagtccacggtgaagacgccgacacgattgaggagaatgccccaaccacatgggatcaacatgggcttaaaggagcactcaaaccgagtatctttacccccaaggcctag

SEQ ID NO: 42382 - DNA, 171 bp, Glycine max
  Peptide Sequence Number=SeqID_159160
atggatattcaagcacagccaaaggtttctgctcaggagggcactcaaaagactttgactgaacatcgaacacagaccaataatgtgcaaattagaactaaaccaatgataagagtgagaagacatgatcagtccaagaaagaggaggttcagcaggcacagggcaactaa

SEQ ID NO: 42383 - DNA, 396 bp, Glycine max
  Peptide Sequence Number=SeqID_159161
atggacaatgaaggtgatgaggttaattctgttggacaaagctcatcattggacacagttgaagttgaaggatatcaagtaaggccggattggagtccatcactggaagagatactcgaggcaaggcagattcttaatcagtcttccatgctaaaagagaaaaaacatatcagcaaaaagatcattgaaactgtcaagagagaattggaagaatgcgttgaagaaaaaaatgcagtggcagcaaagtttcaaatattatgtgataaagagactgcttgcaaggagtcactggctagagcagaggatgagtatgctaagatatctcaaactttcacagatgctacatctaaagtgagacaattcgctaattgctctttagccaatggtttgctttag

SEQ ID NO: 42384 - DNA, 312 bp, Glycine max
  Peptide Sequence Number=SeqID_159162
atgtggatgagttcagttgaccaacaccttagaaacaactttgaaaaggacattacatatactgatgggtctaaagtcccgaatggatgcaagagaatcaaccttagggataagagtctccataagagaaacgtcaatctaaccagacccaaaagcagaggccaccaaatacaaaacatcctcaacaactatatcccaataagttttaaagaaaattggttagctctaagtgttactaaccatatcattatattgaggatgagagatccaggttgcctgaaagtggaaagatttgacttttttacttcttga

SEQ ID NO: 42385 - DNA, 513 bp, Glycine max
  Peptide Sequence Number=SeqID_159163
atgggtaccaagcacctcacaaggaccaaagaaaggtcgcatgtcatcaagcaaaggtccccggacgaaattagggagcacctcactaggacttggaaacgaggatttgacatattagacattggcaataatttctatatggccaagtttgatttggaagcagacagaaccaaagtcattcaagaaggaagccaattagagtggattctaacacctcagatgcaaggaagagttcctttgctagaggaatgcccttcgaatatcaaggtggttgcacagggcaatgctacgacaaacaatactctgctgacggaagaagaaccagcggtggcgccggtgactgagaatgagataattaatcaaaaatcggttacaaatgtcaatattatgggcaatcatggaaagaatattgaggaaattaaagctaatgaagagacaaatcaattgcatggggattggttggttgtcaaacgcaaatccagcaataaatctaccaagaatcatggaaaatga

SEQ ID NO: 42386 - DNA, 1272 bp, Glycine max
  Peptide Sequence Number=SeqID_159164
atggccagcctgctgacgcgtttttacgatatcaacgagggcgagattctgctggatggtcacgacctgcgggaatataccctgcgctcgctgcgtaatcaggtggcgctggtctcgcaaaatgtccatctgttcaacgacaccatcgccaataacatcgcttatgcgcgcaacggtgaatatacccgcgagcaaatcgagcaggcggcgaccatggcgcacgctatggacttcatcaacaagatggataacggtcttgatacggtcattggtgaaaatggcgtgctgctgtctggcggccagcgtcagcgtatcgccattgctcgtgcgctgctgcgtgactgcccgattttgattctcgatgaagccacttcggcgctggataccgaatccgaacgcgccatccagtcggcgctggacgagctgcagaagaaccgcacgtcgctggtgattgcgcaccaagggcgcttatgcgcagctgcacaaactgcagttcggtcaatgattgaacgtatctggagcggacgctcgccgctgtggctgctgttgtggccgctgagtctgctgtatggcgctatcacctggctgattcgcctgagctatcagcgcggctggcgtatccgctggcgcgcgccctgtccggtcattgtcgttggcaacctgaccgcaggcggcaacggtaaaacaccgctggtgatttggctggtgcaggcgctgcaacagcaggggctgcgtccgggtgtggtgtcgcgcggttacggcggtaaggcggaacgctatccgctgctggtcaatcaggatagcgcgacggaacaggccggtgatgaaccggtgctgatcgcccagcgcactcaggtgccggtcgcagtggcaccgcagcgccggctggcaatcaaggccctgctggcggcgcatccgctggatgtgattgtgacggatgatggcctgcagcactatgcgctagagcgcgatcgcgaaatcgtggtggtggatggcgtgcgtcgctttggcaacggctggtggttaccggccggaccgatgcgtgaacgcgcatcgcggctggagcagcgcgcaggctggcgagatcgccatgacgctgcagccgggtctggcggtcaatctgctgaccggcgaacaggctgcgctgacgcagctgccgccaattgtcgcgatggccggcatcggtcatccgccgcgtttcttcactacgctgcagcagcagggcgtgcagccggtggcagagatcgcctttgccgatcaccacgcttatag

SEQ ID NO: 42387 - DNA, 283 bp, Glycine max
  Peptide Sequence Number=SeqID_159165
atgcagagccaagttgtgtgcaatggttgtaggagccttctgctttacccaagaggagcaaccaatgtctgttgtgcattgtgcaacacaattacctctgttcctccacctgtcagactccattttgatgtttattctgaggacctttgccataataatggccctgcagggatggaaatgtctcaactttattgtggaggttgtaggacattgctaatgtacacacgtggagctacaagtgtgagatgttcctgctgtcacactgtaaaccttgttccaccag

SEQ ID NO: 42388 - DNA, 585 bp, Glycine max
  Peptide Sequence Number=SeqID_159166
atggcctcagaaaatggagacaaactagaacttgctttcagtgttgttcctgatcccaagcccaagaaggattgggtcaatttgtcccttagggtggtcgcatttttggccacagcatctgctacgcttgttatggcattcaacaaacaaaccaaaagcatggtagttgccaccattggcactaacccagtaacaattactcttactgcaatgtttcagcacactccagcttttacattcttcgtgatagtcaatgcaattgccagtttctataacatggtggtgataggagtggagatattaggaccacaatatgattacaaagaacttcgtcttggactgattgcaatattagacgtgatgacgatggctctagcagcaactggagatggtgcagcaacattcatggcagaattaggaaggaatggtaattcacatgcaaggtgggataagatatgtgacaaattcgaagcatactgcaaccgaggtggtgttgccctcattgcctctttcgttggcctcattctcctcctcgttgttacagtgatgtctatcaccaagatgctcaagctaaatcgcatttag

SEQ ID NO: 42389 - DNA, 1206 bp, Glycine max
  Peptide Sequence Number=SeqID_159167
atgtggatggtttttatatgttatatgacttcttttgttttctggggtttggaaagattggaaatttctcaccctggtggtggactggataatcctcttaggcataagccagaaatggaaaacacacttgagtctcctggcagttcacggcatagaaagatatcagccagatgggatccagttgacgcatgccggcctatagtcgatgaagcacctgtgttttatccaactattgaggagtttgaagacacacttggttacatagctaagattcgcccccaagctgaactttatggcatatgtaggattgtccctccagcttgctgggtaccaccttgccctcttaaggagaaagatttatgggaaaatgcaaaatttcccactcgtattcagcaaattgacttgcttcagaacagggagcccatgagaaagaaaattaggggaaggaaacgaaaacatagaaaacagtcaaagatgggcatgggtaggagaactgccaaatcaggttctgaagctaatgttgcttctgagcctgaggagaagtttggattccaatcagggtcagacttcacacttaaagactttcagcaatatgctagtgtttttaaagattgctactttggattgaatgatgccaatgaacatgaaaaagttagtgataatagtcaccagcagagatggaagccctctgtggaggaaattgaaggcgaatactggcgaataatagagcaaccaactgatgaggttgaggtgtattatggagctgacttggaaactggatcacttggaagtggttttcctaagatatcatccttaactaagaacgagtcagatagatataccttgtctggttggaatctgaataacttcccgcgactgtcaggttctgcattatgttttgaaggaagtgatatctcaggagttgtagttccatggctgtatgttggaatgtgcttttcctcattttgctggcatgttgaggaccatcacctctattcacttaattatctgcactggggtgacccaaaagtatggtatggaattcctggaagccatgctccaggtctggaagatgcaatgagaaagcacttgcctgatttatttgaagaacaaccaaatctactcaatgaattggtatactactcgcaattgtactttcctcctaaatttcagttttttggttgctttcattctgtttcaatatag

SEQ ID NO: 42390 - DNA, 204 bp, Glycine max
  Peptide Sequence Number=SeqID_159168
atgtcattgcctagcgctgttcatgtgtctccattatcaagtgcgaagcttctggtgactgggaagcacgttattctgttgttttccagatcggttccttcgccaaaagaaaaaagaagaagtagagatgagagtcgtcatcacggaaagggcaggacggacgaaatcagtgtcctatctttgctttcctcttatcttcgatga

SEQ ID NO: 42391 - DNA, 294 bp, Glycine max
  Peptide Sequence Number=SeqID_159169
atggaggaacataaacaacagctggcacctaagccagcacttgaacctgtttctgattttgtagaacttgaagagattaatgaggagactgaagatgacaaggaagaagagacaccaataaaagaaattgtggtggaaggcaattgtagtgttgtgattcaacacattcctccaccaaagcacaaagatcctagagttgtcacgataccgtgttccattggtgaggttgctgtaggaaaagctctcatagacttgggagctagtatcaacttaatgcctctttccatgtgctaa

SEQ ID NO: 42392 - DNA, 735 bp, Glycine max
  Peptide Sequence Number=SeqID_159170
atgaattgcgttttcgttcatgtgtcctccacccacgagttgggagccaggtgtagtgatagcttagtgcaattctccattctcaatctttttcggagccctatgcattgcgttttcgttcatgtgtcctccaccttcaagtttggagccatgcgtagtgattgcttagtgcaattctccattgtcaatctttttcggagccccatgaattgcgttttcgttcatgtgtcctccacccacgcgtttgcagccatgcgtagtgattgcttagtgcaattcttcattgtcaatctttttcgaaaccccatgaattgcgttttcgttcatgtgtcctccaccttcgagtttggagccatgcgtagtgattgcttagtgcaattctgcattgtcaatctttttcggagccccatgaattgcgttttcgttcatgtgtcttccacccacgcgtttgcagccatgcgtactgattgcttagtgcaattctccattctcaatctttttcggagccccatgaattgcgttttcgttcatgtgtcctccacccacgagttgggagccaggtgtagtgatagcttagtgcaattctccattctcaatctttttcggagccctatgcattgcgttttcgttcatgtgtcctccaccttcaagtttggagccatgcgtagtgattgcttagtgcaattctctattgtcaatctttttcggagccccatgaattgcgttttcgttcat

SEQ ID NO: 42393 - DNA, 122 bp, Glycine max
  Peptide Sequence Number=SeqID_159171
acaaatctggtgcagctgcaattccagttggagatttcagaagccttgatgttgctgatggaattgtggttgtggaccatactgttgaactttctgtttcagggcttgctatggtgtcttga

SEQ ID NO: 42394 - DNA, 402 bp, Glycine max
  Peptide Sequence Number=SeqID_159172
atgaattcgtggggctccagtctcgatggtggaggatgcatgaatgacaatcaattcatggggctcgggataagatttgaggttggaggatggatgaacagcgctaggcaatcaatttatggggctctagactcgatggcaatcaattcgtggggctccagactcgatggtggaggatgcatgaatgactatcaattcatggggctccgggaaagatttaaggtggaggatagacgaacaacgctaggcaatgaattcgtggggtccagtctcgatggtggaggatgcatgaattacaatcacttcgtggggctcgagataagatttgaggttggaggatggatgaacagcgctaggcaatcaatttatggggctccagactcgatggtggaggatgcatga

SEQ ID NO: 42395 - DNA, 1836 bp, Glycine max
  Peptide Sequence Number=SeqID_159173
atgtggctcctgttgactggcttctgcatggccagaatgctgccgagctttacagttcgcagtgccgaagccgtgcatgcccttgcagatttaactcttcatggaaaagaagatctaaaatatataaaatggagaagcgcttgtgggaaagatggagttcttaccaaagcagttaagataaggataactatggaaaaggagaggcttgactgtattccaactcatttaaagatgctgaagatggacagttgcaagtgctctcctgactgttattcttgtctcaaacattcaaatttgttttgctcatgtgaaatgaacaacagatttattctgtttcgttatactatggatgaactaagtacattggttgaagcattagaaggagaatcgcatgctattgaagtgtgggcaaatagaaacactgtaatggtttctgctgatgctgaggatgcttgcatttataaacaagatgtggagagtgccatttgccaaacccagagttacaaagaagggaaaaactcaacttattgtgcaggaactaatgataagtcaaattcaactatacctagcagttcttacagccaaatttcagcagaattggttcactcagagtttcaccatgaaactcttagtgcaccatctgacactaaagattgtcataaagatagtttgaatgaaaaagatttggccatggacaataaaattatggtgggcacaggaggttctgtggatttgaatattgatgttatgtctggtgaacctgaaaattattttctgcatgctgctgattaccatcataataagggtgttccatatgtggaaaaagtctgctttgcagagaccagaaaagaacaagacaacatggaacctggggctgattgtattgcttccttggagaaagaattttcatcttgttcaagggatgttcaaaattcttgtacacttgatggctataaattgtttggggtggatttgcagatgcattctgattcaggagagcaactcaacagtgtatctaaaatgggcgttgtcgaaacctccaatacaagtatatctttgacaaaccaaagctccttaatgaataactttggtatttctgttgagcctgtaaatttgggctctgttatgtgcggaaaactgtggtgcagtaagcatgcaatatatccaaaaggattcaagagtcgtgttaagttatttagcattcttgatccaccaagaatttgtaattatgtttctgaagtctatggtgctggatttcttgggcctattttcaaggttaccatggaagaacgtccaaatgaggctttcacaaacacctcagcagataagtgctgggaaacagttcttgacagactaaatcatgaaatcaagaggcgaaggagtcgaggtgaaatagaacttccacccttggaacttctgcaaagcattaacggtcacaaaatgtttggattcctttcaccatccattattcaggccgttgaagctgcagatcccaaacatcaatgcgtcgagtactggaatcacaaagaagttgtctctgagtcttcaggcagtgccattgatgactgtaagttcagtcatggttcaagcaactccctaggtgatgtcaagaccaaactttttggtgccggtttgataaagcaggagcaagatagcatcataggaaattgtgattcttttgaagagatgaaattggtgctacaaggattcttgaaaaaggcaagtcccaatgaattaagtgccatgcataagttattcagctctgatgcactgttcactcagtggagaacagcatttgtatcactgatagaggaaatccagaaagcttgtgcataa

SEQ ID NO: 42396 - DNA, 264 bp, Glycine max
  Peptide Sequence Number=SeqID_159174
atggcgaaagaacccgattctagctactaccacttttttttcgtgtccacaaatccagtactactaaggtggggtagggtggcgtgggagagagagggtggggcggacgggcggcacggcgacttggatctggatggggtggaatgggtgatgcggcgcaacccaaaggagaggctggggtggggtggcgcgggagagaagtctgaggggaaggtgtgtagggatttgggcaaaagaaggatttcacaaggaatggtagtgtga

SEQ ID NO: 42397 - DNA, 732 bp, Glycine max
  Peptide Sequence Number=SeqID_159175
atgcattgtgaagctgaagcagtagaacatacgaacaaaagagatacaggccatcaaaatgtggcattggacaataagacaggagattcaactatgctgaagatgggagattcagctaaagttgtgatcaaacaagacatgaagggaagaaggcataaatatgggtttaacaacaatgaacgaactaaagaattcaaaatagctagtaataagagggatttgttttttggattttctgagcaccaagagcggctatgcaagaagtttgcacttgaggagggaaggatatttgcagctaatgaacaacacgaagacctctccgaaatcgcacacggtggtcaatatctcagcatatcagtgttacagttgtggattctacatctcactgaaacatgtatgcgagcggggaattctgatatctatggattcctcgagcctcagtccattcagaggtctgggcaatcgcagtttgaatctgaaagttacataaagagttggatgcagagttcacaacgcgatgtgtatcttggagcctacctaaatgggttccactgcagcggacattggcagatggtggtcatcctacccaaggaacacttagttgtctggttttgttcattgcataacaggccagacaactaccttaaggggattgttaatagtgctatcaagggtcttgatgatgctccacatcctaaatcaatggctcctgctaggtggattgtcgtcaag

SEQ ID NO: 42398 - DNA, 2837 bp, Glycine max
  Peptide Sequence Number=SeqID_159176
gctttggactctcaggtcacttaagcccttatgttggtaacctttcctctcttcagtctctccaattgcagaataaccaattcagaggagtgattcctgaccaaattggcaacctattaagtcttaaagttctaaatatgagctctaacatgttagaaggaaagcttccttcaaacatcacccacttgaatgagcttcaggttcttgatttatcctcaaacaagattgtcagcaagattcctgaagacatcagcagcttgcaaaagcttcaggctttgaaactaggaaggaacagcctctatggtgcaataccagcttctctaggaaacatttcttctctaaaaaatatcagttttggcaccaactttctcactggctggattcccagtgaattgggtaggctccatgatttgattgagcttgatctcattctcaacaatctcaatgggactgttccacctgctatattcaacttatcttcccttgtcaactttgccttagcttcaaactctttctggggtgagattcctcaggatgttggtcacaaacttccaaaactcatagtgttcaatatatgcttcaattatttcacaggtggaattccagggtctttgcacaacctcaccaacattcaggtcattcgtatggcttccaaccatttggaaggaacagtgccaccgggtttgggaaatctcccatttcttaaaatgtataatattggttataacaggatagttagttcaggagtaagaggtttagacttcattacttctttgacaaacagcactcacctgaactttctagcaattgatggaaatatgctggaaggtgtgattccagaaaccattggcaatctctccaaggatctctcaacactatacatgggacagaatcgtttcaatggaagcataccctcctccattggtcgtctcagtggcttgaagttgttaaacttaagctacaattcaatctcaggagaaatcccacaagagttaggccagttagaggaactacaagagctatctctggctgggaatgagatatcaggaggtattccaagcatacttggtaatctcctgaagttaaacctggttgatttgtcaagaaataaacttgtggggagaatacctaccagttttgggaatttgcaaaacctgctttacatggacttatccagcaaccaactcaatgggagcatacctatggaaatcctcaatctcccaactttgagcaatgttctgaacttgtcgatgaactttttgagtggaccaatacctgaagttgggagattgagtggtgtggcctccattgacttttccaacaaccaattgtatgatggcatccccagctcattcagcaattgtctcagcttggaaaaattatctttggccaggaatcagctttcaggtcccattccaaaggctcttggagatgtgagaggcttggaggctttggacctgtcttccaaccaactctctggagccattcctattgaacttcaaaatttacaggcgcttaagctcttaaacctctcgtacaatgatttagaaggagctattcctagtggtggagttttccaaaacttttctgccgtcaatttagaaggcaataaaaatctctgcttgaacttcccatgcgtgactcatggccaaggaagaagaaatgtaagactttacatcatcatagccatcgtggtagcattaatactgtgtctcacaataggcttactaatatatatgaagagcaaaaaagtgaaggtagcagcagcagcatctgaacagctgaaacctcatgcaccaatgatctcttatgatgagctccgtttggcaactgaggagttcagccaggaaaacttattaggagttggaagctttggttcagtttataaaggccatctaagtcatggagctactgttgcagtgaaagttcttgacactctaagaactggctctttaaagagtttctttgcagaatgtgaggccatgaagaactcaaggcatcgaaatctggttaagctgatcacatcatgctctagtattgactttaaaaacaatgattttctggctctggtgtacgagtacctgtgcaatggtagcttggatgattggatcaaggggaggagaaagcatgaaaagggaaatgggttaaaccttatggagagactgaacattgctctagatgttgcttgtgcattggactacctccacaatgatagtgaaattccagtagtgcactgtgatttgaagcctagcaacattctattggatgaagatatgacagcaaaggttggagactttggactggctaggttgctgattcaaagatcaactagtcaagtttccataagctccactcgtgtcctaaggggttcaattggttacatacctccagagtatggatggggagagaaaccatctgctgctggtgatgtatacagttatggtatagtgttactagaaatgttctgtggtaaaagtccaacagatgagtgtttcacaggaggcctaagcataagaagatgggtgcaatcatcattgaaaaacaagacagtgcaagtgattgaccctcacttgctttccctcattttttatgatgacccttctgagggatcaaatgtacaactcagttgtgtggacgcaattgttggagttggcatatcttgcactgcagacaacccagatgaacgcattggcattagagaagctgttcgtcaactaaaagctgctagggactctctttcgaatcagtctgatgagagtcctacacttactagaaagagtcagagagagttggcaccgtacgatcctttacactttgcagccatgtttgacaaataa

SEQ ID NO: 42399 - DNA, 929 bp, Glycine max
  Peptide Sequence Number=SeqID_159177
atggcaataccattcaaaacaaatgatgtcagcgaggaaataacctctaaagacattaagagcctaatggaacaggcaaattataccaacaaatacttacaagcgttaggagaaaccataaaaactaaggtagttcctaaacaaaaatcaattgaggaaacttcgccaaaaatccccattgagaaacctttattcaaacctttcaaagttagtgagaaggctaaaagaaaaattagggaacttagaaaaaataaatccttaattgaaggcgtaggtgacaaccatagtgaattactaaacaagattggtagtttacttaaagtcattccagataccccccaagcctcggaaaatacttccaaaatggtaacaagaagtacctccaaattaatcaatgttattaatgaagatagtgaccaaaactcagataacacaactgagataggatcagtgtcagaaaagaatataaatccaattaattccaaacactggaaaacaccctccaaattatattatcaacgtccaactgcccctgaccttctattagaagaaagaggtgaaaacaattttaagagttttagtgcaaacaacatctatgaatggaacatagatgcacaaacggagtataacatcatgaatacactccaacatatgaccatggtggctacggcttaccaaacctcccatgaatgttcagaagagaccattatagatatcttagtggcaggattttctggacaattaaaaggatggtgggataattatctcactaacgaagagaaatcaaaaatttacagcgcagttaagacggatctcaatggaaaagtcattactaatgacgatgataaagagattcctgacgctgttaacacattaatttttacaatagcccaacatttcattggagacccatccttgtggaaagatag

SEQ ID NO: 42400 - DNA, 927 bp, Glycine max
  Peptide Sequence Number=SeqID_159178
atgaagactcagcgcagattcttcaacattcctgatcaaacacattcacctatgccaaaaccaacacaagaagccgctccatctgctgctccagtgaagaccttggggattctgaaaccagagggaatatctaggtacatagggaacaagattgaaccaaccatgcaccaacatttcacgacacactgggaaggaaaaaaagaagtgaaggccttgatgaaccaaaatgccagaaagtttgaggacttgtattttgggatccattctgttcctgtgaattttacaggctttatataccatagggcactcaaggctgcagctgcaataaggaaaaaaatccaatttctgatgccaagacttgaaataagcaacatcatcatggggttgatgaatttcagccacatgccaatagctattactcaagctttcatgatcaaacacattggacagaggcctgctatctaccagaaaatcttatccgagtatgctgatattaaaaaatccaaaggatccaatgcagcactagattgggacagcagacagaaattgaaatacacatgggttgttgcacaagagaccatgagactctacccaactgcaccaggtgcattgagagaggcaataacagatatcacctatgaaggttttactattccaaaggggtgggagaatcccaagtactttgatgaacccgaaagttttgatccctcaaggtttgaagggaatgttcctgttccatacacttggataccctttggagctggaccaagaacttggcctggaaaagactacgcacgtaatgtccaattgaccaaaagaaccgaaaggtcaacccaccaccacctgttgattctattaaggcacaacaattactacaccacgcccttgacaaggaaagaattcaaagatgaaaaaccatataagtaa

SEQ ID NO: 42401 - DNA, 1431 bp, Glycine max
  Peptide Sequence Number=SeqID_159179
atgattgaacttcgagaactggatactgcacgtgctattttaaggcaaacacaggtgatgggtgtaatgaaacaagagcagcctgaaagatatttgcgtcttgaacatctcctagttagaacttattttgatccaaatgaggcttatcaagactcaacaaaagagaagcgacgtgcacaaatagcccaagctcttgcagcagaagttactgtagtgccaccatcccgattgatggctttaattggtcaggctttaaagtggcagcagcatcaagggttacttcctccaggaacgcagtttgatttgtttcgtggaacagctgctatgaaacaagatgtggatgacatgtatccaacaactctttctcacacgataaagtttgggacaaaaagtcatgcagaatgtgcttgcttttcaccagatgggcagtttcttgtatcatgctcagttgatgggtttattgaggtgtgggattacataagtggaaagctgaagaaagatctacagtaccaggctgatactttagcagagattcagaaatgcttgcatctgggtctcaagatggaaagattaaagattttaggattagaatcccttcatctgtacagaaaagccagccaccctcaccccgtatttgcacctccatattcttctctcatcttttctggctaccaagtacttcccaacaacctgagtgttttctggccattagccaaacctgtccttttttttggtggccagagcttctgtactcaggtctggcgtattaggactggtcagtgcttgcggcgtcttgaacgtgctcattctcaaggtgtcacaagtgtttccttctctcgtgatggaagccagttattaagcacttcatttgacagcacagcaagaattcatggcctcaaatctggaaagatgttgaaagagttccgtggccatacatcttatgtgaatgatgcaatttttacaaatgatgggagtcgtgttattactgcctcaagtgactgtacaatcaaggtctgggatgtgaagactacagactgcatacaaacttttaagccacctcctcctttaaggggaggtgatgcttctgtcaattctgttcacattttccccaagaatactgatcacattgttgtttgtaacaaaacgtcatccatatatatcatgacacttcaaggacaggttgtgaagagcttctcatctggtaaaagagaaggcggagactttgttgcagcctgtgtttcacctaaaggagaatggatttactgtgttggtgaagataggaatatatactgcttcagctatctatctggcaaattggagcatctaatgaaggtccacgagaaggaagttataggtgtcactcatcatccccataggaatcttgttgcaacttttagtgaagactgcacaatgaagttgtggaagccatga

SEQ ID NO: 42402 - DNA, 572 bp, Glycine max
  Peptide Sequence Number=SeqID_159180
ttgggtctttaactgctaaagtgagtgacacagagacacagcatagcataagaaagatgagcgacgacgaaaggaagaagcaaatagcggagctgagcaaaagcctcaaagaaggagagaggctcgtgggcccaacgagacggcccgacggaaccctccgcaagcccattcgaatccgcgccggctacacccctcaagacgaagtcgccatttaccaacccaaaggagcactcttgaaaaaggagatgggctccgctgggcctcccgggtacgaaccagacgctgattccaagcccaagaccaagtccgttaagaggaacgagagaaagaaggaaaagcgcattcaggctgcgcttgaaaaggaaaagaatgtgagtgaagttgaagatagtggaaagcaggaatctctggaggcattgacctcacagattcgacttacagaagcattggagcagaaaagtgcagagcaagatctgaagccagagcagttggaaaagctagcaaaattagaagattggcgtagggagttaaagttattggaggatgagaagggtgaaacaaccgtatcatga

SEQ ID NO: 42403 - DNA, 881 bp, Glycine max
  Peptide Sequence Number=SeqID_159181
atgccgaaaatgggactcaaaaacttgttcttcttcaaagcatcaccatcgccaccttcctctcctcccacaagaaccttctccgattcactaatggaccaaaacatcgaaaccgctcgcgccatcatttcaaaatgggaacttatttccccttctgaccaaaccgcccctctattcagcaacacacgccaagaagccaaacagtaccttaacgctgtcatgagcctgcagtccactatgcagcacctcgtcgcactggattcctcctccgacaccctcgtccaagcccacttccttatgcaactcgccatgaagagactccaggctgagttctatcgaatattagcccaaaacagagacaatctccatcctgaatccgtcgcctccaccgatcaccggagcagcagcgtctccgatgacggctccgatttctccgacgatgagttccgcttcgccggcgactctgtctccacggtcgccatggcggacctgaaagccattgcggagtgtatggtttccgccggatacagcgaagagtgcgtcaagatttacatcttaatgagaaaatcaatcgtagatgagtcactgtatcacttcggagtggagaggctgagctcctctcagattcagaagatggactgggaagcgctcgagtccaagattaagtcctggctcaacgctgtcaagatcgccgtcggctctttgtttcacggtgagagaacgctctgcgactacgtcttcggttcaccggagaggaagaccgcggagtcctgcttcgccgcgatttgcagcgaaggggctacgtcgttgttcggattcccggaaaaagttgccaagtgcagcaagaaaacgccggagaaaatgttcaggacgctcgactt

SEQ ID NO: 42404 - DNA, 870 bp, Glycine max
  Peptide Sequence Number=SeqID_159182
atggctaatccacacattgcactgctgaaactcacctccatcttcattgtcatttttgcctcagcacctgaactgtgtggaagcaataagactttcactctagtaaattactgcaaggagacaatatggcctggcataacgcgcagtgacaaccacagtggcgacggcttcgcattgaaatcaggacaaacaactgtatatactgctccagatggatggagtgggaggatatgggctagaacaggctgcgactttgacaacaacggcaatggaaagtgcaaaacaggtggctgtggcaccagcataaactgcactggccctggaagccctccagcaacaagtgctgacttcacccttggtgaacctgatttctatgatgttagccttgtggatggcttcaacttgcctatagtagtgaaagctattaatggcacagggaactgcagcactgttggctgtgatggagatttgaggcagaactgcccttcagagcttgcttctaaggacaatgacaaagttattgcttgccggagtgcatgtgatgtcttcaatactgatgattattgctgcagagggacttatggaaaccctgcaacatgtttggcttcaaactactccaagatcttcaaacaagtgtgccctgcagcatatagttttgcacttgatgacccaacaagtctaataacttgttcaaaagcagactttgttgtgatattctgtggatcaaggaatcagacagcttgttcctatcaagacaagcaggttgtatgtaatcgaccaaataaagcctataaagccatacctcagagctggtgggtcctgatgctcctcccattgacatacgggttcaatttaaggatcacaccttag

SEQ ID NO: 42405 - DNA, 339 bp, Glycine max
  Peptide Sequence Number=SeqID_159183
atggcatcggcagtcctctttgaacggaacagttgctcaacttctggatctacattgaaagcagcttgcagaaccgaaggtgataaagccttccacacggaagaacttccagccaagtggctttcacggttgtctccaaaaccctacggtgaagattccattggaaccagtcagaaaaaagtcagtgaattcacctgccttgtgagccttggaagtgtccccaaggaacagaataaccaactcagtttcttccttgttgtaccaccacgtcacacaacaccaaaggggagtgccaaggcatcaatcacccttcttgattgcaacaaccttctcttctga

SEQ ID NO: 42406 - DNA, 745 bp, Glycine max
  Peptide Sequence Number=SeqID_159184
atggattctctccctgatgccattctccaatgcatcttgtcccgaatcactaatgctcgtgacgtgtcatcttgcaattgtgtttccaagcgatggaaggactccaccccctacgtcagaaccctctactttcctcgcagctcatttgacaccccttcttcttcttctgagggtgctgacaacatcatcaaaagaatggtgtcaagagtggtgaagttagaggagctaattgtgtataaccccttttcctctaatggccttgcatcatggctctcactggccgggcaaactcttcttcagctcgagctccgaatggaaaacctcgccgacaatcagggcttccatgaaagcccttccaaattggactatattggtgctgctaagaatttggagtctctgaaactgtggggtgtgttgatggttcgttcccccaaatgggatgtgtttcctaacctcaggaacctcgaaattatcggtgcaaggttggaggaccctgtgttgagtgtggtgctttgctcatgcccggttctcaccagtttgttgctgcttggatgtgaaggggttagatcgctctctatcgagttgccatgtttggagcagtgtaagctggatttttatgggaggggggactgttctctcactttgacttcccccaacattgagtcccttgaggtacaaggctgtagctggattagggtctctgaaaccaagcatttgaggaaacttttcatatcccacagtgcag

SEQ ID NO: 42407 - DNA, 814 bp, Glycine max
  Peptide Sequence Number=SeqID_159185
atggcgctgtctctatcagcgcatgcgctcgattaccaggaaaccattcttggtaaaaccactacgatcaacgccgccaattatggtgagctttctgaagccattaaagaagccaataagaacggcggtgtaattgttctggctcctgacgttcctcgcggcgagatgcctgtgaagccaaacgacaatacccgaattgtagatcagcgctacaacggcggcattgatattgtccgtggtaatcaccctcgtctcgagggtcagtggccgcagtatagtaatcttggtgttggattaggaaaaaacttcgttatctctgacgtcgtaccttatgacgccaaagtggagtcatggaaaggcgagccaatgaacccaaatgccgacaacccaaacaggcatcaggattcacatgaatattcaaactcacataaccactatcaaaacttccttagcgaggtttggactttctcccctaccgttaatggcgtatcaatatggggtgatagtggagcgttttaccctggagcaaaaacatggggtggattcttatcagcacgttcatggccggttcactgggaaaaatatgtccctgatggaactccgtcatttgaagataaagatttcgacgcgcagctggttggcttagaaattgacgtgcttaatggcggccttcctaacgggcaggtttccgagaaaattggacgccctctgtcaaaatctggtttacagattgtcggcttcggaaatactaacactgcagcaatcgaactgcgctctgaagattcagacgacatgtcgaaaaagccaggcgagc

SEQ ID NO: 42408 - DNA, 500 bp, Glycine max
  Peptide Sequence Number=SeqID_159186
gtatgccacctaccatgcaccctctaaacctagatacgtctaacagggccctggggtttccagtgttgatcacgggtctctgccagtcattcggggttcccgtcacacctagtaaggtgattcgaccgccgatcacccgggcctttattgagaagtattgcacgcctagacaggcgcagggtgatgcaccacaggccgcagacgcagcgccaccacctcatcaggctgatccggctgggtcatttggcacggagcggtatttacagcacttggttcgccagcaggcggccaaccacagggggcaggtgcagatacatgagtgtctctaccagctcagcctcaatcagcagagccagggtttcactccttttgcgtgccctactctagatcagttcagggctgaggtcgcatggtccggagattggcctgaggcccaggcagggaggcgcatgcagaggctcccggcgatgcagaggaggcccgcatggatgaggagatga

SEQ ID NO: 42409 - DNA, 567 bp, Glycine max
  Peptide Sequence Number=SeqID_159187
ccccgagatcacatagggcagcccgccgatctcgggcatcgccagcaacaccacgtccgcgcccatgctgatttcgctgagctggacacgccgtcacgattgatgtcggtgacgtccagcagcgccaacgccggcgccatgaaatacagcaacaggatgaacagcagcgaccagcacaccgaacgccgcgcttcctccaccgacgaggtggcacagcaccagcgccaggaaattgatgcgcatgttgcggcgctcgtccggatcgctggacgggaacggttccgcatgcggggtcggcggcgcggcccgggcctcgaaagtggccttggcctgcgaccaggcgatgcgcgcctcttccaccgtcggcggaaatgccgccagctcgcgttcgtccgagcggatctcgaccatgggcgcatcgctggcgttgagctgggccaggcgactgcgcagcttgtccttttccagcgcccaggactcgggcaggtcatggacccgttgcgccatctcgtcggcgcgctcatgccacaggcggcgcgcctcgatttcggcggggtcgttgcgcag

SEQ ID NO: 42410 - DNA, 264 bp, Glycine max
  Peptide Sequence Number=SeqID_159188
atgatagatggaggtgttgacgccaaaagggtggtggcagcagaggaggtggagacggcggtgtcgcggcttcattactatggtttaatcaatgttcttatttcttgtaggaatggtttgaactctggatattgcttacacagagagaaggagtggtgcaacatctcaactgcttcacatgttcttaagcgcatagatcaagaatcaggacttttgaggatattgctaattaatgctaacagagaggagtggtacaacatgtag

SEQ ID NO: 42411 - DNA, 327 bp, Glycine max
  Peptide Sequence Number=SeqID_159189
atggttaggcaaaagaacgtcgtggacgtggattcatgcagtgtgagggacagaagaatttcctcacggctgcatggtgtgaaaggaaaagttgataatcgattcatggtcgttgggtgcggttacaaggtacgtatcacggcctcgatcattgtattggattttatggtgatgaattgctggggttctgagggtggccaaggtgagtccaagagggttagtcttggcatgcaaggcagagaaactattcttgagaggggtgtgagtgaggtgaagcaagaaacattaactgattctgagggtccagccgttgaatcaataacatag

SEQ ID NO: 42412 - DNA, 254 bp, Glycine max
  Peptide Sequence Number=SeqID_159190
atcggtggaggccgatccaattgcgtgcgcagatgtcaaaggcagtggagtcaccggtgttggagttgtcaacaacaatggtggaggtggaggtggaagctcgcaacaggatactctagcaagcgacgatgacagaataggggatggagagcgagtagaagtgtgtgagagaagggaatggaattggagagagttgattcgcaaatggagtgaggaaaaggttagggttcatggaattgggggtgtacaaaaag

SEQ ID NO: 42413 - DNA, 306 bp, Glycine max
  Peptide Sequence Number=SeqID_159191
atggtcccgaaatctaccctaaggctcatgagaaccctagggccttctgttgcatctctggctcaatctacttggagtcttctatccaatgcccttgtggggctcttgaaaaggaccctgtgggctcagcgtgcatccaccgttaagcgcagcttcagcgcgcttagtgtgataagggaatctagaagagcacaaggatcaaggttgtctgctaagcgcgagatcagctcgctaagcaagacgcttgtctcttgccaggctcagcacacgattggcgctaagcccaaatctactaactcgcgctaa

SEQ ID NO: 42414 - DNA, 108 bp, Glycine max
  Peptide Sequence Number=SeqID_159192
atggatgatcaggagtgtctatggcctggggaagtgacctccattgcacttcggcggggtgttttcctaagagtagcagggagagctcaaggcacagcttctaactga

SEQ ID NO: 42415 - DNA, 414 bp, Glycine max
  Peptide Sequence Number=SeqID_159193
atggggaacagagctatgttaaccttgctactactcctcttcttctcgaccaatttggttccttccgcccttgctatctggctgacgttacccaccactggcactaagtgcgtctccgatgaaatccaacacaacgtcgtcgttttggccgactacgtcgttatccccagtgatcacgcccacaacctcaccatcgccgtcaagggagttacctgtgccgtggttctatgtaattctggttggctcttgaatgacaaccttctgatatcagctgttatagaggtgacatcaccgtatggaaacaatcttcatcacaaggagaacacaacacatggtagtattgcatttacaactcaagaggctgggaactaccttgcatgcttctgggtggatagccctagtcaggagtggtga

SEQ ID NO: 42416 - DNA, 417 bp, Glycine max
  Peptide Sequence Number=SeqID_159194
atgggaagtgtagtggaaaatgctgcttcttttgttgcttccaagagttgtattgagtttgaggctgcagttaattcaggcattgcttccagcaatgactgcaccgcctccatctctttcacaacacaaggttccacttctaagataccttcatccatcgttttcaccttaaccagcgcttattcttcttcaattcttctcctccctctcagggtgtatcattctccaatttctctccctccgcgatcgcaatcttcttcaattttttctttcagggtggctacaaccttgttcgattcttcttccaccgcggttgcgattgcaaccttttttggttcttctccctctgctgtatgcagcattggcatattgaatgattttgtttcttctcccatgaaagaaagagaaaaagagtga

SEQ ID NO: 42417 - DNA, 552 bp, Glycine max
  Peptide Sequence Number=SeqID_159195
atggataactcatctaccattgaagaaactgaggtaaatcgtgaatttgaagaagttttggaagcatttaatgaaatgcatgaagaagctcaaaggtttgttgttttgaacataaagatgaaaagcgatctaaaattgcatattactaaattggcttcaacaccaagtgagctagataaattaaagcaagaaaatgaaaaacttgtttcaaaatataaagccactggttgtgattgtaactccacttcttttaacatggatgattacaagtctttgcaaactgaatttgaaaatttaaaaaaggatcactatgctgaatgtatgaagttgcaaactgagctttcctatcttaaagatttgtttggaaaattaaataaaggaaagagtgatctcaatcacatgctcagcgtgcaaaaacatactaaagataagactggtttggggtataacaagcaagctaccttttccaagaaaactaagtttgtatcctcaaaaggggtgaacccaaacaaggtctccaaaaagaagaacatagtgcattctaagagaaat

SEQ ID NO: 42418 - DNA, 2568 bp, Glycine max
  Peptide Sequence Number=SeqID_159196
atggaggacagtgaaaggtttgaagaaaagtcattttcaaatggggatgtctacattggtaaaatcaagggcatgcttccccatggcaaaggaaagtacacatggtcagatggagcagtatatgaaggtgattgggtaaatgggaaaatgacggggaaaggactgattacatggccaacaggagcaaagtatgagggtgaattctctgggggatatcttcatggtcatggcacctttacacattctactggctgcatttatacaggtggctggaggatggatgctcatcatgggattggacgaaaggagtattccaattcagatgtatatgaaggtttatggaaagaaggaattcgtgaaggctgcggaaggtattcttgggagaatggaaatacatatattgggaattggaaaagtgggaaaatagatggcagaggggttatgaagtgggctaatggtgatatttttgacggttgttggttaaatggacttaaacatggatctggagtttatagatttgctgatggggggctttatattgggacatggagtaagggcctaaaggatggaaaaggaacattctatcctgctggtagtaaacaaccatctctaaagaagttgtgctctcttaacagcgatgatagtcgtttgttattgaatatggaaaaacatacagctccaaaacaaaaatttacacgtagtttttctgaaaagatttctgtcagtggtagatcaaaaagttctcgtcaaatatctcacaggacttcatcattagatgctaactgtatccttcaagatcctgctggaggttgcatatgtcgcgattcttcacccacattatcgcagacttttaatgaaagtcaatctgaggcaactagtgttaactctttggtttacgaaagggaatacatgcagggagttctaattatggagagaattaggaattattctgaaatgccacataaaaacaaacgtcaaaataagtatagtgtgaagcaagttaagaagggttcatggattgatatttttggaggcagccgaagctattatttgaagcttaatttgcagcttggcatcaggtacactgttggaaaaattacaccagtgcctgcacgtgaagttcggtcatctgattttggagatcgagctaggataaggatgtacttccccaaggagggttcacagttgactcctccacattgttctatagacttctattggaaggattattgccctatggtcttcaggaatttgagagagatgttcaaattagatgctgcagagtacatgatgtccatttgtggtgattctggtctaagggatatatcttcacctggaaaaagtggcagcatattctttctttctcaagatgatagattcgtgataaagacactgaaaaaatatgaactaaagtccatctttgacaatccatccacactagtaggacttgctagtgcgagtaatttgacgctgataccatgtcagaaaatggattatgagtctaactcaactctacaaatccgacttgttatgctcaatatgcttcctaaatattaccatcatgtaggaagttatgagaatactcttattacaaaattctttggtctccatcgaataacactaagaggtgggaaaaaggtacgatttgtggtcatggggaatatgttttgcacagaacttcatatccaccgtcgttatgatctgaaggggtctactcaaggaagatatacaaaagaagataaaattaatagcaatacaacattgaaagatcttgatctaaaatatgaatttcatatggataaaaaattacgagaatccctattcaaacaaatttctctagactgcatgttcttggagtctcagcacataattgattacagccttctgttgggattacattttagagctccggagaatttaaaggccttagtggaacctcccagactaatgcagcttccacatagcttaccctctgaagatggtatattcaagtttgtatttcaactgtcaagttcactacaaactgattctattctctctattttcttgcatttgtgcctcagtttctttcttttgattgagcacttttcgacttgctttgctttactagatgcacacaaacaaggggagcagttgattattcctaaaggcttgttattagttgctcatgaacctagctttgtgaacactgcacctggaccccacattagaggaaatacattgagggcatactccataggtgacaagcaagttgatcttttacttcctggtactgcaaggctgagggtgcaattaggagtaaacatgccggctcaagcaacacgcaaacttcagggggataaggtggaggaatcagaagtagagctttttgaggtttatgatgtggtgctatacatgggcataattgatatattgcaagaatacactgtgaaaaagaaacttgagcatgcctgcaaatcactgcaatatgaccctatgactatatcagtggtggaaccaaagacatatgctgaacgtttcatcaatttcatggagaaaaaagttttcccggagccagagacttcttga

SEQ ID NO: 42419 - DNA, 1953 bp, Glycine max
  Peptide Sequence Number=SeqID_159197
atggagtccatttttgtgattcttctgatctttatggtggcatcaaatccatgctctgcggcgccttctccttctccctctgcctctcccaccatttccactaccaacagttccacatgcccagtgtccatgaattatgtgcaaacagtcccttggaacagctcttcctgccaaaacttccaacccttggcatcacaataccaaacaaaaacaagtccttgttgccaaactctgctatccctctttggaatagcactttcacaaaacctcaaaaaaagctctcttttccaactccctaacctccctacctccagctcttgtcttcaacacttccaatccaacctcacatctctctcacttcccaacaaccttgtctcctcctgctttgatccatctcaatttgtcatctctccaaacatctgtgctggtattcaaaatattgaagattggcacactaggcttggtcctacaccagagctcaacactgcctgtggaccagacctcactgaccctaaccaatgcagaacgtgtgtggctgagggggacaaggttcagcagaggcttctttctattgatggtaatgattcacattccctagattgcttttacttcgcaacactttacctggctggagttgtcaatgagcttggccctgaaagcaaaggtgttatgtcttgcattttgattctgttgcttaattcacaagttgattcaagggatggccattatgctcttgtgttggggttaattttagcttcacttgcattcctggaacaaagcttcagcctaaggctgaggccaaatgcagtgttaacttggtttgaatttgaggaccttatgagggccaccgacaatttttcacctcagaacttcattggaagaggtgggtttgggttggtttacaagggcattctacctgatggctcaatggttgctgtgaaaaggcttgaagaatcagattctcaaggtgatgctttgttctgcagtgaggtggagattgttagcaacttgaagcaccgaaatctggtaccgctaaaagggtgttgtgtggttgatgaggggaatgagaatcacaattttgagtacagaagaaggtatctagttcatgaatatatgccaaatggtagccttgaagaccatctctttccaaccaaactagacaatcaaaatacaaaaaagtcccttacttggtctcaaaggaaaagcataatcttggatgtggcaaatgctttggtttatttgcactttggagttcaacctgcagtttttcacagagatatcaaagccaccaatatactacttgatgcagatatgagagcaagggttggagattttgggctagccagacagagcagtgaaagtaggtcacagctaaatactagagtagcaggaactcgcggatacgtggcacctgaatatgcactttatggtcagctaactgagaagagtgatgtctatagctttggtgtggttattcttgagataatgtgtggaagaaaagcccttgaattgtctccatcaggaacaccaattttcttgatcacagattgtgtttggtcattgatgaaatctggaaacataggagaggctttggatgcttctatgttaggagatgaaaattgtgctagaaacataatggagaggtttttgctggttggaattctttgttctcatgtaacggttgcttcaaggccaacaattttgaatgctttgaagatgttagaaggggatattgaggtcccaccaattccagataggccactgagtcatgggaactatgtgttgtacagtggtgattgctctgggatgagctcaggatgtggatttggagaagctggaggatgtgaagtgcaagataccaagagccatgccctttgggacaagagtgcacctcttgttggaaggtcttgcttgtgggatatgtacgacagatatttgcctggaggagattaa

SEQ ID NO: 42420 - DNA, 252 bp, Glycine max
  Peptide Sequence Number=SeqID_159198
atggtggaaatggattcagcaattgaaattggcaggcaagcagaggacaaggttgccaagtcagcatcaagaccgttagaggtagtccttgagcttgcaaaatcaccttgtcctcaagatgataaactgacttcaattgtttccaatctttccaagaagtttcttgtggcaaaagaccttcccattggaccaacacctgaagtttggagttcgtgtcttgggggtacccaaaaatcactaagggaacaatga

SEQ ID NO: 42421 - DNA, 1755 bp, Glycine max
  Peptide Sequence Number=SeqID_159199
atggaaaacaacactgacaagttatcctccttgcctgaacttttgtgtctgttcatcatttccttgcttccattcaaggatgccgtgaggacgtgcattctgtccaaatattggttgcacatatggaaaaattcaccaaaaatagagtttagtgaaaattttgatggaaattttatcggtcgttttgaacccttcagttccattaaagctcgaagaagtgtttttatgaaattcttaaaactttggcttgatttccgaaaagaaggtgacgtggaaaagttttctttgaagttctcaaagcctaaaaatgatcatcgtgaaatcatagaagggtgcatcgcctttgtcacccaacatggggtgaaggagttggagctagatttctctgaccccttttgggaggaggaagtgattccaaacaaacgtgaggctttgtttgaattgccaaaacttgcgtatgagaacaaacccaacattgaatcactgaaactctcttcatgtagttttcgtgaaaatgatttgagtaattggcaggcacttaaagaggttactttcggttggatggaagtgacactcgatgccatgacaattgtgttatccaattgtaaaatgatcgagagtttagttttgaacaagtgttggaacttgagtcattttgaaattggcagtgaagccttgagtctaaagaggcttgttgttgacaagtgttcttttcgaaatgctttgttcaaagtcagtgccccaaatttatgctttttcaagtattttgggaaactgtgtttttttgaaatgaaaaataccttagccatcgaagaggcacaccttcatttctaccttggttatgacaatgttggaaccggtgctagggttctgtatgacctggtgaaagatctctacaatgctagggttctgactgtgtgcccttatctaattcaggttatttgtacgggagaaaagatacgtatggaacgtgacatgaatgcaagacatttgatattgagaatgaacatgctccgctgtgaacttcgtgcagtctcattctttctcctcagctgcccaatgttagaatgcctcacatttgaattaggctcagagattattttaccagtgaaaaagagagaagtgggagagggagagggagaaagaaaggtgcaaaagaagggggagaaggagaggagagcactaaagtgtcaatgtaagagaatttacggagagattgtggaagtggattatcaagcaatgtggatagacagcgatgaagaacaagatgatctaccactttggattgacagtgacgaagaccaggatgaccaagcaatgtggatggacaatatatcacagtctacattatgcttcatacaaagtaaagtttatgctgatcatgattttgagaattatgatgacgacgatgaatataacatagacgatgaagataacatatatgatgattactgcacagattttatcaacatggttgataatcaaatcaaggggatgaaaaatgtaatcaactataattgtttggaatcatctctaaagctagtggaggtgaaggattttgtagggtccaagaacgggcttgtttttctaggctatcttatccgttatgggaaggtcttgaaaaatgttagcatcaacgtgttaaagacagagcttgaaggtagtagcaatgtggcattttacagtgcaatagaagaatacttgatgaccactcctagggcttcaagtaatttgcagatatcaatgtgttattga

SEQ ID NO: 42422 - DNA, 1491 bp, Glycine max
  Peptide Sequence Number=SeqID_159200
atggcggcgccatggcggtttttcgaaaaaacgccaccgaatagcggtggcgtggcgggtttgggatggcggcgccatggcggccgccatagccatggcggtcgtggcagttatggcggggtggcggaaaatggcgtccctcccgcaccccacacgcgcacccagccgcgacacccgcagccgcacgcgcatgcagccgcgacgacctccggcagcgacgcaccggcacaaacagcggcgacgagctccggcagcgacgcatctgtcacgaacggcggcctgcagcgaggagttctcgcggagaagacgaaactgctgtcgcgaagaagaagaaggcgtagggttgttagaatacgaagaatgcgtgaagtaaatcaggaagcagttcttcttgcaatgtgctccaaaacttttacttccaaagtcatcatcttcagtggaacaaagcaagctgcacatagattgaagattatatttggattagctggcttaaaagctgctgagcttcatggaaatcttactcaagcccagcgccttgaagctttggaacagttcaggaagcagcaagtggattttttggttgcaacagatgtggctgcccgtggccttgacattattggtgttcaaacagttatcaactttgcatgtccacgtgatcttaccagctatgttcatcgagtgggtcgtactgcaagagccggaagagaaggatatgctgtcacttttgtgactgacaatgaccgatcacttttaaaagccattgcaaagagggcaggttcaaagctgaaaagccgtattgttgctgagcaatctatacataagtggtctcatataattgagcaaatggaagaccaaatttctgaagtacttcatgaagagagagaagaaagagttctaagaaaagctgaaatggaggccacaaaggccgaaaacatgattgcacatagggaagagatcttttcccgccccaaaagaacctggtttgtcacagagaaggagaaaaagcttgctgcaaaagcatccaaggcatccatggataagtgcaagagttctgggaaagaggttattagtgctgaacaagctgaagacctcagaatgaaggagaagaggaagcgagagcgagagaaacatttgcctagaaagaagcgtagaaagttggaagcagctagagagatgttggaggaggaggaggatgacaaacaagtagagactaaggggagaaataaaaaagaaaagggtggaatgtcacttgttgatcttgcttaccgacgggcaaaagcagtgaaggctgtcaagaaggccttagattctggcaagattgtggagaagaataaaaagaaatctaataataattcccgaaaaactccttcaaggacagaagagatgcgggagttattccagactgacatgaaggataaaaagtcaaaaagaagaggtgtgggaggaggaaagaagtcaaagagttcattcaaaagcaagtcaaggtattaa

SEQ ID NO: 42423 - DNA, 819 bp, Glycine max
  Peptide Sequence Number=SeqID_159201
atggctttgcttgcacgtcttcgagttctggttcaacaaatactgcttgatgttgtttcattgttcaacatggtttcttccctctctatatcgaagcaatcaataaaaataactcataatggaattgaggtttttagagatttctaccctgttagtgatgattttgttacattagagtgtgtttggaaatcagacaagtttatattacttgagaggaagcataaaacgaatgatgaaagtcatgttgaggactctggtggaaatgtttctgtccaaacatcagatgttaattataatagtattgagtcttttcttggggatgatcagcttttccatgagagagtagaagcagatgttgttgcaaaagaagatcctaatcatatcgatgatatgaatactgatttgttgactggctcatcacaaattgatgacaaggaaactaggtatagtgatcaagacaccacaaaagccttcatcaacgaatcttcacaagaggctggtttgcctgcatcatcaaggtcttctaccaatgataaacttcaatcttgtccgaagaaggttccatttttatggaatttcttcgtgtttgacttgtacgaggagatgatacatagtgaattggattcagagaatattgatttcacagtgattgatgatgttggtagtgaaagcctaggtcctggcattcgtagagaactttcattttcacgttggtgtgatgatgatggaaggatccatttagatcagcaattaggtaatgaagatgttagtgtagaagacgactctgattttgagttaccgtttcctgaaaagacttga

SEQ ID NO: 42424 - DNA, 960 bp, Glycine max
  Peptide Sequence Number=SeqID_159202
atgatgagtagttcttcatgcacaaactcctctgtcaatggcttctacaacttcctcactcaaggactcaatgagcttcaccaatccttcctctcccatgacttcatgtcaatccaattcatttcagaggtcttctcatccctccaatccttccattcccagttaaccattttggtccaaaggctttgcttgtcagttggaggaaaatggctgaatgaatacatggatgaaagctcaaggctttgggatatctgccatgtactcaaatctgccatttctggaatagagaactattcttcaactggctccaatatagcttcctcagttgatggctaccataatttgactccagagctttcacatcaggttattagggccataaatatttgtcaaagggagagtctaggattggtagaggaaaacaaaagcttgatggaaacaagaacgcaggcattgtctcaatgtctaaaccaaaacatgtgtatggaatcaaagttaaacgagttcaacggcttccgaggtgttctttgtgcaatgaggagtgttagctcattgcttctaatgattttgctgtgtggggttgcatattgttggtcttcctcatgctttgaccaacaagggtatgaaggacacatggtttttggatcaggttttgttgtttctatggcaagattgcagcagaaagttgcacaggagattgaccagaataatggccagcaagggattctgcttcttgaattccaacaagcaaagatttccatggaggaattgaaagtggagttagagagaatggtgggttatgatgcacaacatgagatccaagcaaaagttgacaacttgaaacgttgctttggattgttgagatgtggggttgagactataacagggcaacttgatgatttctttgatgaaattgtggaaggaaggaagaagttgttgaatatgtgtagtcataagtag

SEQ ID NO: 42425 - DNA, 285 bp, Glycine max
  Peptide Sequence Number=SeqID_159203
atggctgttcaatacaagttccctgaaagagtttgcatatctcaagacagtaaaaatctgatatctcgcatttttgtggcaaatccagcaatgagaatcaccatgaaggaaatcaagtcacatccttggtttttaaagaacttgcctaaggaattgagagacggggctcaagatgtctactacaatgaagaaaatacaaaatatcctcttcaaagtatagaagagatcatgaacattgtcaacgaggccaaaactacaactgcaacttccagtccatatctatag

SEQ ID NO: 42426 - DNA, 615 bp, Glycine max
  Peptide Sequence Number=SeqID_159204
atgagtagagagagaaacagagagtgggttggagagagaaacagagagagaggcaaagtgtggatgagagaggatccccgattcaactatgccgaaaccaaggatggacaacaacctaggtttaagcggacaaattggagggataaggctgatatctcatccttttattttacaagattcccagaagatgtaaatgaaaaggatctatggtaccagttcaaaaggtggggggacgtgagggagattttcatctgcaaacagaggaacaaaagcggtaggaggtacggtttcgtgaggttcaagggagaaatgaagatcagagaccagagaacaaagtatagggatataaggagcaacacgaaatggaagcagaacgacaaaggcaatcccagcaaatgccaataccaacatcatatgcgaaggtggtggcgacaaacaccagaaactcggggcaaatgtggacacataggaacagtcgaagatgaactttcgtgggacaaaggagtagatatctcgccgaagtacctaggggacgatatgggaagaaaccatgaacggatcatccctgcttcactcgttggagaagtggaatcagaggttgcgaattggctatag

SEQ ID NO: 42427 - DNA, 525 bp, Glycine max
  Peptide Sequence Number=SeqID_159205
atgcttaacttctcaattgcatatggaaagacgccagttgggctttccaaggattggaaggttactgtgacagaagctaggagaacagttgacctttggtacaatgacagaaaagaagtgctgaaatggcaaaaagaacgtaaaaaagaagcttgtgaatctcaacgtgttcacacattgctagggcgagcccggcggtttcctaaaatagacctagctaacaactaccacaaaggtcatattgagcgagctgctattaatacaccagtgcagggtagtgcagcagatgttgccatgtgcgccatgttagaaatatccaacaatatgaagttgaaggagcttggatggaagttacttctacaggttcatgatgaagtcatattggaagggccaacagagtctgccgaggttgcaaaggctatagttgttgagtgcatgacgaaacctttcaatggtgagaattttcttagagtcggcctctctgtcgatgccaattgtgctcaaaactggtatgctgcaaaatag

SEQ ID NO: 42428 - DNA, 2694 bp, Glycine max
  Peptide Sequence Number=SeqID_159206
atgaagggggaagggagcgagggagaggtcatagtttctactgatgtttctgaagtgaggagaggcccagaggggatgagggaggtagggagtgaaggtgtagaaacggcgttttctcttaaggttgcacattgtgactttgtaattgtgaatgttcggtttatggatggttctggtattgcagggcttgaacagggttttcactctaaaggaagaaaaatccaatcaatccagattgccagcaatatccttcaacatagtgcattgtctttcagaaaaggtttgtcctgtctaaagagaacaccttttgggttgaataaatgtgatgacatggaatatagccataaatatcctgtacatatttcagttaacaaattttcggacatgtcatgtggcatgttggaggaaaggagatatgaagaagatttgggttctttacattcctgtaatagtcaagtaaggatggcgggtttggctcaatttcccacatcccctgctaatggaaaagcgtttgggtataataaacaagcctgggccgaggcaagtaataaattgtctaaaaataaaaaggaaatacaagctgataataagttcagggttgcatctaatgcagttacttccactggtcaggaacaggctgtttctatgaatcacgatcatgcgcagcaggatcttgatgaacctgcctcatcttctgttaaagactcaaaagtgttgacagacactaaaagggtgggcactcagttaaaggtacctccatcagagatctgtaaagagaaaagtgataaagttaatgataatcatggtttggatacaactgctaaggatgcaacttctgttgaaaaggcacgtagtactgaacacacaaatgtgaagcgtgcaactaatgcaactactggtaagaaggcacgcagtactaaacaaacaactgcaaagggtgaaactaatgcaacttttaaaaaggcacatagtactgagcaatcaaaacttcggggaaggctttgtagcatctatgaagacatattggttgttaataatatttctcttgcagaggaagttgctaagatgcttacagtaaattacaggcatcttattcatgcatgtgatactgaggtggccaagataaatgtgaaacaagaaacacctgtagatcacggggagataatatgcttcagtatttattcgggtccagaagctgattttggaggtggaaagtcatgtatctgggtagatgttcttgatggtggaggcaaagagatcttaattaagtttgctgaattttttcaagattcgtctataaaaaaggtctggcataactatagctttgactgtcatgttatacaaaactacggatttatggtttctggatttcatgctgatacaatgcacatggcacggctatgggattcatctaggcgttgggttggtggttattctcttgaaggacttacaggtgaccaagaggtcatgtctagggctaagttggaccatgaaaaggatttgattggtaaggtgtcaatgacaactatatttggtcagaaaaaggtgaggatagatggatctgcaggtaaaatggttaccattgctcctgttgatgtgctgcaaagagatgagcgaataccttggatatgttactctgtcttagatgctagaagcactctgaagctttatgagagcctaaagagtcatctatctgatatgccttggaatcttgatggagtacctgttttacagaaaaacatgtatgatttctaccaggaatattggaagccatttggtgagcttctaataaaaatggaatctgtgggaatgctagttgatcagtcatatcttaaagacatagaaaacgtggccaaagcagagcaagaggcagctgttaatagattccgaaaatgggcatctaggtattgtccggatgccaagtacatgaatgtcggaagtgatgcacagttgcgcgtacttctctttggtggcactgtgaacagggggcgtgtgcggcagcggctgccagagcgacgaccagcatgggggtcgccggtggtcgcaggtggttgccggtcaaacggcaatggcatggctgccaaacagcagatggaggtcgtgcgaaaaaaccataatgaggcaattccaactgagagagttttcaaaattcccaatgttgataaagtaattaaagaaggcaagaaggctcccacaaaacttcgtgatattaagttgaatagcattggctacaacctgaatgttgatatgtacacgccaagtggttggccctcagttagtggtgatgttttaaaggtcttggctggcaaagtttctgccgaatatgacttttatgaggcttgtaacatggatcttgatgatgaagatggaaatccttctcaaagtgaatttttacctgtggaaatagataaatctacttacggaacagctttttcttgttttccaacagaggaagaagggagagatgcatgccatgcaattgccgctttatgtgaagtctgttcaattgattctttgatctctaacttcatccttcccctgcaggggcataatatagcaggaaaggatcaccgtgttcattgttccataaatatcaacacagagactggacgtttgtcagcaagaaggccaaatctgcaggttcttcaaacttgcaagacttctttagctgttggtttacttgaaattttttaa

SEQ ID NO: 42429 - DNA, 1821 bp, Glycine max
  Peptide Sequence Number=SeqID_159207
atgcacgtgaagaaggaagagcaatgcttggagaagatgaagagggtgcctgcagacatcaccgccatgttcttcgaatcccgatccctcctcttcccgctccttttctctctcttcctttcttccgccttcgcttcagactcagatcacaagtatcaacacgatgaaccagttaacctttgggtgaacaaagttggtccttataacaatccacaagaaacatacaactattacagcctcccattttgtcatccatctagtagtgctagtgctgcacacaaatggggtggtcttggtgaggtcctgggtggcaatgagctcatcgatagccaaattgaaataaagttccaaagaaatgtggataagactgtcttttgccagatagatctcgatgaagcaaaggtgaaacagttcaaggatgcaatagagaataattactggtttgaattcttcatgggatatgttggtgagttacatcctgataagaacagtgataatggcaagcatgtcatttatacacacaaaaacattattgttaaatacaacaatgatcagattattcatgttaatctcactcaggatatcccaaagcctttggaagtgggaaaacatttggacatgacatattctatcaaatgggattctaccaatgtcacttttgggcgtcgctttgatgtctacctggatcatcctttctttgagcatcagattcattggttctccatttttaactctttcatgatggtcatcttccttactggattggtgtcaatgatattgatgcgaactctgagaaatgactatgcaaagtatgctcgggaagatgatgatttggaaagtctggagagagatgttagtgaagaatctggctggaaacttgtgcatggtgatgtttttcgaccgcctcgcaacttagttattctttcagctgttgttggcacaggtgctcagcttgcgttgctggttcttcttgtcgtcttgttggctattgttgggatgttgtatgttgggcgaggagccatcatcactactttcattgtgtgttatgctctcacatcttttatttctggttatgtgagtggggggatgtactcacgaaatgggggtaaacactggattaaatccatgattcttactgcttctctgttcccattcatgtgctttggaattggatttatcttaaacacaatcgctatattctatgggtctctagcagcaattccatttggcacaatggtggttgtatttgtcatttgggctttcatctctttccctctagcacttcttggcacagttgttggaagaaactggagtggtgctctgaataatccctgtcgcgtaaagactattcctcgtcccattcctgaaaagaagtggtaccttacaccctctgtggtttctctgatgggaggactgctaccctttggcagcatattcattgaaatgtattttgtattcacttccttctggaattacaaggtgtactatgtgtatggctttatgctgctagtctttgtgattcttatcatcgttaccatttgtgtgacaattgtggggacatactttttgttaaatgctgagaactaccactggcaatggacttctttcttttcagctgcctcaacagctgtttatgtttatttgtactcaatatactacttctatgtgaagacgaagatgtcaggcttcttccagaccagcttttattttggatacactttgatgttttctcttggactaggaattctatgtggagctgtgggttttcttggttcaaatttgttcgtgaggaggatctacagaaatatcaagtgcgattaa

SEQ ID NO: 42430 - DNA, 255 bp, Glycine max
  Peptide Sequence Number=SeqID_159208
atgtctcttggaaattattttctgaaaatcccctctgaatcaactgcttctttcattcttcctcactacgaggtcgtgaaaacaagacaacaattggtacctctaagccctacactggggcgacgaaaggcactatgcaaaaacttcaagcgaacctatgggcagattagaagttctcacccaataggttccctcctacaaggtcatgacgaaaggcaacgattgatgcctcaaagccttacactggggcaatga

SEQ ID NO: 42431 - DNA, 1551 bp, Glycine max
  Peptide Sequence Number=SeqID_159209
atggattgtcatggtggtatttgccaaagctctccaaaccgggagcatgaaggccttaatgaacatgttttcttgcatggtgacttggatctgttgatagtagaagccaagtctcttccaaatttagatttatccactgaagcagttagaaaatgcatcactatgggaaacatgtgccatcctccatttataaaaggacttaagacacactcaggaaaagacaagatgataactagtgacccttatgtttctgtatgcattgctggtgctaccatagctcagactagagtcattgctaactgtgagaaccctttgtgggatgagcaattcattgtgcctgttgctcaccctgcacaaaaactagagttccttgtgaaggacaacgatcttcttggtgctgaactcattggagttgtggagatacctgttcagaagataattgctggaaacactattaatgattggtttcccattattggtcagtatggaaactgcttaaaaccttatcctgaattgcatatttctgttcagtataggcaaattggagtgaaccgttcagagagtatcagtagtggggatggaaaagctttaggagttcctaaaacatatttccctctcaggaaaggagggagtgtgactctatatcaagatgcacatttaccagatggtatgctacctgaaattccacttgagggtggaaaagtgtttcagcagaataaatgttgggaggacatatgccatgcaattttggaagctcatcacctcatatacattataggatggtcagtttatcacccagtgaggcttgtcagagaggcaacaaaaccattgccttcggggggcgagctttcgcttggagagctgttgaagtacaagtcacaagaagggctccgagtggttatgctgatttgggatgacagaacttcacatgacaagtttctgttgaaaacaatatggttgcataacaactttgcacttactcctgcatcacaaggatttagagataaagttgtgggaaccctctttacacatcaccagaaatgtgtgcttgtagacagtctaggttccggcaataatcgaaaaataacagctttcatgggtggtttggatctatgtgatggtagatatgatacacctgagcatcggctctttcgtgatctagatacagtctttcataatgattttcataatcctacatttcaattaaattcaaattcgtgtgcaccaaggcagccatggcatgacttacactgcaaaattgaaggtccagcagcatatgatatattgaccaattttgaacaaagatggaggaaggccaaaaaatggcgcgacttcaggctcaaaaaggtgacaaattggcatgatgatgctttgctaaggctagaccggatttcatggattgtcaaaccttctccttgttccaaaggcgataaatctgtccatgtaaccgatgaaaaagatcctgagagttggaatgtgcagatatttaggtccatagattcaggatccgtgaagggatttccaaaggatgttgacaaagctaagtctcag

SEQ ID NO: 42432 - DNA, 627 bp, Glycine max
  Peptide Sequence Number=SeqID_159210
atgtcctttggcggttttcttttatatatagagagtgagagtttggttttatatccgttagcggtgaatttggcggtgtcggcgttaggagcaatgtttttgcttgagggagggggtaatggtttgggaatgggaagtgggagagtgtgcagtcggagtcggagtgaggttagtggagtcagagtcggagtgaggctggatggacctgtgcccctaaaagacgacgttttggaaaaggaagtggttttcgagcagtgcgtgacgcggactctgtctccggcgttgacattggaggagggacttgagaaactgaaggaggctctccaaatcttgaattctccttccccttcttcccctactgtcctaagaccttcactttgttttgctcccaaccccactcctcctcggtctttcctctcatttatgtttccaagaacgacgccgactctaaatcactctatgtcaatttggatgatcatccgctcccagattgagttagatgagctggaaagtgtttccattctgtccatgacccttgcatgggatgaattttccttctctacttttcaagaagcccattattcgcttcaagattctctagaccaggtgcctgacatgcctttttga

SEQ ID NO: 42433 - DNA, 645 bp, Glycine max
  Peptide Sequence Number=SeqID_159211
atggcttctgcatccgatcctccagaacaatccctgagcaacaacacgtcgtcgtttcagtttcccgccaacgccagcctaaccccggagaagttcaacggcaaaaactacttgtcatgggaaggctacgtaaacctgtggttcaaaggccaaggtctccacgaccacttaacgatgaaacccaacgaaatccccgagaacgaaaggaaccaatggatgagaatcgataaccaactcgttcctctcttgtggcaatccattgatcccaatttattggtccactttcgttctcttagaacgtgcttcgatgtctggaaccaggtccggagcttctactcgaccaacttgcgacgattttacgatgttgtcgtggagcttctgacgctgcgaatgagggaccgcgacttgctcggttacctcaacaaggcgctgggggttgttcaggaggttaggttttttcttggcgggaaggcgctgcaggaagtgccggagaagtttgacacgtttcttatgtgcttcgtgcttcagggtctcagcaaggattttgatgccgtgagaaaccagatactgttggactctcaagtcaccaccacggagggtctttataaccgtttaatgccatttcttctctttaagaaatactaa

SEQ ID NO: 42434 - DNA, 309 bp, Glycine max
  Peptide Sequence Number=SeqID_159212
atggagttggctttgaaaattgctggtaagatcggtgcaaatgaacgcttttgtgtatatatagttataccaatgtggccagagggtgttccaacaagtgctgctgttcaagaaatattgttctggcagggacagacaatgtctatgatgtacaagattatagctgatgcccttgaaaaagcaggtctctccgataagtatcatccacaagattatctcaacttttactgtcttggaaagagagaaccacaatccacaaatatttcaccaacaccaaatccatcagaaaaccgcgctttggtatgctaa

SEQ ID NO: 42435 - DNA, 243 bp, Glycine max
  Peptide Sequence Number=SeqID_159213
atggccattacatatttacatttgagaagtaatcagttggtatcagttaaaaaattcagacgttttatgatttatgtccatgccaaaggaatggtaattgatgacgaatacgtaattattggatcagcaaatattaaccagagatccttagatggttcgagggacacagaaatagctatgggtgcttatcaaccaaattatacatggacagaaaagaatgctcatccacgtggccaggtttga

SEQ ID NO: 42436 - DNA, 219 bp, Glycine max
  Peptide Sequence Number=SeqID_159214
atggttagagtaaagggtatcatgcatgcaagcatcgtagaccaataccgatacaagtatttattccgactcttcagctttggtatctttacagcctccagcaagctggaagtgcaaatagcacttcaagcttcgaatgaacaatacggtacatcaaaacaaagcaatgcaataccaattttaggttactacccaaccaccaagcaaaagctatgttga

SEQ ID NO: 42437 - DNA, 228 bp, Glycine max
  Peptide Sequence Number=SeqID_159215
atgatattaagagtcccatattgttatcctaagaatcaggaaaacaacaagaagctaaatggaaaggatgaggtcggcatagggaagtgctcgatcggaacctgggagcagctgaaggctgagttcttacctggtagtgtgtcgtggatggcacatcattccttgatgaatgtgagacagaccagagcagtccggcactacaaaaaaggacttttctgcgccgattaa

SEQ ID NO: 42438 - DNA, 258 bp, Glycine max
  Peptide Sequence Number=SeqID_159216
atggtgataaacccttattttatgcatcacatggtcaaagagcaagtcgcgatcatgaacaaaagacaagatggcagcttgtggcttacatgcaccagtagctctacttgcgattggcaacatatcagaacttcgatgacaacatctatcagatcaaccaaggaagcagtcaacggtgtggcaatggtggtggttaagggtgctgatagtgctaccttggttgtttgcacttctaaaggtgccaaaaaaatcctgtaa

SEQ ID NO: 42439 - DNA, 427 bp, Glycine max
  Peptide Sequence Number=SeqID_159217
caaaagaatgtttatacggataaccactcgggtatttccgcccgtcagcgtgactcaaatgtcagtatgacagatcttgtgagcgcggaagatgacacagcaaaaaagaatgtttatacggataaccactcgggtatttccgcccgtcaacgtgactcaaatgtcagtatgacaaatcttgtgagcgcggaagatgacataaatctccgcatgttaacggacttatcggccgcgattgacgaagggcgcagaagacgacatcttgtgagcgtggaagatgacgtaaatctccgcgtgtcaacgggcttgtcggccgcgattgacgaagggcgtagaagacgacatcttgtgagcgcggaagatgacgtaaatctccgcgtgtcaacgggcttgtcggccgcgattgacgaaggacgcagaagacgac

SEQ ID NO: 42440 - DNA, 171 bp, Glycine max
  Peptide Sequence Number=SeqID_159218
atggcagcggggggagctgagtccgatgtttctgcggtcgtcgggggtggcagccgcagtggcgttctcgtcgagctagctgaggtgcgaagatcccaaggcactgatgtcgtcggagaggctcccatgataaacaacttagaaatagatatccaaagtagttatcattga

SEQ ID NO: 42441 - DNA, 705 bp, Glycine max
  Peptide Sequence Number=SeqID_159219
atgaaaaaggccattggtgtgaatcttgagctcactataatcgttttttgggacactcaatctttcaacaaagctccatttgatgtgaacaagcttcctatagaaactcaaaatcttctagctgtgtgcaagagggaaagcatggctgagtatccatcacctgaaaaggatgataataattgtaagcacatggatgactacccttcacctcaaacagataatccaaagcctttctctcaaatatacaaacgaaggcgtcataacttgaactccaacaactctaatgtttctggagattcagtccgaaccagccaggatccgtgctcctctacaataactaccgctgcaactgcactcccaaccgcaactgttgctggcacagccaccaacactgcaccgaaaaaacattttctgtctgcactggtggagttttccctgctagaatcccttgaatcaaaggacaaccttgcttcaattaaggcaccggattttgacactgaaaatctcgagtcatccatgcctccaagttgcgcaaagttcatcaagcaaatgcagagtgagatgcagaagctttcagttgaaaaggagacgataaggtttgagatgatgagcgcacaagcgatgattaacattctccagtctcgcatcgacgttctcagcaaagaaaatgaggatttgaagaggatggtggcccaaaatccatag

SEQ ID NO: 42442 - DNA, 321 bp, Glycine max
  Peptide Sequence Number=SeqID_159220
atggcgaaggcctcttgctccagaaactactactccctcttcggtaccgccacatcgacgccgttgctgattccatcaccatcctctccgacgccagactccattcaaatccaaacgaccggagagcatgttgttggagaggtcgttgccggcaagcttgttgccgaaaagggcaaggtactagaggtgctaccaggtgtcatactcgagagggatctgaccggagaagaagttgtcgccgaggtgaaggtggcagaggaggggcatggtagcaagggagagaagaatttccaaattcactcacttaaagatagaatttga

SEQ ID NO: 42443 - DNA, 321 bp, Glycine max
  Peptide Sequence Number=SeqID_159221
atgagtagtgacgcgataggtaacaatggcgtggggaggtttgagtggagctggaactcctcagtttcatttctgtacggtggacttgcacccatttttggggtcattgtggtagcgttgcttttggtagcacgtcaagggtgtcgtccaagatggcctgaaacaacaacaacaacaacaatagagtcactgcgtgatgttgacgtgaacaactcgagaggggtagcaaatactacacaagttgatgaagggcataacattttggtaatcgtagccggagaagagcacccaactcatttggcaaagcccctctccttgtga

SEQ ID NO: 42444 - DNA, 528 bp, Glycine max
  Peptide Sequence Number=SeqID_159222
atggagccattcggtgcagagggatgtcacagcagtgaatctggatggaccatgtatattgggtcccccatagatgatgctggacatagtagtgacaacgacgacaacaacaagaaaggtactcaagctcatccacaagatgatgatgatgatgatgatgaaagtgatgattctatggcttctgatgcgtcttctgggccaagtcatcatcatggctttgcggatttccgccgagatgccgaagaagaaaatgatgaaaacaagtattgcttagagaagaaagcaggtaaaactcaacacaagcaaatggaagggaaaaaggtggaaaagaatgggatgttaatagttgatagcaaagataagtctccagttcagggttgtggaaagccaagagaggagcttgaatgggaaagttttgtcaagaaacaagaaatcttcatatgttcgtcttcaaaggaccaagattatgtagaaaaaatgatggctcgcaagatccaaaataattttgattcgtttagattgtcctaa

SEQ ID NO: 42445 - DNA, 438 bp, Glycine max
  Peptide Sequence Number=SeqID_159223
atggaatgcaatgaagatgatgaactccatgtggcaccttattatgcttccttaagacagtgccttccctatcattctccaacccaaaaacctatctttacctcaacaaacctcctgaacatggaagctggtgaaagccatactttgaaccatatggatccacctcatggtttgcatcatattccattttactgctcccaaaaccttcctagcaacagcaacaacccaattcaagtcccactccataaaccctctcccaacacatcatcaaacagtaacaacaacaattctgatgaagcaaaggctctccttgatgacagaaagaagaggatgttctcaaacagagaatctgctcgcagtgctgagcaacctcacctcatccctaatgacttcctagccgagcctttgactcgaccagttgcaagttccagaacatag

SEQ ID NO: 42446 - DNA, 192 bp, Glycine max
  Peptide Sequence Number=SeqID_159224
atggaatgtcagggagaccctgaatctgaagcatccaaacagtggaattcaaggttgtcagagggaacaacggttattgtgttcaatgaaccttcaacttatatttaccattttccaaaactttgtaagatcagtggagccatgccattggcagatgaagggtgtgtcaacagctaccatgagaatgggtaa

SEQ ID NO: 42447 - DNA, 854 bp, Glycine max
  Peptide Sequence Number=SeqID_159225
atgggcaaccctatcgagcaaccgaacttaccacaagaacaacctgtcgtcgaggtgcaacaaaatgtttctgcagaagaaataccctcatgggcgcgaacatctcccgctcctgaggcggatgcagtgaatgttgaggaatggggtgaaggtcaaggcattggatccagtagtcctcatggttgggcagaggttgatgaccatcatgagccgaaccagtcagataataccattcctcatgaatcaagtcagaaaagttcatctgaaggaaactttttcgatgaagacgccataaaagaggctgaagctggaggctcagacatttacccggtgtcctcaacatctaaactttccgctagcatagggatcgcagaagatacattcattcaaatgcaaaatgaagaccctgctgcagcccttcgactcctgctgaacacaagtcaagccaacacctcaagtgagaaaattcctggtgcttcgaccccatctgatgctgaaataaactcttcagtacgccaagattctctgctcttgaagttatcaacggaatacgcactgaaagatgtgcttaaatccattgaagagaacccctctgctgcctttgggcacctgaactttttgaagaaattgcacaacccccttacctctgatgagactctaggcaaagttatccaaatcgaggccatcattgaccagtttgcaagtgctgtgcagaaaaaacgcgaaaatggcacaagactagatgcccagaaacaggcacatacccttctgctcgagaaagcccgagctgctcaacatgaagtcgaacgtctcaccaaagaggcgaaagaagggtcttctgagatcaaagactt

SEQ ID NO: 42448 - DNA, 593 bp, Glycine max
  Peptide Sequence Number=SeqID_159226
atggaacagttgcttgttcactgcgccaacgctattgaaaccaacgacgtaaccctcgcacaacagatcctttgggtgctcaacaacatagctccccctgatggtgactccaaccaacgcctcgcctctggcttcctccgcgccctcaccgcacgtgccgccaaaaccggcacgtgcaagatgctcgtccccgccggcggcaccaacctctccattgacacgcacagattcaacgtcattgagctcgctaacttcgtcgacttaaccccgtggcaccgcttcggcttcaccgccgccaacgccgccatcctagaggccactgaagggttctccgtgatccatattgtcgacctaagcttgacgcattgcatgcaaattcccacacttgtcgacgccatcgccagccgcaactaccacgaggtgccgccgccgataatcaagctcacggtggcggcggacgctagcttcagggacaacatccctcccatgctcgacctctcctacgacgaactcggagccaagctggtgaatttcgcccggtctagaaacatggtcatggaattcagagtggtttcttcgagttaccgagacgg

SEQ ID NO: 42449 - DNA, 438 bp, Glycine max
  Peptide Sequence Number=SeqID_159227
atgcagtcagaaatcaatttcttaggaaggatttctcacccaaacctggtcaagctattgggttactgttgtgacgatatcgaatttctccttgtgtacgagttcatgccaaagggaagcttggagaatcatctctttagaagaaatactaacagtgaaccactctcttgggacacccgaatcaaaatagctattggtgctgcacggggcttggctttcttacacacctcagaaaagcaaatcatatacagagatttcaaagcctccaatatactacttgatgaggattataatgcaaaaatttcagattttggcttggcaaaattaggcccttctggggaagattcacacgtgagtaccaggatcatgggaacatatggctatgctgctccagaatacattgcaacaggtgataatcttatcttcacatgcatataa

SEQ ID NO: 42450 - DNA, 1041 bp, Glycine max
  Peptide Sequence Number=SeqID_159228
atgatgagcctgcgcgccctgcttctgtggttttttctggccctgtcgcccgccagcttcgccgccaactcgctgatgatctggccgatcgatcccgccatcaacccacaggaaaaagccagcgaactgtggctggagaatcgcggtaacgccaccaccatcatgcaggtgcgcatcttcaactggcagcagattgacggccaggaacagtatcaaacgcagcagcaggtggtcgccagcccgccgatggtgcggctggagccggggcagaagcagctggtgcgcctgattcgtcagagcgcgccgcccgccggcgtggagcaagcctatcgcgtggtgctggatgagatcccgacgccgcgctcgccgggcgagaatcaggccgggctaacctttcagatgcgctactcggtgccgctgtttgtctatggcgatggcctgacgcgcgacagcgctaaagccgatctcagctggcgtcaggtcagccgcgacggcaaacgctggctggagctgaccaatcgcggcgacggccacgcgcgcctgagcaacgtcaccgtcggcggtcgcgcgctcggcaacggcctgtttggctatgtgctggctaacagcagccaccgctggccgctgaacagcccggtgagcggtgaactcgcggccgagctgccaccgccgcctgccgtcagccacagcgccagcggccagcaatacatgctggaactggtggtgaaccagcgcgaacggggcgagattgtgccggtagagcggcgcgacggtgagttctggctgcgcagcggcgatctgcagcgcgccggcattccggcggcgaagctggctggcgaacaggtcgctcccggtcagttgggggaagtcaaagtggaatacgatgaacgccgccagcgcctgctgctgacgggtaccgcccgcctggctgccagagcagacgctcggtcagccgcaaaatggcccgcgctatcccggccaggccagcaacggcgcgctgctcaactacgaccttttacgccacgcgcaccgacaacgccg

SEQ ID NO: 42451 - DNA, 654 bp, Glycine max
  Peptide Sequence Number=SeqID_159229
atggtccaagaacttgatggacacatgcaaggccctattatgtccctagccctcgacgggcatctcctcatcagcaaaggtgaggcaattgttggtggtaatattgttgatgatggccctgaagccctccacggatatgtcttgggcgacgtgggcctcattcaagatcttgacctgaagtgcccgatgaggctcggagttcatgatggggttttattgagatgttcaattaccttgaactcgctttgctggatgatccgaaggaactcatttgcttcttcagcagatattttctttctattgaagtcttcctctcccttagcaaatctcgcagccgagatcgcctcatctagaatcgggtttgccttgtcgctttcttccatgcccaccttcgcctttcccttcatgtccttggaccgcaccaacgggttgggtgccgcgaagattcacccactacgggtcatactactcgtgccagagatgttagtaaccttggcagaggataggtttttgaggggcgtacctccatgggaccgtcttggcactcttgtaaggggaaagggcaggcttcttacccaggataggctggaagcctcagggcttttgggtggcagcatctctggtgaagtggatcaccaatgtgggatcctctag

SEQ ID NO: 42452 - DNA, 441 bp, Glycine max
  Peptide Sequence Number=SeqID_159230
atggaggatctcatttctgtaatgtccaactctagaaatttctccaacactatagtgtcagacacaagtttagatgtgagtttgttgcaaatggctccaaagaaacttacaactaagagggcttggaaaatgactacaggggaaggatctagcacatctccacctgcatattttgtttttgatggacacaggtttcaaagtgaggagcaccaaggacattttgagttgatcaaagatttttccttcctcaaggaaatgagagttgaactagcagagatagattatcctgagttcattgaggaaggaactaaaaggaattatagacaactagcaaaaccaatgcccaaatacgaccctgaagttgtcttggaattctatatgaatgcttggcctactaaggagggagttcatgataagcgttctaaagtacgaggccaatag

SEQ ID NO: 42453 - DNA, 378 bp, Glycine max
  Peptide Sequence Number=SeqID_159231
atgaagttcgacgtggatgctgacaattattccttcatcaactgtttgaacaaacttcccactatttttcatgagaccacatatgatctcaccaaaatggatgaaagagagtttacagatcatgtgactcaactccataattctcaaaaggaaaagagagcaaggatggaagaagaacttatttctacaattgctgtcagggagcaagttgttaaagtccaagccgaggcttttgccaaagctatggacaacaacattgttaatgaggtcattattgatctcgctagcactgttgttatggatgagaccctagaggtgtccaaagtagctcaagctaatgagattgtccaccaagagaaagaacttctttccaagtaa

SEQ ID NO: 42454 - DNA, 438 bp, Glycine max
  Peptide Sequence Number=SeqID_159232
atgtcaaaggcattagaagctttccaggacatgatgggttctaaggttgtggtttttactgatcatgccgctataaaatatcttttggtcaaagatgattctaaacctacacttatccgttggattctacttttgcaagaatttgatttggaaatcaagggtaaaaatgggattgaaaatcatgtagctgataatctttctagacttaccattaatgaggtgaccacacaaggtattgaaattcaagaagagtatcctgatgaaaagctgctcaacattgcagaaagcccatggtttgctaagatggccaatttcaaagtagttggtgcacttccggatgatctcacttggcaccagaaaagaagtttctcatgggctccaaatactttgtgtgggatgatccttatccttttatgtttggagcagataatctcctga

SEQ ID NO: 42455 - DNA, 312 bp, Glycine max
  Peptide Sequence Number=SeqID_159233
atggaaatcactaccattcatactgacaatgagcccttcatccatgtagagcattttttttacattgttgaactcgaaaaggtaggtcttaaactcaacaagacactacttttctatggggtaaggctcttcttcaacatgcctcagactatatacccagaactagtcaaaaaattttggaggaatgttgagttcctgaacatcaaagtaatagtgtccaaggttcttggagtaagggtgactctttctagtgactccatagctaaggccactagttatctccatgaaggaagtacacaccacaagggttag

SEQ ID NO: 42456 - DNA, 765 bp, Glycine max
  Peptide Sequence Number=SeqID_159234
atgggtaagagctttgtcaagggtatccaaatattgacctttttcttaaactcaactgtcgcaacctaccattcgacaggagtgtgggcgaaaagccaaaggagcgtcttccaaaacggaaaacgcgcgggagttgccaccgacgtttattcgaggaaaacgctagaaaaaccaaaaagagggtatgcgaattttgaaaagaagggttcgggagttgtttacgcaaggggaaggagcgtcttccaaaagggaaaacgcgcgggagttgccaccgacgtttattcgaggaaaacgcttgaaaaaccaaaaagagggtctgcgaattttgaaaagaagggttcgggagttgtttacgcaaggggaagtaattggctcgcccaggcgagctccaacttgccttacttaacatggaagtcttttggtggcctaggcgagccagaggctagcctgggcaagctaggggtccctcctatgtttctcaaacaaatccctaggaatattgttttaggtgctcttcttgtctttggacttttgaaggtttctccacactacctccggtgtgaccttagtggatggatgaacacactattggatgataaagccttgaaggctttagatgttgtatgtagtcatgcctcttccattctagggcttgaactaaaaaggatattttggagatgggttctccttgagcttcttcagagaaaggagataaggattgagggtgtatgggggatggaggaagacgttgttttgttgtattag

SEQ ID NO: 42457 - DNA, 132 bp, Glycine max
  Peptide Sequence Number=SeqID_159235
atgcggaaattgattaaggaaaggatggaaaataaggtggttaatttcgtgggtcttaataaggttaagtggtggctggacagaaatatagaagtgacaataactcaagttacagggctccaaatgaggtga

SEQ ID NO: 42458 - DNA, 441 bp, Glycine max
  Peptide Sequence Number=SeqID_159236
atgaagcttgcttctacattcctctcccttcattcttctccttcttcctccaagctcttatccatggcctcctatggtgaagcaaaggaatccattgatgaagaagatcctaggcctacaagctccaatggagcttacatcaagattcaagaggagtctaagggttgtggtagtagtggcctagagaatacttgctcaaccatcaagtcattcaaagaaaggaaggacaaggagaaatgttccatcatatgctatgagtgcaagaagctaggacattttaagttagaatgtccagacttagacagtccagacttagacaggacaaatgacaaggaagatttggaagactcatcggccgatgagggaacagaagaagaagccaacttctatctaatggcagacacaacatctgaagaatcaaaatctgaatcagatgtagag

SEQ ID NO: 42459 - DNA, 306 bp, Glycine max
  Peptide Sequence Number=SeqID_159237
atggcagggggtacaaagaacgagaagaatgatgaagaacatcaatggttggatgatggaggtggaggaatatctttagaatttgctagagctggtagagaaaacaattacttcttgttggacaaaagtgacttcatgagactgtgcaacttgaatggactcatggatggtgatgcaattttcccaaggaggggacccatcaccagagccatggctaggagacttcaagtagattgggccagagatgcaggagaaggccctaggattctcatgagccttagggtagattttgagcccatgggctaa

SEQ ID NO: 42460 - DNA, 1053 bp, Glycine max
  Peptide Sequence Number=SeqID_159238
gaaaacttggaaaagtttgattccaagagtgatattgtaacattgcttggatgctctgaaacatctaaggcatatagagtatacaactctagaaccttggtagtagaagaagcaatccatatgaagtttaatgacaccaagcctgatacagaaatatcagagttggaagagtcatgtgcagatctcaaactagatgatggaatcatgcccttaacaaccaggcagacaccagaagcagacacaccagatcaggcattggataaccctcaagaaaatgctatggaagttgaacattgggtcaaggtgacgcaagaagaacttgaccaatttcaaaagaatgatgtttggaagcttgtggaactacccaaaggaaagaaggtagtaggcaccaaatgggtattcaaaaacaagttggatgaggcaggtaaggttgtgaagaacaaggcaaggttagttgccaaaggttactcacagcaagaagctcataatagaatgaagttatatcaaatggatgcaaagagtgcattccttaatggactcatccaagaaaaagtctatgtagaacaaccccctaggtttgagagtgatacacttcccaatcgtgttttcaatctaaacaaagtcatgtatggactaaaacaagctcctcgagcgtggtatgaaaaccttagttcatttctcttagaaaatgattttgaaagagggaaggatttctctaacttaattgagactaagtttgaaatgagcgtgatgggtgaactaaagttcatcctaggattaaaaatcaaacaaacaaaccttggaatatacattcatcaaaccaattatgtgaaggagctcttaaagaagttccacatgcatgatgctaaggagatgaaaacatctatgcatccaaccacaaatcttagactggacgaggaatccaacaagcaagggaaaacatttaggttaataagctattgtgatgctgactatgctagtgataaacttgagagaaaaagcaccaatggaagtggccacttcatcgatggaaatcttgccagttggatttga

SEQ ID NO: 42461 - DNA, 581 bp, Glycine max
  Peptide Sequence Number=SeqID_159239
ggtacatctacttgggttgttgtaattgagaacaagagatggtacatcttttgtggattagttcaagtggagggtacatccacttggttgttcaaagagaacaagggaggatacatcccttgtggatctttgcttgtaaaggctgttggttctctttctccttcaaccatgcaagatggacaagtcactagaaaagaaggaagaacttttgagctggaagaaggcatcctagccttcaccaaaactttgttcgaagaacataaaagtaaggctaatgaggatgttcatttggctaccttggctggcaaggctgatgaagagattctagatgaagtggtgctggattctctaaaaaccttgtctactgaagaggttcagaggaaagttgttgaggaggataccatgatggacataaatggtcagccaatgcgtgaagctgttattctagaatccattgtggcatatctagatcccgcagagaaagaagcactggaggaagctatgcttgagtctttgattaaatcatctatactcaaaccaggtattaaagatgttgtagagacaaacccaggagttccaag

SEQ ID NO: 42462 - DNA, 219 bp, Glycine max
  Peptide Sequence Number=SeqID_159240
atgccgaggacaccaaggcatctgcggcttggcatagctgcaagagagtgggtatgccaattcttgttgactctagtggagtatgatgggcagagcaacattcgccaatacaatgtggagagagtgcacctagtggatgttaaagatgatcgaagagaccatttagacatgtcatccgaggagatcgaggagtaccaggaacttttacagtacagttaa

SEQ ID NO: 42463 - DNA, 360 bp, Glycine max
  Peptide Sequence Number=SeqID_159241
atggtgatgttgaggataggcatcaatactgtgaagattgctacagctccttccaatgtagtggtgcttacatctgaaaattttaatgaggttgtcttagatgaaaccaaagatgtcttggttgagttttatgcaccctgtcttacccgaatggaagaggaagttgagaatctgaagggttctgcctcaaggcacgagaagatttacttgaaagctgccaagaattacttggaaaaaggttctgattatgctaagaacgaaatccagtgcctacagcgcatacttgacaagcccattagtcctgcgaaggccgacgagttaactctaaagaaaaatatcttgtcgacatatgctgcttga

SEQ ID NO: 42464 - DNA, 1152 bp, Glycine max
  Peptide Sequence Number=SeqID_159242
atggcggtgacaggaagacaaagaagcaaatgtagagaggaagagaaagaaacgacaccaagaaaagaagagaagacgaagcaaatggagcgtagaaaagatgaaacgatgcagtcacagaccattgatgttgtaaaacgtatgaaagagatcacacttgtgatgcaaactccagaacaagtcttgaaagaccaaggagttacccctgcagacattgaagatatgttggatgagttgcaagagcatgttgagtcaattgacatggccaatgatctccattcaattggtggcttggttcctcttcttggttacctaaagagttctcatgccaatattcgagcaaaggctgctgatgttgtgaccacaatagtccagaataatcctcgaagtcagcaacttgttatggaagcaaatggctttgaacctcttatttctaatttcagttcagatcctgatgtgactgttagaactaaagcactgggtgcaatatcttcactaatccggcacaacaaacaaggcattactgtatttcgtttggcaaatgggtatgctgctttgaaagatgcactagcctctgaaaatgtgagatttcaaaggaaagctctcaacttgacccattacctgttgcatgagaataattcagactgcaacatcgtgaatgagcttgggtttcctcgactgttgatgcaccttgcctcaagtgaagattcagatgtcagagaagctgcccttcggggccttcttgagcttgctcgcaatactcaagatggcaaggatggcaatgaggaagacagtgagaagatgaagcaacttcttcaagaacgaataaacaatatcagtttaatgtcagctgaggaccttggtgtagtcagggaggagaggcaacttgtggactccctgtggagcacttgcttcaacgagccatcttctcttcgagagaaaggtcttcttgtgcttccaggtgaagatgcaccccctccagatgttgctagcaaattttttgagcctcctcttagatcttcgactgcgaatccatcttccaagaaagactcaaacaatgaaaagaaagagatccctttgcttttagggtcagggccttctcttgcagacactaacaaccaaggttcaaatagagaaaatgctaatagctga

SEQ ID NO: 42465 - DNA, 276 bp, Glycine max
  Peptide Sequence Number=SeqID_159243
atgaggattccttttttacaggccaaggttcaaaaaggtgtcggtctcgggccgaacttccatattactccacaaggcacgtgtgacaatgatgatttgaaaacaacgtgcaaaattagtcatggctacagccaggtgggccctcaagcatcccgtttatggcattgtgatactatggttgggaatttacacaaacagacccaacgtttccaagttatgttctttcatcagttcaatgaattcatccatccttatctcggttattccggaaaataa

SEQ ID NO: 42466 - DNA, 408 bp, Glycine max
  Peptide Sequence Number=SeqID_159244
atgtctcttaggactccaagagaggctatagagatcatagagaacatggttgccattgctaacaaatttcaagaggatagagccatagttccatcaaatagattgctagaagttaatacccaagatcgaggccatgcaacaaatgagtatggcatgattcaggaggaagttcaatacaagaaaaaccaaaggcaagggaactaccagaactacaacaatcaaggctacaaacttcatccaattataggtcaagaacatgggagtagttttaatgccatgtctaggaaaattgtcatgtctagtcaagaacaagtaaactggaggaaaccctcacatagttcatgcaagtatctctttccaaccataagaatattgaaacctccattaaaagcttggagttccaagtag

SEQ ID NO: 42467 - DNA, 159 bp, Glycine max
  Peptide Sequence Number=SeqID_159245
atggatctctccttggagaatggatctctcagtctcaaggtacgcactgtaagtcatttagccatggcgaagatggatctcgccatattgaaactgaatcgtagaggcaaggcactctctacctgtgtaccagaattgtcgttgcaaattgacagctag

SEQ ID NO: 42468 - DNA, 351 bp, Glycine max
  Peptide Sequence Number=SeqID_159246
atggtagcctggcccgggacccaaccttctcttcacagggaagatggaggtcccacagcccagccaattattatagaagaagaggcagaggagacacaggtgagacaagtagttgctgccacacctgagcgatcccttgaggctacttcagacccttctacacagggggaggacataccctcacctcaacccgcagtagacccctccactcctcttctagagatgtcagaggacccgactacatcattcctggctatggacacttctcctccagctactctagtattgcatctgacggataaggaggatgttcagacacaagacacccaggaccagtcacaggaattctga

SEQ ID NO: 42469 - DNA, 435 bp, Glycine max
  Peptide Sequence Number=SeqID_159247
atgatcaacaatggtcaagatggtggtgttaccctggtatggtggaaggccgaaatgaagtccaacgagagacctgtccaatggatgtttttcgatatgagagccaaggtcttagtaactctggcatggccaccagtaggagtgtcatggtattcggtgagcaagatggaaggtgagcttccagttgttgacgaagttcgccaaggaaggtcaacgatggtactgatagaatcaaggacagagatgagactgtctcaggcttcgatggtcagtgaggatgatgaagcggtgaacgagaagaaagcaatggtgtgtccttgttgtgagaggaccacaccaatgcccatccccaaagcatccatctcgacggtgaatggcacaataaagttgggcaaggccaggattggtgctaaagacagggcatgcttgagttga

SEQ ID NO: 42470 - DNA, 558 bp, Glycine max
  Peptide Sequence Number=SeqID_159248
atggctactccacctcgctcgcctcctcctcctcctccccctacagacccatcggcgtctccatctactgtgaagtggacacgtaaagcaacacggctacgatcgttggccactagacaacttagtgcagggagactagtggtcaacattgatcctgataccggcaaggccgatggtccccacaagaagaaattacgaacatatttagggattgtcgcgtgtgataaggtcgatgtcacatacgagacctggaaggaagcggaatttgaaatccctgaagcttctgacagtaggacaaagaaaaaaattcttcagactgtcagtgagaggtggaggcagtttaaatcggacttgaccaggaaatgggcccttgtaaccaatcaggatggtgtagatgacattgtctgtaaaaaatacgacattagcaaggataaatgggctcaattttgtgagacatgcatagacccttcttgggaggatgtgcggaaaaaggcccaagtcatccagaagcaaaacactgcccccacgtgttgtctcgtaggggttgcgaatatttag

SEQ ID NO: 42471 - DNA, 756 bp, Glycine max
  Peptide Sequence Number=SeqID_159249
atggaggtatatccaaattacgtatttgggtcatcaaaacgaagaaaacaatttagggttggagatgatggtaagatattgtttgacgaagaagagctcaaaatgatcctcggtttcaacagaggtgaagactatattgaggttctttgtggcactacaaacaaagtatatggagattatgttgggaggctaaaaatcaataacaatggtgaatattttatcacttgtgagtgctgccctgggtgtcccttggtgaatgtgactccagaagcgtttgagaagcatgctttgaaagaagggactggaaggtggaagagcaacatctgggttcattgtgaagatgaagatagagttccactctggaagacacctctgacgaaatattacacacaccaggcaaatgtggctaactggaaagacactgcaatgaggaaacgaaactttcacagggatgagttcctacattgtacgagttgcaggaaggagcgcaggttccgtctcaagagcagaccagatattaagaactaccatgaagctttgaacaacaaatcctggacttgttctctttggccttaccataaaataacctgcgatgatgatgaagagagaccaagtctgagagcaagcaggggctgttctcgttcttcaacttgccaaggctgctcaacttgttactgcgaagggtgcatcaagtgccgctttgaggattgcaattgccaagaatgcagagactttatgctttatgctgaaccttaa

SEQ ID NO: 42472 - DNA, 606 bp, Glycine max
  Peptide Sequence Number=SeqID_159250
atgttcgacccaagcaagcacgaggggtccttgacccacctcgaggatttcctcactcgtctcggggataccatgcactccttgaccttgaagatggacaaactccttcaccgtgtttcgcctgtcaccctggtctccgttgcaactctagcacaagctcatcaccaccagccctttttccttgcaaccaatcacaagatgaaattagaagtaccacgtttcgatggcacaaaaccattaggttggatctttaagatcaaccaatattttgaataccacaataccccagacaaggatcgtctcaccattgcctccttctacatggaaggcagagctcttgcttggtttcagtatatgaccaacaatgctcagtttacatcatgggcgacattattgcaagccttacagacaaggtttgtgccatctcagtacgatgatcccaccagaaccctgtttaaactcacacaaacagggacatttgtagagtacatgtcagaattcgaagacctggccaacaggataatcggactatcgccaccctttctcttggcctacttcatctctggcttgtcgccggagattcgccgtgaggtgcaggcttactag

SEQ ID NO: 42473 - DNA, 723 bp, Glycine max
  Peptide Sequence Number=SeqID_159251
atggtgatctgtggttcttgccgaaggctgagcatgtggctgttggaagagaagcgtgaacttagtgaacgccttaggcatcaccgtaatgtggaagtaggaagtttcggcctggtagcgataaagacagcggaactggtgctgagtaagggcccccaaattggtgtcgtgctcgccttggagctcaaccaagcggtcctgataaaaaaactacatggacaaagtattatagttggtcaacactggacccaaggtcttaagccattggacacccaatacgacattggcgcgcggaaattggtaaaatgtagaggtccaggacgaaggtattgtcctgaatgtccacgaccacagcttcacaaatgcttgtacactccaagtattggtcgttacctacaattacacagagtggttgtcaggcgggttgggtgtcgggtgtgggtcgccctgctctatattaggccaagaagaaccctaggggtgcaacgattccctctgtggtacttctcgtcgcagttgaagcataacccacgctcatggcgtctggttagctcctttggtgtcaagcgcttcactggtggtggtggtggtcggcgaggcgatggcaagagaggtggaagcgaagtcgagcgaagagggaggggagctagtggcagcgggcatgcacgcgtgggcggtgacagcccgagagcttttcctcctggaggtgggcagggccggtag

SEQ ID NO: 42474 - DNA, 1392 bp, Glycine max
  Peptide Sequence Number=SeqID_159252
atgttgtggttaactgccatgttcccagacctaaaaccttcctgtgaatcatacatgctagactgcaactctggtacaccagcccaacaagctcttttgttcctttctatgggattaatttctattggagctggttgcgtcagaccttgttccatagcctttggagcagatcaactgaacattaaagaaagatctaatgatgagaagctcttggatagctactttaattggtattatacctcaattgcaatatcaaccgtgattgcactgagtgtaattgtgtacattcaagaaaatctaggatggaaaattggatttggactacctgctttgctaatgttcatatcggctgtcagtttcatcctgggtttgccgttctatgtcaaagtgaagccaagtcacagcttactcactacttttgtacaagtagctgtggtggctgtaaagaacagaaaacttagtcttcctgattccaactttgttcagtactatcaagaccatgattcggagctcatggtccctactgatagccttaggtgtttgaacaaagcttgcataaaaattcctgagacagtctcgatctcaaaccctgatggatcagtttcagatccatggagccaatgcacagtggaacaggttgagtcactgaaatctttgctcagaatcctacctatgtggtcgacgggcgttttaatgatggtgtcccaaggctcattctctaccctccaagcaaataccatggaccgaaggctatttggaaatttcaagatgcctgcagggtccttcaatcttatcatggtattgaccttatcaatagtcattcccttgtatgaccgcataatggtacctctactagccaaataccggggcttgcctagaggattcggttgcaaaactcgaatcgggatcggattgttgtttgtatgctcagctaaggcgacgtcagctgtagttgaaactatgaggcgaaatgcggccattgaacaaggctttgaggaccaacctaatgctgtaattgacatgtcggttttatggctgtttcctgagtttgttttgcttggaataggcgaggcttttaactcggttgcgcaggttgagtttttctacacttgtatccccaagaccatgtctagttttgcaatggctcttttcactcttgaactagctgctgctaatgtagtggggagtgtgttagtgagcattgtggacaaggtcactagtgtaggagggaacgagagctggatagcaactaacattaacaggggacatctgaattactattatgcactgctcacttgcttaggtttaattaactacctctactttcttgctattagtttggcttatggtcctcctcccgggcaaaaacttgaagctagaagagaaatttga

SEQ ID NO: 42475 - DNA, 1692 bp, Glycine max
  Peptide Sequence Number=SeqID_159253
atggtcgacatttttgcaagccttacaggcaaggtttgccctgtttatactcacacaaagagggacagttgtagagtacctgtcggagttcgaagacctggccaacaggataatcggactgtcgccaccctttctcttggcctacttcatctctggcctgtcctagaagattcgtcgcgaggtgcaggctcaccaacctctcacgctggtccaggctaccggccccacccgcctccaggaggagaagctctcgggctatcgccgccctcgcgtgcatgcctgctgccactagctccactacctcttcgctcgactccacttccacctctcttgtcgtcgcctccccgaccaccaccaccaccaatgaagcacctgacaccagaggagctaacctcacgccgtgagcatgggttatgcttcaactgcgacgaaaagtaccagagagggcatcgttgcacctcttgggttcttctactcattggggaaaaagataacccttctttgcctaatatagagcagggtgacccacacccgacacccgacctgcccgacaacccggatccataccaggcccaaataagtttaaactcactttcgggccacttagcaggcctcttgcccagccaccgtgtcactgtcctcgtcgacggaggaagtacacataatttcgtacaaccttcggtggtcacctgcttgtgcttgccttgctggacgatgtctacaccactccgtgtaatggccgacactttctacttccacattacggtgatgcccgaggtgtctatagtccccaatgcccaagtcatacccaaagggattcagcacttactcacgaagttcacgcttctcttccaacagccacatgctctgcctccggcaagaaccatagatcaccatattcacctgcttcctcactctttgccgggtctcatccaacccagcacgagcccattctcgtcgtcggtgttgcttgtaaccaaactagatggcacatggcgcttttgcatggactaccatgctctgaacgcggtcaccgtccgagataggttccctattcggacaattgacgaattgcttgatgaattgggtggtgcccaatgctttttgaagctcaatttacgacagggataccatcagatacaaatgaatgatgccgacattcccaaaactgcatttcggacgcaccatggtcattacaggtttaaagtaatgtcattcgggttatgcaatgcgccgtcttcatttcaggccactatgaacgtggagtatctcgggcacctggtttcaaaaagagttcgaagcttcttgggactcaccgggttctatcgcagattcattcgtggatacacaaatatactagctcctttggttaaggcatctacggtggaaccattccagtggaccccacaagctcaagcggctttcgatcaactcaagcataccctgtctttagcaccagtcctggccttgcccaacattgttgtgccattcatcgtcgagatggatgcttcgggggtgggcatgggtgtggtcctctcacaacaaggacactccagtgctttcttcagcaagccatccagtcagaagctcctccgtgcatcaacctatgtccgagagctgtgtgctataaccacggtggtgaagatcatggagacaataccttctcggtcactacttcatcatcctcactga

SEQ ID NO: 42476 - DNA, 855 bp, Glycine max
  Peptide Sequence Number=SeqID_159254
atggctgaagagaaatccgggtattcacctcaactgaagagaaatcaaaaaatagagataaagaaagaattcaacaattttactcaaggagaaaattgccgacgagaactcaacgggaacaatggagggtcatcaaaacgaagaaaacagtttagggttggagatgatggtaagatattgtttgacgaagaagagctcaaaatgatcctcggtttcaacagaggtgaagactatattgaggttctttgtggcactacaaacaaagtatatggagattatgctgggaggctaaaaatcaataacaatggtgaatattttatcacttgtgagtgctgccctgggtgtcccttggtgaatgtgactccagaagcgtttgagaagcatgctttgaaagaagggactggaaggtggaagagcaacatctgggttcattgtgaagatgaagatagagttccactctggaagacacctctgacgaaatattacacacaccaggcaaatgtggctaactggaaagactctgcaatgaggaaacgaaactttcacagggatgagttcctacattgcacgagttgcaggaaggagcgcaggttccgtctcaagaacagaccagatattaagaactaccatgaagctttgaacaacaaatcctggacttgttctctttggccttaccataaaataacctgcgatgatgatgaagagagaccaagtctgagagcaagcaggggctgttctcgttcttcaacttgccaaggctgctcaacttgttactgcgaagggtgcatcaagtgccgttttgaggattgcaattgccaagaatgcagagactttatgctttatgctgaaccttaa

SEQ ID NO: 42477 - DNA, 315 bp, Glycine max
  Peptide Sequence Number=SeqID_159255
atgccgagaagacatagcaacgcacacaaacatgacattacaaaaatatgcatggtggtggcacctaactttcaaaggtgtctagagatatcgttccctttgatatcaaacattgtggcagtagggactaccagcgacaacgtattatcaaagagaaaaactctagatgaggtttcactatcatcaagcaagtcagagacttatcatgaccacatattctcctccgcttcctatgttcccatggacccgggtatagggcccttaataactcaccgtgtgtgcaaaaagtgtaggtgtcgtgtgtgcatcaaataa

SEQ ID NO: 42478 - DNA, 780 bp, Glycine max
  Peptide Sequence Number=SeqID_159256
atggttggagcaatctcacaaaacatcgtgaccctgactggtcatcctatgatcttacttagtgagagtgacctgacaaacccatggtgtggtgtgtcttgttatgtactcctaagcgccctagggtggtttttcactgacatgggtgtcacacatatactgaaaccaagcaagagctctgccttccatgtagaagaaggcaatggtgagatgatccttgtatgggttggtgttggagctatagtggagaccggggtgactggtgggtcgaggatccctcgtgcttgcttgggtcggacatggaggcaacaagagcaccaaatgttagggatgcagcaagctggttttcgaggaactagtacctccaacaattcaataaggaagaagaagaacaaagagggaaagagtgaggagcaaataatatcaagcaaggaaattctagaaggtagcctcagttggtctcacccttcttctaaaaacgtagtctttgaggtaaaaagctcgtatcaacatgtttccgacccagatgaagcttggacatgcagcaggaagggtgataaaaataattgggatgaggttcttaacaaggtagagatgcaaaaatgccataagcataattgggatgaggttcttaacaaggtagagatgaagcaaaatccaagctgctcagttatggtggacaattggtatggcgaatttcttgaaagcattgagccttccatggtgaagcaaatccctttctgtgaagctgttcagagaagctctccagtaggttcataa

SEQ ID NO: 42479 - DNA, 519 bp, Glycine max
  Peptide Sequence Number=SeqID_159257
atgggatcattcgacccacgagaggagcttcccccacaagcttggccgaggatggatgaaggctcgcaaatattgttcaattatgcgattcaaaacctctgtctgtccatcaatttgtgggtgatacgagaagctcattcgcaaaagtgtcccactcaaacggaagagttcttgcaagaatctgctgatgaaaatagggtctcgatcgaagaccaagctccagagaatcctatggattttgacgacaatgtggatccatttggaaaaatgatcaacgacgaccaagatggtggtgttaccctggtatggtggaaggccgacgatgaagtccaacgagaagtcctcccaggacctgtccaatggaagttttctgatatgagggccaaggtcttagtaactctggcatggccaccagtaggcgtggcatggtattcggtgagcaaggtggaatatcgcaaatggattggcgaaggcccgtgtactcagggtgagcttctagctgttgacgaatttccttaa

SEQ ID NO: 42480 - DNA, 294 bp, Glycine max
  Peptide Sequence Number=SeqID_159258
atgacatcagcctcggtgtcgaatattgtgagcacagttgcaatgccactctactcaaacgctgatgtaattgcgagcatgagaggctggagagcattcctccatttcaatccatgcccatgttggggcaggacctttgtatcaaggaggccttctgatgtagctccatgtggagcttgtgggccttggatcttcttcatcaatggacaaaatggagaaggaagaaagatgattggagacgccacttcaaggattcaaggagaagatgagtcaagaagaagctcaccaccatag

SEQ ID NO: 42481 - DNA, 1021 bp, Glycine max
  Peptide Sequence Number=SeqID_159259
gatagcggtagggacacacattgaccggcgaagagtgaggaagcaggtgaatatggtgatctgtggttcttgtcggaggcagagcatgtggctgttggaagagaagcatgaacttagtgaacgcctcgggcatcaccataatgtggaagtaggaagtgtcggcgtggcgacaacaaagacggtagaactggtgctgattaagggcccccaaattggtgtcgtgctcgccctggagctcaaccaagcggtcgaggatgcaggtattgtcctgaatgtccatggccacaacttcacaaatgcttgtacactccaagtattggtcgctacctaccattacacggagtggtgtagagatcgtccgacaaggcaagcacaagcgggcccgctaagcgtagcgcttttggtgctaggtggcccgaaagtgagtttaaacttatttgggcctggtatggatccgggttgtcggcataacccatgctcacggcgtgaggttagctcctctggtgtcaggcgcttcactggtggtggcagtggtcgaggaggcgacgacaagagaggtggaagtggagtcgggcgaatagggagtggagctagtggcggtaggcatgcatgcgagggtggcgacaacccgagagcttctcctcctgaaggcgggccagagatgaagcaagccaagagaaagggtggcaacagctcgattatcctgttggccagcattgttggtcatatacttaaaccaagcaagagctctaccttccatgtagaaggaggcaatggtgagacaatccttgtctggggtattgtgggacaaagggttggtggtgatgagctggtgttggagttgcaatggagaccggggagactagtaaaacgtggtgaaggagtttgtccatcttcaaggtcatgggacatggaggcaatgagagcaccaaatgttagggacgcagtaagctggttttcgaggaaccagtacctccagcaattcaataaggaaaaagaacaacaaagagggaaggagtga

SEQ ID NO: 42482 - DNA, 405 bp, Glycine max
  Peptide Sequence Number=SeqID_159260
atggcagttcgaagcttcttgggactcgccgggttctatcgcagattcattcgtggatacacaactatagtagctcccttggttaaggcaactacggtggaaccattccagtggaccccacaagctcaagcgactttcgatcaactcaagcataccctgtctttagcaccagtcctggccttgcccaactttgttgtgccattcatcgtcaggatggatgcttcgggggtgggcatgggtgtggtcctctcacaacaaggacaccctagtgctttcttcagcaagccatccagtcagaagctcctccgtgcatcaacctatgtccgagagctgtgtgctataaccacggtggtgaagatcatggagacaataccttttcggtcaccacatcatcatcctcactga

SEQ ID NO: 42483 - DNA, 279 bp, Glycine max
  Peptide Sequence Number=SeqID_159261
atggcgggaattacctggcacaaggagttactcaacgaccaacccctcgtgtttccattagctatcttggattaccgtagagcatccaccgaggatccctgggaggtgttcatgcaatggaatggtatctcacctgatgatacctcgtgggaagactggaatcagctgtgtgaaaactaccaccttgaggacaaggtggtcttacaagggccgagggaggatacgagcttacaaatagaggtaagggcaggggtcacaaaatcaaaagaaggggtgtag

SEQ ID NO: 42484 - DNA, 594 bp, Glycine max
  Peptide Sequence Number=SeqID_159262
atggtgatctatggttcttgccagaggcagagcatgtggctgttggaagagaagcgtgaacttagtgaacgcctcgggcatcaccgtaatgtggaaataggaagtgtcggcctagtggcgataaagacggcagaactggtgttgagtaagggtccccaaattggtgttgtgcttgccctagagctcaaccaagcgagatcgtccagcagggcaagcacaagcgggagaccaccgaggatagtgacacggtggctgggcaggaggcccgctaagcgtagcgcttttactgctaggtggcccaaaagtgagtttaaacttatttgggcctggtatggatctgggttgttgggcgggtcgggtgacgggtgtgggtcgccctactctatattaggcaaagaagggtcatctttttccgcgatgagtagaagaacccaagaggtgcaacgatgccctctctggtacttctcgtcgcagttgaagcataacccatgctcacggcatgaggttagctcctctggtgtcaggtgcttcactggtggtggtggtggccggggaggcgacgacaagagaggtggaagtggagtcgagcgatga

SEQ ID NO: 42485 - DNA, 270 bp, Glycine max
  Peptide Sequence Number=SeqID_159263
atggtggtgttaccctggtatggtggaaggccgacgatgaagtccaacgagaagtcctcccagggtcagcatgccaaatatgacctgagtgtagcaccaagtcttgagagagagaaaattggtggtatttgtggggagtatcgcaaatggattggcgaaggcccgtgtactcagggtgagcttccagctgtttacgaatttcctcaaggaaggtcaacgatggtactgacagaatcaaggacagggatgagcctgtctcaggtaatctag

SEQ ID NO: 42486 - DNA, 708 bp, Glycine max
  Peptide Sequence Number=SeqID_159264
atgtcaaccaagtttggaagattggtgcctttggttttttccaaaaggggattttccacctccaccagtattcaaaagggtggttctgaggaaggtttaaaatcattgaacctctgttctgcaattaatcaggctcttcacattgccttggacactgatccccgttcttatgtttttggagaggatgtcagcttcggtggggtcttccgttgcaccactggattagcagaccaatttggtaaaaagagggttttcaatactcctctctgtgagcagggtattgttggttttggcattggtctagctgccatgattgtcaatgaagctgctaaattcagataccggagtggtaaccaatttaattgtggaggtttaacagttagagccccttatggagctgtgggccatggtgggcattaccactctcagtctcctgaggctttcttctgtcatgttcctggtatcaaatggctttatcgtttggctgttgaagaagtaccagaggatgactacatgctgcctttatctgaggctgaggtaattcggcaaggaagtgatataacacttgttggatggggagctcaattatctataatggaacaagcttgtcttgatgctgaaaaaactcagtttttccacaaaggaacagaattgggttgcaacctactatgcgtgattgcattagatatggaagggaaaccaagttga

SEQ ID NO: 42487 - DNA, 792 bp, Glycine max
  Peptide Sequence Number=SeqID_159265
atggcacaatgctgggatccccaaatgcttggattgttaaaaaggaatcacattcaagccacagggtcatcaaaacgaagaaaacagtttagggttggagatgatggtaagatattgtttgatgaagaagagctcaaaatgatcctcggtttcaacagaggtgaagactatattgaggttctttgtggcactacaaacaaagtatatggagattatgttgggaggctaaaaatcaataacaatggtgaatattttatcacttgtgagtgctgccctgggtgtcctttggtgaatgtgactccagaagcctttgagaagcatgctttgaaagaagggactggaaggtggaagagcaacatctgggttcattgtgaagatgaagatagagttccactctggaagacacctctgacgaaatattacacacaccaggcaaatgtggctaactggaaagactctgcaatgaggaaacgaaactttcacagggatgagttcctacattgcacgagttgcaggaaggagcgcaggttccgtctcaagagcagaccagatattaagaactaccatgaagctttgaacaacaaatcctggacttgttctctttggccttaccataaaataacctgcgatgatgatgaagagagaccaagtctgagagcaagcaggggctgttctcgttcttcaacttgccaaggctgctcaacttgttactgcgaagggtgcatcaagtgccgctttgaggattgcaattgccaagaatgcagagactttatgctttatgctgaaccttaa

SEQ ID NO: 42488 - DNA, 603 bp, Glycine max
  Peptide Sequence Number=SeqID_159266
atggcccaaacgagtggagacggtccaacctatgttgtcagtagcagtcgtcgcagttttgtcaataataaaaaaagcaaaatcccagctgctcagttagacaattggtatggcgaatttcttgaaagcattgagccttccatggtgaagcaaatccctttctgtgaagctgttcagagaagctctccagtaggtcagatctttgctgatatgaaaccttcatggatgggaatacaactgagctttcgtggaatggacctcttggagagccatttgctgtattttgccacaaaaaaccaaagaaacacccggatagaaaataatcccaggttcactaaattgaggatcctcctatggaaaatacaactccgagttatcaaatttcaacaaatccaatcacagaacaacaaatccatatcagaacaagttaccaaggcattggaaaccaacaacaatccctttttgtttcatgatgtaattatgaattcgagttacatgggaacaaagaaaatgtcaagcttcaacaaccttgatggaggtgcagacacaatctatagaatttggagtgtctgtcacttatatttccaccatactggctactag

SEQ ID NO: 42489 - DNA, 345 bp, Glycine max
  Peptide Sequence Number=SeqID_159267
atgccgaaaggtttatacaatgtaatatattgtgaattttttgttaaaaattggaaggatattggagttgcagtgtcacctgtttttagaacgggttgtgggtgttatacaatgattggccctgtggatgctaatataaagcagaggaaggtatataatggtcgcaagcgtgtgggacccactgaattgacacggcctaaagagggttccaaaccagaagcaaagattcttttctacgatacactggaatcggatctatcccttcctcccccatggcttcgccgggatttcagccaaataataccaaccacagatctttctttgatcacaagctcggccaaatag

SEQ ID NO: 42490 - DNA, 177 bp, Glycine max
  Peptide Sequence Number=SeqID_159268
atgaggcgagcacagggtcatggcgatggtggtggcagcatggcgacacgacctgacctccccaaacaacagttcttacgaccctcgtcggcgaccaaggtgcccatgtcgacggccaaggcgaccctcactgcgcaaccaatgtatgatatttggagaggaaagtttaaaaaatga

SEQ ID NO: 42491 - DNA, 198 bp, Glycine max
  Peptide Sequence Number=SeqID_159269
atgcaggatatatacattcttaacattgctgccaatgtatacattttcagaaataatcaaatcttcaagaggatatcccacaattggctaagcaccttgacaaagtattcacaagatacactgatgaatatatccgtaggaacaagtgcaaacacaaaggcagaggttttgttgagtaattggtcccctcatgaatga

SEQ ID NO: 42492 - DNA, 534 bp, Glycine max
  Peptide Sequence Number=SeqID_159270
atggggtccccctgggaccggaaagacaaaatctttggccacactacttttgctctattgaaaatgaaatatagagtccttgtatgtgcccccacaaatattgccatcaaagaagtggcttcacgtgtagtaaccttagtgaaagagtcacatgctaaagaatctggtgatttgttctgttcaatgggagatttgctactctctgggaacaatgagaggctaaaaattggtgaagatattaaagatatatatttggatcatctagcgcaacagctagcagaatgcttagcaccttctactggtttgagttcttgtcttaaatcaatgattggttttcttgaaaattgtacttcttattatcatattgtcaaggatgagtatgagttgggaaaaaggaagaggttggagatgcttttcacttatccagaattaccagagatactttcttggtcatttgattatgctatataccagttgcacaagaagagagctgaatgtctaactgctttaataactgttaagggattcacttga

SEQ ID NO: 42493 - DNA, 462 bp, Glycine max
  Peptide Sequence Number=SeqID_159271
atgtctccctatgctggccaagttactgctattcaagagaatctcggcaagatgtatgataggcataaccatgatggatttaatgtgaatgttaagtccatcgatggttttcaaggtggtgagcaggatgttattatcttatcaactgtaagaaccaacaacagagcatctcttgagttcattgcctctctgcagaggactaatgttgctcttacaagggctaggcactgcttatggattttggggaacgaaagagccctcacaagcaacgaaaatgtttggaaggctattgtgcttgatgctaagagccggaaatgtttctttaatgtggaccgagacaacgaaatgacaaaagctattttggatgcaatgaaagagtcagatcaatttgatgatttacttgatacaaatagcgtccattttaaaaatgcattttggaagatatgtggatcctggacttaa

SEQ ID NO: 42494 - DNA, 1515 bp, Glycine max
  Peptide Sequence Number=SeqID_159272
atgacttggctgaaagcgttatatgttatacgggagaagcggtggttggttgttgaaggtactaatagcccgaagcagaagaaagcttctctgagaagaagtgaagcaaaacaaaacaagaaaagcatgatgtcgagaataaacaacaacggcgttgcctggatgggcgaacgagaagacgaaaactctcgaaaccacaacatcatacccaccgacacaaccacaacaaacacaggtttcgtcgaaaccacaaacaacgacttaggttctctctgcgccttcaagcccatgctcgacgtcgacgacgaatggtacaacaacatcaccaaccaccaccaccaccaccaccaccaccacgacatgaccttcgaccccgacaacctcttactccacgctgccaccgccgtggactcctcctcctcctgctccccctactttttccctcccaatcccaaacccccctttcttgtcaaccccttcgatatgggctttcttgaccctcaagcttcttcttctccctctctacccctcctccccgaatcaacacacttcacaccccctcacaccaccaccaccgctttcgccggcttccagagccgcctccaagagagtggttcttcaaaatctctctttttgaggcctctcgagtcgctgccaccctccggggcgcaacccacgctgtttcagaagagagccgcgcttagaaaaaacatggaagggagtgataataataagaagaagaggaaggagaaggagaaggacgaggaggttgaggatttgagtttcgatggctccgggttgaactatgattctgatgacttgactgagagcaattataataatgtttctgagggtaatactgggaagaatggtggggttagttccaacgcgaacagcaccgtcatcaccggtttggatcaaaaagggaagaagaagggaatgcctgctaagaatttgatggccgaacgacgccgtaggaagaagctcaatgatagactctacatgttgaggtccgttgttcccaagattagcaaaatggacagggcttcaattcttggggatgcaattgagtatctgaaggagcttctgcaaaggatcaatgatctgcataacgagttggaatcgacaccagtgggttcttcactcactcctgtctcaagtttccatcctttgacgcctactcctcctacgctgccaagccgaatcaaggaagaactgtgccccagctcattgcccagccccaatggccaacctgctagggttgaggttcggctgcgcgaaggaagggctgttaacatccacatgttttgtgcccgcaagcctagtctgttgctctcaaccatgagggctttggataaccttggattagacattcagcaggctgttatcagctgcttcaatggatttgctatggatatttttcgagccgagcaatgcaaagaaggtcaggatgtccatccggagcaaatcaaagcagtactcttggattcagctggctacaatggcatgatgtaa

SEQ ID NO: 42495 - DNA, 1311 bp, Glycine max
  Peptide Sequence Number=SeqID_159273
atggcatcatcggaggtgacgatgaagggaaattgcttgaaccacaacgacggcggagccacggagcctcattcgccgtccacggccaaagacgcagaagctgcacttttcagggaactatggcacgcatgtgccggtcctctagtcacggtaccgcgggaaaaagagcgcgtgttttatttccctcaaggacatattgagcaggtggaggcgtcgacgaatcaggtggcggaccagcacatgccggtttacgatctcccacccaagatcctttgtcgggtcatcaacgtgcagctgaaggtagtgttggttcgatctgtgtcactttttttcgttattaataaaaaaatttctcatgctttcgaacaaagcaatcctcaaaaagagcatgcttctttttttcaggccgagcccgacacggatgaggtgtttgctcaggtgactttgcttccggagccaaaccaagatgagaatgccgtggagaaagagccaccaccacctccgccaccacggtttcatgttcattctttctgtaagactctgacggcgtccgatacgagtacccatggtgggttttctgtgctgagacgacatgctgatgaatgtcttcctcctctggatatgtcgaagcagccacccacacaggaattggtggctaaggatcttcatgcaaatgaatggcgatttaaacatatctttcgaggtcaaccgcgtagacacttgcttcagagtggttggagtgtttttgtcagctccaaaaggcttgttgctggggatgcatttatatttcttagaggtgaaaatggggaacttcgtgttggtgtccgacgtgcaatgagacagcagggtaatgttccatcctcagttatctcaagccacagcatgcatctcggtgtccttgcaactgcttggcatgccatcttgaccgggaccatcttcactgtttattacaaacctaggaccagtcccgccgaatttattgttccgtatgatcaatatatggagtctttaaaaaatagttatagcatcgggatgcggttcaaaatgaggtttgaaggtgaagaggctccagagcagaggtttactggtaccgttgttggaatagaagattctgatcccaaaaggtggagagattccaaatggagatgcctcaaggtgagatgggatgaaacatccaacacccctcggccagagagagtttccccttggaaaatagagccggctcttgctcccccggctctaaatcctctttcaatgcccaggcctaaaaggcctcggtctaatgcagttccttcatccccagattcttct

SEQ ID NO: 42496 - DNA, 168 bp, Glycine max
  Peptide Sequence Number=SeqID_159274
atggttagttttggttctactaaaagggtggcagcaagaacagaacagaccattcaattcccttttgttcatgtgacaaactctaccaacatcttcacaccttatgctgctgttattggtgttgatggtggtggaggtggtgatggtgttgttcttctttggccttag

SEQ ID NO: 42497 - DNA, 1632 bp, Glycine max
  Peptide Sequence Number=SeqID_159275
atgggatttgaagctaataaacaattgatggatgagtattctggtaaaagaggtgtagatgggatggtattccctagaaagggaatgagccatgtatttagagatactgctaatactagagatcgaaatcgtcaaatttgtagccgattgggttgcagtagccgagccaatcttcccaaagttgctcaagtcagatgttctgaaaaaggtaaatctttgaggccttcataccagtcctcttcaagtagcaagggagcaattggaagttcctctagaactactagtaacccagccaaacgacttttagaacctaggaaaacattatcctctcagtttgaggcagattcatctgaaactagtagtgtacaggatggaccagaattttcagagctcatccctccaacagaagaaattcggagagggcctctagctgaaggggaaaatacagagtctagtaatgcaatattgatggaagtaggaagttccagtgcagtatcaaatactagatctcaaaggaatttaaatcaaagagctggattgcgtgggcaagaaattaaaagcactggtgcagtgagacaggctgtttccagcagttatgggttaaggaacctcaaatgcaactctatatctgatgtcgtccgatctggttgttcatcatcagattcaagccttaatagaaggaaggatacaataaaaaagggaaactgtgaagggggagatagttccactggtagggggaagaatatcactgggtcttcactggaaggaaggaattttggctccagaaatggcatatctatatccaactcaagaagatctagaaatattccttctcaccggaacaccagcgtggcatcagtaagaactccaagatcaattagtggtcaagccagggcaaggttttctagccaaggaaatgaaaaccctttgccaaccagtgagtcccctgttattgtacccctttcacctcattctggtgatcttaatgctcctggcttttcatatcatacttctatggagactcctttaagtggctcaagctcttatggtagaccaggcaatagcagtgagcagttaagtggtgttatgcctgtgtctcctgctgaagatgacatcactcattctctaataaatagagatagctttggacattacaatatgggtggtattgcagaggtattattggcacttgagaggattgaacaagatgcagaactaacccatgagcaaattcttttgttggagaccaacttattcctcaatggattaaacttttatgatcaccacagaggcatgcggttggatattgataacatgtcctatgaggaacttttagctctagaagagaggatgggaactgtgagcaccgctttgccggaggaagcatttgctgaatgtcttaaaagaagtatatatcagtctgcatatacacatgagtgttgtaatgaggataaggatgatatcaaatgctgcatttgccaggaggaatatgttgttggagatgaagttggggatctgcaatgtgaacatagatttcatgtggtttgcatacaggagtggttgcggcataagaactggtgccctatttgtaaagtctcggcagcaatgtccaattcatcttcacctcattga

SEQ ID NO: 42498 - DNA, 468 bp, Glycine max
  Peptide Sequence Number=SeqID_159276
atggatgcacctactcaacaacatccacctcctactctcattgcttccaaagtaccaggtattgagagtgatgatgataggcccttggtcttcaagaaaagaaaagttgcaccaccttcatttgagacctatgtgcctcaagtgaagaaggatccaccaacagggatagaagttcctcctcctccaacatggaagcgacttcaccccaaggtgtccaagccttcatcaccaacaataaaacacaagattatctacaaaattccttctagagcttgcagagaaaaggtcagctatgacaaggacaccattggttggtttcacaagattgatgcacaacaatttgatccatcttctgatgatttcttgcctccctttctctgtacaaaacatgtccaacttttcactcccatgtctaagtttgttcctttagactatggccatcaagctctcccctttactaaggatgat

SEQ ID NO: 42499 - DNA, 630 bp, Glycine max
  Peptide Sequence Number=SeqID_159277
atgtcggtcaagggttcgttgtcgagggagttggtgggaagcgagtctaaggttctagggttcgacaacaaggtttttgatgtgtccttctgcccaatgtggcttaaaaaggtgagagagagcattgcggttctagtggttgccgctgcaattgaagcaggaaagtcctttcagcctaggaggcgccccgtgctaaaggaaaagtgtttgcctcctcccatcacgcttccagagtataccaaggatcacagggggaagcaaaagcataagaagcagagccaccaggaccatcgaagtggcttgggggaatacttcgagcactcggaaggcacctcccgggataaaaggctcaagcagtcaacgcttgagatccaaccttccattgtctccactttgggcaaccttgtggctttgacaaatcaaagctttttcaacaataactttcagttggatcgtctggtccaatcgaagatgattttagaggatggccaccaggggtcgtcaaacaccgagggcttaaaagatcagttgctgaaagccaaggattctatgaacatggcacttcgagcaaacatgaagttggccggcgacaactacaacttagggcaaatatctgcctctgaattccaa

SEQ ID NO: 42500 - DNA, 884 bp, Glycine max
  Peptide Sequence Number=SeqID_159278
cgcacacggagccggctgcaccgacctccgcgccgtggtcccacctcggacgtccgtcgacggacgctcgggtcccgaatctcctgctccctgacgtcgatgacctcgccagcggcacacccgtcccggtccccgtcgacgaggaagagctcggccggtgggtcacggacccgacaatttcggtgatcgacctcaccgacgccccggtgtcccagtacattcctcccaagccgaagcccgctgaccctggggtgccaggaccaggacccgatgacggcgagcagccgacgctcagccctggcgtcacttctcccgttgatgccacggtctatgttgcgccgctgatcaccggacagactgctccgggaaacgccgtcgccatcgacttcgcgtcccagcggtacgcgattgacgttgcgtccgacggatcgtggagtttcgatacacgtgcgctggcgttcgatcccggatcctatgactactccgtgtgggctttcacacccacgcaacagtcgctcgcaacgacagggaccatcgtcctacaagctccgacagtgcaaggattcgagcagatcgatggaccgattccgctcgacgaagcgcgcaccacaggagttgtgatctcgatcaccgggccccccaatggcaccgtctgggtctcgacgcccaagacagacgccaccatcacgttggacgacgccgggcatgcgatccgccgaatccgaatgctcgccgatggctggtaccccttcgggatcgcggtcatcgatgccgagtggtacgccggacccggcttcggcgccactgtcgatgtcctggacgcggatcgggacccaaccctgccgcgcggcagcggcggggtctttgagatcgtcgatccctga

SEQ ID NO: 42501 - DNA, 165 bp, Glycine max
  Peptide Sequence Number=SeqID_159279
gattctattgaaaacattattgatgtcaaagcggatggtggttgtggttattgtgcaatagctaccttattgggttaccatagagaagtagatgaatattacggatatgaggttttttttatgagatcattgtcctttaccaccattggcgttgttatggaatag

SEQ ID NO: 42502 - DNA, 666 bp, Glycine max
  Peptide Sequence Number=SeqID_159280
atggcgggaggttttaaagacaagttgggtgaaggaggatatggctctgtgttcaagggaaaattgcgtagcgggtcttgtgtggcaataaagatgttagtggctcgtggaattgcttatctccactatgggtgtgagatgcagattttgcactttgatatcaagccccacaacattctactagatgaaaacttcaccccaaaggtctctgactttggattggcaaaattatatccaatagataatagcattgtcccaaggacagcagcaagaggaacaattggatatatggctccagaattgttttataataatattgggggaatatcccataaggctgatgtttatagctatggaatgcttttgatggagatggcaagcaagaggaaaaatctaaatccccatgcagagcgttcaagtcaacttttctttcccttttggatttataatcatattggagatgaggaagatatagaaatggaagatgtcacagaggaggaaaagaaaatgataaagaaaatgatcatagttgcactttggtgtatacaattgaaaccaaatgaccgtccctcaatgaacaaagtagtcgaaatgcttgaaggagacattgaaaacttagaaatacctccaaagccaactctgtatccaagtgaaacgatcacataa

SEQ ID NO: 42503 - DNA, 282 bp, Glycine max
  Peptide Sequence Number=SeqID_159281
atgaagaacaaagccctctttaggcttcttgttattcttctggctcttttcttcgttgtatttgttgctgctgttcctgcaaccagaagctccatgatcgggaaaattgatcctttagtgcaagatcatctggctaaggaggatcttgttatgtggttaaggaatagcgaagatgaaatgaaagaagggactttagagaccagaatgttgatggatgttgtggactaccctggaacaagaccaaatccagcccattatccaaaatctcctggaaagccttga

SEQ ID NO: 42504 - DNA, 927 bp, Glycine max
  Peptide Sequence Number=SeqID_159282
atgacagagcctcctagtgtgctgcccctccaaataatgataatccttctccttatcaaaagtggcagcagcaacaatgagtgtggggaatggtcttgcggctctggccaaccacctatcagatttcccgtcaaactcatcaagggaattaaagatgaatgtggttatccggggttttgtctatattgtactcaaaagcatgagactatgcttgttctctcctccgtaaaactccaagtcagttacataaactacgaaaatcatgaaattgtgttgaatgacccggaaaattgccttccgcacaagtttctgcaaatcaacgattctcttattcatccttacaaatttgacgatgaagctaaaacaagtaagttgagcttcttcaactgttcttcagttgagcatcaacacctgagaaactaccagcagtcactgtcagactcacaagacatgatctcctgtccgatttatgtttctgatcttcatgacagtgtgctcagtttggacctaacatcctgtaccaaaatgttcgatatcgttacgccagtttcggcatacgggatgcagcgaaattcgttggatttaagatggtccgaagcaaattgtagtcagtgcaaagcaaaaggcaagaaatgtaaatggaagaacaacagaggtgacatcgaatgtttcgactgcaaggacaagcgaaaaactattcatgttcccaaatcttttatttactctgcaccaggttcgattcttttggggttcgcggttattgtcgtttttaagatcatataccattttagacagaaacaagaggaccaagcaagggtggagaagttcttagaggaatacagggcagaaaagcctgcaagatttacttatgcaggacttatatacctttttgataaaaactcatgcatgacttatatacctttttga

SEQ ID NO: 42505 - DNA, 639 bp, Glycine max
  Peptide Sequence Number=SeqID_159283
atgtcggctaacattgccggagaagaagaagctgacgacgttcatgctaatcgaaagtggctacaccacccagttctcctcttcctcctcctactgcgaacaagaaaagccacacgactaagatcattggcgactaaaccagttaggatagagagaccgctggtccatgtcgatcctacgatagggaagaccgacggtccccacaaaaagaaaaattggaagcaagtccctgttgctcagaaggatttgatatgggaggatattaaggctgaatttgatatccttgaagcatctgatgtaaggatagaaaagaaaatacttcagactgtgggagagcagtggagacagtttaagtctgatttgacgtccaaatgggtacttgcagccaacaaggacagtgtcaatgacactgtatgcgaaaagtacggcattaacaacgagaaatggacccaattttgtcaaagccacagagacccttcgtgggaggatatgcggaaaaaggcacaggccatccagaagcaaaacactgcccctcacatgttgtctcgtgggggttacgaatatttagagaagaagttgatggatgagaagaaaaagagaaatctggaggaagctgctcaatctgaaagcactgacact

SEQ ID NO: 42506 - DNA, 288 bp, Glycine max
  Peptide Sequence Number=SeqID_159284
atggggatgtctcctccacctctaggacctctcaatcactcacaaactcagctcacgctctcaagacggcttccttttccagctcaggtctctgcagatcttcactcaacaaaatctctcaaactctctggaatttggacctctctctctagaactgaagacatgcaagagctcctcaagaaaaatggccaaactccccctctaaatctgatttcaggcttaaataagtggttttgttcgtgctcttatgcttatcgtaactctgatcctctcagcgcacattactga

SEQ ID NO: 42507 - DNA, 2175 bp, Glycine max
  Peptide Sequence Number=SeqID_159285
atggaaaccccgtcttcaaatggatcggtttcgaagcgttcgctgaggaggaaggtgaatttgaggaactatgatgaggatctgatggatgagatgtttgagaagcagttgggaggtggtttgaagaagaggagtaggactaaggaagatttggagaaggaaactgagactgaggctatgattgcgatgtcgctcggttttcctattgatgctttgcttgaggaggagattaaagctggggttgtgagggagttgggtgggaaggagcagaatgattatatagtcataaggaatcatatattggctctgtggaggagggggaatgtcaggttgtggttgagtaaagggatggttagagaaactgtgagcaatgagtatgatcatttgattaattctgcttatgactatcttttgtataacggctacataaattttggcgtttcacccgcgtttacttctcagttgcccgagtcaactgaggggactgcggttgttattggtgctggccttgccgggttggcagcagcgaggcaactcttgtcgtttggttacaaggttgtggttttggaaggcaggagccggcctggtggtcgagtttatactcagaaggtggggcgcgagggtaagtttgcttccattgatcttggtgggagtattattacaggcattcatgctaaccctttaggggttctggctcgacagctttctataccacttcataaagtcagagatgattgccctttgtataagccaaatggggcaccggttgataaggaaacggatgcaagcgttgaatttgtattcaataagttgcttgacaaggttatggagttgaggcaaattatgggtgggttcgcaagtgatacctctcttggttcggtcttggagatgctcaggcggttgtataatgtgacccgaagtacagatgagaagcagttgcttgattggcatcttgcaaatttggaatatgcaaatgctgggtgcctttcaaatctttcggctgcctattgggatcaagatgatccttatgaaatgagcggtgatcactgctttcttgctggaggaaatatggggttgataaaagctttatgtgaaggagttcctgttttttatggaaagaccgtcaatactatcagatatggaaatgagggtgttgaggttattgctggggaacatgtctttcaagcagatatcgccttatgcactgtgcctcttggagttcttaaaaagaaggccatcagttttgaacctgaattgcctgcaggaaattggaagcaattgagaggatgggtttctggaggtccagcacttattgcgctggtggctggtgaagctgcacaagcctttgaatccacagatgcttccattttgctgcatcgggttttgaccgtgttaaaaggaatatttcatcccaaaggcatcattgtgcctgatccaatacagtcaatttgtacaagatggggcagtgatcccctttcttatggttcctactctcatgttagcgttaattcatctggtgccgattatgatatactcgctgaaaacgtggggaatagattgttctttgctggtgaggccacgagtaggcaatacccagctactatgcatggtgctttcttgagtggcttaagggaagcatcacacatttaccgatcagctcggattcaaaacaatcctaggaagtgcatgcctaagaatatcgtaagcaatgacatcctgggtgatttattcaagtggcctgatttggaatttgggaagtttgctttcattttttatccgtctccagaaaatctgcagtcaacggggcttctgcaagtcactattggtgatgctgaagaaatttatgaggagctgtttagcagctacccaaatgcagcaaaatggcccttgcagctgtacactataatatcccgtgaacaagcccagcagctacaaaaagttgagggagggaatgaaagcctgttatcctttttggtaaaaacccttggcttaaagcttatggggccaaatgctttgcttactgcaggcaacacattgatagctagcatagctcattcacggaaaggccggcttgactggagagatgattcaatttctgaaggaaatcttcagtctcattttgagatgtttctgttagctgatcatagtgtcatagaacccaggaaaattagttga

SEQ ID NO: 42508 - DNA, 682 bp, Glycine max
  Peptide Sequence Number=SeqID_159286
tgtcaagaatctgcactttgaagggatcgataggaaatcatttgacgatggattcaagaataacttggtggaagtggaaaagaaagaagctgaaatcactcacatggaggggaaagttgcgaaacaagaacaacccttggcaaagaaagcagagaagcttaaagagaaagagatagaatatcttccaatgacagaggagaacaacactctaagaatgatgcttcaagttctaagcagcaagtacacaaagcttgagacccatcttcaagaaataaacaagacacaacacaaggacatgagttcaaatgaaataggtttagtaacagtaccacctatgtttcatacaaacaacagagcgagagtagatttcacttcatggataactaccctgacctcatcattggaaattacactgatggaaacttgttctctaaatgcaactcaatgttgtgtaatagagttagggctgtcgacattacctatttcacgacctgagttagggtttgaggtagagactgtagctatgggccgcttcgctgcgcctgactttgacggacacaatatgcacgagctcgaggttcaggggaaagcgaggatcagagacacaatgtgcgtgacgttgacagagagaatgcttgagctacaacagaaattcgctgagacaatgactgaggaattctaa

SEQ ID NO: 42509 - DNA, 296 bp, Glycine max
  Peptide Sequence Number=SeqID_159287
atgaaggtgagggtggtgaaattataagagaagattacaaaagtgagaacaagaacaatggagaagaggcaatagaggaacaaaaggaagcagttgaaaaagtagaagagaacaaagttgaggcaacaccatcaaagcaacaatcaggagaaagaagacatgggaaaatggaggctcaggtgtccaatgatgagattgaaaaaactgccaagcttttggaggcaaggaagaacaaggtgagagcattggctggggcattccaaactgtcattgatcaccaaaccacatcaaaatga

SEQ ID NO: 42510 - DNA, 291 bp, Glycine max
  Peptide Sequence Number=SeqID_159288
atgtactgcaaagagggaccaacaacaaggaagggaggaacaaagacggaacaagggagcagctggagtgatgcagcttttataacacaacaattttttttaaaagcaacttgccagttggaatggcgagtcttctctctgcaacgcgccaatagcaatggcgacttcctgcacttgacctgcagccctgcaaccttgcaaacctcccccctagcctatgcttggaactcgccagtcaaactggctactccccttgcatggccaaatcgccaatggggttggcgacactag

SEQ ID NO: 42511 - DNA, 219 bp, Glycine max
  Peptide Sequence Number=SeqID_159289
atgagtggtttgaagcttcaagacttgagaactaagcaaaccaagcaagaatactttttcctctcttctccacaagctcggccaagggcaaagggcgtgctaagcacaattccaacccaagagagaattgctctgagcgagccatcgtgtagaggaagttgcgctgagcgagaatttgcacgcagagtgggaaaagtggactcccgcttagcgagatga

SEQ ID NO: 42512 - DNA, 231 bp, Glycine max
  Peptide Sequence Number=SeqID_159290
atggaaaaatccgacaagaaaaatttcaaagataagaaagaagagaaagcatacatcacttgggaagatgatgacatggatttatcaagtgattcagaaattgaaatcataaatctaggcctcatggccaaagattatgaaagcggagaagagggtgaggcaacccaaggtgtgttcaaagtctgtaaaggatttatagagatagtgaaaaatctcaagtgggttgcttga

SEQ ID NO: 42513 - DNA, 612 bp, Glycine max
  Peptide Sequence Number=SeqID_159291
atgggacatgaagctgttatttgtaaaaacaggaatcaatcacacagggaagctgcaaagggtgttaatccagaggaggagtacttgtttactgctacatgtttctctaatattgaatcaaatcaaaattggcttcttgatagtggttgtactaaccacatgacaaacaacaaggatttattcaaggaattgagcaatataagcacattgaagggaactgtagcaatctcaatcaacagaggtacaaaactcatttctgatgtgttgtatgttcctaaaattgatcaaaatttgttgagtgttggaaaactagttgagaaagaagagaatgccactgaattgtctcacaaaaggcagaaagatgaagaaaaacaagcaaattctaaaatagcagtccctaagtcccaaagtagttcaactgaagaaaaatgtgcagctattgcacaagagcatacaaacaagaagatacacttgagggaaaaagatggaagaattgaactgaataagaggtgtttaaagtccctgactaagaacctgaaagctcaaaatgacaaggctcaatcacatgtgaaggaagcaattgcttttcaacaatgtaaatcaacgggttga

SEQ ID NO: 42514 - DNA, 1350 bp, Glycine max
  Peptide Sequence Number=SeqID_159292
atgagaactgcatcttccagtagcttagcatccagcaatggaacccctgcagaagttaagcttgagactattaagagccttattgattttgatgatgatcctgaaccacctgttgcttcagcagctcctcaagcccagcaaactactgtggctcaacatgggatgcctgcaaattccaatgataataattgggcctcttttgatgttgctcccgaggcaaaagcacctcagggtccttcgaatgtaaatccacttgaatccatgctgacacaattgtcagtaccagtatctttaccttctcatgtttcaggagcccaaggtgattcccgtgttgcaacagctaattctgggagctgtgtgacaatattgttaatattcaatgacccgtctgtttctcctgcaggacttgtgatgggatcagctcttaccgctactgctgcaggaacaccaattattagcagcttctcaacattcccagccagtggtgcttcagtaacatcttttggattaacaccagcatcaactcacaataatgcaggacagtgggctactttgcagtatcagcaacaacaacctttgttcactgctgctgctagtcagcctactattcaacaatccacatcaccagttggtggagctttgaataatcagccctggactgtaccactggtacaagggaacccaagcacaccaatgcctcatacatcacacctcgtcccaaagcctgccaatgaggctaaatcccgtgttgttttacaaccttctacagcagacataaaaccaagtggaagaagtgagcttccagaggatctattcactgtaaaatattcaccgttccctgctccagtcccaggttggcaaatgggtccaccacctagcatgggtatctcaattcaatacaataatgtggtgcccatgccaaattatgcacaaccatcaaaatcaacaaatccatttgatgtcagtaacgaaccaactccagttcaagcctcaacatttccttccatgtcatctttgcaaggtgctctgcctagtgtaacaccttcagctacaatgcacccgtcaaacatgggtaatatatctcatgcttggaatccaccctcatcatcatcttatgtatcgcctcctcaagtacaaactcttgcaccagcaatgggaccaggggcatacatgggacaacaaatggcaactaacatgccaatgccaaggcatcaaggaattgggagttttgctactgaggcaactgcttttgggttctcaaatccagatcaacagctgactggaaagatgaaaggcaaaatctgccttgggggagaaggggaaattacggagacactattgtggagataa

SEQ ID NO: 42515 - DNA, 147 bp, Glycine max
  Peptide Sequence Number=SeqID_159293
atggctaaatttagtgcacaggaagttagtgcacttcaagaaggaggaaatcaggaactgttactgcttgctggtaattcaaaaacagaatcagaaaagctaataaggcacgttcaacaacactcttccttgccttggaggctgtaa

SEQ ID NO: 42516 - DNA, 1305 bp, Glycine max
  Peptide Sequence Number=SeqID_159294
atggcattgaatagttgtttgggtaaatgctactcaaatggatgttgggacatgcatcctattcctgaagccaaggagaacatggaagaattgaacttgaatcagaaaaaagtggaggctcttcaggagaagtgggttgcagcaatcttcatgcacaatgaggattacactgatgccagaaacaagttacttagtgctcagctactatacccacaacttgataatattaatctgatgttaaccatttgcaacattttactgtttgcttccagtgtcaggctatcaaacaatgatattgattttcattgcattcttgatttaatacatccctctgccacttattctgctgctataaattctctccatgactttgttacctcagtaagtggtgtaaaagatgagtttcctggagctgagtcagctctagaaattgttcagagtgcattgaacatgctttcagatagaggaaagcatcttcatgatggttttagccatggcaaagatccaatttcttccattgagattgtttctgcttccacttcagagaggtggtgcagcgataatagctcagaccctgatgatgttccatttgaagatagaattttggaagaatccattgaaggagatgatattagtcagaatattttgcgtggtggaaagttcttatcagcggatgattttgccactggtcaagtctgggcaatttattgtggggaggataccatgcctcgtcaatatgctctagtaaatagtgtggtttctgataggcaagtttgggtaacaattttagaacatgaacaactagttggtgaagataagaacaaatggagagaagatctacctgttgcttgtggaacatttaaacctggcaatggtaatgttgtgcttgatatgtcacaattctctcatttgctcaagtatgagcaaggtacaactaggccacattatatgatttatccccaggaaggagaggtttgggcaatgtacaagaattggagtagaaaatgggagcacactgattatgaaaattgtcaatattggattgtagaaattgtttcaaatttctctggagaaaatgggattgaagtggctaagcttgaagaggtgcataattggttaacatttttccgcaggcaaaggtacgagggagttgatctatctcgttcaatttgtgaaacagaattgccaagtttttctcatcaagttgtagcttatagagtgccgggaattgaaaagtatggcatacctgaggatagctggcatcttgaacccaatgctataccaattcctaagctcaaccaataa

SEQ ID NO: 42517 - DNA, 1467 bp, Glycine max
  Peptide Sequence Number=SeqID_159295
atgcacataaagggattaggtgaggcacgaagagttgatgaggcttttgaattgcttgaaactgtggaaaatggcactgccacaggaagtccaaacttgtcagctccattgatctttggtctgctaaatgccttaatcaaaacaggagacttgcgtcgtgcaaatggtctccttgctcgttatggttttgtgcttcgtgaaggtggcaatttttcagtctcagtatacaacatactaatgaagggctacataaactctggttgtccacacactgccataaacatgctcaatgaaattttacgtcaaggcataatgcctgacaggctcacatataacacactaattttagcatgtgtccagagtggaaagttggatgctgcaatgcaattttttgaggaaatgaagggtaaagctcagaagttcagcaatcatgatctgtttccagatattgttacatatacaacaatgcttaagggttttgggcagactaaggatctcgctacagttctgaaaatagtgttggaaatgaagtctcatcgtgaattatacattgatagaactgcttacactgcaataattgatgcttttctaaaatgtggctcagttaagggtgctctgtgtatttttggagaaatattgaagcagactggtctgaatccagagttgaagccaaagcctcacctctatctttccttgatgcgtgcctttgcttttctaggagattattatctcgttaaaaaattgcataaacggatttggcctgattcagcaggaaccatattattagttgctcaagaagaagctgatcaccttctcatggaagcagcactgaatgctggtcaggttaatgttgccgttaaaactcttactgagattgtttcaaaatggaagggcatatcctggacaagtcgtgggggcatggttgcttatcgtattgaggccttgttgggattctcaaagtcattattcagtcctcacttacttcctcaggtttcaccttctgaaccggttgagaattatatgatacaatttgaagcaacacggccactacaaggttccataaagctgaggaaagtggttatgcgttttttttatgaagcagttgttcctattgtagatgagtggggcagttgtacagggctgttacatcgtgaagactgcatagaggctagatctgtcagttttgtggatcttcaaaagatcaaagcaatcccaaaagtgattgaattggatgctccacttacaacaatgatgagaagtcctcctcccactgttacgacttcaacatctattggtcatgtagttgatttaattttagagaagcgatacccaatgattattgttgtaaattacagaaattcatatgctactactccatacagctcaagagcagttggagtttttacatcagaacagttgagtaggtttatcacacctgtatctcaagtaaaagggacagacctttag

SEQ ID NO: 42518 - DNA, 1098 bp, Glycine max
  Peptide Sequence Number=SeqID_159296
atgaatggttgtggatgcagctccagtgcatggaagagagttcagaatcgttacgctcgagatgtttcaagttttacaaaggatgttgaaaatacacggcttggagaggcatatgatggagacatttcaattgcaagtgcccttgaaaattttggaggagggcataatgatcctctatttgtaactttgggaggacctgtcgtgaccaaattttctattgctttgagagaaatcagtacatacaaggaacttcttcggtcccaggcagagcacatgctgaatgaccggttactaaacatgctaaatgtcgatatcctagatgtcaaggaagctagaaggcgttttgagaaagcttcccttgtacatgatcagggacgtgagaagtttatgtcattgagaaaaagcactaggatggatattgccactgtcgtagaagaggttagtgctctccataatgttgaggccaagaagagatttgagtttttggaggctgtcactggagttatggatgctcatcttcggtattatcgacagggatatcagctattacatgagatggagcctttcattatcgaggttttggcttatacacaaaaggcaagagaaagttacaatgagaagcaaattagtctttgtgaaagaatgttggagtacaaaaaacatgttaatcatgaaagtatgttgtccttgaatggtccttatgactctccctgtagagatggtcaagtgcagcctttttctaggatatcaaataaagtggcagatgctataacagaatctgctgaaaatggaaaggttcaaatcattcgacaaggatttctttcaaaacggtccacaaatctgaggggtgactggaagagaaggtattttgttcttgatagtcgcggaatgctttactactttcgtaaaccatggagtggattacatagtggcaatcaatcatctttacacagaaattgtgccactgacaatagtgctggaattttcagtcgcctgctttcttcacattaccatggatttatccctgatgaaaaatttgtagcacgtcatacagtgaacctgctaacatcaacaatcaagattgatgctgaacagtaa

SEQ ID NO: 42519 - DNA, 1260 bp, Glycine max
  Peptide Sequence Number=SeqID_159297
atggaagcaggggaaagcaacagtggtaacgagaggcgcattatatctaaggattcttcatggtgcagccaattccgaaatgcatctaatccttggatggcaagatatgcctatgccttgatttttcttgtggcaaatcttttagcatgggctgcacgggattatggtcgtggtgctttaacagaaatgaagagatttaaaggatgcaatggtggaaaagattgtttggatgctgaaggtgttttgcgtatattttatatcataatgtttttgtcaactgctcgcacttctaaactgaacaatttgagagatacatggcactctggatggtggtcagtcaagattgctctctgggtggtcacgactgccattccatttctactccctactgaatttattcagatttacggtcgggttttcctccttattcaattgataagcataatcagcttcattacatggctaaatgaatgtagtgagtcagaaaaatttgcatcaagatgtgaacctgctggaggaaactgcatcaggaagtcagactctgcaaccaaaacagactggctaagcatcattagctttgttgttgcaatactagcaattgttattgcgacattttcaacaggcatagactccaaatgctttcagttcaggaaggatgatacagcaccagcagaggatgatgtaccttatggttatggcttcttccattttgtttttgccacaggagcaattgccctcatacatgtaatagcaagttcacaagatgtaattacctttattctttctgcagatggacaattgatgtgggctggaccagcacctgggtcaaaatataactctttccatataattcttgaacaattgaggctcaacgaaacaatacttgtgtttcttgacagtgtggatgctgatagccccaatcatatggaaaaacagacaaactggttctacttaagaacgcgtcgaaacacaaaccattctagttttgatatttttttcaaggaaagatcttcagatagttccatatctcagatgcagttaggaaaaagaatagcaattgaaaaatcaagggaattctctggaagaaacggttcttcttcagtggacactagacagaagcaatgggtctgccacaaatgcatatatacttgttggatttctatcacccccgtagatatccgatcctttccctccaaccaaccgatcattttaaagaaaaatacactttttacctgtacatgtgtcaatcagggagcataa

SEQ ID NO: 42520 - DNA, 258 bp, Glycine max
  Peptide Sequence Number=SeqID_159298
atgggtggagtaacagaatggctaggaacaagcagcagacagcatattcctcttctgctattgattccggatgatatggagttccagtctggagacatgccaaattacactacatcagatggatcagttaagattcaaaaagatagtgaagtgagactaaagataattgggactcgagtggatgctactgaaattttctgcataggtaccataaaagatgatttcttgggtgtgatcaacgaccctgcaacagtttaa

SEQ ID NO: 42521 - DNA, 1050 bp, Glycine max
  Peptide Sequence Number=SeqID_159299
atgcaggggaatgctgatagtttcggtgggaatctcagcagccatttaaggttttcttattttgatcaccaaaacgatagcagggaagtgccatgtgggttcttaaagaaatttccaattagtgattatgatcgaatatcgatggaaaagtgtgagagtgtagttgtagtttcagcaatattcaatgaccacgacaagatccggcaacctaggggccttgggtcccaaacactacaaaatgtctgtttcttcatgttcatagatgatattacactcaaaggacttgaataccatggcttaatttcaacaaagtccagcgaatacaagataggtgtgtggaggattgtgaaggtttcaaaagagaatttgtatcagaacccagcaatgaatggggttataccaaaatatttagtccataggctattcccaaattcccaattcagtatttggatagatgcaaagttgcaacttatggttgatccattgttgctcattcattcacttgttatatctcagaatgcagacatggctatatcgaagcacccatattttgttcataccatggaagaagcaatggcaactgcaaggtggaagaaatggtgggatgtgaatgccttgaagatgcaaatggagatctactgtgaaaatggattgcaaccatggagccccggcaagctgccctatgcctcagatgtgccagacagtgcactgatcctgaggaagcatggacagagcagtaatctgttctcctgtcttatattcaatgagttggaggcctttaacccaagagaccaattggcttttgcatttgtcagagaccacatgaaacccaagctgaagctgaacatgtttgaggttgaagtttttgaacaagtgacaatggagtacaggcacaatctcaagccaagtagtgatgtgtccattgccaagaaattctccatgacaagaaaaactgtaagggcagaaccagatttgttgtatgaaaatgggagctgttgcagcaggtgccagcagtatcttaccaccatgtggggtgattctcatcaatag

SEQ ID NO: 42522 - DNA, 3024 bp, Glycine max
  Peptide Sequence Number=SeqID_159300
atggagaacactggtttgtgtgtactatgctttatactactcctgttggggtgtgtcatttcctcagaatgtaagtatataagatacaacacaacatcaaccattgttcctgggaaactcaacgttcacttggtccctcacactcacgatgatgttggatggttgaagaccattgaccagtactatgttggttccaacaactcaattcagtttttcactgttggggtagtgcagggggcgtgcgttcaaaacgtgctcgattccctggtaaccgcattgctggcagataagaatcgcaagttcatatatgttgaacaggcatttttccagcgatggtggagggagcaaagtgatgatatccagaatatagtcaaggagctggtcaactctggtcaattggagttcataaatggtggtttttgtatgcatgatgaggctgctactcattacattgacatgattgatcagacaactcttggacatcaatttattaaagaagaatttggagtgactccgagaatagggtggcagattgacccatttggacattctgcagtgcaggcctacttgttgggggcagaggttggatttgactctctattctttgcacggattgattaccaagacagagccaagagaaaagatgaaaaaactcttgaagttgtgtggcggggctccaagagctttggttcatcatcacagatattttctggtgcattccctgagaattatgaacctcccagtagtttctactatgaagtaaatgatgattctcccattgttcaggatgatgtcagtttatttgattacaatgtccctgaaagagtaaatgagtttgtggcagcagcaatatcacaggccaatattacgcgcacaaatcatataatgtggacaatggggacagatttcaagtaccaatatgcacaaacttggttccgacaattggacaagtttattcactatgttaatcaagatggtcgtgttcatgccttatactcaactccatcaatatatactgatgcaaaacatgctgccaaggaggcctggccaatcaagactgatgacttctttccgtatgcagatcgtgtaaatgcctattggaccgggtattttacaagcaggccagcaatcaaaggttatgtcagattcatgagtggctactacttggcagcaaggcagttggaatattttaaagggaagagtcccttatgtcccaaaactgactctttggctgaagccttggctattgctcaacatcatgacgcggtatctggtacagaaaagcagcatgttgctaatgattatgctaaacgactttcaataggttacacagaggctgagaaagttgttgcattatcacttgcttgtttgacagagggagcaaccaaaacaggttgtaagaacccacagactaaatttcaacaggcaagtagtgatgttcttagttcaacaacttgtccacttctgaacataagttactgtcctgcatcagaagttgatttctcaaatgggaaaaacttggtagttgttgtttacaatgctctaggatggaaaagagaggatatcataaggattcctgttgtcaatgaaaatgttgttgttcgggattccagtggaaaaaacatccaatcccagctggtgccaatacttgacgattttcgtggtttaagaaactaccacactgtcgcatacttgggagtgtctccaactgcaaaacccaaatactggcttgcttttgcagcaacagttccccccattggttttagcacttactatgtatcctatgccaaaaaagaagctactatttcagatagagatacagcttaccaaccagggaataagagtgatacaattacagtgggcctaaaaaacttgaacctagtttattctgtgaaggaagggaaacttattcaatatatcaacagcagaagcaaggtcaatgaatctctagagcaggcatataaattttacgctgggtatggaaatgatggaacagaaactgctcaggcttctggagcatatattttccgccctgatggttcaccctctcccatcaaatccaacgggaagactactagactgtacaaggggaaagaacatgctgaagttgagttcattgttggacctatacccattgatgatcgagttggcaaagaaattgcaactgagatcaaaacaaatctagcaagcaacaaaaccttctatactgattccaatggacgtgatttcattgaacgtgttcgagactatagagaagactggcacttggaagtaaatcaacctgttgctggaaattactaccctatcaaccttggaatttacctgaaagataaaagcaaagagttctctatattggtagatagagccgtggggggctccagcatcatagatggacaattggagctaatggttcataggaggttacttgaggatgattccagaggtgttgcagaggcactgaatgaaacagtttgcattcatgataactgcactgggttaactgtgctagggaagtactatttcagaattgatcctgtaggagagggtgccagatggcgccgatcattcgctcaggagatatactcacccttgcttttagccttcacagaggtgggtgaaggtcactggggagattctcatgtcacaaccttctcagcaatagattcctcatacaacttaccagataatgttgccataataaccctccaggatctaggtgatggaagagttctcctacggttggcacacttatacgagattgatgaggacaagtatctttcagtgaaggcaactgtagaacttaaaaaggtgtttcccaacaagcagataaacaaaataactgaagtgagcttatcagcaaaccaagaaagagcagaaatggagaggaagagattggtttggcaagttaaagggtcacctccagaacccaaggtgtggaggggaggaccagtagatccagaaaatctaattgtagaacttgctccaatggaaataaggacttttatcatcagttttaggcattaa

SEQ ID NO: 42523 - DNA, 867 bp, Glycine max
  Peptide Sequence Number=SeqID_159301
atggctgattttcagacctctacccacagagccaagtggattttctctcctcaacagctggttgagaaatatagagctgccaatcagagagccaaacaaattctagagaagtgtggagcaacactaatggaagtagatgttgatggatcgttgtcatatcctgaaccccaaatgactgcaaaggatagtgctgaaaagcattctcgaacaaaacctcttactattgaagaagaacaatgtataaaggtattttatgaaaacaagctacaagaagtatgtaacaatttccgcttccctcataagatccagagtttggaatttgatcttattgtgtatgcaccatatcgctcagttgaaggttttataaatgatatggaggaattctttaatgctggtgataaccagcttgaaatgctcaagactttgcaagagacagcaagatttgaagttgataaaatgatgcttacagatgcaccacttttatttcctcctgggcagttggccttggctgctttacgcaactcaaatgcattccacagagtcattgactttgatagcatattctttgacccaaattgtagcatactctttacactcgcacttaattgcagttatcttaggggtattttttcccgtgagaattccatgcatacaatgtccgagctttctgaatcactggatgcaattgattcttgggttagaaaatacaaaagtccttctgagaaggaattgaagcatatcaaccgaaaactgaagtcttgttggggtcatcactctcatgacgagggcaagaagcgggagaagaaatcaaagcacaagtccaaaaagagctcaaatgaagctcaaaatatgccatctattgcctag

SEQ ID NO: 42524 - DNA, 498 bp, Glycine max
  Peptide Sequence Number=SeqID_159302
atgagagaagagttttgggaactcattggcggggcagaggtttctgttggttacttcattgctgatctagggacaatattatggttttttcctgctcttggtggatatgagtatgtgattcatcatctgttttctttggtagcagtagcatatgcaatgttgactggggaaggacagctttacacattcatggtcctgatctctgagacaactactccagggatcaatttgagatggtatcttgatgtagctggaatgaaaaagtccaaagcttatctcatcaatggggttgtaatatttatttcttggctggttgccagaatacttctgttcatatacatgttttaccatgtctacttgcactttgatgaggtagcagattttgacattcagttcttggcctttaatgactcaaaagatgtctgcacattattctcttggatgataaatggcctagatcatggatctacctatttcttcttatcagctaaaatttga

SEQ ID NO: 42525 - DNA, 234 bp, Glycine max
  Peptide Sequence Number=SeqID_159303
atgggcaccttagccgccaacgaagacatttattcaaatatttcaatcgtcatcttcttccttctcgctatgttttttttcttttggccaactccagctaggttgtgtcatgtagtcgtgccaccatcaggccttgcactcggtggtgtcaagggtcgcgcctccttcgtggaggtgtctctccttagttgcgtcatcaaggtgctgctaatgcacctaggattttatatatag

SEQ ID NO: 42526 - DNA, 147 bp, Glycine max
  Peptide Sequence Number=SeqID_159304
atgctaaacttccaaaaacttgttaagcgtattgggaggagagactctgctaaagatgaccagccaagtttccagcagatattagtcatcaacaacgtcgatattgcagaagacaagcttgattcatttctgggcatagtagcttga

SEQ ID NO: 42527 - DNA, 183 bp, Glycine max
  Peptide Sequence Number=SeqID_159305
atgtctgtatactcacatactggaataagagatatgcagttatggagcatgatagggaagcatacagcagcaggagacaaagagcatgaaacaggggtgcattcacaggacacaggggtacagttagcaggaaaatccaagagggtcaccacaagaccctcttacctcagatattacatatga

SEQ ID NO: 42528 - DNA, 174 bp, Glycine max
  Peptide Sequence Number=SeqID_159306
atgggtgccaagcacctcacaaggaccaaagaaaggtcacatgtcatcaagcaaaggtccccggacgaaattaggaacgagtttgttgaggaatcaagaacaaaagctaagagagttaggctcattcttgtgaggaatcatggtttgagtatttactcggtgcaagagcactaa

SEQ ID NO: 42529 - DNA, 270 bp, Glycine max
  Peptide Sequence Number=SeqID_159307
atggataaggtggcaaaagcttacaacgcaagttttgttgtgagcagcagtgagctgggggaatatgattcactcatgcagaatgctactcaacattttccgtctctgagactaccctggtacaccacatacactactactacatcttcaaaaacaaaaggacaagaagtggggtgcttttcaaagaagatcacgacatctaacaggataacctcaggtgtcatcggtgtggatactgaattattgaaatggattcagaggctaaagtaa

SEQ ID NO: 42530 - DNA, 1998 bp, Glycine max
  Peptide Sequence Number=SeqID_159308
atgaccgttctcagaaacgcttatatagccttgcaagcttggaagcaagccattttgtctgatccccgtaaccagacagccgattgggttggatccgatgtgtgcagttacaccggagtttactgtgctcccgctctggacatccccaagatccgtaccgttgccggcattgatctcaatcattgcgacattgccggttatttacccgaagagcttggcttgcttctggatcttgcactcttccacgtcaactccaatagattctgcggcaccgtgccgcacaagttcgagaggttgaaactgctctacgaactggatctcagtaacaacagattcgcagggaacttccctgaggtagttctgcgtcttccatcactcaagttcctggatctcaggttcaacgaattcgaaggaacggtgccgagagagttgttcgataaggatctggacgccattttcatcaacgacaaccgtttcgtatttgatcttccggacaacttcggcaactcgccggtctccgtcatcgtcctcgccaacaacaggttccacggctgcattccggcgagcttggggaacatgtccaacttgaacgagatcattttgatgaacaacgcattccgatcgtgcttgccttcggagattgggcttttgaagaacctgacggtgttcgacgtcagctttaatcagcttcttggtcccataccgaacgcagttggaaacgccgttagcttggagcagctcaatgtggcgcataacttgctctctggtcaaattccagctagcatttgtatgttgcctcaccttcagaacttcacttattcctttaacttcttcaccggtgagcctcccgcatgtctcgcattgccggcgtttgatgacagggtaaactgcttaccggcgaggcctctgcagaggcctccggcgcaatgtaagtcgttcttgtctaaacctgtggactgtaactcctttaagtgtaaacattttgttccttcacctccatcaccttcaccatttccttcacctacagcaccggtaacaccttctccatcaccttctacgccttcaccatttccttcacctacaacaccggtaacaccaccttcaccctcacattcccctccatcaccttctacgccttcacctacaacaccggttacaccttctccctcacattcacctccatcacctgctacaccttcaccatttccttcacctacaacaccggtaacaccttcaccctcacattcccctccatcacctgctacaccttcaccatttccttcacctacaacaccggtaacaccttcaccctcacattcccctccgtcacctgctacacctacaacaccggtaacaccttcaccttcacattcccctccgtcacctgctacaccttcaccatttccttcacctacaacaccggtaacaccttcaccttcacattcccctccgtcacctgctacaccttcaccatttccttcacctacaactcctgtaacaccttcacctccatcgccttctactccttcaccctttccttcacctacgacacctgtgacaccttcacctgttcatagtcctccttctccagtgtatttgccaccgccacattcttcccctacaccacctgctcataattacggctctccgccaccccatcactcacccgctcaacctgtttatccttatttatcaccgccacctcctccctctgtccattcttcacctccaccaccaccaccaccaccttgtatagaacttcctccaccccctccccaatctacaccttctcccacaccttacctgccaccaccatccccatctcctcccccgccaccgccaccggtataccattctccaccgccggcatcaccgcctccgtgcgaaactccaccttcagtttctccgcctccaccacctgccccagtatacgaagggccattaccacctatcgttggactcccatacgcgtcgcctccaccaccacccttttattga

SEQ ID NO: 42531 - DNA, 126 bp, Glycine max
  Peptide Sequence Number=SeqID_159309
atgcggacgcggtgcaccgtaaatctcaaggctgatgagatgatccagctgggagtaggagcaacgggacaggtttcatccgccatgtttagtggtcccaatcccagaggagaacgtccacagtaa

SEQ ID NO: 42532 - DNA, 348 bp, Glycine max
  Peptide Sequence Number=SeqID_159310
ggaggtgtgcattatgtaaaaggaaacaaggcaattaaggaaaacgattttggagaagcagctgataactttagtcgtgctcacgaaatcagagtggcacattatggtgaacttgctcctgagtgtgtgcacacatactacaaatatgggtgtgctcttttgtacaaggctcaggaggatgctgatccattggctgatgtgcccaagaaggaggatggatctcaacatggctccaacaaagatgttcttagtcctattattgttttgcttatttctgaacggacttcttcaaaggaaaatggccaagctagtgcctctgatcaggatgttgccatgattaactcttaa

SEQ ID NO: 42533 - DNA, 243 bp, Glycine max
  Peptide Sequence Number=SeqID_159311
atgttagggcccaaatatttcaatcaacccatcttagaaggcttcgctactaaaaagcctattgttggtatgcttgattccctcctacctgggcctgttacagttgtactaaaacgtggaagtgaaggacatacattagaggaagccaaatctatcaatctatccttgagtgcattggggaagtgtattaacgcacttgcagagaatagtgcacatgtgccatttcgtgactcagcttactag

SEQ ID NO: 42534 - DNA, 867 bp, Glycine max
  Peptide Sequence Number=SeqID_159312
atgatagttaaccaacaagtgaaggtacctttttccattgggacatataaggatgaagttaattgtgatataattcccatggaagcaagacatatatttttaggaaggccatggcaatttgataggaagatcatttgcaatggcctaactaatcagattaccttgacccatcttggcactaaatttgtgttgtatcctcaaacaccttcacaggtggccaaggatcaactaactatgaaagataagagggacgaggaagaaaaagttgaaaaccaaaagaaaaaaaaggatagtgttgaggaaaaaatctctgagtttcaagaatctctggatttgtggtcaaatccttttcaagggggagggaattatgcaatccaaccctccccccaaagagcattggatagaagaatccaagaagattgggccagagatgcaagagaagaccctaaggttctcatgagccttaggaaccgaaccagatggaggaagcgcaagagagattcgcaaatcagccagcgccaccagaagcaggaggaggaggaggacgacaatgatgacgaaaaccccaatacagaggaagacctcgccgaacgcgactacgattcagaggaccaaatgcaccacaaccaccttaatttgcaacctcacgtggagaaggagatcctctccgaccacgacgttcacattttgcagtttctgacgagtgtcttaccaggcattcttcaaggggacaagtcagactccctcttgtacggctttgttgacaatggaaagaaaatttgctggaatgaagattttcattctaaggtgagagactttgaccgaaatggattgaacctcaatgcaagcaaaagagaagagttgtag

SEQ ID NO: 42535 - DNA, 633 bp, Glycine max
  Peptide Sequence Number=SeqID_159313
atgagcacggcgtatcaccctcagacggatgaccaaacagaagttatgagccgcgtcatcgagcaatacctccgggagtttgttcaccggaaactgacgacttggcggcgcttcttgatgtgggccgaatggtcctacaacacctcttcacactcagccacagggatgtccccttacgagatcaaattcgggaagaagccacctcactttccccaatacttagcaggtgtctcaaatgtggaggcagtggacacgtggatatcctactcaagccctatcatccctcacaggtcacccagaccaggcccactcccttacccaaagacgctgaagacaatcagcccatcatctcccctcttgcgatactcgacactaagtggcaaggcttcggagacgacaaacagttccttgtcttggttcagtgggcagactacttacaaccttgaggacgaggttgttttgcatgcgcaggggaatgatacagctgaaaacataattaagaaacaaacagttgaattagcagaagcagaaccaaaggaagcagaatcaccaaactcaagggcaaagatggaagaatcaagaccaaaaaggaccattaccaaacctccttacctgtgggatttcatggaatga

SEQ ID NO: 42536 - DNA, 201 bp, Glycine max
  Peptide Sequence Number=SeqID_159314
atggtgtttggatcaagctacctattgagcttgttaatcttgctgaaactgcagttaagagatgagcgagggagagaggaacttaccagcgagaggaagaaaagccacggagagggagtggtagctcgtgacgctgctgagagggaaagagagagagcttgtgatggtgtgctgagagggagagagagagctcgcttgtga

SEQ ID NO: 42537 - DNA, 345 bp, Glycine max
  Peptide Sequence Number=SeqID_159315
atgacctacaacattcattcattcagcagaaaagacacaaaagaaaaccatgtaacagaaaatattgtggtcaaggcgatgccaatacatcttatgacaaatgacatgttcatcagtgttaatcaccgggtcttggtgagtcatagccctaggatttctgtagcaagcttctttatgaattttactatgcccaagtgtacttcaaagatttatggtccaataaaggaattgttatcagaagaaaaccctccaatctacagggacattactatgaaagatttcttgacacattattattcaaaaggccttgatgggaactcttgcttgctacctttcaggatctga

SEQ ID NO: 42538 - DNA, 147 bp, Glycine max
  Peptide Sequence Number=SeqID_159316
atggaagaagggaatagaaagaattatgagagagaggagaattccctaaggaagagttctcaggctttgggtatgtatgagagtgcttcgagactcgttactgaagtaaacttaggccttcatattcgcgctctgctcgctcagtga

SEQ ID NO: 42539 - DNA, 1140 bp, Glycine max
  Peptide Sequence Number=SeqID_159317
atggtggtcaccaccggcacaaatgagttagagacaagtgatggctctacttatgatggtagagctgaacgaatatcttttgatgattcaaaaactggggtgaagggccttgtagattctgggatcacaaagatcccacgcatgttccattctggcaaattggacctcagtgagacctcactaagtgcctcaaatatcatcagtatcccgatcatagatcttcaagaggttaacaaaagttcatctctgcatgctgaagtggttgaccaaattggaagtgcatgcagaaagtggggtttttttcaggtgatgaatcatggtgttggtgttgatgttttggatgagatgatatgtggaatccgtaggtttcatgaacaagatgctgaggtaaggaaaaccttttactccagagatagcaataagagagtcagatatttttccaatggtggcctgttgagagatttggaccagcctgccaactggagggatactattgcttttgttgcaaatcctgatcctcccaacccagaagaaataccagcaacatgtagagacattgtggctgagtattcaaagaaagtaagggcattgggagttacaatcttagagttattgtcagaggctcttggtcttgatccttcttatcttaagaaaatggactgctctgaggcactttttattatgggtcactactatccggcatgccctgaacccgaattaactctgggctctacggagcacactgatatggacttcatgacaatacttctgcaagatcaaatgggtggtcttcaagttcttcatgagaatcaatggattaatgtttctcctgtgcatggggcacttattgttaacattggagatctcttacagctgacccaacctagcgatgcaaaaattgcagaatggtccatgcaccagagaaaaacagtttgtgaaaagcggctaggattttctaggtgtaaatcatggcatacgatttgtgatacagctgaaaacgtaattaagaaacaaacagctgaattagcagaagcagaaccaaaggaagcagaatcaccaaactcaggggcaaagatggaagaatcaagaccaaaaaggaccattaccaaacctctttacctgcgggatttcgtggaatga

SEQ ID NO: 42540 - DNA, 357 bp, Glycine max
  Peptide Sequence Number=SeqID_159318
atggaaaaatgcataaagacctcattgcccaacactaatcttagtcttaccactcaccacgtggggtcctttgtttgtaaaaagcaatcccttatggtcaagactaggaaaagaagatttaatggtgataaacagggtcgaatcatgcttgttgctcatttatgcgcttttattgccgaagggatgaacgaattcttgaactatgacagttgtcttccaagggtgttgcaagtcgaggaaatagcattcgaacacacattcatattaatggctctaagtaagcctatggcggttgattcaacctccccttcttttgacgggttagcctcaggttgtcgggacctatgtgcttcttga

SEQ ID NO: 42541 - DNA, 1503 bp, Glycine max
  Peptide Sequence Number=SeqID_159319
atggcgacgagggtccaccaattcttcgacgaactcgaagcgaagaaaaccattctcgccaaatgcaccgacctcttcaccaccctctccacccacttctcctccctccaacactccgtcgccgagaaatcccaatccctcgattcaaagctccaatctctcgattccctctccaaagaaaccctcgaatccctccaccgccgcgagacctccatcccggagcgcgagtcctccgccgccgcccgcatcaaggagcagagggaggccgcgctcgcagagctcctccgcgccacgcctcccccggaccccgacctctccgccacgctcaaatccctgtggaggaagatggacgcagcggcgctgctgcggttcgtggtgtcgaagcggaaggagtcggcatcactgcgggcggagatagcggcggcgatggaggaagcggtggacccggcgcggctggtggtagaggcagtggaggagtttctgaagagcaaggtggcgaagtccggggtgacggataagaggtgggcgtgcgggcttgtgatacaggcgctgatggtttcgtcagagtcaagggaacattctagaaagatcgtggagagagccgttgcggttgtggaaacgtggaaggagcatttggatggggaatcagagagtggtgctgccgaagtcgtcatgtttctgcagatggtcgtgtgtttcggattgaggtctaggtttgatgatgactatttgaggaacttcgttatgcaatttgcttctagaagggacatggcaaagcttgctgcttccttacaattcggcgacaagatcatagaatctggtttgactgaaagatttcctccaatcgacctactcaagtcctaccatcggaactacaaaaagaatgttagtgccatattcaaaaagggaaacaacaatcatgctactatggatgattcaagcacttcggagttgaattccattaaggctataatcaaatgtgtagaagatcacaagcttgaatcagaatttaaccttgataatttgaggaagcgagctacccttctggagaaagctaaggccgaaaagaaaaagggttcaacatccagaagtaaacctcagaacaagcgaggcagtggatccagctcttcacgtccagccaaatcagccaaatttaacagtgcacactcatcatctttcagtcgcaggaacctggcaccttctctacaacccagtcctggtgcaagattttctgctccattcaactaccccagccaaaccatatacaatggtgcaactgctaatccttatgcagcaacctatggaacttcccacactcaaagcccggctggaataacacaacagcactactctattcctgttgacaatttgggtccgtctggttaccggtctagtggttcttattcaggacagactagctatggcctatacgactacagaaatggtgctcctccaacttatccacctccatactcagtagatgaaaccacctacaggggataa

SEQ ID NO: 42542 - DNA, 357 bp, Glycine max
  Peptide Sequence Number=SeqID_159320
atggtgactctcatctctctctttctctctctctcgctctctcttaattctcgcattagatctgcaattgtttctccaattttccattcttctagtcatgttctacagaacgatattgatttgctgaatcctccagctgagttggagaagagaaagcacaagctcaagcgtcttgtgcagtcaccaaactctttcttcatggatgttaagtgccagggctgcttcaacataacaactgtgtttagccactctcagactgttgtggtttgcggaaactgccagactgtgttgtgccaaccaacaggcggacgggcaaggttaaccgaagggtgctcttttaggaagaagggagattga

SEQ ID NO: 42543 - DNA, 726 bp, Glycine max
  Peptide Sequence Number=SeqID_159321
atgagtggaaaaatagagttgaagaatgttgattttgcatatccaagcagggtagggacaccaattttgcgcaagttttgcttggaggtgaagccaggaaaaagtgttggacttgttggaaaaagtgggtgtggaaaatcaacagtgattgccttaattcaaagattctatgatgttaagagaggttcagttaaagtggacgatgtagacataagggaattagacattcactggcacaggcagcacacagcacttgttagccaagaacctgtgatatattctggcagcatacgtgacaacattttgtttgggaaacaagatgcaacagagaatgaagtagttgaggctgcaagggctgccaatgctcaggagttcatatcatcattgaaagatggatatgaaactgaatgtggagaaaggggagtgcagctatcaggaggacaaaagcagagaatagcaattgcaagggccataattcgcaacccaaagatactacttcttgatgaggcaacaagtgccctggatgttcaatcagaacaagttgtgcaagaagcccttgataggactatggtaggcagaaccactgttgttgtggcacataggcttaacaccatcaaagagcttgattcaattgcttatgtgtctgagggcaaggtcctggagcaaggaacctatgctcaacttaggcacaagagaggtgccttcttcaaccttgccagccattaa

SEQ ID NO: 42544 - DNA, 171 bp, Glycine max
  Peptide Sequence Number=SeqID_159322
atggcactcccgtctaaggcagggaaacgcttacatttaccttgtctcaaggagacgtgtgagactcaaatctgcgacctggcagatgcaagaccctgtcttgccttaaaggtgtacctgagccactgtcaacatgaagtgctaatgcagtgcctggccttagcccttcag

SEQ ID NO: 42545 - DNA, 297 bp, Glycine max
  Peptide Sequence Number=SeqID_159323
atggcacagtcctcctcgatcgtcgttactctgaggcagcacttgtttaaaaggaacctcacctctctcactctgcctcactctccttctcttccttccttctccttctctctgagaacaacaccccacactcctctctctctctccgcttccttctcttctcacacctccatggcccacacttcccttccctccgccgatgccggcatggacgctgtccagcgccgtctcatgttcgaagacgagtccgttcctctccttattcattcgtttttcaattacttcttttttgcctga

SEQ ID NO: 42546 - DNA, 306 bp, Glycine max
  Peptide Sequence Number=SeqID_159324
atgtggaccaccacgggggaggagcttgccacccagctcgcccaggcgagcaaggttgcttcctccagaagcaacagccttctggaggaagaatctggaaggcccaactttcgaagaagttacgaaaactcacggattgcgaaaaatgcctcctttcgatttccgtcacatcacggaatattcacagatcgcatagcaaatgagacttttttgcagtctcggccagaagatgctgacaactctgggaaaggtgctgatgatgacgtttgtgactgcttgctattgggctttgagtcttacggatag

SEQ ID NO: 42547 - DNA, 907 bp, Glycine max
  Peptide Sequence Number=SeqID_159325
actaaaaaagaagttaagaaatcttaacctagaacccgcaattgaagagcaaataaacaatttgctcatagaaacctcggaggaagaaacagaaacttcatcctccgtgctttccgacgaagacctaaacttaatccaacaggatgaccaattatcatcgacagatgatgatgatgggcaaatcaatactctaacgagagaacaagatctcttgtttgaagcaatcaattccatccctgatccccaggaaaagaaggtttttctggaaaaacttaagaaaacattagaggtaaaacctagacaaaaggacttcatcacaaacaataaatttgatgtaagtaacatactcaaaagattagaaaactcttcaaccaaaccaacgacaatccgggatctccaaacagagataaacaatctaaaaagagaggtaaaagaacttcgtcaacaacaagaaattcatcagatcattctttctcagcttgaggaagaaagtgattctgaaagcgccaacaacaatgaaaacaaccaaccagaaaatttagaagatgaaatgtttataggattaatcaaaaagattaaaatccaaaagttttacataaacataaaaataattattaatgatttcgttttagaaacaatggccttatttgacacaggggctgattcaaactgcatttttgaaggattaattcctacaaaattctttgaaaaaacctcagaaaaattaagcacagcaaacgactcaaaattaaaaattaattttaagctatcaaatgcaatcattgaaaaccaaagtcttaggattaacacaaactttcttctggtaaaaaaccttaagaacgaagtaatcctaggaaccccctcattagagccttgtttcccatccaaatatctaatgaaggaataa

SEQ ID NO: 42548 - DNA, 279 bp, Glycine max
  Peptide Sequence Number=SeqID_159326
atgtcttctcccttggaaattagtgaaccaatagcatccactcatacagatgataatgaggtgaaggcaatgttccacgtgaccgatgaagctggcaagaagctcacagacgaaaccctcatgctccacatccaacaggatgtcaagtgccagggttgcttcaacatccactctcagacagtagtagtatgtggtaactgccagactgtgttgtgccaaccgactggtggacgagcgaggttaaccgaagggtgctcttttaggaaaaagggagattga

SEQ ID NO: 42549 - DNA, 405 bp, Glycine max
  Peptide Sequence Number=SeqID_159327
atgtccgacactaccttcaccgaggaggaagcagagaggcttctcaaagagtgtctcaacaccaatccacgtgacaccaatgcgttccacgcacaaatgcagttgactctgatggatgaagtctcggcggaaggaggactcataggccaatgtgcacatagtggagatcttcgccttgcactggaacatgtggcgggcagaggagaagtgcttcttgcaccatgccgcaatgagacaagattgtcaggttcgtgtcgtggaggatcgaggatgaaggattgggtgggaaggagagggaggtgtacggtaagaagaatgaagagtggtttgatgaagtggtggggtccattgctaggagcttggaagaagaggtcaaggttgtctttgaagaacataattagttag

SEQ ID NO: 42550 - DNA, 2583 bp, Glycine max
  Peptide Sequence Number=SeqID_159328
atggcagaagggtattgctggagcaaaacaagcgagaggcaggtgctgagaatccgttacaagtacttggaagctgtcctaagacaagaagtagggtttttcgatttgcaagaaacaaccacttctgaaatcattaatagcatatcaaaggacacttctctcatccaagaagttctaagtgaaaaggtgcccctatttttgatgcactcatcatcattcatctcgggggttgcatttgccacgtacttctcttggaggttggcattagtagcatttccaacgctgcttttgctcataatccctggcatgatatacgggaaatacctaatctatttgtcaaagtccacactgaaagaatatggcaaagcaaacagcatagtagaacaggcacttagctccataaaaaccgtttattcattcactgcggagaagagaatcatgggaagatattcagacatattgtgtaaaacttcaaggcttggaatcaaacaaggcatagcaaagggcattgcagtgggaagcacaggtctatcttttgcaatatgggcttttcttgcttggtatggaagccgtttggttatgtacaaagtggtacttcctgatttgaagtacttcacggaagcatctgttgctgcttcacgaatatttgacatgattgatcgaacaccattaattgatggtgaagacacaaaaggagtagtgttagagagcattagtggcaggctagactttgagcatgttaaattcacatacccttctcgtccagatatggttgtgcttagagatttcaatctccaagtggaagcagggaaaacggttgctctggttggtgcaagcggaagtggtaagtccacagcaatagcattagtgcaaaggttttatgatgctgatgaaggtgttgtgagggttgatggtgtagacataaaaagcctacagttgaaatggatgagagggaaaatgggccttgtgagtcaagaacatgcaatgtttggaacttccataaaggagaatattatgtttgggaagcctgatgctaccatggatgaaattgttgctgcagcctcagcagccaatgctcataacttcataagggaacttcctgaaggttatgaaaccaagattggagaaaggggggcacttctttcgggaggacaaaagcagcgaatagccattgcaagagccatcataaagaatcctgttattctcctacttgatgaagcaactagtgctcttgactctgaatcagaattacttgttcagaatgccctcgatcaggcctccatggggagaactacattggttgttgcacacaagctatcaactattcgaaatgcagacctcatagcagttgtcagtggtggttgcatcattgaaacgggcacacacaatgaactcatcaccaaaccaaatggccactatgcaaaacttgcaaagttacagacacaattgagcattgatgaccaagatcaaaatccagaactaggtgctctttctgcaacaagaagcagtgcaggcagaccaagcacagccaggtcaagccctgccatatttccaaagtcaccattgcttgatgatcaagcaactccatctcaagtttctcaccctccaccttctttcaaaaggcttctttctctgaatgctcctgaatggaaacaaggtctaattggaaccctctcagccatagcctttggctcagttcaacccttatatgctttaaccattggtggtatgatttctgctttttttgctgaaagccatcaagaaatgaggcacagaatcaggacttattctttgattttctgttcactttcccttgcttcaattatcctcaatctcttgcaacactacaattttgcttacatgggagccaagttaacaaaaaggataagacttggcatgctggagaatatcttgacctttgaaactgcttggtttgatgaggaacaaaactccagtggagcattatgctcaaggttaagcaatgaggcttccatggttaagtcccttgtagcagacagactctctttactagttcaaacaacttctgctgtcacaattgcaatgatcataggccttgccgtggcttggaagctagctcttgttatgatagcagtgcagccactcacaatcctttgtttttatacaagaaaagtgttgctctccacactctcaacaaaatttgtcaaggcacagaatcgaagtacacaaattgcagtggaggcagtttataaccacagaattgtgacttcatttgggagcatcacgaaagtgctatggctattcgatgaggcgcaagaggcgccgaggaaggaggcgaggaagaagtcttggctagcaggcataggaatgggttctgctcagtgtctaacgttcatgtcatgggctttggatttctggtttggtggtactttggtggaaaaaagagaaatatcagctggggatgtgttcaaaacattttttgtgttggtgagcactggcaaggtcatagctgatgcaggaagcatgacttctgaccttgccaagagctcaacagcagtggcatctgtctttgaaattcttgaccggaaatcgctaattcccaag

SEQ ID NO: 42551 - DNA, 216 bp, Glycine max
  Peptide Sequence Number=SeqID_159329
atgggaacctcttctggtacaccacccagttcacacataaatctactcgggtttataacttcttgcctggttaaaggagcacctttaccactacccattcatgtttcagcaggaattgcaaaaacatggttatcccggaacattataatccataccttacctccccgtttaatgcttctggttaaggggggacgagcagccggggtgtgtctataa

SEQ ID NO: 42552 - DNA, 165 bp, Glycine max
  Peptide Sequence Number=SeqID_159330
atgtgggggcagactgtagagaagatgcacggtaatataggtggagtccttttttggcttagaaaggaggcttggatgcagacggatgcgaatcgtaaaaagagaaatggtcctagggaacacaaaggcttttcttctgagcaactagtttggttggacttttga

SEQ ID NO: 42553 - DNA, 249 bp, Glycine max
  Peptide Sequence Number=SeqID_159331
atgtttttggtggctaacaaggctgatttggaagccgagagaaaagtcagatatgaggagggcgaggaatatgccaaagaaaatggcttgtcttttcttgaaacttcagcaaaaaccgcacaaaacgtgaacgagctcttctatgaaatagccaagagattggcgaaagcaaatccttcacgtcaaagtggaatgaagctgcataacagagctggagaaacaagaagaggattcttttgttgtacttaa

SEQ ID NO: 42554 - DNA, 456 bp, Glycine max
  Peptide Sequence Number=SeqID_159332
cacctcgcgccgtgaagcatatcttggtcaaacccttgctacgtgacttaaacccctatctccctcaaacccttgctacgtcaagcagtggagctcacgccatgaagactgtgtccatcatagtgagcttgtgtcgtgacccactccacgaagaactattgttgtcgtcaagcggtatctccctaaaacctgtttggctccacgtgttaggttgtggtccagtcattgatgattgttgcgatccccaatataatagggattcctcatttttgtatatggggatgttgttggaaggttttggtgttgggattatctcttatgtggtgcctgtttatatagctgagattgcacctcaaaacttgagaggtggccttggatcactctctgttacaattagcactatgttggcttatctgttgggtccttttgtcaactggagagtccttgcaattctag

SEQ ID NO: 42555 - DNA, 201 bp, Glycine max
  Peptide Sequence Number=SeqID_159333
atggaagatgatgaggatttcctggaagacgatcaggagcaccatgttgatctggttgttcccttcagaaaatcagtgaagcatatcatgcgtgagttgccttcattccaccttgcatatttgattagtggggctctagcttcagcttcttccttcatgaaaggagtatacattttcttcatcttcacattcatcatctag

SEQ ID NO: 42556 - DNA, 1485 bp, Glycine max
  Peptide Sequence Number=SeqID_159334
atggattgtttggcaaatgacacaacaaaatgcatggccaaaatgtacctacttaacagggggggaaatgtcaactatgatatgccagtgatgctattatatatggtatggagtagcaggtttggagtagcaggagtgacaatggtaagcattttatcttcttacacagtgattcctagtgaggctacaccaaattgtagtctcttgttatctgagagtgagcaaatcaatgctcccactcattcgctcaccatctacgtctacaagccaaatcatctcaacaaaattatccccaacatgaacatggttgatacaatgagagactctcttgccaagatcttagtccactattacccactagctggccggctacgcatgatacaaggtagaagatgggaagtggagtgcaatgcaaagggtgtgatattgttggaagctgaatccacaagagcacttaatgactacgctatctttgaacccaacgacaccattaaagaacttattcccaaagttgattacaccgaacccattgagaattcaccattgtttctagtgcagttgacaagattctccaatggtggcttctgtgttggcattgccatttcaaacatcattactgatgggatttccggcactcacttcatcaacttgtgggcaacgttggctcgaggagacaccttggaggaacacgacatgccacttctgaacaaagtggttcttcaaagttcggacaaaaaaccatgctttgatcacaaagaattcaagccattgccacttgtactaggtcacgctgacaccacggaggagagtaagaaggagacaacagttgcaatgttgaaactctcaagagaaatggtggagaagcttaagaagaaagccaatgagggcaaccagggtcgagcttatagcagatatgagagcatttcggctcatatatggcgatgtgtcgtgaaggctcgtgacgggtatcacaatcaaccaacagtcgtacacattattgctggtgcaagaaacagattgaacccacctttacctttaaactactttggaaacgcaacgtatccaacagtgacaccgacatgcctaagtggggacatagtgtcaaaacccttgagctacgtggctcacaagataagggaagcaattgaagtgttaacagatgagtatctaaggtcagggtttggttttattaggagtcagagtgatgtggggtggcttagggaaaaaaatgataatgaagggaaagtggagtccttgtttcttgggaaccctaacctgaacatttggagctggatgagaaacatgccaatgtatgggccaaattttgggtgggggaggcctgtgtatatgggcccaggtgttgtgaaaggggatggaagggcattcattatgccaggtcaagaggatgggtctgttttagtggctattaggttgcaaagtgctcatgttgaagcctttaaggaggtcttccacaaggacatgtga

SEQ ID NO: 42557 - DNA, 618 bp, Glycine max
  Peptide Sequence Number=SeqID_159335
atggtggtgacatttgctttgcatggatatcatacttcgattcgtatttcaatctgtgcaactccattttccttagtatatgggatggaagcagtcttacccattgaagttgaaatcccttctttaagagtgttgatggaagcaaagttagaagaagcaaagtgggtccaaagtgaatttgagaaattaaatctcattaaggaggaaaggttgaatgcaatttgccatgaccagttataccaaaagagattaaagaaagcatttgagaggaaggtacatccaagagaatttcaagtggaagattcagttttgaagaagattcttctaaacaaaaaagacaagcttggtaaatggacaccaaattatgaaggatcctatgcagtcaagaaaaagttctcaggaggagcttttatcctcacaaacatggatggtaaagagctctcatatcgggataatctgggcaaagttgaagtaacttgccaagttgaaaggaacatcttgaaaaagaaggtgtggaacaagaaacggggggtctgtcagaccctaactaagggtttagcctctcatgtcgtgagagacttttacactctagaggttgaggtggatggaagaaggtga

SEQ ID NO: 42558 - DNA, 1248 bp, Glycine max
  Peptide Sequence Number=SeqID_159336
atggagtacttgaaggaagtggaaggaaaaagtgtccatgattatgttgaggtaaagatgggtaaaatgacaaagccaataagtgtggcaggaccagtgatagtgggtgctggtccatcagggcttgctgcagcagcatgtcttaaacagaaaggcattccaagcttaatccttgaaagagctgattgcttagcttcaatgtggcagctcaagacttatgaccgcctgtgccttcatctccctaagcaattctgccaactccctctaatgccattcccacaaaactttccctcttatccaaccaaacaacaattcttggcctatctcaaagcctatgctgaccattttgatataaaaccagctttaagcaagacagtgatcagtgccaattttgatcatggatgtgggtactggagggtgaagactcaaggtttgaaaaaggaggagacagaatatgtttgtcagtggctgatagtagccactggagagaatgctgaagaggttgtgcctcaaattgaaggaatgagtgagtttgaagggcctatcttacacaccagctcatataaaagtggtagtatgtttggtgggaagaatgttttggttgttggatgtgggaattcaggtatggaagtttgcttagatttatgcaaccatgatgctcgcccatcccttgtggttagagatacggtgcatatcttgcctcagcagatgtttgggaaatcaacgtttggtttatctatgagcttgctcaagtggttccccatgcgtctcgtggacaaatttttacttctgatgtcacatctcattctcggggacacagctcaatttggacttaatcgtcccaaaattggccctctagagctcaagaacttgtgcggcaagaccccagttttggatgtaggcacacttgctcacataaaaagtggaaaaattaaggtttgccgcggaattaaacaactagcaaagcataaggtggaatttgtagatggaaaaacagagaatttcgatgtcatcattatggcaactggttacaaaagcaatgtacccacttggttgaagggcagcaacatgttttgtgagaaggatggattgcccaggaaagatttcccaaatggatggaaaggtgaaaatggactctatgccgtgggtttctctaaacgtggccttcttggtgcatctattcattcaaagaggacggcagaagatattgaacactgttggaaagctgctaataccacgcgtgtgtag

SEQ ID NO: 42559 - DNA, 384 bp, Glycine max
  Peptide Sequence Number=SeqID_159337
atgttggacggaatactcggcagaggcttcaccgcgaaatgcaaatcgttgatcaaattgacgaacaggcgaatcgatgtgatacggaggaagagaagagcgacagagaagtttctgaagaaagatattgctgatctattgctcaacggtctcgatatcaatgcctatggaagggctgaagggcttgtggttgagttaacactgtcctcttgctatggtttcgttgagaattgctgtgagtttgtgttgaagcatctccctgcgatgcagaaactgagaatcatgacgtatgtggtcaatctgccagtgttattcgctagtaacataattgctttggccgaaaaccaattttactctgaaattcgtccgctaaattgggtatga

SEQ ID NO: 42560 - DNA, 981 bp, Glycine max
  Peptide Sequence Number=SeqID_159338
atgctgaaatgcatctccttcaaatcctccacctcttcctcaacaatcccaaacccctctcaagagggcactcccagcatctctcgcgagtacaacctcgccgttcacaccacctcctacaccgagattcgctccaacgtcgaagcccaactccaccaccttaaccctaaccgcgaccgcgtccaagatgccctaaccctaatccccacgcgcctcacgcgcctcatttcaacgttctttgaccacaccgaaaccgcctccgacctctgcctccacctccaccaatgcctcctccgcgcgcgtgacctccacgctcccctcctcgatttcttccaaaccctaaaccccaccgaccccacccaaaacgactgcgttcgcgccctccgcctcttccaccccttccacgccttccaaaaccccatccctgattccctcaccttctccgccatccgctccgacctctccgccctcaaaacgcagctcgaccgccgcgtcgcaaaatcgctgtcgcgactccgcatcgtccggcgcgccgtccgcggctccgccctctgcctcgtcgccgtcgcgattgccgtggtggccgccaccgttgcggtcaccctgcacgccgtggccgctctggctgcggccggtgctgtgccggtctgtgcctttgagaagaaggaacttgcagaactgaggcagcttgatgctgctgcaaaatgtgcttacgtgttgagcaacgatctcgcgacgattgacgcgctggcatcacggctgcgcgccgccgtggagggggacaaggtgctggtgaggcttgtgctggagagggggaatgagaggtaccttgtggaggaagttatcaagcagctgtggaagagtcataaggggtttttggaacaggttgaggatcttgaggagcatatattcctctgcttttataatattaacaaggctagatttttagtcctccaagagattaccagtaatccggcttag

SEQ ID NO: 42561 - DNA, 144 bp, Glycine max
  Peptide Sequence Number=SeqID_159339
atgacggttggtgggcattggtacgaagacgggcatggtgtcagacccgtcttagaatggggattgttctacatcggttgtgatggtacaaccgatgtagaatgtgagtgttctacatcggttttgagggtgaaaccgatgtag

SEQ ID NO: 42562 - DNA, 3015 bp, Glycine max
  Peptide Sequence Number=SeqID_159340
atggctgctgatcagaggagaaaacgagtaaatggtgcaaacattgctggttatggttctagagagcaacacaggatcaaaagaaagaatttgggattagttcaaaatgatttgaacatgagacctcacatctctgttgagtgggatgataatcacaaaaaggttgttgctaagcgggaacaaattggcatcagttggagacaaatgaagccatttatcaattcggtttctaatgatcacaaaatcttggcagatgtgttttcagtgcctcaagaaatttttgacttggataatttaagtgaagttctttcgtttgaggtttggaagacccatctttcagaaaatgagagaaaccttcttatgaatttcctcccttgtggctttgagccacatcaagttgtggaagaactacttaccgggattaactttaactttggaaatcccttctcgaaatggggtgcttcgctttgtttaggtggtcttcatccagatatgattgttgatcaggaacagcatcttaagactgagaggagagaataccactcacacatacataattatcacaacgatatgataggatttctatctaagttgaagaagagctggcaaagctgtaaagatccagaaaaggagattgcgcaaaagatatggaggtcaaaacatgtagagaaaagaatgccctcaaaagtgattgaatctagagtctatgatcatgatgggaatgttacagggacatctgattcatgctcctgggatgcagaggagaaagcatgtagtagcgacaaccaaatttcctcactgagaaaagacaataaacttcaaagaagggtgcttgaaaagggcatttttaaaggtaaatcccaaaatttgatggattctttggacaacatgcctaatgtggcagaaaagccgaagacaggagacaaactgcctaagcgtagcattcattctagtgatagtgataaatacatgtcatgtatcaagattagtaggcagcagcatgagcttgttaagaatatgaagcagtctggtaaaagcatccaatctaggtcccttaaccgggttttgggtaaccttgaaaaaattcatgtgcaaccatacaatatatttgtcaaagaagaacagaagaagttgcaggagcattggttgctattagtaaacaaagacctccctgtggcttatgtaaattggacagagagacagatacagagacatgccgtgagaaattctttggtggcagagatgaaggataaatcaattcctctcatagagggagtgaacacagggagtgaacttaaggatcaggttgatgtgaactcagggagtgaacttaaggatcatgatgatgtgaactcggggagtgaacttcaggatcatgatgaggaggtgaactcagggagtgaacttcaggatcaggatgaggacaatattagctcaggggacaagctgaaggatcagaatgaggataacatgagttcagaaggtgagcttcaggatcagaatgatgataatctgagctcagggagcgaacttcaggatcagggtgaggataatgtcaactcgggtgatgagcttcaggatcaggtgaaggatggaggtctgagtgatcagtctgatttgaaagatgatgatgattctatttctaggtcccccgagaaccagtcccagcacaattctgatgttagtggtgataatgagttcaaccaaatgagtgtggattcagaaaagaatattcttttatcaaaatcaacaaataatacttcgtcgggtagtggtgatcatgaattcaaccaaatgagtgtggattcagaaaagaatcttttatcaaaatcaaataatacttcatcgaataaagatgagtattcagtgcatatgaacactcaggatgtttctattgatgaaggagcacctttcacttccagtggtgatgtctggcaaggagttgaaatgccacattcatactatgattctgctgtgacccacgagtacgcagccagtgggttatcactggctaatcctcaagtcagtcaagagcagccaactcgtatgattgatcttgaagctgatttgcgtcgagaagagacaggcaaagagttgttaagtaggcaattagataatggaaccttcagttcataccaaagccaggatcgaagtgtcttacttcaatcactcttcaaaggagagggattgttaccttatcatcatgatcagaaagaagctgagttagatttccaaacttcaaacaatgttatgatggggggtggccaattttccagtcatttcaaggagccattgcaaacgtcgctgacattggaccaggggcgaaggagagctactgaggtttacatgccagaaaacatgtcagagaatatttattcggatgaaggaaggtatttaatccccagacaagatccattgatccccaggcaagatccattgatccccacgcaagatccattgatccccaggcaagatcctttgatccccaggcaagatccattggtccccaggcaagatcctttggctgcagtaaatatgactgattgggctgctaataatgctcgcatagcagggccttcccaatctcacttaaatactggagattttattggtcatcattggtttcctgctgatcatcaagttcgtggtggtggctggaatggatctgatggtggtggtctttcaaatcaaagtcttggccctggagcaagctctgatcagagtttatttagtattctgtcagagtgtgaccaattgcattcaggtagcctttatgattcagttagaaatactgaccagtttcttgcacccagaacttatggattagtagatgcaggtacaccaagggtgaacacggttgcaccaccggcttctcgtccattagattacttcactggacgtgaagcacctagtggcctggtgcctgatgatatggcatggatgagcttgccacgtcagaattcttcaatacatgaccaaatgggaaagccatacttaaggtcatggaaccggtaa

SEQ ID NO: 42563 - DNA, 435 bp, Glycine max
  Peptide Sequence Number=SeqID_159341
atggcatggaagcttcttaaagatatccctagatctgcaactcgcaaggctggaaggagcatgcctactttggtttacgtctactgtgtgagcagaacaacattcagaggacatatgcttggagttgcagcatcatggcttgtccaagtaggcattgatttatatcgattcttttcctccgcgttccagggtcagcatgaggataatgatgttgatcaaaccaatcaagttggagttcttggacagaaggttttcattgctacagttagatgtacttcatctttaatttttgcctccataggagcaggaattggtgcaacccttattcgtccatcgctcggccagtgggttgccatgtctgatagagccactaggaagttggtggacctgcttttagctgaaagaattctaacaattttctcccatgatggataa

SEQ ID NO: 42564 - DNA, 882 bp, Glycine max
  Peptide Sequence Number=SeqID_159342
atggaaaaccataaccgtctcaaactgcgaatctctcgcatgttccgatcctcattcgggtcgtgcagaacccgtaacctaaccgatgttatggaaaaaacggtgtttgcaccacccagccccatcgatgaaccaccctcacccaaaacgagacccatttttaggcccaaaaccatcaacgacacttgcatcctgtcgtttaaggattctcattctctccccagacgcaaaatctccgagtggtcatcaccttttgtagtgggtggcggcaacaaaatcaaaaacaacaacctcaaccttaacctcggtgtcatgtcgtgcccacccacttccccaaacatttccctcaacacaatccacgaacacgatttcggttacgacgacaaaaaaaaggtctcgacgaaaaactcgaggaccaacaagaagaagaagaagaagaagaagaagaggcatgcccagaagaaaagggagtttttccctttcaattcatgcgccaaagacaccaactttggtggatactggtggtatagcagtgacgaagacgacgaaaccgacacccttttctcctcgaaaagcctctcctcggattcctcccggtcccggcgccggcgccggaataatgaacggagctccgacatgggtgttctgccgctgaacgggaaggtgaaggatacattcgcggtggtgaagcgctccagcgacccttacagtgatttcaggacttcgatgctcgaaatgatcgtcgagaagcagattttttcgcccgctgatttggagaatctcttgcagtgttttctgtcgctgaattcgcatcaccatcataagatcattgtccatgtcttcaccgagatttgggaggctctgttctctgactggttttga

SEQ ID NO: 42565 - DNA, 324 bp, Glycine max
  Peptide Sequence Number=SeqID_159343
atgagattctctatatccttccacttcataaaacaatactgtatctcccttcttatgctggtaactctagaagcaggggagaaggtctcaaggaatagtgtcagaatgtgttcccatttttctacaatccccagtagtaggatgtggggccccgttaggaagcagaaagtaaagaagggcaacaaaggagcgtgtgaagacaaaagagcacaaaaaagcaaaggaagcctatgcccgaaaccgaaaagggaattccatccatcattcaaaagaaaaaaagctaaagaatctttcatggctcctctccttctatcatctgtataa

SEQ ID NO: 42566 - DNA, 1455 bp, Glycine max
  Peptide Sequence Number=SeqID_159344
atgcacataacacacttgcaaaagtatcgcatattcctgagaaaagtagctgagaaaggattgcttgaaggcttatctaacagggatctaaggtcaatattttcctctggcctttcactagcaatgatcaaagacttccaggcaacaactgccaaaacctgtgttcctgtgcagcaatatatgaaaagaataacacatcagtcagggtacggaggcacaggcaatgctgttaaaccttacaactatgtttcaagtgtgactaatactccacttggaaaatgccatcaatttccctatatatatcacaaaggcttgaatatgatgctccacaaccagcatgataattatttgaatcaagcaagacttggagtacaatcaagctttggaagcaatgttgggaccaataatatccatcaaaatatgttgggaagctatgcaaaccaaccatattatgcacaaagctcttacaacaatgttggtgttgtctctccatcagatggagtaatgagacatgacttcatgacttcttcaaatggcctaagagaaggttcactgggaaataatcaaaagtttatctctgatcaaggaaataggaacacaggatctttgaacaactctaatactaatcttccttggactaattctacttacaatcccagccataacattcaacttaatggtggaccacaaatggttggaaatggaatacaaggaaggtttaatagtaccattggtattatggattctgttgcaaacaacaatagctttggcttgattaatgagacaagtcaaaatgcaaaaatgtgggcacttttggggcaaggaaactttggtttggctcaaggagggtttgcttttgcttttgctactagtactggagagagctcgtcaagtgaggttccagaaacactaatcactaataatggaactagagcagaaaatatttcagggaacccacaactgcctcaacagctacacgacaatgttgcagaaaattataatggtacttcaatcggcaagggcaatgtcgtccacttggaagatgacctttctgatcttttcacgatgctagatgaaatggatcttcttcttactgagaaccctgacacaaatgaattcttaaagtctgacttttcaagctctactcacgttgtgcagtgccttgaacagtctaacagagctagtgatatgattgttaacccaaatgaaaccacattaaatctgccatacaactccccaacaagatctgagaagaattctaatcagatgggaggtgatgacagatctgtgtacatggaacccttggacaggttcatgatgaacgatgtttccttagcaagtaactcggctactgatcagggttgggatttaaaactaattgaagccttattgttggtgacgaggctaactagaggaaatgaaaagattgctgcaatttcttgttcacaacaatag

SEQ ID NO: 42567 - DNA, 195 bp, Glycine max
  Peptide Sequence Number=SeqID_159345
atggccaggtctaggcccaaaaacaatggtacccattttgtggcccatgtagcagccaacctagaaggctctcttctctctcctcctcctctccgtggcggcccaaccacgccgcttccgcttatgtctctcgaaacgcagtcgttgatgaccgcagatccgatccttcctcccatcccctttttcccttcagag

SEQ ID NO: 42568 - DNA, 297 bp, Glycine max
  Peptide Sequence Number=SeqID_159346
atggaagctgattttaatgaaaatatatatgcagtcaaaacctacagaatcctttatcaatttgccttgctggattcagatgctaaatttacgatcaactggaaccgcttggctgttacgagtatgtttggatttggttttgttggaccagttgggcacttctggtgtgttcctgtgaagtgctttctggatagtgcttttctgtcatgcttggagcaacagaagggtgcacccttgaaaaaatggtttgcatcatttcattctacgattacgaatgaaaaaggaggtggtcattga

SEQ ID NO: 42569 - DNA, 228 bp, Glycine max
  Peptide Sequence Number=SeqID_159347
atgatgataaatcctaaggcttgtttctctaaacattcgcagtggccgcccaagagctttcgccttcgccaggctagagagctaatgctgctattatccttccttggatgtctgaggctagcacctgtgtccttggtacgattttgttacacatggctaaatgaagatggtgttttcgtcactcatatttttgtatccactggaattagtctgttcccgcatagttga

SEQ ID NO: 42570 - DNA, 225 bp, Glycine max
  Peptide Sequence Number=SeqID_159348
atggcagcattagctctcaagcctggcgaaggcgaaagctcttggtataatgtctcagacatccaaggaaggataaaagcagcactagctctcaagcctggcgaaggcgaaagctcttgggcggccactgcgaatgttttgagaaacagccttaaaagatatcatcacagacaacaaacaatgtatcacggaggaaaatattacaacatatgtggactaatctga

SEQ ID NO: 42571 - DNA, 285 bp, Glycine max
  Peptide Sequence Number=SeqID_159349
atggaactagagcagaaaatattccagggaaccgacaactgcctcaacagctacacgacaatgttgcagaaaatgataatgactgaagagaaccctaatacacatgagttcttaaagtctgacttttcaagctctaatcatgttgtgcagtaccttgaacagtctaacagagctactgatgtgattgttaacccaactgaaggcacatcaaatatgccaaaccagacctcaataagctctgacaacaattctaaccagaaaaagaagattgattgtgctgattga

SEQ ID NO: 42572 - DNA, 318 bp, Glycine max
  Peptide Sequence Number=SeqID_159350
atggctcaagatattcatctggtcaggggcaaccatattcttcgtgaggcgaatctgcaagttgctaatttgttggctaagcgtggagtggagctgcacgatggtgttcatgtttttcatagtcctccaactaggaatcagttagctatgttggctgatgtctcttctgtttatttctcccttctgaattacaaatcacaaaaaaggaaccagacccatacatgcacgagtcacacacagttcaatttcccagtccaatgcattaccggagaaagagagatgccacgtgcttacatcaaggacaaggattacgattag

SEQ ID NO: 42573 - DNA, 186 bp, Glycine max
  Peptide Sequence Number=SeqID_159351
atggcaccgttgcagtggttaccagtggaattgggaagcttggaatcaatgatgccgttgcatagcgcggtagcttcagctcgattagtgtcaagcttgtctattgagtctctgggttggggattagttcctcaagggtataccatatcatcagcacttgggtattggaagtatttgtatttgtga

SEQ ID NO: 42574 - DNA, 429 bp, Glycine max
  Peptide Sequence Number=SeqID_159352
atgggtttgaaagcactttttgtttggtgcattatatggttaggtttagcacatttgtcccttggaggaagagtgaggcactacaagtttgatgtggagtacatgatcagaaagccagattgcttggaacacgttgtgatgggaatcaacggccagtttccaggcccaactattagggctgaagttggtgacattcttgacattgctctcaccaacaagcttttcactgagggaactgttattcactggcatggaatcagacaggttggaactccttgggctgatggaactgctgccatctcacagtgtgctataaacccaggagaggcttttcattacaggtttacagttgacagggcatttgtcatttctattgtcagttatactgaaaaaacaatgttgattgattccccaggtcgtatcctttga

SEQ ID NO: 42575 - DNA, 285 bp, Glycine max
  Peptide Sequence Number=SeqID_159353
atggtatctactttgaggagtaaacatggatcagaagaatggggctttgtgcaagtcagacccagctcttcaggagttgggtttggaaactttaaagagattggtcctttggatgctaatttgaagccaaggaatttcacatggttgaggaaagcaaatatgctatttgtggacaatccaattggaactggttacaattttgtggaggattatgagtggctccctaatttttgcttcatgtgcataggaagtaaaaaggccataaggtacaagatcaccacatag

SEQ ID NO: 42576 - DNA, 501 bp, Glycine max
  Peptide Sequence Number=SeqID_159354
atgttggaaagctatgcaaaccaaccatataatgcagaaagctcttacaacaatgtcggcgttgtattttcatcaaatggagcaatggggcatggcttgatgacttctgcaaatggcctaagaggagttgtgaaccatggtgacaaccaattgatgtatccaaattatggatgcaggctatggtgggagagccaaataggttcccaccatgagaaatggagcctccgacactcatcactgctcaatgactccgccaagcaccaaaccaaactcttcaacaccacatttcttgatgcgacgccaccacgacaatgcttcaccttgaacccatcacgctttagaaggttctcaaaaactttgacagccttcccgggtatggatatgacgctcagccgatcacggaggggaggcacaacagcaacgatcttcacatgccagattgcaatctttggtgctggaacggcgctagaagttgtagtcaccgcttttgattgtccctaa

SEQ ID NO: 42577 - DNA, 243 bp, Glycine max
  Peptide Sequence Number=SeqID_159355
atggttgggattgggaatggaatacaaggagggtttaacagcactgttggtatcatggattctgttgcaaacaacaatagctttgacatgatcaatgagaccactcaaaaggcaaataagaatgtggcacctttggggcaagggaactttgatttggctcaaggagggtttggttctgcttctacgtcagggttgaacctagctcaacttaagttgttaacaactcactcgatttcagtttga

SEQ ID NO: 42578 - DNA, 225 bp, Glycine max
  Peptide Sequence Number=SeqID_159356
atgagagattcatcatctgcttgccacaagttggctagtgtggccgatgtcatgcaatgtaactggctggttgcatattgcatgctgaaacacttgacaaaagtgttgaagctgtcaatggaccatggagaaagtccactgtaccaggttaatgcctcccccttgagggacattgggaagacaccacataggatcacattgtcattggtgtacaaatttgcttaa

SEQ ID NO: 42579 - DNA, 261 bp, Glycine max
  Peptide Sequence Number=SeqID_159357
atgggctacaagcagccatggaatgcatttaaagattctgccacctctgttcctatggatgcccttaatcaagggttacaaatgcatgatcttccatcaactgatgatcacttttttgatttaagagcttctgagggatccaataaaggtggtatgcaaggcattgtgcctgttgctaggtttgatcatgatctttcattgcattttgttagtggcttaccatgtcctccatctgcatttgctccgatgggagaggtttag

SEQ ID NO: 42580 - DNA, 360 bp, Glycine max
  Peptide Sequence Number=SeqID_159358
atgtctttacaccatcaccatgaagtctccatcataatcactaacttcatggcagctccattgatattttatactggaagacattccaaagacttgaagtattgcttgacgttatctaacctcacgctgatccactccccggctttgcaaggaaacaagaaaccacttaacgagtttggagccatcgtctccatgccgcatcaaaagattaagttccctagcctgacgggagagatggtgactatcaaggccgaccaaaagcaagcacaaaagtgttatgcggaaagcttgaaagtggcactctatcctcccaccagggagcctgtcaagcctcacctcacatccgacaatatcacttaa

SEQ ID NO: 42581 - DNA, 528 bp, Glycine max
  Peptide Sequence Number=SeqID_159359
atggggcaacaacttttttatattcattttggtggagcaatcagatctaagcttattcatcatcattttcattgccttcaccttcgtacccctgaaaggcaagcaaatccatctctttcgttactgacatataatgcacttgataagcttgcaactgcaacaacaattgctcctttgatttggcagtactactcaaatagcaatctgtcactcaatttcaaggcctacatctccacctccatcaatacctttttagctacatctccacaagggttgacatctttcacaacacctggttgggaagacactaaaccagatgtggaacactcctttatgcaacaacttgtcctttttcattctgatggttttgctcgctttatcccttgttgtgcagatgtagattgctatttgagtagtactgccaaatcaaaggagcaattgttgttgcagttgcaagcttatcaagtgcattatatgtcagtaacgaaagagatggatttgcttgcctttgaaggtgaagacaattaa

SEQ ID NO: 42582 - DNA, 297 bp, Glycine max
  Peptide Sequence Number=SeqID_159360
atggaggtggcgcttgcgggattgtgtctttgtcacccctcttatttgctggacaggtttatgctcctgtggaggttgtcgatcacgtctaggctgattgtgtctttgtcttccttgatcttctactctatctcttcttctgtctatgtcataactcctatgatgcttctcttagtgttctccgggtctctttcctgtttggtggttgtccagccttttaacgaactgggctgggtatccagccttatttggtcaagtctaacctcagtctgggtgatttcgtcggaggtagcttga

SEQ ID NO: 42583 - DNA, 1176 bp, Glycine max
  Peptide Sequence Number=SeqID_159361
atgggggaaggtgaagctgaggggagtgatggcgctcccaagaatgttgtggcaaacgacgtcgttgccaatgcgctgttgccgttcgatgttcccgccaagaagttagcgcggcagctcgatttcaccggcttcggcgggatgtcgacgacgccgcagccgcagccgccggtggttttgccgctgcggccttctacttctgtcagggttgggaaaccagaatctcctaaatcaagaccgaggcctggctttgaaattaaagaagctaccccgaagaagcagaagcagtgcaattgtaaacattcaaaatgcctgaaactatattgtgaatgttttgcttcgggaatatattgtgacggctgcaactgtgtaaattgttgtaacaatgtggaaaacgaagctgctagacgagaagcagttgaagctactttagaacggaatccaaatgcatttaggccaaaaatagcaagtagccctcatagaacacgtgatatcagggaggatgctggggaaattttgatattgggaaagcataataaagggtgccattgtaaaaaatctgggtgcctcaagaagtattgtgagtgcttccaagccaacattctttgttctgaaaattgtaaatgcatggattgcaaaaactttgagggaagtgaagagagacaggctttgttccatggagatcaaaataacaacttggtgtatattcagcaagcagccaatgctgccataactggagctattggttcctctggctattcttcaccaccaatatcaaagaaaagaaaaggtcaagaactcttatttgggccaaccgtcaaggatccatcagttggcaggcaggggcaacaggcaaacaatgtcagagttcctgcaccctcctcatccttgtcacctatcccaggtgctcgtgttggaccagcaacattaggtccttcaaaattaatgtacaggtctcttttagcagacatcatacaaccacagcacctgaaggaactttgctcagttctggtgctagtatctggacaagccgctaagacatttacagaaacaagtgcatcagaaaatcaagaactaaacaaattttcaatcatagtaagctgtttgatgagtttcgaatttgggatggagtgcgatgctcaagatgctggggtatccaaaaattttagcacctaa

SEQ ID NO: 42584 - DNA, 1188 bp, Glycine max
  Peptide Sequence Number=SeqID_159362
atggctcttggagctagtggcattaggtcatgtaccttggcctttaccgcagatcaaatctacaaccctgaaaacccacaaaacgagaggaccatgaagagctttttcaattggtactatctttcagttgccatttcagtaacaatttcaatggcattcatagtgtacattcaagttaaagcagggtgggttgtgggttttgggatttctatggggattgtgtcactgtctgcaatcatgttttttttgggcacttccatatacgtcaaagtgaaaccaaacaagagcttgctcactggcttcgcccaagtgattgttgcggcctggaaaaacagacacttacccctgcctcccaagaactctgacatttggtatttccgcaatggttctaatcttgttcaaccaacaaacaaagtaaggttcttgaataaagcttgcataatcaagaatagagagaaagatttggactatgaggggagacccaatgagccatggagtctgtgtacagtgagacaagtagaggagttgaaagccataatcaaagtccttcctatttggtccactggcatcatacttgcgactactgtaagccaacaacaatttttcatagtccaagcaggtaccatggacaggatggtgttcggtatagatatcccagctactaatttcgctttattcatgatgctaactttgaccatgtgggtgattgtgtatgatcgcattctagttcccattttgcctaaccaacgaatactcactgtgaagctacgaatgggaattgggctagtgatctcatgtttagccactctagtagcaacattggtagagaagaagagaagaaatcaagccataagtgaaggatttatagacaacccgaaaggagtggtcaacatgtcagctatgtggttggtgccctcctattgcttatttggtttggcacaaggttttactgtcattggacaaatagagtttttttactctcaatttcctaaaacaatgtccactgttgctgtttccctatctacccttaacattggggtgggaaacttggtgggaagcctcatcatcaaggttgtgaaagatgggacaaggagaggaggaagagctagttggctagcatcaaatatcaatagaggacactatgattactactatggactccttttcattctaaatttggttaatttg

SEQ ID NO: 42585 - DNA, 678 bp, Glycine max
  Peptide Sequence Number=SeqID_159363
atgactaatcacaaccaacaacatccacagcttgttagctcttctccaattggtacaatgataccaacccctgatatgtcccatgttacaaattcaatcatgatcatggcatcttctatggatgcctcaatgattcctgcctgtgggtgtaacaacatagcatactcatctgtcaatagtgtaaatagatctgatggaggaaacatgtcatcggtgggggtgcaaagagctactagccacatgatcccaactccaggacttagtgtcagtaataatcattcatatacaaatatggatccatcaactgatagcagttctttttccgatcaagtagcattagacaagttcttctctggtgttgattctacaaaactatcacagtcacagtcacagccgcaacgacaccagaagctgcaagactgtgaccacaacaatcatgcattgcacaaccttggcagtcaaattgatggtggaatgagatctgatttgctgcaaaattcatttgcatatccaaatggttctataaataatgggctaggcttgattggaaacagcatacaatttgcaaatgaacctggcactcatgactattcttcaatgtacactaattcccctaaacacttacagcagcactttgatcaaaatcaacagccaatagtgcagagtaatctttcttaa

SEQ ID NO: 42586 - DNA, 159 bp, Glycine max
  Peptide Sequence Number=SeqID_159364
atggatggattctttatcacaaaccaagagaaaccaataaagagctactcctgtaaagcgcgatgggttcaaggtgaagcatcatcgtggaagcgtcgcatccggaaatgcagcatcaaagattttggttcagtgctcggtggagtcattgagcagtga

SEQ ID NO: 42587 - DNA, 240 bp, Glycine max
  Peptide Sequence Number=SeqID_159365
atgaccactgaaatttatcaatacacgcaatatacaggaaaatggccgatgctaccaatttttaacgaacataaaataaaatcgacaagaatatgtggttcaaaacagctcctatgttacactgctgccaatgtgttggagggtcctcaggcgcagtggacaagaccagtgcttcatttgggtttgtttgcctttttctctgattaccattcatctgatgattgtcaacaaatgaagtaa

SEQ ID NO: 42588 - DNA, 570 bp, Glycine max
  Peptide Sequence Number=SeqID_159366
atggtacttgcaaatgacaagaagaggagaagacaacaacatagggaagcgatattagccaagagccaagcctctccaagcaagacacaggggaaaagccaagtagcaaagaagaagctcgacaattcagttccagctagcaatgaagatcctcgacaattattgaaaagccaaccagcactgtttctgacttattgggaacctaaaaagcaacctggggctgacccaaactggttagaaactaaatctggggcagattcattctctgatcatacatgctacaaatttatctctaatcatggtagggttaacatatgggcactaagcaggattagctacttaagtggaaatgtgaagtctaggttccctatttatagatcagaaattcatcatcaggttcattacttttcacaccttgcacctatatgtgcaacctttaaggaacccatggggtttggaccagccccaaagaaaaggaagaaaagcaagatgagaagggattatgatgaagaagatgatgatgaagaacaagaggaggaagaagaaccaggggagttattcctgaagtag

SEQ ID NO: 42589 - DNA, 267 bp, Glycine max
  Peptide Sequence Number=SeqID_159367
atgagtgttcaacacctttgtagcaacaatgtatgtagggatctcttcgagccacacttccaagaacagtgtagggggttttgtgggttcgagcgaggacagtgtgggtttttcggcagtgtagggggttctgtggtttcgagcgaggacaatgtgggtgtcgagggagcggtttccggcgggaggagaaagagaagagcgatttcagacaggaggatgaaaaagagaagagggagggcaaggttttcgagcgcgcgcggcttgtga

SEQ ID NO: 42590 - DNA, 361 bp, Glycine max
  Peptide Sequence Number=SeqID_159368
ctggctcttccttggatggatccgctataaaggtatcccagacacgtatgatatagcgatatggaacaattccaattacagtatagttggatcattgcaaactggatctgatgtgcgggccatggaagtgagctcagaattgatttatttggggtgcaaaggaggtactgtggaaatttgggataagaagaaacacaaaagagtcgacacgttgcaaatgggtacgaattgtagggttaattgcatggctctagacagcaatgaagaggttttggtaattggaacttcagatggacagattcaggttcctcgtgagctgtatatagctcaaagtttatacatccaagtgacttgtacatag

SEQ ID NO: 42591 - DNA, 429 bp, Glycine max
  Peptide Sequence Number=SeqID_159369
atgacagttaaagaacacaatgaaaatgattctcttactatcaaatctactcctttactaaatgttactactagtgataatttcgagaactcatggcatgtgatatttggctgcaacccaagttcagcgagtcttcataaggaatggtctgctgctcgtgctttgtccaatctacatcatgagcaccatcaccaaattatgctctcatcttggtcgaaacctgcacctggatacatcaagataaacattgatgctgctagctttaaagacatcaacaaatatgacgtcagcgtttgtatacgagatgaccaaagtaatttcatttcagccaaatctcttcaccatgagggaacaccagaacctcgggaggcagaagcaattgatctcttacatggtttgctttgggctaaaagagctacgacttcataa

SEQ ID NO: 42592 - DNA, 687 bp, Glycine max
  Peptide Sequence Number=SeqID_159370
atggtttacgggatactattctttgtcctatttgcattcactttgagtttagcttttctactctcaaagtgtctatcaaaaagtcaaacaaaaaatgttccaaaaaatgttccaaaagggtctctggggtaccctatcatcggagagacacttagttttctcaaagcacagagacaagataagggttctgtttggttggaagaacggatatctaagtatggccctatcttcaaaacctctttaatggggttccctacagtcttagtaattggacaagaaggaaacaagtttgtccttggttcaccagatgatttgctttcttctaagaaacccctcaccctgcgaaagatacttggaaggcaaagcttagttgaacttacaggaccaagatacaggttagtcaaaggggaaatgttgaaatttttgaaacctgaatgccttcagaactatgtcaaaaagatggatgaattggtgaatgccacattattgagagaattcagagagaatgaaaccattggagctgtggtcttcatgaagaaactgtcctatgagatagcatgcaatctattgtttgacattaaggatgagcacactaaggaggctttgtttgtagattttactttggcatttaaagcaattcattctcttcccatcaatctccctgccgagccagggcaagaattgtag

SEQ ID NO: 42593 - DNA, 360 bp, Glycine max
  Peptide Sequence Number=SeqID_159371
atgccgcttcaccttgttcaccctccacccttagtgttgttgtcagctccagtgaggtttctagagatcacagattttccatggtcgagtcccactaggggccataccaggctgttagggacaattgcaagcggtactacaatttctagcggcgtttcagcatcaaagattgcaatctggcatgtgaagatcgtcgctgttgtgcctcccctccatgatcaactgagcgtcaaatccatactcgggaaggctgacaaagtttttgagaaccttctaaagcgtgatgggttcaaggtgaagagtttggttcggtgcttggtggagtcattgagcagtgatgagtgtcgaggctccacttga

SEQ ID NO: 42594 - DNA, 307 bp, Glycine max
  Peptide Sequence Number=SeqID_159372
atgacattggccgcactggccaacctgcgacaagcaaatgatgaatctctcccaaaattcatggataggtttggacacattgtcgtccaaatccacaatctcaacccagaggtagcattacactccttgctcctcgctttaaagcctaacaaatttgcagagagtctgtgtgaaaaaacccctagtagcatggacgagccaatggctacatccagatggaagaaatgtctagattcaagaacaaagtcaaacaagtcagacaaaaatgcgataagccagaaggaagcactaaggccgactcacacaa

SEQ ID NO: 42595 - DNA, 1518 bp, Glycine max
  Peptide Sequence Number=SeqID_159373
atggatgctatgtcagatgaatgcctaattttgttcgggcatgaaatggtggatcagtactgttatatgcgaaagagatggggaggatgttggggtgcattttcttgtttaggttcacagaagggtgggaagcgcattgtacctgcatctcgcattcctgacagtaatgggccagcctctcaaccaaatggacctcaagtggttgggttgaccaatcaagccacgggactagctccttctctcttagctccaccttcttcaccagcatccttcacacattctgcccttccttccactgcacaatcacctagttgtttcttatccttgtctgctaactcacctggtggtccttcatctacaatgtttgccactggaccatatgctcatgaaacacagctggtgtctcctccagtcttttcaaatttcactactgaaccatctactgctcctctcactcctcctcctgagttggctcatttaacaactccctcttcccctgatgtaccttttgctcattttctttcatcttcagtggatctcaaaaacaatggcaagggtaactacatcactgcaaatgatcttcaagctacatattcactctaccctggaagtcctgccagtagccttatatctccaatatcaaggaactcgggtgactgtttatcatcttcttttcctgaacgagagttccatccacaatgggattcatcactatctcccgagaatggaaaatatcagagaactgggtctgggagggtgtctgggcatgacacaagtggtgtcactatggcatcacaagatacaaatttcttttgccctgctacctatgcacaattttatttggaccaaaatcctccatttcctcataatggtgggagattaagtgtttcaaaagactcagatgttcaatctaatggcggaaatggacatcagagtaggcatgctagaagtcctaagcaagatgtggaagaaatagaagcttaccgagcatcctttggtttcagtgcagatgagattataactaccagtcaatatgtggaaatttctgatgtaatggaggagtcatttaccatgttgccatttgcttctaacaagtcaacaatggaagaaagcatagagccttcatttatgaaaggattcaaagctcaggatacgcaggtggcattgcagagtcagagaagtcttagatcagatccaggtccagtaggcaaggaaaaagacaatcaggcccctatatgtccaggatatgaaggcattgttcatatttgtatatcatctggaaaagatggaggcaaatatgctctttcttgcatgtcagatcatatatcacaagggcattgtagcaacagctctggattaagtacaccagagaaccgtactctcgaagatgatgaggatatattctcaaaaatggaatcttccagaatctgcaggaaatatcagatggggttatcgtgctctgatgctgaggttgactacaggagaggaagaagcttccgagaagaaaagggaatgtga

SEQ ID NO: 42596 - DNA, 861 bp, Glycine max
  Peptide Sequence Number=SeqID_159374
atggtgaacaccaaatgttcttaccaaaatccggagctgacatacatcagggtggacgaggctaaggttagagataacctattggttgggaagcctgactgcttagggctgggtgtccgtgctcttgtgtcagaattgacatggaaggttaacgtgtgtctcgaagtgtcacggaattccttcttggatgttgatgctcgtgcttggcttcttgaggggagtactttctactttgaggaatctcatgataatatggttcagattgttcatcaggtcaatgttatgagagatatcattttgtcttgtttcaatggtggagcaaattcttcgaagccaccaaggttgacttgttggagacagaattttgataatgttgatggtagctcccttggcaaccttggtcttgctggttatgggagaatcctgcgtaattctgatggcgaatggatctacggattccatggtcacattggtaactccaaaaatctccatgctgagcctctttacttccttcggggctttccttacaacatgctagtgatgttaaccagagagcttgctccaccactagagggccttctccagcgagacgatgacatcttctgtgtcgtctacatcatcgactttctgctccattttaacttcaagcctttcctttttgacatgctcaactttccattgcccacaccacaaatcaccatagtctctgtggattcaatatcatcggaggaatcgaacgcttggggcctcgaggggaactggtacacgatggcatacaccactatacccgactacagcattcagtcaatggcgcaatgcatggcccaggtcctccgtgccgtcgaacacctccatgcgtga

SEQ ID NO: 42597 - DNA, 171 bp, Glycine max
  Peptide Sequence Number=SeqID_159375
atgtggataagtgatgttggtggcttaaacttcgggccaggctatgctagtaaaggttgtttcttctacaagttgtttcaatctctagatccaatggaacaaggttgtttcctgaaattatacttcacatacaagaaagaaaacaactacaacacaggttatcaaggttaa

SEQ ID NO: 42598 - DNA, 3339 bp, Glycine max
  Peptide Sequence Number=SeqID_159376
atgaccaccgtaacggtcaccactcgagctcaaatcctccgccacaccgccgcattcacctcctccgtcctctcgcaatccgaactacgtcgccgcctcatcgccactctcctccgcgacactccattctccgaccaaaaacacctaaacctcgccgcagacactcttgagagcgcgatctcgttctcgagccccgccctccgcttctcgtccctctccctcgccgagaagctcctcctccctctccccgacttccccctctcctctcttctcctctctctcatccacgcactccgtaaccgccctaccgaatccgccgttagcctcctccgaatcttccactccaacgcttccctcgctcgatccgaaatcgctcccgcgctctacgaacgcctcttctctctccacctcttccccgtcttccgctggttcgatgatcagaggacgcggattctctcaacgagccgtaacgatagcgattattcggtaacttccgaggagtactccgtggtgctgccatgcgcgaaggtgttgtcgaagatgagcgaggagcaggcagcgaagctcagggaggtggagagagactacgaagaggtcctcaaccagaactgcatggttctcgccgagtatttcaaagaggttttggtcaacgaaaacggtgacgctgctgcgattagtccaccgtcgttggtactgaagagcgccgcagaagatggccgcggcggtgtggagaacagaaaggaggagatgatgaaaatgagcgtgttggagaacggacggtataatccaatatggtccgaaagggaagcatctattgaatttttgagccccagttccagcagcagatcttcccaagtgccattttatcctcaaagagtcttttccagaatcctcaaaccccaaaaagcttcaaaaacttggacaacaccagtctatttaaactcaaccaccgctgatactgatttttctttagatgagagtttgcttagttcgtcttcagattctgaggcagaaaatgatgaggaaaaggacaaaactgttgcattgttggagcctcgacaaagccaaattaaggagcgaatgctatccatcttcaaacaatcaagaggttccccagattatcctatggcagacttcgataccccgctgcatggaattgggaaacatgcacctcccaaggactttgtctgtccaataacaagtcacatatttgatgatccagtgactcttgagactggtcagacatatgaacgtaaagctatcgaggaatggtttaatagaggaaacataacctgtcccatcacacgccagaagcttcaaaacacccagctacccaaaacaaattacgtgctcaagcgactaattgcaagctggaaagatcgcaacccccatttggtcccaccgccgtgtgagagtccgtacgaagatactgatgaggcagttgtgataccaacaacattgccttcaacttctcctaatagtgttataacccaagccaccgttgatgggatgatgagtgagttacgctgtgcaatcaataacctttatatgtcagaggttctccaggaatcggaaatggccgtgcttcaaattgacaagttctggagaggagtgaatgtaggagtggatatacatagcatgctatcaaaacctgcgataatcaatggatttatggagatccttttcaattctgttgagccccaggtgcttcaagcttcagttttccttttggcggagatgggttccagagacaatgctgttattaagactctcacacgtgtggacactgacgtggaatgtatcaaggctcttttcaagaacgggttgactgaggctgttgtcttgttgtatctgctaaacccttccactatgagtcttgcagagatggcaatagtggagtctctaataacagttttcaataagaaagaggaagacttggttaagatgtgtttgaagcccaaaacagctgcagtgcttttacttgcacggattgttggaagcagtgaagagataattgcatcttcggttgtcaatacccttttctctgaaaaaacaattggaactattgtcggaagtttgggagctgacttggcaaaggagaggattgctgcagtggagatcttgttgagatgcatggaagaagatgggacttgcaggaataacattgctgataaagcagagttgtcacctattttggaaactttaatcggtgcaaccgatggagatcgatttaagattattcagtttttctttgagttagtcaaattaaataggcgtacattcattgaacaaatcctccacattataaaggaagaaggaccttttagtacaatgcatactcttcttatttatttgcagacagctcttcaagatcaatgtccagttatggctggcctcttactccaactcgatcttctggttgagccaagaaaaatgagcatataccgggaagaggcgatggatactcttatttcatgcctgagaaacacagatttccccgttacccaattagcagctgctgatacaattatttcactgcaagggagttttgacttctctggaaaccctcgaacaagagaagttcttcttaaacgagcaggtatcgaaaaaagttccagaagtcttgtacaggaagaagagaaggcagctgatgattgggaaagaagaattgcatctgttctagttagccatgagtttggcactctttttgaggctttagcagatggcatgaagagccgaaacccagaactacgatcagcatgctttatattagctacatggctcatttacatgttgaccattctaccagatacagggatacatgtagcagctcgtgcctgcttgctgaagcagttcatagctaaattaaattgtgctaaggatgtagaagacagaatcctttctatgcttgctctcaatagctttcttcatttctctgacggctttggtgatctaacttccttcactaaggatatcataaaagggttgagagagctaaagagatcctgtcctttagcaactaaaatgctaaaggttcttgttgaagaaaatgaatctaaagcggaaatttggatacataaagagctcataaaagaagactgcagcgagaatggagaggtgctgtctgtcatttgctttaagggtaaatttttttcaggacatacagatggcactatgaaggtctggacattaaaggataacttattctgtctgatgcaagagatccaagaacatactaaggctgtgacaaacttggtgatttccgaatctgatgacagattatacagtggttcacttgaccgaactgcaagggggactggtgtcaaggctagagtgtaa

SEQ ID NO: 42599 - DNA, 342 bp, Glycine max
  Peptide Sequence Number=SeqID_159377
atgttgcctataaataaggaaagaggttgggagagggggagaatcttatcatttggggaagaagatcggcctcgttggcttggtcctatttcatatgaatacccatcatatcttactggggaactgcccggggattacggctttgacattgctgggcttggccaggatcctgtggcactgcagaaatacttcaactttgagatattgcatgctcggtgggctatgcttgcatccgtcggtgctctgattcctgaaatattagacctattgggagcctttcactttgtagaaccagtgtggtggcgtgttggatattcaaagctcaaggtgcatatgctctag

SEQ ID NO: 42600 - DNA, 216 bp, Glycine max
  Peptide Sequence Number=SeqID_159378
atggatgaacaagagagagttgacaagagaccacaggatatgttttaccatggccccatggtggacaccaaatatacttaccaaaatctaaagctggcacacgtcagggtgtatgtggctcaagtgggctcccggacttcacatgccgactttaagaggaaaagagtggagttacgggtccttaattctatcgtagagctcaaactcattacctaa

SEQ ID NO: 42601 - DNA, 1125 bp, Glycine max
  Peptide Sequence Number=SeqID_159379
atgaatagaggtgttttgcaaagctcaccggtgcaacaaatgatggccagaaaccctaacaactggtggaacatcaacaccatgcgccctcctcctccttctcaagcttctgcacctttcttctccactccttccaactttctaactccttataaccccacttctcttcctcttccttcttggcatgacaacaatcaagagctacccgagtcatggagccagctactcatgagtgggatggtgtctgaagaagagaaagggggtatgtgccagattcagtcaaagaagttggagaactgggagcaacaaatgctaagccaggctccaagtgctcctattgttgatgttaagcaagaaagctcggtgaacagctatgtgtatgggcatggaacaaacgaagagtttcaagcagcaaagccaattacatggtctcaaatagtgcctgcttcttcccccaaatcatgtgtaacaagtttcagcagcagcatgttggatttctccaacaataacgccgatgcgaggcctcctccaccagatccatcctcagagtgtaatagcagtactgcaactggtggggcattcaagaaagctagggttcaaccgcccacaactcagtcgaccttcaaggttaggaaggagaaattaggtgacagaattaccgcccttcatcaactcgtttccccattcggaaagactgacacggcttctgtcttattagaagctattgggtatatcagattccttcagagtcaaattgaggtcattaatgtttattctcctcgctctgtcgatttttgcaaacgaccacgagagtcagtgaatagtgatggcacgctagatgcccttagcttaccatacttgggcagtggatcaggaaacatgaggcaccaacaatccgttcaaggagagaagaattgtatattccctgaagaccccggtcagttgctgaatgaaaactgtttgaagaggaaagcagctagtagtgagcaggattctcaagaagaagcaaataaagacctgaggagtagagggttgtgcctggttccagtgtcatgtacgctccaagttggaagtgacaatggagctgactattgggctcctgcttttggtgggggatttcggtag

SEQ ID NO: 42602 - DNA, 219 bp, Glycine max
  Peptide Sequence Number=SeqID_159380
atggagatgagaacttcatgtagcatacacaaggatcgtccagctcaagatgccacaaagattaaccaaccgagggaggagcttcatcaatcaaaggaagagatgcgtgtattttactcagttgtctttcaattcctacctcctgaagctagaacattattcatcaacatcaacaatctcaccagtaacatcaagaccaacaacaaaacaagagaatga

SEQ ID NO: 42603 - DNA, 359 bp, Glycine max
  Peptide Sequence Number=SeqID_159381
atggcattcttgggagagacaagcagtcagacagttgtgaactccacattaggttttatttttccaaatggatccattgttcacaacgacagtggtgtttcctttcaagcttccactccagttcccattcgagtacctaacgggtgtgattttcaaacattaaaaaccagaatacacaatacccttaagctaaccaacaaacaatttttggatgaaatttactaccgacaacctttcacgtatgcagttggtccgattgagttattatgtagcattgctagaaccccagatggtattttaaacttacttgaagctactatgacccctactcatgatgccctgctatattacaatgggag

SEQ ID NO: 42604 - DNA, 507 bp, Glycine max
  Peptide Sequence Number=SeqID_159382
atgacaacaacagttgcttctatgagtgtttgtcaagccttatggctagataaattgcagcaggaaatgaaagtgaaggaaccaggagctgttggcatcatcagaatgtttgagcagtaccaggaacggttaagtgcagttgtaggggctaaacgggcgaagaaggttgtgaatgaagctctggtgctaatgactttgggtggtaacgactttgttaacaactatttcttggctggctcctattactccgagaggttgtatgagttgggggctcgacgggtgctggtgacaggaactggtccattagggtgtgttccttcccagcttgctatgaggagcacaaatggggatctgtgctcaaaccgggatgcttatgcattttgggatgctttccatccaagccaacgtgcgcttgatttcattgtggatgggatcttcaagggaaccagcaaccttatgagccctatgaacctcagcaccataatggccatggactccaacatctaa

SEQ ID NO: 42605 - DNA, 1077 bp, Glycine max
  Peptide Sequence Number=SeqID_159383
atggcggaggctcctccgtctctaatatctctgtgcatcgacgctctcgcacaacaatttctccgtccaagcgatgatcttccttctatctacgaccttccttctcacttactccacaccttaatcacgcgtttgccccctttcgcactccgcacattccaccgccaccacctaccattcgacgaggaagggttttctcgcgacgactccacgaagaagagaaaacgcgcaagggattggaatttaagttcagcttggcagaggttgtttctgctacgctggcctgatcgcgttaagcagattcagccaacggattgggagcaacactattgggaaattcatttgcaagaggaaaacaatttaggaaaagatgatgtagaaagtcttagatatgctcttcaacatgtgcctaacttggaggagctggacatcagtggcaattcaattgaagatgaaggaatcaggaatttaattccctattttgttggagcatctgaaacgtgtcctcacataacttgtttgaaattagagaactgtgatctgtcctgtgttggagtgaataatctcctacatatcctttctaatttcaaaggaccattaaagtctctttctattgctgacaattaccttggcagtcaagtagctgaagcattgggaaaattttttagcaccccaatcgaagtacttgacattgcaggcattggattgggttcttacggttttcaagagcttcaaagtctaataaaagagaaggttaagctggtgaaaattaatataagcaaaaatcgtggtgggattgcaactgccaaatttttgtctaaactcttgtcccaggctccacaactagttgatgtgaatgcagccagtaatcttatgccaatagaatcactggccatcatctgctccgcgttaaagtttgcaaaaggtaatgttcagcaagtggacttgacaggacatatatgggactataagccagagcatgtttccccttacactgaatttgtacataatggattacctatattgattcttccatcatcatcagcctctgctgcacctcacgaccatgatccttag

SEQ ID NO: 42606 - DNA, 1224 bp, Glycine max
  Peptide Sequence Number=SeqID_159384
atgatgcaggttgcaagttggggagcctatcttctgtcacgtgacatcataacagtgtcaattgcaccaagggacacccacgaagcacaagttcagtttgctcttgaaagaggagttcctgcattaattggggtcctagcttcaaagaggttgcctttcccttctagagcctttgacatggcacactgctctcgatgtctcattccttgggctgaatatgatggactttatctaaatgaaattgatcgaattctacgccctggtggatattggattttatctgggccaccaatccggtggaagaaacattggaaaggatgggaaagaacaaaggaggatttgaatgaagagcaaaccaaaattgagaatgtagccaaaagcctgtgctggaacaagctagtggagaaggatgatatagccatttggcagaaagccaagaaccatttggattgcaaagccaaccgtaagctctctcacaatcggcctctctgcaaggcacagagtaaccctgacaaggcctggtacacagaaatgcaaacatgtttgagtcctctgcctgaagtgtcaagcaaagacgaaactgcaggtggggcattgaaaaattggcctgaaagactaaaagccaccccaccaaggatttctaaggggaccataaagggggttacttccgaaactttctcaaaagataatgagctgtggaagaaaaggatagcatattataagaaggttaataatcaactaggaaaagcagggaggtatcgcaaccttttagagatgaatgcttacttgggtggatttgctgctgtactcgtagatttacctgtttgggtcatgaatgtggttcctgtccaggctaaggttgacacacttggtgcaatatatgaaagagggttgattggaacataccataattggtgtgaagcaatgtctacttaccctagaacttatgacttaattcatgctgattcagtgttcagcctctacagtgacagatgtgaattggaagacattttgttggagatggataggattcttaggcctgaaggaagtgtgataatcagagatgatgttgatatattggtaaaggtaaaaagtatagtcaatggcatggattgggactgtcaaattgtggaccatgaagatgggcctcttgaaagggagaaacttttatttgctgtgaagaattattggacagccccagccgcttccgacaagaatagttaa

SEQ ID NO: 42607 - DNA, 627 bp, Glycine max
  Peptide Sequence Number=SeqID_159385
atggagagaagtggaactttgaaattcattatcacaccgctctctggaggaaccaagaaagctaatgaagatgctaagaagaaatatgaaaaggacaacaaaactcttacggggaattggctacgttttcagatgttggatgataagtcaatcatggagcaggaacgaagatgtgagatattacaagctaatgtgcttctggagaaattcccaccatcatggagtgactaccgcaaccaattgaaacccaataagagagatttgtcacttcaagagttggtcaatcatatgatgattgaagaggccaaaagacttaaagataaacatgttttattttttgtaaattttgttaatgctaatgttgttgagattgttgatcaaaacaggttcaaagggaaaggaaaagagaaaaaaaaatcagaaaaatcataccggtatcaacaaaggcaagcttggttgataacaaggtggactagattctggatattggtgtttctaaacacctatgtgccaacaaagagctttttcaccactttgaggatgttgttgatggagagtgtgtcttcatgggaaattctactacagctggagtgcttggtaaaggaaagattcttctcaaacttctag

SEQ ID NO: 42608 - DNA, 324 bp, Glycine max
  Peptide Sequence Number=SeqID_159386
atgactttgatgtatcgagcggaaaccgtgcggcgacgatttcggaattgttcgctattttgctcttgcatgacctgtctcgtggttctggagaatgaggatcggaataatatcgcgagatctttagtcttaggatctcttgctggtgtgatttcatcgtcgcgtgtgtttggtttttcatttaagatccatatttactgcaaaatcacgtcgaagagcatgcaaaagcagctattagttgttagggatccacgtcctgtagtgtcaatcgtgtttccaaacacactactagtagactctagaggagcattaagaaacatgtga

SEQ ID NO: 42609 - DNA, 280 bp, Glycine max
  Peptide Sequence Number=SeqID_159387
atggaatcaaaattcattgctcttgatttagcaagtcaagaggcaagatggttgaggaacttgttcataaatgtgtcattgtggggaaaacggtctataccggtttctcttcattgtgattctcaggcagctataggacttgccatgaacaatgtgtataatggaaagaggagacacatatgcattagacacagttcaatcaaagaattgttgaaaaatggtgtgatctctttagagtttgtaagatctgagaggaacttgacggatcctcttaataaag

SEQ ID NO: 42610 - DNA, 288 bp, Glycine max
  Peptide Sequence Number=SeqID_159388
atggctgcatcaccaaagtctctcttgtctctaattcttcttctcttggtggttgtggcacatgggacacaaatagcaatggcacagagcagcacctgcacaacccagctgagtgagctcaatgtttgtgcaccatttgtagtgcctggtgtcaacacaaaccctagttctagatgctgcaatgcacttcaagctgtagaccgtgactgcctctgcagcaccattaggatcgcttctcaactcccttctcagtgccaaattccatccctcggttgcagtgcaaattag

SEQ ID NO: 42611 - DNA, 3396 bp, Glycine max
  Peptide Sequence Number=SeqID_159389
atggttttatgtgctgtggattatccatgtttttgtgggctcctgaagcaacttgttggacctttaaccacacaattgtcagaccgaagatctaccattgtgaagcaggcttgccatctattgtgctttttgtcaaaggaactcttgggtgattttgaggcatgtgctgaaatgttgataccagtccttttcaagctggttgtgattactgtgcttgtaattgcagagtctgcagataactgcattaaaacgatgctgcgcaactgcaaagttgctcgtgtgcttccccgtatagccgattgtgcaaaaaatgatcgcaatgcagtacttcgtgcaaggtgttgtgaatatgcttatttggtcctagaacattggcctgatgcaccagaaatacatcgatcagctgatttatatgaggatctgataaagtgttgtgtttcagacgcaatgagtgaggtacggtctactgcaaggatgtgctacagaatgtttgccaaaacttggcctgagcgttctcgtcgcctattttcatcctttgaccctgctattcaacggttaataaatgaagaggatgggggaatgcatcggcgacatgcttcaccttccattcgagatagaggtgcactgatgtcattatctagccaggcctctgctccctctaatctacctggttatggaacttctgctattgttgcgatggatagaagttcaagtatatcatcagggacatctatctcatctggcatacttctttcacaagctaagtcacttggtaagggtacagaacgtagtttggaaagcatgttacatgcaagcaaacagaaggtttctgctattgaaagcatgcttagaggcttggatttgtctgataagcataattcatcttctctccggtcaacaagtttggatctaggagttgaccctccatcatctcgtgatccacctttccctgctgctgtccccgcatctaatcatctgacaagctctttaacagaatcaactacttctggcatcaataaaggtagtaaccgaaatggtggtcttggtttgtctgacataatcactcagattcaagcttcgaaagattcggccaagttatcctatcgtagcaatgttggtatcgagcctttatcatcattatcatcatattcgagtaaaagggcatctgacagacaagaaagaagttctcttgatgataacaatgatatgagggagactaggcgatatatgaaccccaacactgataggcagtatttggatgccccttatagagatggaaactttagggaatctcataatagttatgtgcctaatttccagagaccactattgagaaagaatgtggctggacgcatgtctgctagcaggaggaggagttttgatgataatcagctatctcttggagagatgtcaaattttgcagatggaccagcatctcttcatgaagctttgagtgaaggacttagttcaggttccaattggtctgctagggttgctgcctttaattatcttcattctttgttgcagcaaggtccaaagggaactctagaagttgttcagaattttgagaaggtaatgaagttgtttttccagcacttggatgatccccatcataaagttgcacaggctgctctttcaacacttgcagatattgttccagtatgccgaaagccatttgagggttacatggaaagaatattaccccatgtgttttctcggttaattgaccctaaagaacttgtcaggcagccatgttcaacaactctggaagttgtcagcaaaacttacagtatagattctctcttacctgcattattacgctcactagatgaacaaaggtctccaaaggctaaattggctgttattgaatttgctatcaattcctttaacaaacatgctatgaatccagaaggtgctgcgaatattggcatcctaaaattatggcttgctaagttaacccctttggtcaatgacaaaaatacaaagcttaaagaagcagctattacctgcattatatcagtgtactctcactttgattcgactgctgttcttaatttcattctgagtttgtcagttgaagaacaaaattccttgagacgagcattgaaacaatacacccctcgcattgaagtagacctaataaactatctgcaaaacaagaaagagaaacaacgttctaagtcttcctatgatccatctgatgttgtgggaacatcctctgaagatggatatgttggttactctaggaaagctcattaccttggtaagtattctgctggttcccttgatggtgatggtggcaggaaatggagttcccaagattcaacactgataaaagccagtcttggtcaagcatcttctggtgaaactcgggaacatctgtatcataattttgagactgatcctaacagtggtagtcttggttcaaaaactaaggatcttgcttatgcagtcaatccgatgggtcaaaacattggctctcaaactagccaacatggacatgtggacagtagcgtgagcttagagggtctttccattcctcgtctagatgtaaacggtttgatgccatcagagcatttaaatggtactgaaggctatgtaaatgacaaagagcatccttctgaattggaacgtaatcatcactcagctgaagatgtaaagattaactctatgacagacacaggacccagcattcctcaaattcttcatatgatatgcagtgggggtgatggaagccctatttcaagtaaacggactgctcttcaacaattggttgaagcttctataacaaatgatcattctgtttggaccaagtacttcaatcagattttgacagtagtgcttgaggtgctggatgattcagattcctcagtcaaagagcttgctctttcactgatagttgaaatgcttaaaaaccagaaaggtgccgtggagaattctgttgagattgtaattgagaagctgcttcatgttacaaaagatatcattcctaaggtctcgaatgaagcagagcactgcctgaccattgttttatctcagtatgatccattcagatgtttaagtgtcattgtccctctactggttactgaggatgagaaaacgctcgttatttgcataaattgcttaacaaagcttgtggggcggctttctcaggaggaactgatgactcagttaccctcgtttctgcctgctcttttcgaagcttttggtaaccagagtacagatgttcggaagaccgttgttttctgtctcgtggatatttatatcatgcttgggaaagcattcttgccatatttgcaagggcttaacagcacacagttgaagttggtcaccatttatgcaaatcgaatctcacaagccaggacaggcaaagcaattgatgccgttcaagactag

SEQ ID NO: 42612 - DNA, 231 bp, Glycine max
  Peptide Sequence Number=SeqID_159390
atgacgatacaagctgacgtggatggtctcgccattggcactaccgatacacgctggcgtggagtgtctcgccagaagcattggcgatataggttgcaggctagggcaaggggttgcgcagaggttagaggtcacatgcatgcatgtttctcgccatttccactggtgagactggtgcagtctagattcgccatttctagtggcaagactggtgcagattcctttaaatag

SEQ ID NO: 42613 - DNA, 1472 bp, Glycine max
  Peptide Sequence Number=SeqID_159391
atgaaaaaaacagtatgtgccgccctttttctttgtggagtttttgtgttttcgcaggaaaacatcaaaagcgatactattgatcaaacaaagacggcagaaatccaggaggtgattataaagtcccaacgtaaaaaacagtttgcagacaaagcagtatatacttttgataaagcagcgttagaaaaggcccgttacgcaaaggacctattaaggacattaccggaattacagttggatcctgtttcgaatactttgaaaagtacgaaaggaggaacttctttatttcttattaatggaattgaagcaacggatatgcagatccggagtatagcacccagtgaagtagtaaaagttgaatactatgatattccacccgcaaggtgggcaacaagagcggatacggttattaatgtgattacacggtctacagagacaggatatgtttttggaaccgatgtaatgaccgcattgaatacaggattcgtaaatggatcagcatatgccaattttacaaaaggcaaaaataatttaggtttggaatattccatgaatttaagagattatgacaaccggagagtacgcagtatctatgactatcagcttgataattcacattatctttccgatgaaaataagaaagatcattttggatatacctctcaaaatattgctttaaggtatacccgtatggtgcctgataattattcatttcaggcaaaactgaatatggatatccttcatactttcgtgaatggtaagggagaaagtactttcacaaaagatgatgttacggaagggcataccatgatgaaaaggggagggacggattacgtagcaccgacacttgatctttacttttcaaaaaaactgagtaaaaaagatgaattaagtttgaatgtcgtgggttcccattttaccacagatacttcagaatttacaaaagaatggatcacctcttcagggaattcagtttttgataatgatatgaatcttacagctaaacagacgggttttgttggagagattgcccatactcatgattttgaaggtggaaaactttcttcagggtatcgtatctcgaacacctctatttccaatgatctccaaaaccttgcaggattttcacagtacaaagtgaattatttagagcaatatttctacacagaattttccggtaaaattgaaaagtttacgtaccgtgttggtgcgggtcttaccaacattcataataaaagtgctgaaactacttttgatgaatggtctattactccaaaagttattttaggatatcagctgaaaggaaatcagagtcttcgttttacaagcagctataaaccaaagagtccatggagtgctgcattgagtagtaatgtggttcagatggcaccgaacattgtgcaaaaaggaaatccatttcttaagtcacagctgacatggggaaataacctgatctattcactgaacaataa

SEQ ID NO: 42614 - DNA, 182 bp, Glycine max
  Peptide Sequence Number=SeqID_159392
cagtggtggcagctcaaggagcaatgatggttgtgcgagtgagcgacaatggtagtttaaggagttgtcttggttgtgagggagcaacgttggtggctcgaggggcaactgtgactgcacgagggagcggtaccagtggctcaaagggcagtcgtggttgcgttagggagcggcaacactga

SEQ ID NO: 42615 - DNA, 327 bp, Glycine max
  Peptide Sequence Number=SeqID_159393
atggaacctcgtcagttaacagcacttattgttgaggatgacatggtgattcgaatggttcatcaaaagattctgaacagtgttggattgaaaattcaagtcgcggaaaacggaaaagaagctatagaaattcatggctccggacaaagttttgacctaattctcatggatagggatatgcccgtgatgaatggcattgaggccacaaagacacttcgatcaatggggattaatagcatgattactggtgtatcaacacgctcagtggcagcgcatatacgagaatttatggaagcaggactagatgactacgtagagaagccttga

SEQ ID NO: 42616 - DNA, 423 bp, Glycine max
  Peptide Sequence Number=SeqID_159394
atggaaggccatagcgagatgggtcaaatcggagaaagttttgatactagtaatttgctggggaggctgagggacgatgagtatgaaagccggtctggaagtgacaattttgatggcggatctggtgatgaccaggatgctggggatgatcagccacataaaaagaagaagaaataccacagacacacccctcaacaaattcaggagcttgaagcgtatggctctatgaaattctcaaatcttttttacaaaatgtttttcaaggagtgtcctcatcctgatgagaagcaaagaactgatcttagcaagaggcttggcttggagaacaagcaagtcaagttctggtttcagaatcgacgaacccaaatgaaggcggttaaaaacattatcgtaatgtctttcgaccaaagcgttattacctaa

SEQ ID NO: 42617 - DNA, 198 bp, Glycine max
  Peptide Sequence Number=SeqID_159395
atgttatctctttcaactggttccatatgtaaaggcttagtaaataacgcaactgcaggcttaaggcttttgaaagggaatgcttctgaacaaatattgcaagcggttagggatatgctgagtaacagaagtaccctgaacctacaatctgatgcagtaactattcttgatggaaaccaagaagctgcttatatgtgg

SEQ ID NO: 42618 - DNA, 1875 bp, Glycine max
  Peptide Sequence Number=SeqID_159396
atgattcttaggcaggaaaacgacaagctccgagctgagaacagtgtaatgaaggatgctttggcaaatccgacatgtaacaactgtggtggcccagccattcctggtcaaatttccttggaggagcaccaaactagaatggaaaatgctcgactgaaggatgaactgaaccgaatatgtgcattggcaaacaagttcctgggccggccactctcgccactggccagtcctatggctctgccaccctcaaattctggtctagagcttgctattggaagaaatggaattggtggtccaagcaattttggcatgtccttgccaatgggatttgatgtgggagatggagttatgggctcctcacctgggatgtctagtatgggtgctagatcaccaatgggaatgatgggaaatgaaatccagcttgagagatctatgcttttagaccttgcattaaatgctatgaatgaattaattaagatggctcagccagatacctctctttggattaagagctctgatggcaggaatgaagtactcaaccatgatgagtatgcaagactgttttctccttatgttggatcaaaacctgctggttatgtgactgaagctacaagagggaccggagtagtaccagccagcagtttgggcattgttgaaacattgatggatgtggatcgatgggcggagatgttttcatctatgattgctagtgctgccactttggaagtactgtctagtggcatgggtgaaagcagaagtggagctttgcaagtgatgcttgctgaggttcaattgctttctccactagtccctgctcgttcattgagtttcctcaggtatagcaagcagcacggcgaaggtgtatgggctgtggttgatgtttcagttgacattggtcgtaatgttaccaattcacatccattaatgagctgcaggaggcttccctctggctgtgttattcaggatatgcccaatggtttctccaagattacttgggttgaacattcccaatatgacgagagtgttgtccaccaactttatcgcccattggttagttctggcattggctttggtgctcagagatggattgccaccctcttaaggcagtgtgactgcttggcaatcctcatgtctcaaatcccatctgaggaccccacagtcattagcctagagggtaagaaaaacatgctgaagctcgcacaacgcatgaccgagtacttctgctcagggatctgtgcttcgtctgtgcgcaagtgggaaatactgaacattggtaatctggctgatgacatgagaatcatggcccggaaaatcaatatggatgacccaactgaggctcctggcattgtgctgagtgcttcaacttctgtttggatgccggtgtcacggcaaagggtgtttgattttctgcgtgatgaaaatttgagaggcgagtgggacatgctgtccaaagatggaccaatgaaggagatgctccatattgctaaaggacaagatcgtggaaattgtgtttccatccttcattctgctaatagcgagtgcaatgtgctatatctgcaagaatcatggactgatgcttccggctcattggtagtgtattccccgatcaacatgcaagccttgaacatggtgatgaactgtggagattcatcatttgtcgctctccgcccatcaggctttgctattctgccagatggcgcttcaaacaacggtgatggcagtgatggtggtggcagctgcctgcttacagttgggttacaaatgttgccaaatggagaccaatcaaccaagttcacaatggagtcagttgttactgtcaatagcctcatctcaaacaccattcagaaggtcaaagatgcacttggagttgcgtga

SEQ ID NO: 42619 - DNA, 456 bp, Glycine max
  Peptide Sequence Number=SeqID_159397
atggcacgcagagacaaattatggtcattctgcgcctttccatccaggctcgatcgtgtccgatggcacgcaaagacaaattatggtcattcggcgcccttttgtcatccagaggcggcgggctcgatggcatatggagacaaattatggtcattatgcacaccttttcgccatccagaggcgatcgtgtccgatggcgcgcagagacaaattatgttcattctgcgcctttccatccaggctcgatcgtgtccgatggcgcgcagagacaaactatggtcattctgcgccctttgtcattcaagggcagcaagtcaagtgataaacgcgcagagacaatttatggtcattttgcaccctttgtcattcaagggcagcacatcaagtagtaaacgcgcagagacaaattatggtcattctgcgccctttgtcattcaagggcagcaagtcgagtga

SEQ ID NO: 42620 - DNA, 324 bp, Glycine max
  Peptide Sequence Number=SeqID_159398
atggtagtggcgaaatatgcatgcaacatggccccctgtttcaccagcactggttgcaaaaccagcatagcctgctctgaacgctgctctcctactctgaacacctacgcaccctctgcacctatatcgccattcaaagtggcgaaaaccactatgccaactatttcgctagtggcattggcggaacaaccacgtgtccagtcccaggcgtatatcgccagcatgcatggcgatatacgtgcatgcatggctgggggctacgtaaaaatagacccccttagtcatttgtttgaaaacagacctactttgagaattagtttgtaa

SEQ ID NO: 42621 - DNA, 120 bp, Glycine max
  Peptide Sequence Number=SeqID_159399
atgatccttgacttgttaattcttgatggccactggtggtggaagagaaatattgatattgaaggttgttattggtccatatccattaatgaggatagcagagtaatggttgaatattaa

SEQ ID NO: 42622 - DNA, 366 bp, Glycine max
  Peptide Sequence Number=SeqID_159400
atggaggcccaaaagaggatggagaagagggctattgccaccattcacgagttgttgtcgttgactgtggagaagaagattacgctagagaggattgcacatttccggatggcgaagaacctgcccaagaagttgaaggatttcttgcagcagcaccaggggattttctatgtctcaactagggggaatcaggggaagctgtacacggttttccttagggaggcgtataggaagggcgagctgattgagctgaatgagttgtatttggcacggagtatcacgattaagcagttgcagttagttacaagaagttatttgagtagtttgttggttatggcagttagttggttactagaagttatttga

SEQ ID NO: 42623 - DNA, 1533 bp, Glycine max
  Peptide Sequence Number=SeqID_159401
atgacagagggagttttgctaactattgatgagggaggaaaacccgtggttgagggagatttggggaatgatgtcattgatggaaaaaacagtgatggagaggttgacatggctgacttggatgatagggataaggaaactgatgaagataaaggagatgatgataattatgaggaaaaagatagtgatgatggggatgacttggatgttgaatatgatactgataaattagaatttgatatagcaagtgaagaagatgatgattgttataaccagtttccaagagatttcaacctcatgaaatgggaagatattttaattgaggttggtatggagtttgattcaattagtcagttcaaggtagccatcaaagaatatgcaaacctgcatggttttggggtgaaattcaagaaaaatgacaatgttagatgtagggtgatttgtcaggatggttgtgaatgggtggcatatgtgagtaaggtctctaaagaggcatatgactggttgatgcagctagatccgagattttggtcaaaggctcacatgtcagagtacttcaggtgcaatatggtcatgaacaacatattagaggcttttaatggtaggattttggaagctagggagcaacccatcgtagctatgctagaatgcataaaagtgtatatgatgactagatttgcgaaaaacagaaaattaggagagaaacaaaaggcaaagggtcaaaaagtgtgtccgaggcccatgaatatattagatcaagaggtgttggcatattcaaagtggactgtggtttggggtggtggtccgaaatttgaggttcaaaaatatccacttgcattcaaggtcaatctagatgagaaaagttgctcttgcaggttttggcagttgactggaatatcatgcaggcatgcagtggcaacaatgtttgaccgtagattgctaccatctgaccttgttcatccatattgtcatgtgaatacttatacaaattgttatgcgctcattatggaaccaattaatggagaagatatgtggcagcaaattggacttccaactgccttaccccctcaagttagagtcctaattggcagaccaaagaaggttaggagaagagaaaatgatgaagcaccaaaacctcataagctaaagaggacaaacacatctttgaggtgtgacatgtgtggcacttttaggcagaacaaaagggagtgtcaaaacatgacaatccctaaattagatcctcctccaaagaaacctaaagttatgacatcaacaaagaagaaaaacacagccacttcaacaagtaagcaaacacaaccctccaacactcaacaatctcatactcagccacctaaaacaagcaacatgcacactcaacaatctcaaacccaagcaccaacaactgctaaaggcggctttaggcccaaactgctgatcaagagtaaaggcctccaatggaagggaaagcaagccatcacccaacaacagttgcaagatgttgtgaagaatgcatctgggaagaaaactaattga

SEQ ID NO: 42624 - DNA, 273 bp, Glycine max
  Peptide Sequence Number=SeqID_159402
atgagtggtgatggagcaaattctcaacaacccatcagtggtgagggaaatcaatctcagctgccggacttgaatgatcttccaagtgttgaaatggactttgatatgagtgttgacaaggaagaagatggtatggctgacgacactgaagatgcaagcttacacggggtaatgagtgatggccaagaggaggaagcaaatgcagaaacggaatttcctataaatacagatgctacattaaacaagcaacgaagattcttatcaaatgaatag

SEQ ID NO: 42625 - DNA, 615 bp, Glycine max
  Peptide Sequence Number=SeqID_159403
atgtgtaggataacaacaatagtcagagagattcagaagattacaccaacaggcaatgtattgaagattacagttaagttaataactgcagaaacaagtcagcacaggggaaggcagaaagagtacaatatatttgcaatacgccaaataatggcagcagcatgcagctggctaggtagctgtagaagcatatgtaagggaatggggacacagtgtatatatgtaaggggcacagacacagtttccttccttcgttcacatttttcttttggtaagtggaagtggaacctaatgcaagaaaagggggagatatggaccagagttttggagtcgaaatatggagggtggaggagttttcatgaactagggaggacaggacaacaatctgtgtggtggaggaatttaaaacaaacattcaatatttcacatcagggagacattattcaaagcaatatgagatggaaggttgtaggtggggacaagattaggttttgggaagacaagtggagccagcaacagcaaacattagcagagagataccctagactgtatctaatatcatcacagcagaaacaaagcatcagacagctgggacatcatatagattcagggtag

SEQ ID NO: 42626 - DNA, 309 bp, Glycine max
  Peptide Sequence Number=SeqID_159404
atgaaaactatacataaatattacaaagttccaaatctggtggtggtgttggtgttttcgacgtggtggctgaaggatcgggtgcgtacgattcccttggcggcagcgttgttgtcgtcaagcaatctcggcaaaggcggtggcagtgacgagggcagggagcgccctcttggtgtggtggacctgaccgtcaccgacgggggtttgtatgagggttgtgacaacaatctcggtgaggcattgaagatccttgacggcgtcacgaccaagggtgtcgacattacagacctcgacgacgcggttgagtga

SEQ ID NO: 42627 - DNA, 531 bp, Glycine max
  Peptide Sequence Number=SeqID_159405
atgtacacttcaaggcattctcacatgaagaataagggcatggctaagaaagcatcaaaagtgttaagacatagtccatcccttgtacacataacactctcaaagttcaatagatcaaaggccataagagaaagttgttcattgggtcaacaatcatgtggtctagatgagaccgatttattagaaactaatgttcctacaaattttgagttggctgccattgtggtcaaagaccatcttccctctcatgacttggacaaagtaggaggctgggtacttcagagaagatctagcaatgaggagattctgtctcatgtagatacacaagtagagtgcaagtcagttgatttagttactcagggttcaagcaacttcagccccaccttgagaatggtgaatgttcatgatggtttatattttattgatcattttcaaccatccttgtctgcactaccgtctttctccatcgccgtggtgattattcacacgcagagtcctactcttgagcctaataatgcacaggagttgtga

SEQ ID NO: 42628 - DNA, 264 bp, Glycine max
  Peptide Sequence Number=SeqID_159406
atgaagcaactgctggatgaacatgattgctttgtggttccatttctttcagcagtccatttagatgagaatgtatacagtggagaaattggagaactagtccattctatgcaccctttggaggaggggctagattctgtccaggagcagagttggctcgcatataaattgctttttttttcttcattacttcgtaactacctacaggtagtgaaaagaaaaagaaaagctgccactttcactgttgaaagcaacaaatgctag

SEQ ID NO: 42629 - DNA, 583 bp, Glycine max
  Peptide Sequence Number=SeqID_159407
atggcaagtgcagatgagatgtatcttcgttgctgcctcgaatctgtacacaatagtgcattgaaagcttcccaacacaacaaacctgtgagcttgaatacagttaaatttgttggtgaagcagaatgtgattctggtcagttagtcttgggacattctgtagctgtaagtaataatgcttctgataattggactctaggcacagtaatggggactaagagtatgataaatatattgaatagtcctttgcttcagcactttggtgcttcagaaggaaatgataatttgaacagcatgaacttcactgatgctaaaaacatgacatgctatgattttaaggactctcctagttcatcatataaactagaaatggaaacaccaatggtgcaaagtcatgagtatggttccatttctgttcataaaagaactacttccaagactaactctacttatgatcagaaggaggtctatgtagccaaattgagcaaggtagacacaacacatgatgaggatttggactatgtgtacctatttcacttgaacaagggctgcgagattcctgaccgtgatttgcaacttgttg

SEQ ID NO: 42630 - DNA, 866 bp, Glycine max
  Peptide Sequence Number=SeqID_159408
cctttcgagggctacgtaccctcgccatcagagggctacacgccctcaccctcagaggactacacgtcctcgcctttagagggttacacgccctcacttgcagaggactacacgtccttgcctttagaggactacatgtccttgacttgagaggactacacgtcctcaccttcagagggctacacgccctcgccttcagagggctacatgccctcaccttcagaggactacacatcctcacctttagagggctacacgccctcgccttcagaggacttcacatcctcaccttcagagggctacgtaccctcacattcaaaggcctacacgccctcgccatcagaggactacacgtcctcgccttcagaggactacacgtcctcgccatcagagggctgcacgccctcgccttcagaggactagacgtccttgccttcagaggacttcacgtcctcaccttcagagggctacacgccctcgcttttagaggactacacgtcctctccttcaaagggctacacgccctcaccttggagggctacacgtcctcgccttcagaggactacacgtcctcactttcagagggtggcacactcgccttcaaagggctacacgccctcaccttcagaggactacacgtcctcgccttcaaagggctgcatgccctcaccttcagaggaatatgtgtcctcaccttcagagggctgcatgccctcgccttcagaggactacacgtcctcgccatcagagagatgcacgccctcgcctttaaagggcgacatgtcctcgacttcagagggctgcatgcctacgcctttagagggctacgcgtcccaattttagtaggctctacatccgcaccttaa

SEQ ID NO: 42631 - DNA, 1260 bp, Glycine max
  Peptide Sequence Number=SeqID_159409
atgttgctcacaatgcttatatgtcaccactcactgcaggatgagatttcaagcccgattagtgctcgaattttcgaactttgcgagcctgatttcttcccagacacactgcaaaattcagatgttacttccagctcaaattgttgccatgaagagaagtcctcatatgccacaaccatatctccacctttagatttagtagacaacaagatcaatatcaataacaatagcaacatagtcactactacctcatctagcactaccacaaccagcaccacaaccaacaacaacaacaacaacacaacgaacagcaataacctgtccatcctctttgacactcaagatgaaattgacaatgacatctcagcctccatagacttctcatcatgtcgatctttagttgttccaccacttctctcaatctcaactcagcaggatcagtttgatttctcttcagctcagccacaggtgcaactatcagcagcagcaggttcagttttgaagggcctctctcactaccctacagatcatgtgattgcaccccttattggatctccgttaccatctgtttttgatgaagattgcatatcttccatcccttcttatgtgcctctcaacccatcatcaccctcttgctcttatctcagtcctggcataggagtgtacatgcctcctcctggttcccttaacactgccttatctgctgacagttctggattgtttggtgggaacattctactggggtctgaactgcaggcacatgaattggactatcagggagaaaatggtggaatattttgcacagattcaattcagagggtgtttaaccccccagatcttcaggcacttggtactgagactcagaaacttgtagctggggctggaagttctgccactttgacaccagaaatctcacacttggaggactctaacttgaaagttggaaaactctctgttgagcagaggaaggaaaagattcatagatacatgaagaagagaaatgaaagaaatttcagcaagaaaatcaagtatgcttgccgcaaaactttagcagatagccggccccgggttagaggaaggtttgcaaagaatgatgagtttggagagagccatagacaaggaagtagcaatcatgaagaagatgatgaagaaataattgtgaaagaagatgatgatatggttgattcctcagatatctttgcacatatcagtggagtgaactctttcaaatgcaactattccatccagtccttgatttga

SEQ ID NO: 42632 - DNA, 1834 bp, Glycine max
  Peptide Sequence Number=SeqID_159410
atgagtgaagaacaagatggatctctcagtgttcatagtcctcactacctgcaccctagtgaaaatccagcaatctcattagtttcgcctcttttggatccaaaaaattacaattcttggagcagatcagctctcacggtcttgagtgggaagaataaagtagaatttgttgatgatttccttcctcaaccaatctcgaatcgtagattgtacgcagcttggaaaagagcgaataacatggtggtttcatggcttgtacactcaattgcaacttccattcgtcaaagcatcttatggatggacaatgcggttgatacatcggccataggtaatatactatcctttgtttgtaatattcacaagtctgaagctgtaacatggatcttggactctggtgctacagatcatgttgcatcctcattgacttgttattctacatacagagaaataaatcccatagtagttcgccagcctactggtcaacaagtcatagccacacactctagaacagtcaaatttactgagtttctacacttagaagacgatataagcagtcaaaggatgattggtacagttgatgtagtggaaggtttgtacaagcttagaatacctgctgccaattcagttcccaaggctaacaacaatttcatttctattaagtctgtgttgtcttgtaataaagaagtcattgatatttggcatttccatttgggtcatccttcatatgataggatgcaattgcaatttaatacaaaagtgaaagctattcgatcagataatggtgctaagtttatcatgaaacagttttatcatagtactgtctttggttgcttgtgctacaccagcactctcactaataacaggaagaagcttgatcctagagcttctgcttttgttttcttgggcttcaagcctcacactaaagggtatattacctttgatctttcctctagagccataatggtatctagacatgtcattttccatgaagattgtttcccttatgtctctcctagtgcctctcaatcttttcccgcattccctgtacattcctatcctaccatttatgactatgacatttcttatgatgcatcaaattcaccaattattattgctcctagaagatctaacagggaaagaaccagaccaaagaagtttcaagactttcacactacattcacatcaattgctactggtcaatcctcagactacaaagatctttgtatggccttaaacaagccagtagacagtggtatgatcgattgtccactttcctcatctcacatggctatagacagcaatgatcttctagagattaagtccatcattcagcttctggatgaagtctttaaaatcaaagaccttggtgacttgaaattttttcttggatttgaagtggctcgtagtaaacaagggatcaatatttgtcaaagaaaatatgttcttgatatattgcatgatgtaggcatgttaggaagcaaacctgcctctactctaattgattgtgtagtaagactacaccaacaatttggtactccacttgatgatacaacaacttcatcatatcgtaggctcattggtcgccttatttacctcaccaatacaaggcccgatatcacatatgcagtgcaacacttaagtcaatttgtagctcatccttcttcagctcatcaacaagcagcctataggattcttagatacttgaaagcagcaccaggttctggtgtatttttctctacttccaacatattgcaactcaaagcatttagtgactctgactgggcaggatgcattaataccaagcgatctatcactggctacttagtttatcttg

SEQ ID NO: 42633 - DNA, 204 bp, Glycine max
  Peptide Sequence Number=SeqID_159411
atggggagttgctcagccggtgttgaggggtggataacatcctgcaacatggtggtggtgaatcctcttttgcacagaattaaggaggcaataatgaagagaaagttggttatgtgcatatatagaggaattgatgaggttgtacgtaggccgtcaagcctggcactcgcgggcgtcaacgcgagagtggcgtttggccattaa

SEQ ID NO: 42634 - DNA, 312 bp, Glycine max
  Peptide Sequence Number=SeqID_159412
atgacctacttcactccccgctaccgaagactgctgagactaatgggtcgaagcaagggcggtgaggcatggccagagaggtggcgaagttctgccccttccaccaccggatcaagggactacttgcccgaggagtctagcttaacccagcccaactactcctcagtgccttcgaaagctctatctaagcagctttttcaatatagccagtgtgccgtgcatgtgtatcagccacagaagagacttccggagaaaggtctttgctctaaccccggggaagacctttctcccagtgaagctgttgagcaatag

SEQ ID NO: 42635 - DNA, 1371 bp, Glycine max
  Peptide Sequence Number=SeqID_159413
atggcttccataaacaattctcaacctcctcctccccctccaccaccagattccttagctccagtgacaaaatcttctattccgatgcttgttcggacggtgtcagtgattccgcagtcgacttcttcaattcagatgccaattctgacggtgtttccttcttctactccaatattgtttccttcttctactctgacggtgatgtcagttccaccagttccactgttcacagctccgttcacagtggaattcatgtcgacggccgttccttcgttgtcttcgatggcagatccaccgatctctttgatgatgactccagtggttgcgacaccacttctgtcgttccctgcttcaactgcgattccggaagctgtgtcatcttcagctttgcagccttcctccttcgttgtcttcgatggcagatccaccgatctctttgatgatgactccagtggttgcgacaccacttcagtcgttccctgcttcaactgcgattccggaagctgtgtcatcttctgctttgaagccttcctccttctcgcatgcaatctttgcgaaacttgtgaacttgaactacttgctgtggtgaatcctgtaattcctccgcaattcagaacccttgcggatcaagatcttggaattttctttccagagtaccttgcttgggagtcacaggatcagctcttttcctgtcttcaatcaacgatttctccagagaccattgttgatgctctcggttcaattggagtcaccattttatttgatgagcaacttgatgttattattgaggggttaccaagggattatgactctgttatgtcactgatttgcagtaagtttgaacctctttccattgatgaggttgaaactttacggttagtccatgaagctatgcttgatcggtttcagaaacgtgattctcaaatcattgttaatttgactcaaggagcatctactagctctactgttaatttctctcaaggagcttccacttccaacagcaatgcctatgttcaagcagttcaagtactgcaaaatgtgccaagttcctcctgtagcagttccagcactcagtcttttgatgcacaagctcacctcactcaagggaattataatcttagatttttagaatgtgagtttaggcctaactcaacctcaaaagctagctcaaggggtggtcgtagctatggaggccgcaatggaggaagaggcaatgctggtagagaagatggctgtggtcgtggtagatttgcaatagttcagtgtcaacaagctgttaatcaacaatcttctgtgccacaaactgtaactcagactcagcagcctccttctgctcagcagtgcatgcctataatggctccttttccttga

SEQ ID NO: 42636 - DNA, 180 bp, Glycine max
  Peptide Sequence Number=SeqID_159414
atggtgttcggttaccggagaatcgccgacggcgaccggagcagcagcagcggcgcggaagggagggttccgaagaagggcaaaacgaaccgtttcggggacggtggggtttgtgaatgggagaaaggaagagagaaattgccgcgaaggtggtgggggagccttccatccagaacctaa

SEQ ID NO: 42637 - DNA, 705 bp, Glycine max
  Peptide Sequence Number=SeqID_159415
atgagagagagagagagagagacagagcgagacagtgagagagacagcgggtgggaaagagtgaggtcgagaagggagagaagagagaatgagaggacgagaggtatggagggtccatgtctgtttatcgccagggaagggaaaggaggtcaacaacgtcgcttgcgagtcaactggagagatcatcggaatatatcatcgttttatttcacacgttttcctgaagatacaacagaagatgagctatggaagatattcagaagagcgggtgatgtcagggaggtgtttattcccaacaagaggaataggaccggaagaaggtatggatttgtgagattcatcggagtggataacgtccaacagttggaaaggcgtttggataacatagtcatggggggattaaagttatatgttaacatccctaaatttgaaagaggtaggggtcgagtgcaaccacaatcaacagggggacgagaacacaccaggcttgtcgaacaggggcgcagagaaacttaccaggcacagaaacacacagcgacgccgggcctggtacgcgggtcttttgcagatgtggtagctaggagagaaccacgtatacagcagaggaggacatcggcagttcagaatgctaaaaccaacacttcgagatcagaagtacatctcgacagacctatgacagcaccgaaatggctacaggatgcatgg

SEQ ID NO: 42638 - DNA, 603 bp, Glycine max
  Peptide Sequence Number=SeqID_159416
atgaaatttccaaattcccaattgttttttccactcttcttcttcttcttcttcgcctttactccctttcgcgctttagggcagcaaacggattggaacagcgaagagactcaacatggaaatggggttcgccgcagagttcttctgagtttcaaagaaaagccctcaggaagtaacgttacctttgaatgtgctccttcgggtccctgtgtcccctgcctctactctgagaaggactactttaacataagggatttgaggagattatatatgtttggtgatgagaaatatcggtgcagtgagactggctaccgaattccattcaaatgtgtagagattaaagactcaacgaaggatgcaaagaaaacaaagtctcaaaaaggtcggttgtctttggaaatttctgatggtattgcagaatctcatatagtgtcacatgttgctggagaaatcaatccttcacaatcacatagaagattagtggatgattcattgtcttcagataatagttcacaggcttatatcacttatagaagctgtataaccccagttaatgaagaaaagttgtcattgcttaactttgaggtaattttcagcttgtag

SEQ ID NO: 42639 - DNA, 411 bp, Glycine max
  Peptide Sequence Number=SeqID_159417
atggctgaggcagttcttgaagttgcacttgaaaagttgagctctttcattggaaaagagatgggattatatctggcgtacgagttggatgacatcctagatgagtgtgcctatgaagcattggggttggagtaccaaggagtcaagtctggtctatcgcacaaggttgcaacaatcatgggaacaatgtctcctcataaattatcaatgttattagaggaagatggttgggaattgttcaaacaccaagcctttggaccaaatgaagaagaacaagcggagcttgttgccatagggaaggagatagtaacaagtgtgggagagtgcctcttgcagcaaagcactaggaggttttctacgcttcaaaggaaaggaaatgagtggctttatgttaaggaaaacaacctttga

SEQ ID NO: 42640 - DNA, 300 bp, Glycine max
  Peptide Sequence Number=SeqID_159418
atgcaacaaccactacctgcaacattgcaattgcctgtgatatccgaaactgcaatgagtgaacaatttagctacagcattgcacggtcgtatccattgtttacggctaagactaatggggtatctaatcccattcgctcccctagctttcgtctctccgtgtcagtccagcagagtgtttttgccgttgatgttctgttcgatctctacgcatttccctactccacaccggaaattccctctgcccctaccgtactccagcttggtagtttccactgcctatccaaggttgagccctga

SEQ ID NO: 42641 - DNA, 1640 bp, Glycine max
  Peptide Sequence Number=SeqID_159419
cctcaactttatctcttctctattcctctgcaagcaactccgttcttgacccttttcaacccaccgcaccctcctactctctccaacaccgtatcctcttccccgaccaccatctcctcattatcaccaacccccaacaacaaaagctccacgaactagagtgcgtctactacacgcttcaccccaacgcttcctcttccggttcacctgaaccggttttccaagttcatgttcgaccggtcctgtccacggaccgttatgacgaatctcgatccattgttaggtgcccacttacccaaacgaactcctctgccggcgacgcctccaaagccgtcgacatgcggcggcgcggcgaggtgggtcatcggaatttgggcgttttgatgaaccaaacggctcaatcttgggacagggtggcgtacgaggctacccttgacggagacaccgtggttgtgttcgtgaaagggctgaatctccggccacacaagatatcggatccgacccggatccggtgccatttcgggctgaaaagtttcgacaaagacaatgcctttttacttaccacgagagctgtttctgtggctcaagaagttgtgaggtgtatgttgccacagagcatgaggaataatcctgataaggctcgaggaattcgggttactgtgagttatttgggtggcaatgtgaggcacccggttcgtgttcttgtgcgttctgtgtctagggttagtagccctggtggtggtggtaaagttcagaagaggaatagaaagaagtatgagttgtgtgcgtgtactatggtgtggaaccaagcttctgcgctcagggagtgggttatgtaccatgcttggcttggagtggagcggtggtttatctatgataacaacagtgatgatgacattgagaaggttgttcaggatcttgatcttcaagggtttaatgttagtagaaaatcctggccttggattaagactcaggaagcagggttttcgcattgtgctttgagggctagagaggagtgtaaatgggtggggttctttgatgttgatgagttcttctacttccccagtgagtttcggcaaccattgggggagggtgttcctggtgagaattatctgagatctgtggttgccaatttctcatcttcgaaatttattggggagataagaacagcttgtcatagctttggcccttctgggttgaagtcacccccgaaacaaggggttactctagggtacacttgccggcttcaaagccccgagcggcacaaatccattgtgcggcctgatttgcttgacatcagtcttttgaatgtggtgcaccattttcagcttaaggaggggtttagataccacaacatgcctgaaggtactgctatagtaaaccactacaagtaccaggtatgggaaaccttcaaagccaagttcttcagaagggttgctacctatgtggtggactggcaggaggaccagaacaaagggtcaaaggatagagcaccgggattaggaacagaagccattgaaccacctaactggcggcaacagttttgtgaggtttgggatactggcctgaaggacttccttgtgtcttattttactgaacctgcaaccgggttaatgccctgggaaaagtcttctctataa

SEQ ID NO: 42642 - DNA, 384 bp, Glycine max
  Peptide Sequence Number=SeqID_159420
atgactgctcatgacacttatcatcagttcccattatcaccactttctgaaaaatcagccttgtccccaaggttgatagcagagaaaagcttcttccttattatgtccatccatttcaacaattcatttcttgcaaaatctttgctcaccatgattggaaattccaaattcttccttcatgtgtataggaaaccttcagagaatggcctaaaggtcacctatgaccagtccattcaaaagtgtatttttgaacgggttcgcaaacatggccaatctcaggtaccaatctcaggtacaacattgcttctcttttcttgtcgatgttgcctgttcatttgcaagttagagcagtgttctcatagaggtgtggctcgaaccccttaa

SEQ ID NO: 42643 - DNA, 405 bp, Glycine max
  Peptide Sequence Number=SeqID_159421
atgatttgtcttcatggttgtggttcacatgtttttgggattagggttttgtgtgatttggaggaagattctagtgttaaagcttgtgatcccaaaagtgaagaaggtggtctagacaggttaatcacgagagacaaaacattgttgctagacatagatgagaataagtggtccttctttgaattggttggcattctaaaggatgacattaaatttgcagcacctagtgatggggaggaaggtgttgttattattgttagtgagtcaaatggcagtgataccaagtctgatgaaggtggttctgagaataataataagggtgctctttttgaagataacaaagaggagagagcagttgtgattggtgatggttttaatagtgaggatgaacctttagtgatgtga

SEQ ID NO: 42644 - DNA, 381 bp, Glycine max
  Peptide Sequence Number=SeqID_159422
atggggtgtttgtgcgagtggaatgcccttgagcctaaagaagagaatggcatccattggtgcgacaaggtagcgattcaactaatatctcgaactaagaagcatccagacaagatattttggcaatatgctgagtggaatgaagacaagagatgtaaatttttgggttgggatgatgatttggcaaaatatttaaaccaaggttttggaagtactgtggaggtacaagacttgaagaagatgcttgcaaaagaagatgctcaatctcggggatatgccaaaggtgttgaagaactacgatatgtccaagtggagaaagatgaaggcccagaggcagatgcactaccaagactactaattgctgctgaaggcccaagttaa

SEQ ID NO: 42645 - DNA, 1483 bp, Glycine max
  Peptide Sequence Number=SeqID_159423
atggggaattcatttgggtgttcggcttccggcgagaggttggtgtcggcggcgagggacggcgatttggttgaggcgaagatgcttctggaatgcaacccttgtcttgcaaagtactcaactttcgggggtctcaattcccctcttcattttgcagcttccaagggccataacgagattgtggcattgttgcttgaaaatggagctgatgtgaattcgagaaattattgtgggcagaccgctttgatgcaagcttgtagatatggacattgggaagttgtacagacccttctgctcttcaaatgcaatgttatgaaagcagattatctcagcgggaggacagctcttcactttgcagccatcaatgggcatgcaagatgcattaggcttgttgtggcggattttgttccaagtgctccgtttgaagcattacatgctcacatggttgctgagggtgatgcatcaaatacaccagatcttctagaggtttacacagcagtggcgtttctgatgggtttgccagaggtttgcacagcagtggagatgagatctatgtgcagtgcgctgtccaagtttataaacaaaacagctgatgctggtatcactgcccttcatatggctgcattaaatgggtactttgattgtgtacaactgctacttgatcttagtgctaatgtgtcagctgcaacatttcattatggaacatcaatggatttaataggtgctggaagcactccattgcattatgctgcttgtggaggcaatttaaaatgctgtcaggcaagaattgcttcaactttgataggtgcaagtcgaatggctttgaattgcaatggatggcttccacttgatgttgctaggatgtgggggcgccattggcttgaacctttgttgacacctacttctgatgccacaatatcatcattcccttcttcaaattatttatcccttcctctcatgagtgtgctcaacattgccagagagtgtggactgcaatcaactacaacctcctctaacgaagttgatgcttgtgctgtctgcctggagagacaatgttctgtggctgcagaaggatgtgggcatgagctttgtgtaagatgtgcactctatctttgctcaacaagcaatgtttcttctgaaacgggtgggcctcctggttctatcccttgtcccctttgtagacatggaattgtctcttttgtcaaattatcagatcgaccgtctctttctcttacccccgagattcgaagaaaccgtgtagcttctgttccgtcggagatgctttgccccgtcacttgtactccatttccatctgtagcaattcctctgtgtacatgcaatgatggtccttgtccatcatttgaaccccgggaagcagaagcacaagatggatcacctcgccactcacaagctgcgatgatggatcagaataaaatggatggtccgaggctggagaaaatgacatgctcaggcatgttttggg

SEQ ID NO: 42646 - DNA, 255 bp, Glycine max
  Peptide Sequence Number=SeqID_159424
atgacaggaagacatagaaaagcaaggaaaaagagtcatgttgagggacctttaggaacacaagaggctaggagatcaaacactctcaggacttgtcaaagggctccagtgaagaagggcaaagaaaaaaagaaatcaattgctaaaggtgcaaccggtggagaagcaattcctattgacccaaatgttgttgcagttgctaccactcattttgtccaagctgaaaacactgatccaaattctacatgtggatag

SEQ ID NO: 42647 - DNA, 906 bp, Glycine max
  Peptide Sequence Number=SeqID_159425
atggtgttggggtggaggagaaggaagggctgcaacaataaccgccgaaaaggtggcaaatccatcacggagttggtgattcccaaccacttcaggtgtccaatttcccttgacttgatgaaggatcctgtgacattgtcaacagggataacctatgatagggagagtgtggagaggtggtttgatgaagggaacatcacatgtcctgttacaaaccaggttgtgagaaactttgacatgattccaaaccattccctcaggataatgattcaagattggtgtgtggagaataggcaacatggggtggagaggattccaacaccaaggataccaattagcccaaatgaggttgctgagcttctgatgcaagtgaaggcctcagcaaggggtttggaccaatatggttgccttaaattggtgcagaaattgaagaggtggggtggtgagagtgagaggaacaagaggtgcatagtggacaatggagcacctgtggcattggcttcatcatttgatgcatttgccaatgattctgttgagagaaatgtggtggttcttgaggagattttgtcagcactcaattggatgtttccacttcaattggaggcacacaagtctttggggtctttggcttctctaagatgcatggtttggttcttgaagcaccaagatctctcagggaaagagaagtccattgtggcattgaaagagcttctttcctttggtgatgtgcagcatgtggaggccttgtcacaaattgaaggggtcaatgtgctcttggagttcatcaacaagaggattagtccaaccatcacaaaggcctcattgagggtggtttggtacttggtctcatcctcttccaaatcaactctgaagaaggaaggaacaaagcctgcgggaatgatctaa

SEQ ID NO: 42648 - DNA, 616 bp, Glycine max
  Peptide Sequence Number=SeqID_159426
aggagacttgtttgctggttttgataatggtttttctggaagtgaatatgagccagtggatgaggatggaaatgacaatgaagattatgaaagtgaaaacattagtgactttgaggaaacaatagatgtcactggaaataactatttagatgatgatattgaaaaaatttatgtggagagggggattaagactatgctatacaggaaagatttcaactgcatagagtttaaaatggaagaacaagggttacttatgagtgtaacactcgtggttgcacatggaggatccatgcatcccctactccagataagctatcctgcaatgaagcaaactcttcttgaaaaatatggtgttaaaccaggcagtaagatgcaattttatcgagctaagagaaaggtccaacaaaccacaaagggtgtacatgttgtctcttacaatgacttgccaccatggattgttgcagtagagaatgaaaataaaggaagcattgttaagctaaatgtggaactagtacctaaccctaatatgaacactcaatttaaaaggctttttttttgccttgatgctcaaaagaagggatttgtcaagggatatgcaggccttggcttggaatag

SEQ ID NO: 42649 - DNA, 435 bp, Glycine max
  Peptide Sequence Number=SeqID_159427
atgtatgttatctatatgtctatcatctgttgttggacttctttatggaaccttgacttagagtgcagctacaaacgaaacggaatctttccaatgcttaaaagaaattcaacagtcaaattagcaccgcaacggtggcaagaaaatgccgctgatggttcctttgatgtggtagttacatttgaagaaaaagtgtttgatatggttattgaagatctccataatagagatcatgctttattgaaaactgtgctggtaatcaacttggaggtaaaagataaccacgatgaagcagccgtgggagcaaggcttactttagatctctgtcgggagattgaagctgctgaatcatgggaagagtcaattgatgaaattattgctggttttgagaataaacatcggcggaagcttttgtacagcatctccttctactaa

SEQ ID NO: 42650 - DNA, 498 bp, Glycine max
  Peptide Sequence Number=SeqID_159428
atggccctggatgaaatatcacatgatttggcagtttcaggtggcagggtttccaatattgatgccacagaagacacttgttgcaagctacctggtactgactttttgagttctaaattctggaagaagacagaaggtcgttattccacatcaaggttctctttaggaagcataccatcaacagatgctgtgcatattgcaaccaataaagatggaaaaagagaaatattaactgcaaataacaatagattgcaacatggtaagggtggatattttgtaaacccattggcagaagttcaaagcgatttgaaagggcatcatacatataaactttctaaaaacttattccaagatgctgtgaggagatatgatggcattcaaccagctactgaatcactcaggaaccagaatatcagaaagaggggggaaaatgatgaagagttttcgagcttctgccagaattggcacatagagtgggtattgaagatgaaaaattaa

SEQ ID NO: 42651 - DNA, 1520 bp, Glycine max
  Peptide Sequence Number=SeqID_159429
cgccaccactctccggcaccgagtcgactcataacctccgacagcgagtcatcacgtgccttaacaaactctccgaccgcgacactctcgccggcgccgccgcggaactcgagtccatcgccagaaccctaaaccatgactcgttctcctccttcctctcttgcattcacaacactgactcctcttccaaatcaccggttcgaaaacaatgcgttcatctcttaaacgttctctcgcgcttccacggcgaagcgctttcgcctttcatttcgaaaatgctcgccaccgtgctccggcggctccgcgacaccgactccgccgtgcgatccgagtgcgtggacgccgtggcgtcgatgtcgtcgcggatcacgcggccgccgttctccgccgcgttcctgcggccgctcatggacgcactggcgcaggagcaggaagccaacgcgcagatcggcgccgcgctgtgcctcgcggcggcggtcgaggcgtcgccggaccccgacgcggaggccctccgccggagcgcgctgccgcgactcgggaagctcgtgaagagcgacgcgtgcagggcgcgggcggcactgctggtactgatcggaagcgtggtcggtgctggcggcgcgtcgagccgcggcgcggtgaactggctcgtgccgtgcctcgtggagttcctcggcagtgaggactggacggtgaggaaggccgcggcggaggcgctggcgaaggtggcttccgtggagagagatttggcgtcgcagcataaggctctgtgtttggattcgttgcagaatcggagatttgataagatcaaagtggttcgggagactatgaatcgtgcattggagacgtggaaggaggtaactgaagatgctcctgcttcgcaagtaaagtctgaatgtgcttctgttggcacagatgatggtaaaagtcagtgtgtcactaaaagttcacccaatgttggctttaagtcttcttctaaaacagtcattgccaacaggtcccctgcatctgtggtttcattcatgtcgtccattaaaagagagagttctctaaagagtaatgagaggcatttgagaatggggacaatgcatcagcagggtcaggagaaatcctccgatgagaaacttgaaactccatttttgggttcctcccactcaaatatgtctagggaagatgatattaaaaggtgtaatgttgaagtttctaagccacccccatatcaaaatcaaaacggggtaaattcgagggcagagataaagcgtgttctctttagcaagatgtctgatgaaaaaatgaggagattcagtggttcaaaatctcgcgtggttccatgtattgatgatgatgatcttgatgcagatgttattgtcaacaatgcaaatgaagtttgtgagagcccacaagatgttgaggagtttgctttgatccgtgaacaacttcttcaaattgaaaaccagcaatcaaatctattagacctcctccaggtatactatagtgccgtgatataccttttgccttattaa

SEQ ID NO: 42652 - DNA, 375 bp, Glycine max
  Peptide Sequence Number=SeqID_159430
atgggtataaagatatatgtgatgatagaagcaggcaagaaaataaagggaatgttggtgtactgcgacaacaacaatgcaccaatacctcttcgttctacttcgcagcagatctacaacgacgtggttttgctcgcaattctagaccctgaatccaattcctcgtcgaatggtggcttttcttcttgttgttcacttgctgcttcggcaatgggatctccacaacatcattcgggcccacagaaggagacgatgatgatggggcttagggattgtggctatggtgagattttttgttgtggtgttgcatgcgtgtggcttttctatgattttacaaagccttcatgtccattggaggccagggtggaaggttga

SEQ ID NO: 42653 - DNA, 453 bp, Glycine max
  Peptide Sequence Number=SeqID_159431
atgccaatgatacacatgcgaagccacatcagagggttcttggtggaagggagtttgaagacaatgcggtttggtgaaagtgagattgaagacaatagtgtggtcccagaaaaagatgcttcatttatagatggcattttctatcaaagtgcatcacagggggcatgtggtccatcctatttggggttatgttggtggagatgtcataaagatatgaaactgaaagaatgtaagggtgtgtttaagttgtggtggaagggggttgataatgagatcaaagagtttgccttggatagccatgccgtggaattgtgcaaccactatgtgagcactgacaatgttgtgaaaatgtatgtgaaggtgttgaatggtggtgggaatgaagttgctgttggtgggaatgaaaatgcacaaggtgggaatgaagttgttactgctgggagaagccaataa

SEQ ID NO: 42654 - DNA, 330 bp, Glycine max
  Peptide Sequence Number=SeqID_159432
atgaccaaagttatgcaagcacagatgaaggctatctgtcaaatgaatggtaatggaagcacagtcgtcaccaactcgattgcgcctctaaaccctcaatacacgagattatctgaatttcgtaggaatgatctaccattttttcgcgacagtgtagatcctatggaagcagaagaatggcttcaaaagctagagaaatttcttagagtcatgatatgcgatgatgcacagaaggtggactttgctacctacatgctagagtctgatgcagagcattggtggaacaacactcaagggaatttggcaacttcaggagctcttatcacttag

SEQ ID NO: 42655 - DNA, 324 bp, Glycine max
  Peptide Sequence Number=SeqID_159433
atggacacttacagataccatggacactctatgtctgatcatggcagcacataccgtacacgtgatgaaatttctggtgtgagacaggagcgtgatccaattgagagagtaagaaagctgttattgtctcatgatattgctgctgaaaaggagctaaaggacatcgagaaagaagtcagaaaagaagttgacgaagccattgctaaagcaaaggagaatccaatgccagacccatctgatctatttaccaatgtctacattaaaggttacggagttgagatattgatttcatccaacaaactatacgtgcttcagaatttatag

SEQ ID NO: 42656 - DNA, 651 bp, Glycine max
  Peptide Sequence Number=SeqID_159434
atgcatggaaccacccttccccttcgagcacccatcactgcggcccatgagctcggcgaagacctcgaggagcgtgccaccgcggccgaggaaggtgcagtggtcgcggtaggcggtgatgatggagtccatttttgtgatggcggcctccatgccgacggcgacagcctcctggccgtcgtagaggtggcagaagccgcggatgagcttggccttgtagagggagtccgcggcgatctccatgcgccgcatcagggccatatcgaggaagaaggtgaggagctccgaggaggaggttgccacggcgcgcgaggggggttcgcagttgtgcgcggtggagtggatggaggtctcgatggtgaggggggtgtcggtggtggagatgacggcggagaagggttaaatgggaatggggttgtggttactggtgagggaagcaatggagcaatgaacagagaagagaagggttatgtaaagcagaaaaatagagaagatgagaaaccaagtgtggggaggagtgagttaattcacttgattgatgagagagagagacagagacagagacagggagagtactttcggtatttctttcagtatttcacgaatcacggtcgcgttgcgtgtcaccttttgattcactgctgtcaataa

SEQ ID NO: 42657 - DNA, 774 bp, Glycine max
  Peptide Sequence Number=SeqID_159435
atgggattgttggggtgtgggttggcgtttgcgcagaagtattctaaggatgagagtgtcacttttgctatgtatggagatggtgctgccaatcagggacagctctttgaggcgcttagcattgctgcgctttgggatcttcctgctattttggtctgcgagaataatcactatgggatggggactgcggagtggagggctgccaagagtcctgcttattacaagcgtggggattatgtgcctggcttgaaggtgagtttggttaatgtgttctttgatgcacttgttgtaatggtttatctgttaatgggtggttttaatgtgtttctgcaaagaaatctccaaattctcattattggtaatgaagagatacaaggttatatacatggttacgaggctcaaaccaggattatcactggtttgtatgagaaaaggattggaatcatccatggcacccatggaaccgaaaaaggagaagaaaagctagaaggaaatcagagaaagcagaagaaatgtatctctgctgataccatattaacagagagctgtgtgcagcaaagaaatctccaaattctcattattggtaatgaagagatacaagggatgtatgcctttcctgttcttgcattatacgttgatgcttctgtggactctccttttttagcctcctcattgggctttattcctgttgatggcatggatgttcttgctgttaaacaagcttgcaaatttgcaaaggaacatgctttgaagaatggactccttgtgagttaa

SEQ ID NO: 42658 - DNA, 2457 bp, Glycine max
  Peptide Sequence Number=SeqID_159436
atgtctgtgaacatgatgcttcttcttgtgatcctttttgttttacaaagttttctaataccaacatgctattgccaaaccaatactcctcagaatatcgaaatattttatccaatccaaactccaaaaccaccctttccaatccaacctcctgagtcacaaccaaagccacaagcatcaccaccatcaccaggaccagtagctgcatcaaaaacctcttcatcaagcagtaagatcggaacagcggtggctgcaactgcagcaggtactctagttgtttctggtttgattttctgcttggtccaaaggtgcttcagagcaaggaagagaaaggaggtcacaaacaacactgcttctgccgtagataggcgcgttgcacctcaggtcaacgtgtttgagagaatggaagggaacgtcaagggactaattgttgatgaggatggtttggatgtggtttattggagaaaacttgaaggtaagaaattaccagacaaggatttccaaagggaggttttggatggcacccaagataaaatagaagatgatcatgaggagaatcaaaggaaaagatccgagtccattcaagaaattcctctgcttagagacagatcttcaacttctcacatgaatatatttcttccagaagagtcatatacaatcatgagaattccacctcctgctcctcctcccagtgttccttcatcaattggaggctcttctactcaatcaccttctccaccctttactccttcatcaccaaaaccactcaacacttctttctcatcaatttcaaacattacaagtcctgcactaccaataactgatataaataatcaagcaccagcaccacctcctccaccaccaatcgcaggtataaaaagctcagcactgccaccgcctcctccaccaatcccagttaaaaagaactcggcagcagcaccaccacctcctccaccaatcccaaataaaaagaactcagcagcagcaccacctcctccaccaattcctccaagaaagagtccagcaccacctcctcctccaccaaaagcaagtggtttgaagtcatcatcaaaaccaccacctacccctattgaaagaacaccaagtaccacaactaggcaaggaaatacttcacctgaggtgaaactgaagccattgcattgggataaggtgactaccaaccttgatcactctatggtgtgggacaaaatggaccgtggttctttcagggttgatgatgatcttatggaagctctcttcgggttagttgctaccaaccgaaatgacaataccccaaaagtaaataactcaatgagtcctagcagggatgctttggctacttcagtgaataccttcattcttgaccccagaaaatcacaaaacattgctattgttttgaagtctctggcagtctctcgtaaagaaattattgaagcactcattgatggtcaaggccttaacacagacaccattgaaaagcttggtagagtagccccaacagaagaagagcaatcacttatacttgcacatgaaggagacccttcaaaacttgctgcagctgaatctttcctacatcacatcctcaaagctgttccttcagcatttaagcgcttgagtgctttgttattcaggttgaattatgattctgagattgtagaaatcaaggagtttctgcagactcttgagctggggtgcaaggagcttcgaaaccaaggaatttttgtgaagcttcttgaagcagtgcttaaggctggaaatcgcatgaatgcaggcactcaaaggggtaatgctcaagctttcaacttggcttctctcagaaagctctctgatgtcaagagcactgatggaaaaaccacattgcttcactttgtggttgaagaagtagttcgttcagaaggaaaacgtgctgttcttaaccgcaatcacagtttgagtcgtagtagcagtaggaacagcaacagcagtgtagactctaaaaactctgctgcttcaaatgaacaaagacaaagggaatacataacactaggattgccagttgtaggagggatcagttctgagtttcccaacttaaagaaagctgcggttacagattacaaaagttttgttggttcaatctcatcactctcagccaggattgttgagattagagaacttgtttccaagtgtggaaatgacaagggaggaaactttgtgagagaaatgaacaattttcttgaaaatgctgaggaggaacttagattagtgagggaggagcaaacaagggtaatgcagcttgtgagaagaacgacagattattatcaaggaggagcttcaaaagatagtgtagaaaaccctctttatctatttgtcatagttaaggattttctgggaatggttgatcaagcatgcattgagattgctcgtaacatgcagaagaggaagacacctaagagaggaccttgtgctgctaagtgctaa

SEQ ID NO: 42659 - DNA, 1323 bp, Glycine max
  Peptide Sequence Number=SeqID_159437
atggaagcggcggcgacggcaacggcaacagttctcgcaccaccgtcggctttcctcggaagaccctccgtactcgccttccgttccaatcttcgcttctccactaagttttgcaagggggttatacagaacatgcttttaagcacttctgtagctatctccaagcatggtcatgggagacactgtgttggaactagaaggggttttgtagttagagctgcatcatttacaccagagtcatccgaaccgagttccaagattgctccacttaagctggagtctccaattgggcagtttctgtctcagattttgataagtcacccgcatcttgtgccagctgcagtagagcagcagcttgagcaattccaaactgatcttgatggtgataaacaaaagaaagagccttctgcttcaggcaccgacttagttttgtacagatatactaaagaagtaaagatatcttacaacaacaacaacaacaacaaaagccttaatcctattaggagaattgctgaggttaaggctaaagagaggaaaacagctctagaagagatattgtatgcattggtggtgcaaaagttcatggatgccagtatttctctgataccctccttaactccaaaccattctggtcaggttgattcatggccaagtgaagatggaaaactggaggagcttcactcaccggaagcctatgagatgatccaaaaccacttggctctcattttgggcaaccgtttaggggattcaacatctgttgctcagatcagcaaaatcagggtaggacaggtttatgcagcttcaataatgtacgggtactttctcaagcgagttgtgcaaaggttccagctggagaggacaatgaagattcttcctaatgcaacagaagagaatagcattcaacaaactgttgtagatgattcaagaatcagaggcggagagggccattctcatgttatgtcccatcctgaagtttctactttgcctggtggtggcatcagctctgggggatttggctatggttcaaaagtgtccaggttgcgtacctatgtgatgtcctttgatagcgagactttacagagatatgcaacaataagatccaaagaggctctcagcatcattgagaagcacaccgaagcattgtttggaagacctgaaattgttgtaacaccgcagggggtaattgattcttccacagatgataacatcaaaattagctttggtggtttgaagagacttgttttagaagctattacttttggttcttttctctgggatgttgagagctacgtcgactcaaggtaccattttgtcctgaactga

SEQ ID NO: 42660 - DNA, 384 bp, Glycine max
  Peptide Sequence Number=SeqID_159438
atgaacagagtctataactttccaaattggttcttacaatggtggaatttctttggtccaattctagagattttgccagagcagtttgattcgtccaaggctgatccagaacaagtgaagctttggtttcaattccatccagaatttctcaaagcagctgatccagagacttctgtgtttttgaaccaaaagtcccatatggctgcatttttagcaggatcaaaatcaaaagaggtactgactaaaaatcttaaagaagttatgcaaatgttgcaacaaaaagaagaaagttcatcctcaaagaaggaagaaacaagttctgttgaagaagaagatcctttttacccgaacaaagatgattgttttggtatttgtttagattaa

SEQ ID NO: 42661 - DNA, 192 bp, Glycine max
  Peptide Sequence Number=SeqID_159439
atgtctcttccaaaaacacctcttctcttgatcaatccaatgggagtatgcattataagatccatacagaggccatgcataacgccaatggtgatggcgccttcaacagggacgagccacgtggccatggaagcgccattcccaccagcgcgtctccttttgctgaggtggctttggaagcgtcagcaatag

SEQ ID NO: 42662 - DNA, 201 bp, Glycine max
  Peptide Sequence Number=SeqID_159440
atggcagcacgctttcaatctgcatctgaaagtgtttggaaagtgatttgggctcaaagtgcccttgtcattttagggaatgatgaaattcaagtctatgaaaggatggaaatctattgtaccacttcatttgaaaggaaaatcggcaacccgtttttctttatttcgcaaagtcaatttagctggagacctaaattttaa

SEQ ID NO: 42663 - DNA, 291 bp, Glycine max
  Peptide Sequence Number=SeqID_159441
atgggagtgttgacatctcgctaccgctctggaggagcttgtcttcgtcgttgtcgcaggtggaaggagaagacggaaatggtgttcctcgtggaagaacatattttgagtgaggctaggacacaaataaaggagtgctacgaaaaggaagagtatcttccttctagagaagccttctgcgactctatggatgaaaacgatggccatattctattcaaaagatctacaattagacggtgtcttttagaaaagaaaagagaaaaagtgttttggtgccctttgaaattttaa

SEQ ID NO: 42664 - DNA, 3033 bp, Glycine max
  Peptide Sequence Number=SeqID_159442
ggaaaggcattccgaggattattgtgcaatgtatgacatttgtggaacgcgcagtgatggtaaagtagtgaactgtccatatggttccccggctgtgaagccagatgatttgctttcatcaaagatccaaagtttgtgtccaacaattactgggaacgtttgttgtacagaagctcagtttgaaacattaaggacgcaagtccaacaggttggtggtaatttgacagtgggtgggattgattattttgtaactgatgcttttggtgaagggttatatgaatcctgcaaggaggtaaagtttggcactatgaattctcgagctctacaatttattggtgccggtgctcaaaattataaagactggttttcttttattggtagaaaagctgcccctcatggtcttggttcaccttatgcaattacattctggccaaatgcaaccgcatcatctgacatgaaacctatgaatgtttcaacttattcatgtggtgatatttctcttggctgttcttgtggtgactgtccttcgtcttcagtatgctctaattcagcttcaactaccaccaataagaaggattcctgctcagtgaaagttgggactttaatggtgaagtgtgttgacttgagtttagcagtcttatacattatattgatttgcgtgttcttgggttgggggttgtatcatcggataagggaaagaaaaccgacgtacagaacaaaatcagtgtccaatgtcattagtgatggtgcgctgtattctcataatagggagaaggatgagaacctcccaatgcagattcatatgatggaagatgctcaacaaaacagaaatagagttcggctctcggctgtacaaggatatatgacaaatttttacaggaaatatggatcatatgtagctagacatccaattatggtgctggcttcatccctggctatagttcttctcctctgtctaggtctaatccgattcaaggttgagacacgacctgagaagctctgggtaggacctgggagtaaagcagcacaagagaagcagttttttgacactcatcttgctccattttacagaattgaacagctcattctggccactgttccagatcatgtaaatagtacatcaacaagaattgtgtcagaggacaacattaggtttctgtttgaaatacagaaaaaggttgatgcaattcgtgctaattattctggcttgacggtatctctccaagacatctgtatgaagccactagacaaagattgtgccactcaaagtgtccttcagcattattcctcagcagaccattgtatgagtgcatttaaagctcctctggatccaagcactgtattaggaggtttttctgggaatgattattctgaggcatctgcgttcatcgtaacatatccaataaataatgctattaatgaagaaggtaatggaaccagaaaggcagttgcttgggagaagacctttattcagttggtgaaggatgagctgttaccgatggtacaatcaagaaatttgacactggctttttcatctgaaagctctgttgaggaagaattgaaaagagaaagtactgcagatgctattacgatattggtgatgcttggtctttcaggagtaattcttgttatgctgtctgtcattggatcagttggattttttagtgtgcttggtataaaatctactctgatcatcatggaagttatcccatttcttgtcctagctgtgggtaaatgggataaggttcaggtccaagttcatgctgtaaaaagacaaaagctggagttgcccttagaaggacgaataagcaatgcacttgttgaagttggaccatcaataacattggccagtgtatcagaggttttagcatttgcagttgggagttttatttccatgcctgcaattcgtgtgttctccatgtttgctgcattggctgttcttttggacttcctcctgcaagttaccgcttttgtagctctgatagttcttgactccttacgggcagaggataagagagttgattgttttccatgcataaaagtacatgcggaccctgatataggaactggacgaagaaaacctggtttattggctcgatacatgaaggaggttcatgctcccattctgagtatttggggagtaaaaatagttgtcatagctatttttgtgggatttgcattggctagcattgcattgagcactagaattgaacctggtttagaacaagagattgttcttcctcgagattcatatcttcagggttatttcaataatgtttcagaatatctcagaattggacctcctgtgtattttgttgtgaaaaactataactacagggatgcatgggggcgtgtgttagtgattgctagagcggcccttgtaccagacacaagttatattgccaagccagctgcctcatggcttgatgattttcttgtgtgggtgtctccagaagcatttgggtgctgcaggaagtttacaaatgggagttattgccctcctgatgatcagcctccttgctgtgctcctggggaaagctcttgtgtttcagtaggaacatgtaaagattgcacaacgtgtttccgtcactcagatctccataatgatcgtccatctacaacacaatttagggagaaactgccatggtttcttagttctctgccatctgctgattgtgcaaaaggtggtcatggagcttacaccagcagtgttgaactgaaaggctacgacaatggcattattaaagcatcgtcatttcgtacttatcataccccactcaacaagcagattgactatgttaattctatgagggctgctcgagagttcagttcaagagtttctgattctttgaagggtgtgatggccattctgaatatccaattgaatgcactctcggtggtcaaccttgttatgtcagtgggcattgctgttgagttttgtgtgcatatgactcattctttcactgtagcaagtggagacagagatcaacgtgctaaggaggctttgggtacaatgggtgcttcagtgttcag

SEQ ID NO: 42665 - DNA, 2724 bp, Glycine max
  Peptide Sequence Number=SeqID_159443
atgggagatagtggtgtgacatcatctgctgctaccatgatggaagctccaccacctgatggaacaacaacaacagcaacttcaatggattttgattacatgggtgagtttttcttagatgggtgctggttggaagcctctgccgatgtatctgacttcttgctgcaaagtccttccttttccaatcccctctttgacccttcattatcctggcctgccttggagaccaaccacaataaatcccaggatgctgcttttgggactcaacaagaaagtcataacaacatcgttagtgttgttgctggtggtggttatagtcagcagtttcagtctgagactcattcagttgaaggtgtatctgaaggtgtcagaaggtggtggtttgcaccctcacccatacctagtcctggacctgggccttctataatggagaagctaataagggccctcatgtggatcaaagattacaacaggaacaaagatatgcttatacagatttgggtgccaattcataaagagggtaggccgattcttgcggctgatgaccttctgttctcacttgaatccaagtctctgaatcttgcaaagtaccgcgaaatctctgtgacatatgagttctctgcagaggagagtgactccaaggagttggcgcggggattgcctggtcgagtgtttaggtacaaggttcctgagtggactcctgatgttagattctttaggagtgatgagtatccaagagttgaccatgctcaagagtatgatgtgcgtggaacggtggcggttccaatctttgaacaaggaagcaagacgtgcttgggggttattgaggttgtgatgactactcagcagatcaactatggtcctgaacttgagagtgtttgcaaagcacttgaggctgttgatcttagaagctcaaaacaattaagtattcagaatgtgaaggcatgcaataggacctatgaagctgcactacctgagatttatgaggtgttgagatctgcttgtgaaatgcacagattacctttagctcaaacttgggtcccatgtgtacaacaaggcaaagaggggtgccggcactctgaagataattatctactctgcatatctcctgtggagcatgcttgctatgttggtgatccctctattaggtcttttcatgaggcttgcactgagcatcacttgttaaaaggtgaaggtgttgctgggggagcttttatgacaaaccagccgtgcttctcagatgacataacttccttaagcaagaaagactatccactgtctcattatgcaagattgtttggattgcacgctgctgttgccatacgccttcgaagcatctataatagcacagatgactttgttctagagttcttcttgcctgtagattgcaatgacagtgaagagcagagaaagatgcttactgcactgtccatcattatacaaagggtttgtcgcagcctgcgcgttataagagacaaggaattagaggaagctaacttgtcagttgatgaagtgatagcccttgcagatagtggatttgctaggaatgcaattttttcggaaccccaatacaaagggatggtcgcctcattggatgctgaagaaaaatcaagtgaaacaatgggtagaaaattctctgacctaaggcagcaacaagaaagtcctattttaaaaggaaaccttgactgtgttaaggagtgttctacgtctgttgagggtaacttatcaagtttgggaacaaataaaactggagagagaagacgtgccaaagcagagaaaactatcactttgcaagttcttagacaatattttgctggaagcctaaaagatgctgccaagaatattggtgtttgtactacaactttgaaaaggatctgccggcaacatgggataaagcgttggccttctcgaaagatcaaaaaggttggtcactctctacaaaaacttcaacttgtcatcaactcagttcaaggtgcctctggtgcatttcaaatcggttccttctattcaaacttcccggatctagcttctccaaatttatcaggaactggcttcttctcaactttgaatcaaagtgattatccaaactcaacaagcacacagccagatcatggctcattgagcccagaaggtgcatcaaaatcgccatcttcatcgtgcagtcagagttccatttcaagccattcctgctccagcatgtcagagctacaacagcatcgcacagctaacggtgctggtaacaaagtttccaccacggttagtgaagattctgctggtgttgtgttgaagaggatcagtagcgaggcagagcttaaaagccttagtcaagatagagcaaagctcttgccaagatcacaaagccaggaaacacttggtgaacaccctaaaactcagtatcaacagcctttattgaaaaccagtagcagcaaggtggattctcacagagtaaaagtcgcatatggagatgagaaaacccggtttcggatgccgaagagttggggctatgaagatcttctgcaggaaattgcaaggagatttaatgtgagtgacatgagcaaatttgatgtcaaatacttggatgatgactgtgagtgggtactactcacttgtgatgctgatttagaggagtgcattgatgtttgtcaatcttccgagagtggtaccatcaaacttagtctacaaccttctagtcatagtatgagaagttctttagaatttagataa

SEQ ID NO: 42666 - DNA, 648 bp, Glycine max
  Peptide Sequence Number=SeqID_159444
atggcaaatctcataaaccaatacttacaagaatggaataaagacttgataaaggatatttttaatgatgatgattctggaaaaatcttgagtttgcctttaatactcacgaatgaacctaatcttcttgcttggagactcaccaatactggagcttacactgttaaaagcacttaccataaaatcatggaagaaatccttgacacaagccatctcaaggttgctggaaattgggtacagatttggaagctcaatgtccctccaaagatcaggaattttatttggagactccaaagaaattgtgtgccaacccgactacgattcaggagaattgtatcccatgttcttttgaatcaagcagcacgcacaacaacactctccaaccaagcaccaccaacactagaccaaggtataaaatggaggagtccacctccaaacgtcatcaagtgcaacctggatgcggcatttttcactaagacaacttggttttacgacattccgttagtttttgaagcagaaacatgggcactatatcaagcaattcagtcatccattcaattgcaactcaaccatgtgatttttgaaatagactcaaagatggtagtgttggaagtgcacgttcacctccacgttcttttaattaattaa

SEQ ID NO: 42667 - DNA, 297 bp, Glycine max
  Peptide Sequence Number=SeqID_159445
atgcaggaaatcaacaatggatatgcctcctttcaatacatcagtcaaaacctaaccaaccctaccccaaaacatgagaccactaactcttttgatcctttttttaacgatgggtcctggcagccaggcccatcggggacaatgagtttcatcagctggaattgtagaagcaagcttcatgatgaatcaagcttgattcaaagaagttttgatgataacgaaggtgatgacaaaaaactcaaaggtcaagaacacttcatgataacaaagatgatgatctcaagaatcaaagaatga

SEQ ID NO: 42668 - DNA, 435 bp, Glycine max
  Peptide Sequence Number=SeqID_159446
atgtccaagaaacaaaaccaaacccaagccacccaagctgaacctaacttcaagaatagcccaccatctacttcatttgaggatggcttccctggtgaagctttacaaatcgttagacttgcaccagtgtccattcttgttgtgaaagtctgtttgaaggacaaagaacccaaagttcatattgaacactttttcaatattgactctttgaaaaatgttgcatatgtcatcaaggccaacctcatgatgtgtggcatccaccatttcttcaaggatcccaagttggtggtgcctgaacttatccatgaattctggaggactataaagctaattgctaaaatgattgcccaagccattggatgtgagcaacaaggaacaaagttcatgaatagttggggcaatgaacttgaagatcacaatgggcactccttgtag

SEQ ID NO: 42669 - DNA, 855 bp, Glycine max
  Peptide Sequence Number=SeqID_159447
atgtcaactagggctaagagcatgaagcctaagacaactcataaggtcacggacttcgagctcgacgagttggagaagtcttcgttgtcgacttggtcttgtttgtttaagaacacaaccatgttggggacactgacttgtttggctaaggggatgtgttctttgtggtggttcttagtctcatactcgatggtggcggtgttgatggtgatgttgctgaagaaactgtcgtggctgattgaggcgtttggtggacaagctcttaccttcgcgggagatgtttcaaatgaggccgatgtggaagctatgattagaactgtagttgatgcttggggaactgttgatgtattggtaaataatgcagtaattactcaagatggtttgttaatgagaatgaagaaatcacaatggcaggaagttattaatctgaatctcactagtgtttttctttgcatgcaggagctaatggtttgcattttacaggcagcagcaaagattatgacgatgaaaaagaagggaaggataatcaatattacattagttattggtcaggttgccaatgttggacaagccaattatagtgctgcaaaggcaggggtaattggcctcacaaaaagtgttgccagggaatatgctagcagaaacatcactcttaatactttcaccttggattcaggaagacttggcctactagaagaagttgttggacttgtggaattcttggctcttaatcctgctgccaatacatcattgggcagggtgttcaccgttgatggaggtatggcaatctacttgaacttctttacttcacagttcatctcaaaggccacaaaatttcaacttctgccatggtga

SEQ ID NO: 42670 - DNA, 432 bp, Glycine max
  Peptide Sequence Number=SeqID_159448
atggacgcaccttcgtccaaggctactcctgcaccacaacatctacttctcattctagttgctcataaggcaacaagtgcaatgccccatgtatcaagaagggcaacacctaagaagcaacaaccatcatccactgcagatcgcttaagggagcttagtgagactgatgataacgaagatgggttggtgtttagaaagaggaaatttgcaccacctttggatgagacctctgcacctcaagtgaagaaggctaaaccaacaccacaaatattcctctcattcgagaacagacctccgaccatccaacctcatccgccacttccaaccgcttatttcgcacctacaatcactgacaatcttgtgcctgtgcctccaccttcaccaccaaagtcaccaccatcaaaccctccacctttatccactgagggatga

SEQ ID NO: 42671 - DNA, 282 bp, Glycine max
  Peptide Sequence Number=SeqID_159449
atgatgttcttacatatcaagtggcatcaggcattgaatgaatctcctattggacataaccagtcccctaaagttacctcagaagctgtggccatcgctgaagatattaatgacatgtcatttatcagtgcacaatcagctgaagtcacctcatatacaacagacaagggacatgatggtttattggaggaagatgaaaatggagcaaaggattgtataattaaggatggaggctgggagaaggctaaaaatgaagtgacaagtttaaagaagcaagtctag

SEQ ID NO: 42672 - DNA, 372 bp, Glycine max
  Peptide Sequence Number=SeqID_159450
atggcagactgggctcgacaccaaactcacaccatcgattctctctgcggccactaccacctttgccgcctccgtcacaacccggagcgtgcatttgatagcattgatgggaggtatcagcggtcttttgcaagcaagagcattgattctgaagaaaatgtgagaagtagtatcgaagggatggttggaaatatttatgcatcttcgagcatactagcttctagcatgcttctgtttttcttgttcaccctgttcgagtttttaaccatgtccttatttaatagggttgtatatgaggaattggggaaatatggagatctggataaccaagttttgtgtcgtgagcgagttgaggaactaggaaattcatga

SEQ ID NO: 42673 - DNA, 234 bp, Glycine max
  Peptide Sequence Number=SeqID_159451
gttgatgtaagtgggcaagtcaagcttgcagattttgggttggcaaaggtgacaaaatttaatgatgttaaatcaagcaaaggctctccatattggatggcccctaaggttgttaacctaaagaaccaaggtggttataggttagcagttgatatatggagcttagggtgtatagttttggagatgttgacaaggcagcctccttattctgatttggaaggaaaaagaaaatga

SEQ ID NO: 42674 - DNA, 177 bp, Glycine max
  Peptide Sequence Number=SeqID_159452
atggaagatcaaggatcgagctcacaggaactttgtttgtacttagatcaacttaatttttacgcaaccttcgcgctaagtgcacttggcgagtatgaccgtattgtcgcgctcagcgcgtgtctcgcactaagtgcgccttcacgtttcagacttctccatacttcctcgtgttaa

SEQ ID NO: 42675 - DNA, 759 bp, Glycine max
  Peptide Sequence Number=SeqID_159453
atgggctcttccaagagaggtgttgggaggtgtgttattggaaggagatatggtgggagtgagcttagggagccaatgagtcagatggaagagttgtatggggtttcagttataggggactatttaccttggtttgattggttgggaagggttaatggggtgtatggtagagcagagagagtggcaaaacggcttgatgaattttatgatgaggttgttgaggagcatgttagtaagagaggccttgatgggcatggggatgttgatagtgaagaccagaatgattttatgggcattttgctgtcgattcaagagagtatcaccacagatttccagattgataggacattcgtcaagactttggtcatgttattatttgcaaattgtaactatgaagccagcatgtttgttgcaggaagtgatactacccttggagtcctagagtgggctatgacagaactcttgaggcaccaaaatgtgatgcaaaaactacaagatgagagattctcaaagagttcaatgaatatcaaaggacatgatttccaattgatcccatttggagcaggaagaaggggttgttcaggaataggctttgtcatggctttgaatgagttggtccttgcaaacattgtgcaccaatttgattggtcagtgccaagtggagtggttggggaccagacacttgatatgtctcaaactactggattgactgttcacaaaaagttatctctcgtgactcttgcatcacctaatgtgtaa

SEQ ID NO: 42676 - DNA, 210 bp, Glycine max
  Peptide Sequence Number=SeqID_159454
atgggtgaccaccatgaatccacagcaaagacttttctgaaaaagaaaactcctcaattttttggctctccatctgttcaaggagtggagagatcatatgctgcaagcgcgccgtatcgatcatcgatcacgtcaacgttaacaacaaggactcaatttctaggtgcgtcaatggcgatgcccaaggaggcatttttggccaagtggtga

SEQ ID NO: 42677 - DNA, 1035 bp, Glycine max
  Peptide Sequence Number=SeqID_159455
atgacccaggcctctgttctagcaccacctgatttcacactgcccttcgtcctcgaaaccaatgctttgggtacggccatgggagtagtgcttcaacaacgctcttatcccatcgccttcttcagcaaggtattttgtccacgactgcaacatgcctcgacttacatacgggaactccatgctattacctcgacagttcgcaaatggcggcactaccttctcgggtatccctttgtcattattactgaccacaaaagcctcaaagacctcatgtctcaggtgatccagatgccagagcaacaacattacctctccaagcttcttggttttgattactccattcaatacaagcctggctccgataatgtggctgctgatgccttgtcacgcatccacaccttggagaatcagcattttgtcttatccatggaaaatttcaaattccttgaacaattacgactctcattgcaggatacccaagagttttgtgactttttgcatcggattcaggataaccccagcgaacacactaacttctccgtcagtcgcgggtgttgcaaagactctgcgcaggctaaagataatttcttttgggcatctatgaggggggttgttcgagactttgtctctcgatgtctcgtctgtcaacaggtcaaatacgagactctgaagcccgccaaccttcttcaacctctccctattccctgcactatttgggaagatttgtcaatggactttatcaccggtctccctccttcccacgggctcttcgttatcctagtcgtggtggaccgcttcacaaaaggggcacattttggtgctctaccggtgacatacaccgcccacaaggttgccctactattcattgatatcgtctgtaaattacatggctttccaagaagcattgtctctgatcatgacccgatacttatcagtcgcttttggcgcgaattattctgcatttttgataccaaactgcgcataagcacctcataccaccctgagatggacggccaaacagaggtgctcaactag

SEQ ID NO: 42678 - DNA, 1449 bp, Glycine max
  Peptide Sequence Number=SeqID_159456
atgcctattgggcatcctcagtccactggaattgatcttttcgaaataacatggttagagcatggcactgatcttggaggggtcaagggccactcccgctgccgagactatatggcccaagtactgaagttcagttctggcaaacagacacttctgccggatgtcattgaaaaagaatgcaacgaacttgcgaagaaacggtttaagcaattcattcatcatggcttggaacgttgccagcgcattgcagaggccgaagggtattactttgtattcgtaatgtccttgatgggtgcgaaaagcagttttgggcacgtcgtcggtggccatggggatttgatgaaatccctgacggagctcgttaatgatgggcatgggaaaacggtccttggtagtgatggcgttcaaatccttgtagtcaacacaacaccgctagctcatattggctatttgacgctcaagctcaactttctgactatgagggtatcggtagggtcgtatattgacgggttgggaatcagggtggttcctgaaagaggtgatcgtaacgagaaagaaggtgtagtaggggaggtggaggccgaggtggggtggaagggaacattggcggtgagttggattggacggcctaacaaggagaagctcatggtgcgggagtggaacattagggcaaacttgttggcatatgagggtgccgccatcgccaatcataacttagagagggttgatgacggtggtgtgcaggagccatacatgtggaaggttgcttgggtaggcatgcctgacaaggcattgagactgagctgcagggtttctgatagcggtggaagaggaaactgtgagatcgggtctggtgtctcaagcgtgagtctgtggtctctgcaagaagtgagcttctccgaagaaaggcgtttcaccggcagcttgggtggtggtggtgaagtggtcgtggtggagagtgggcaaggagttgcagcttgtcctcctagagcttggccagggcgaaatgttgcggcagcaacattggttgaagggcttgcacctcacggcggagaggtagtcattgatggagcctctttgttgaagcttgaacaaagtgccatgagggtcctcgtagaaggatggtgcgaaacaagcttcgagggcctccacggtcagacgctcattgtcagggatgcaatgatagtcgaagaactgggtgattttgaaaatccaccccggtggatcattaccgtcaaatcgagggacgtcgagcttcatgtgcaaccggggaattggagaggaagggtgatttggctgaggcgttcaaggatagaatcaatttttgagtccatggttgattggctttgggaaaaggtggagcatagcctcctcaagtcgctccgtggttgcttgcttggtattgtgctcaggcatggaggcacgacagggcagatcagaccaagttga

SEQ ID NO: 42679 - DNA, 504 bp, Glycine max
  Peptide Sequence Number=SeqID_159457
atgtacttagacaaatttagtaaacaaacaagtcctaagacattgcagataaaatttgtgaggatgacattttacccatactcaatgatccaaattcaaacaaataagaaaccccaagcaagtttcaccaacgaggggaccggtgtcgctgaggacttggatctagatctagaggccttggtcgtagtaggagatggatctatcgatcaggccaagcataaagaaggtgttgtcaagctgcatgtagtcagagaagacgacgagggcatgattggtgccacattcaatgtcagggacttggatagtgcatttgaggacagggacggcttcttcgaagtgtccgaggttgtagtagatggcaacaaggatgtggaagctcatggcaagatcgaggttggactctcccttgatgacacagtgctcaaaggatttggaggcaatggtgtcacaagtcgagattcgggttgtcaagagaggcatcagaaagaattggaggggttttaa

SEQ ID NO: 42680 - DNA, 354 bp, Glycine max
  Peptide Sequence Number=SeqID_159458
atggctgaatcacttactataattgtgagaagtaagcagtatcttgcgacacaaaagccagtaaatctggctctcggctatcggaatccacatggatatgggttcagttttggatcgagaagatcaatacacgagagggtgagctctcatttcaagggcatagctgttatgacagatgacaaatcaacaatgtcatccaccgaggaagacttagaaaacattggcatctttcatattgatccatccctaaagccatataaagatcacttcaaatatagactgaagagatatgtagatcagaaaaagcttattgaagaatatgaaggaggtcttgaagaattttctcaagtttaa

SEQ ID NO: 42681 - DNA, 495 bp, Glycine max
  Peptide Sequence Number=SeqID_159459
atgacggtgataccaatggtggtagttggtgatgttggtggtggtgcttatatggtgttgatggtggtatttaaggtggcggtgatggaggtgcaaatagaatcccaatcttcctatgtagtgtcctccggagccaaacctgtccactgcaccaagacttttcgaacaggggaacgggtgtatctccccgatatggcttcaacagggagacatggaacaccggatggattttggaggaagtgggaagttgcaaccgataagcgacatggccaatgcgttccaagatacaaaaaggcccgtaaaaacgtttggagagtttggagtatgcgggctgaagggaagtttggcggtaaggctggagccgaacgaaaacctaatctccgacatcaaagtggacgtcccgactgtgagaatttgttgtcctttccattgcggcttgtgccttggcgaggcgatgttgaagggaagagtgtagttgggttcttgacgccatga

SEQ ID NO: 42682 - DNA, 1692 bp, Glycine max
  Peptide Sequence Number=SeqID_159460
atgaatgaaacagcttttaatagtgtcgaaagctatttgtatcttcacccaagtgaaaacccagctactgcccttgtctccccagtgctggtttcaactaactatcactcatggagtcgttccatggtcactgcacttagcgccaaaaacaaattggagttcgtcgacggaagcgcgccggaaccactgaaaaccgataggatgtacggagcctggaggcgatgcaataacatggtcgtctcctggatagtccactccgttgccacttccataaggcaaagcgtgctctggatggataaagcagaagatatttggagagatttgaaatcaagatattcgcagggtgacttgttaagaatttccgaccttcaacaagaagcgtcgacgttaaagcaaggagctctctcaataacggaatacttcactcgattacgcgtgatctgggatgagatagaaagctttagacctgacccggtctgcacttgtaatgtccgatgctcttgcccagtttccaccattatcggacaaagaaagcttgaagaccgagctatgcaatttctgagaggtctgaatgaacagtatacaaacattcggtctcatgtgttacttatggatcctataccacccatatcaaagatcttctcatacgtggcgcaacaagaacggcaactgttaggtaactgctctcctaatctcaattttgaatctaaggaaatctccattaatgctgcaaggtccgtttgtgagtattatggacgaatcggtcacacagaaaatgtgtgttacaagaagcatggtatgccttctaatcatgaaacaagaaacagaagcaatgggggaagaaagacttgtacccactgtggaaagataggccacacgatcgacgtatgttaccggaaacacggatacccgccgggatataagccctacagtggaagaaccacagtcaacaacgtggtaacgatgaatgacaagtctatggaagatcaaacccagcatcatgaagtccaagatttcgttcgattctcacctgagcaacataaggccctactcgctttaatccaacggccgtcgactggaagcacaacgtcggagcaaaccaaacaagtggcctccatatcatcctgcaccactgataaacttcctaacccaggtatgtcttcatccaccataagctcctggatactagattcaggagccaccgatcatgtgacttgttctctgaacaaccttcatgcatataagcctatcaacccagtaatagtgaaactccctaacggcaaccatgttcaagccacccattcaggcacggcgtacctttcgaagcacataaccttgttcaacgtcttatatatacccacgttcactttcaatctcatttcaatctctaaacttgtatcctctactgactgtgcactaattctttcttccaattcatgtatgcttcaggacacgaacaaacgtatgaagattggtatagttgaggagaggcatggcttatatcatctcataccagaccaaaacaataaagctgtttgctcaaccattatccaccctaagtgcaatgttataccaattgatctctggcattttcgaatggggcacttatcaacagagaggctccaatacgtcatgcatagaaacacccgaacaaaacggtattgcggaacgcaagcaccaacatttgcttaa

SEQ ID NO: 42683 - DNA, 183 bp, Glycine max
  Peptide Sequence Number=SeqID_159461
atgccggctggagaagaaggaaggtggggtcaagttcgggtttacatcatgacgttaggtgttttggcaccttaccgtcgacttggtattgaaaacatgggaaaaactcttgaaacaaaacatgctgaacttcacagcaaaacagctttgagaaatttagaagatgcaaacaaagtggcatag

SEQ ID NO: 42684 - DNA, 462 bp, Glycine max
  Peptide Sequence Number=SeqID_159462
atgctcaaggaagagaacacagaggagaactacagtatgttccatgattccttagctctccaagacaccgagagatcattttatgaggttatcactcacaatcacaactacccttcttcttccacccaccatcatgttcacaactaccttagcgtggagagccctgaccaaagtctctcttgttgcagcactagcagctccgctgagtctcagtggagaaaccttgaccatattcctgataactttgttttccactctaattcaaccaccaacatgaatactggatttggattcttcaacgattccctgcaggctgggtttcttgattctacatttctacagaaattccagagaggtgtagaccaaggtgcccagttccttcctaaacatactccattcattattgccccttctttcccaaaggctcctcatctggtaattaagacagaagcagaagaatga

SEQ ID NO: 42685 - DNA, 252 bp, Glycine max
  Peptide Sequence Number=SeqID_159463
atggcaaccaaaagcaaaacttaccaagacacagtagagacagcagacacgagaagaggagcaaaaagtgctttggtgtcaatggctgcaaggaaagcaacgtcaacagacacaacagacacagtagacataaagcaagaaaacttaccaaagcacgaccagggtggctttgcgagactccgcgtggtgggtcaaggacaatggcagtgcagagggtggctttgcaaggtgggtcaagagcaatggcagtga

SEQ ID NO: 42686 - DNA, 213 bp, Glycine max
  Peptide Sequence Number=SeqID_159464
atggcaacttgtaaagggcaagaaaaggtggaatcgaagatgatgagtgacgctagacactttgtgactggcacctttgtcgatggtgtggcactaaacgcacttggtcttgaagatcttctcatcgtttttagagttttcgggaggagcttcatcgaacaacaaaagttagaagcaatagatggaagctctgtcatggtgggactagagtga

SEQ ID NO: 42687 - DNA, 225 bp, Glycine max
  Peptide Sequence Number=SeqID_159465
atggcgcctcccaagtcgtcgacttgcggcggcatgacgagggtggagtacgaggctacccttcacggagacatcgtggttatgttcgtgaaagggctgaatcttcggtcacacaagatctcggatccaacccggatccggtgccatttggggctgaaagtttccacaaaggcaatgcctttttacttaccacgagagttgtttctatggctcaagaagttgtga

SEQ ID NO: 42688 - DNA, 201 bp, Glycine max
  Peptide Sequence Number=SeqID_159466
atggtaggaggcggtggcaggggggaggcttgtgttgggtttcatgattgttgcgacaaacatcccgtgaacattgttgcaagccaactgtgtatctctactaaattcacttctactgaatcctcaatggccaaatatccacttcgatctattgaattcccaatagctgaatttcacaatagctcatgccacttctactga

SEQ ID NO: 42689 - DNA, 165 bp, Glycine max
  Peptide Sequence Number=SeqID_159467
atggctgaagaaggacgcgctacctccaagagacgagcgtactccctctcctcctcctcctcaaatttaggggcctccacacctatgttggcgaatgctttgattccttggatggtcgctttgaaggcatggatacccgcatcatacaacttgaagaggatgtga

SEQ ID NO: 42690 - DNA, 504 bp, Glycine max
  Peptide Sequence Number=SeqID_159468
atgtgtcacctaactgcaaatgtttgtgtttactacaatggccaaatctacaacactaacgagggccccaccttcattagtaacaacataaaaactttcatggtcaacaaggccataacccttacacaattgcttgaacttgttccccaaaaaataagcattgagccacacaaacatatccaacatctctgctttcaatgccctatatttgagctaggacaaccacatatgtacacatgttttattctgggagatgatcccgaccttcgaccaatgttcaacattttttacaacaacccaacactaccattcgtggagttatttgccacaatttatgacaacaataacccaccaaacaaccaacatgactcaacctccaatgttgaggacctattatacgaatacgagagttgttgggtcaaagaccatggtaatgatagtgactcctcttccaagccgcaaggatgcaacacgtctccttcccacgaaccaatattcaaatga

SEQ ID NO: 42691 - DNA, 531 bp, Glycine max
  Peptide Sequence Number=SeqID_159469
atgcatactggggcaagatttcacccgtgtcgctgcaaagagatgagtgtggatcgtgcgcaccagcatgaccactcttacacaggggtagcgcccacaagacacccggaggagcccaacagggccctggggtttccagctctggttacgggcctctgggtagcgcccgcaagacacccagtggactcagaggagcccaacagggccctggggtttccagctctggttacgggcccctgtcagtcttacaggggatcgtgcctgcaagacacccagtggacccgaagaagtccaacagggccttggagttgtcaagctataattacgggtctctgtcagttatacggagtgcttgtcatcgccagcaagggcatcagaccccctactaatcgagctttcatcaagaagtactgcgtccccaggcaggcgcagggcgaaacaccacagcagcttggggatggccggcagcgggcaacagacgcaccgccatcacctatagagttcacctcagctcatccacaaaaaggttag

SEQ ID NO: 42692 - DNA, 423 bp, Glycine max
  Peptide Sequence Number=SeqID_159470
gtgaggctcaaggattccgagataatttttcttagggagaagttggaggaagctaataggcaaaacaaggcaatcgagaatagattgaatcaaattggccaactatctgttcttgataatcttcacataacaggattaagtcctagccatttcatcacggttcttcgccacacggtccggtccattatcaactttgtgaggctcattgttgatgacatgagatatgcaggttgggacattgatgccacggttgatgccatcgagcagaatgtagtttatatggcagaagatcacaagtgtttcaccaagatggcgaagagggtgtggcttctacactgcttggccttctcctatgagcctcaggcttcaatcttccaagtagggaaatggtgcatattctctgatgtgtacatggaagtgtga

SEQ ID NO: 42693 - DNA, 498 bp, Glycine max
  Peptide Sequence Number=SeqID_159471
atggtttctaattgcatgttgcccaagtatggtgctgatctttttcaagatccaactttatacagatcagtggtgggtgcactacagtatgtcactttaactagacctgaaatcagctttgctgttaacaaagtctctcggtttatggccaagcctcttgaatctcattgggcagtagttaaaaggattttaaggcgttcaacctcaggggcagctatctttcttggtccaaatctgatatcttggtggtctcaaaaacagaagagtgccatgtcaattgctcaaaatcctttgttccacagtcgcaccaaacatatggagatcgatgtctttctcgttagggaacaagttctggcaaagaagctcttcatctttcatattcctgctctggatcagtgggcaaatgtgctgaccaagcccctttcttcagctcgttttgaatttcttagggacaaactcaatgtgaagagtttttcctctaaaaactcttccctttga

SEQ ID NO: 42694 - DNA, 129 bp, Glycine max
  Peptide Sequence Number=SeqID_159472
atggctggggaggagaagggtctgagtggtgttaatgagatgagggataatttcagcaaactaaaagacaataatttggagagtacgatgagccctacactatatgctctagatgcagctgtgggctaa

SEQ ID NO: 42695 - DNA, 573 bp, Glycine max
  Peptide Sequence Number=SeqID_159473
atgtggtaccatccccaaggaaatagcttaagcatgtccacacgacactctcacttaggaaaactaggtagtaagtgtcgaggccactctgtcgtgcacaggcaactcctccccccccccacggtgatcagcctgagtctcaagggagttctaaaccgagtgacacaccccctagtacaagtattcctcctcacaaggaactacaagtacttactggcaaagtttatactatttccgtgtcatatgaagtatgaaacatgggcaccatcaaggacatccgacaaggtcaatgcaccctcccataaacatacaacgtatgaaacatgggcatcatcaaggacatctgacaaggtcaatgcaccccctacgaacatacacaacatccaacgtatgaaacacgggcaccatcaaggacatctgacaaagtcagtgcacccctccatgaacatacaaaacagacatcatcacagtgtatttcagcaccaacaacatttcattttaatatcactctcaacatcaatatcctttcatctcaatgacattgtcaataacaaaaacataatctcattttaa

SEQ ID NO: 42696 - DNA, 612 bp, Glycine max
  Peptide Sequence Number=SeqID_159474
atggttgtagcagcaggaatcggttacactatgtcacatggggggtgttttggtgcttgccgtgagtgtggattcttcatgatgcattggcctcatccttgtcccaaatgcactggcattggcccaatcattgactcaattacagtccttgggttcgatctggtcaagaatcatctttttcagcaactgcttactagtcccatcagttattgtcatagacatcagtttatcacaactgcttactggtctgtccttgtcccagatgcattggcctctaatgtccttgcatcgttgtcatggcttgcaaaggttgatgcacttttagacatggtggaggggctccaccatacatgccatcaagatcacattcaagatttgaggcgtttgcaacagcatggcaccttggcagaatttaataatgcatttgatgcgatttctgggggtattgatataaaaacttcgtaccccattgcccagaggctcttcgctatgcgaaggtatggggagagatgttgtacgcagccttaccctttcatatgcaaagaggctgtttccggattcgaacccatgaccaacaagtcaccaaggcacaactttatgtcaattagttag

SEQ ID NO: 42697 - DNA, 1509 bp, Glycine max
  Peptide Sequence Number=SeqID_159475
atggcacttctgcttcctcaagcagttcctctactgaggactgtttcaacagataaggagtttactgttaggccttcagatatgttgccttgtcaggtgaattccaaggatgaacagaagggatatagtgtggatgtattgccttctgatattgttgaagctggtagatctagtttcaataaagaaatgtgttctcaacagcttcttggtcatgacttgacaaatggaacaatcacttgccatgcttcggggttggactttaaagacatgcctcagaattgtgatgtatgcattcctgaatctgttctagatgacatgtctcctaaggatctgattatttatgaaagaagtgatgatgcttgcttacatgtgaaagaaaatcctgcgcatgtttttctcagttctgtgcaaaaggacctgccaactgctcaggattttactgggggtgtaaaagcaaagagctatcaattggaaaacatggcaactcttgcagaaaagacacaagatgaagttgtgggtcaaacaggcaatgctgaaatgatgattatgtcttcaaatttaccaaaattagtatacaccagaaaaaagctccgaaatgatattcccttccaagaaaattgttcagtcatggagtgtactgaatatgacaaatttaaacatgttactcctgaaatgtatactgccaaagacactttacatccctcagaaatcattctagtaaacaattctaatgataaaccatgtgaaacagatgatactgcaggtttatgtgttcaaacacctcaaattcgtagtgatgttctgggtggacatagcaacctagtggatcctaacccaacatcgtctcagaatctaaccctgtttgctgatgaaaataagtgctttggtaccaaggaggttcaattaatttcagaaccaatgcccctgcaaaaccaggagctcaagaataatctgggcagcagtgttaagtttgtgggacgttacttgcacccaatgcctgtttcatccttatttttaagcacaagagaggatgaaatccatgtttgtgtcttatgtggctatctgactggtcagtacaggaccctgttcacgtacaaggtagctattgctgaaccaactttagggtgcccttctgtcatggctcacagctcaatactgttgccagatccaaaacataacttcataaaagaaactatggtggaaagatctggggtgcagttgactcctggtggacagtatgttgtcttaataggcagcataaagacccccaattgcagggaaggaaagattgattgtcattgctcaacatgtaaatcagtctgctctgagaagaacgctttgaagattgtccaagtagaacatggttatgtatcagttgtaacaacattggaaactgttgacaattgggaaactgcaggtgtgggtcatgaattcaaaatggaggtgattatggtgactctttttgctcttgcattccctagagccatttatgtccctttcagaatatga

SEQ ID NO: 42698 - DNA, 678 bp, Glycine max
  Peptide Sequence Number=SeqID_159476
atgaagaagttgattcccatgcctcaacaagacaaaaatagcatggagggaagtgggtcagaattcaatgaagcaaaggctagttcttgggaaagaaaggtagaactatccagctttgatagaagcatagaaggggaaactgatttgaagggtagcaattttgagtgtggtagtgacccattgcagttcttgaaatcagaaaacagaagtaaagaaggttcagtaatcaagaaccacaccctttgtggtggagaagaaaccaaaaatgatgaagcaaagttagcaatagaaaaaaagattgaaaaggttatggaggaagaagttgatccaccgataaagagggagaagcccaaggaaaacggagtgacgaatgtgggctgcgaagacaattttcttgataacccaattacagatttaatcaagaaggaagtcgaagctggtgattcaaccaagccacattgttttcaagattcagatttccataaaaagattgttatggtgaaacaaaaatcattcatgaaagtggttggaacaacaatggtgctgaaatcttggaatgtcaacttgttgggtgagcctttagcattaaattttgttgcatctatggctgacaacttagccatggagctaaggcagaaggagtgtactgagccagtcaagctaattaaagttatatga

SEQ ID NO: 42699 - DNA, 411 bp, Glycine max
  Peptide Sequence Number=SeqID_159477
atggcgaagactcgaagcgctgagaaagccgcgcaagtagatgcggaggacagaaccgatggcctcgaaataatttccatcggttccctctacaaaggatcctgggataagaagtactggaccacctctaggggaaaagatcggtatccatatccagttggttatcaagctgttagagcttataacgggaccacttataagatggaaatttgtgaaggtgtcaatggccctagatttttgatttcttctgatgatgggagttcatcttctgggaaaactcctgaccaagcatgggaggagtttcagaagaaaggttgcccacgaatcaagatttggcatgggaagagactttcatctaagatggatggcttggaggtagaaattattgatgttgatgaaatctatttgtaa

SEQ ID NO: 42700 - DNA, 705 bp, Glycine max
  Peptide Sequence Number=SeqID_159478
atggtgcatgcaacttatattgttcacccttttatttacatttttggcagcgaaaagatagagtacttcattattccagctgatggctctgtatcccctggcattatggagttgaagagggttccgaagtgtactcatttggttgttggtcataatagtcgtggggaatttagtttatgggatattgcaaagtgtaattgtgttacaagtttctctgctttaaaaagtccagtaaatgagttctttccaataagcttgttccagtggcaaacaaaaggctcaggattcagcaatgtgaatatagaggagcaggctgataaacttttagaagcaaccaatttgtggtactcagagcagagagatatctgttggttttcaccaatagaggaagatgttgctatgtggctttttgtctcgactacctctgaccttgattcttgccataatcatgtttcaacttcaagtagttatgatatacatacagctagaagttggaggcttgctcttttgatgaaaaatagcataatttttggaagtcccttggatctaaggacttctggtaatggtgtttcttgtggttatggaatcatcagtacaagtgatggagtggtgtatatgtgggagttgtctaaaggatccaagcttgatactctgcatcatttccaaggtatgttgcaatgtgccactttcacttgtatgctttga

SEQ ID NO: 42701 - DNA, 558 bp, Glycine max
  Peptide Sequence Number=SeqID_159479
atggctcaaggagactattcaagaccacatagggacctacaaagccaacaaaccacagtggaggacacccctagagcaacaaaaccaagtggttgctccacgtacacttcctcaagatcatcatgtagaaaatcatttttaatatcaagctggaacagtggccaatggcgaatagcctcaatggagaggaagagttggacaaaagccatcttggccacaagggagaaagttagtatagtcttgcctaaacacttgagtgaagcccttcgccaccaatcgagctttaaatcgatcaatcttgccaacattgagggcataaagccaacatcaacctatggtggattgtttaggaggaaaaggaaccagatcccaaaacaattaccttttcgaagtgcaatggaaggtcaaggtcaaatgctaagcctagatgtagtaaaggagttggcatcgagggtcgattatgacctcagcttctacaagaggatcagggaggcgtgggcgacaatatatccgaaatggccacattgtcggagaatgcttagatgtgtcttcctatga

SEQ ID NO: 42702 - DNA, 315 bp, Glycine max
  Peptide Sequence Number=SeqID_159480
atggctataattgcagtcgttatgttgtccgttttttgtgtgacaagtggtgaggttgcattgagaaagtggatgatggatagagatacactggggtatagtaggcagagagatttgaagaacataggagaattagtgagtggtgactacccagcatttggtgcacttatttggcgtgggagtgaaggactcacttctaccatcaacaactttcagctactgaccctgccaagtacacagacgcatctgcgggcttggcatagttcacagagagagcgggtatggccctacatcgtaaagtggactacacgttag

SEQ ID NO: 42703 - DNA, 1533 bp, Glycine max
  Peptide Sequence Number=SeqID_159481
atggctaacagcaaatatgagtatgtcaagtgttttgaagttgaggatgaggtcatgtttcctaatatcattcttgtttggatcaaggccagtaaactccataaacctcatgatttaaatgccttgaaattgatgaactcttgcgctgttgaagttcttgaagagtatgcagacgtagtccttgcatatgggttcagtgatgagtatacttttgttttcaagaagacctccaagttctatgaaaggcgtgcaagcaaagtgctatccatctttacttcttttttctcatccatctttgtgagaaaatgggatgaattctttccatacaaggaactacaatgttctccttccttccatgggcgagtcatagcttgtgcatctgtagaagctcttcaagtgtatcttttgtggcggcagaatatttgtcatttgactaatctgcatgagcaatgcctttggcgtcttgttgaacgtggaatgaatgggaaggaagcatgggatttcatcaaggattttgacaaaggtgagctaaacaatcttttatttgatgagttcaatgtcaattacaatacactagagccgatattccgccaagggtcttgtgttctgaagacaatcgttgaggatattgtgaagtacacagataatggtgctccaattaaaaggtgcaaaaggaagataatcacagtgcgttccaagaaaatagcaagtaagagattttggaatgagcatactgttcttttgaaggagcttggtgggtttgttgaagaaattaacaatgtgactcccgagtatgtgaggtcctttgaatttgatagcaaattgatgccgtctacatggattgtagttcgaatagatggatgccacttccacaggttttctgagatacatgaatttgtaaagccaaatgatgatagagctcttaacttgatgaatttgtgtgcagtcgctgtcttagaaaagttttgggaggatatagtctttgcctatggggttagtgatgagtatagctttattcttaagaaagccactaatctttatcaaaggagagctaatacaataatttcagctattgtgtctttcttcacatccacttatgtgatgagatggaaaaacttcttcccacaaagtgagttaaagtaccctccttcctttgatggacgagcagtgtgctatccatctactgagattctacgggactacctttcatggagacaagtggattgccacatcaacaatcaatataactcttgtttctggaagttagttgcatctggaaaaagcaaaagggaagcccaaaatagtttaaagggtgctcagttgcaaaagaaaattgaggaattggctattgactacaataatttaccagtcatgtaccgacaaggatcctcggtttatagggacaaggtagatattgctctaattcatcaggagaatggagagtttcctgaaaattatggaaaggttattgtaggacatattgacattattggaccaaccttttggttggaacacccaaacatccttgattaa

SEQ ID NO: 42704 - DNA, 375 bp, Glycine max
  Peptide Sequence Number=SeqID_159482
atgggcctcaaaagaaaaaataacgtgccagttggaagacgaggaatttaccaagcagcggaggttaaggagattgctgctgagctggctagattgagcggaggtatagtgcttgacattcatgaagataacacaataataatgtacagagggaaaaactactctcaacccccaacacagatcatgtctccacgagtctctctttcaagaaagaaggcattggataaatccaaatacaggcttgaacaagagcttgcaattcttcgtgcacaatttaaaagttcagctgaaagtaaaacagaagctgctgaggcaatccagaacagtggcagagagagtattgagtctgggagtatctcaaatttccagctatag

SEQ ID NO: 42705 - DNA, 324 bp, Glycine max
  Peptide Sequence Number=SeqID_159483
atggaagttccggagcatcgtaagtggatggatgagaggacgggtcctgataagaaaaaagtcacaaatgaatttatggcaggggttgttgagtttattgactttgcttgtgcaaaagaaaattataaaagagaaggaaagttgaggtgctcatgtaaaaaattcaaatgtatgaagtatcatttagttgatgaggtcaagacgcatctttgtatgaaagggtttatgagtgattactactattggactaatcatgatgaacaaaggcctcccattccgccaaccatttcaaacaactactattatggaagtagtggagtttga

SEQ ID NO: 42706 - DNA, 270 bp, Glycine max
  Peptide Sequence Number=SeqID_159484
atggacaaagatcagtggatgcatgacagtataatgtctgaagaagttgatatgaatgaacaaaatgaagacgaagctggtgtgaaatcagagcatgtgtttcctatccatgatgatgttttgaattgggctcaagctgttacttatgaaattgattctgtggcggtgattataaggccagacacaaatattggtatgagaggaaggacgtcatttgttttaattggttgtgaaaggagtggtcagtataagaccaagaagaaagatttg

SEQ ID NO: 42707 - DNA, 519 bp, Glycine max
  Peptide Sequence Number=SeqID_159485
atgggatcaagtcaaaagccttcgcttaaaaagaggttctatcaagtcaaaatcaagagcttagaggtcactagtttacgagagttggggcaattaatgggtcaacttcaacagcaagccttccgcaaagcctatggtaagatttgggacctagctagggtagaagtctccatggaaccgattgcatccctttcccagtattatgaccagcccctaaggtgcttcacattcgaggacttccagctagtgccgactgtgaaagagtttgaagaaatcctgggatgcccactgggaggaaggaagccatatcttttctctgggttctatccctccacgacaagagttgccaaggtggaatggggtagtcggagtaccaaggaagtgtttggaggaaagggcaaaggccttggaaaatcaagggcgaatgggcttttttttattgacatcttggcacttttgatctttggagttgtcctcttttccgaatatggaagggttagtggacctagcagtgattga

SEQ ID NO: 42708 - DNA, 480 bp, Glycine max
  Peptide Sequence Number=SeqID_159486
atggcgaccctgctacaaataccttcaatcccgcaggtgttggctcgctggcttcagcactgggaaacgtacggtttcggtaattgggctatcgcgctgacggacaatccggggagagtcattggttttggcggactcagtatcaggagctatgccgatttatcaatcaataaccttggatatcgcttcgctacagaggcatggggaaaagggctggcgacagagtttgctaagtatacggtcgactatggttttggtgaaataaagttggctgaaatatctgctgtagtacgggcaaatcatctggcctcgcaaaaagtgctaaccagggcaggattgcagtacttacgagaaattcatgatgtgaaaagtgcgcccccaagcttgcttttcaccttgactcagacaagtggaataaaaaataaatatgcggggcacactgtctcccgccggataacatcaatttccgctgtgctctaa

SEQ ID NO: 42709 - DNA, 310 bp, Glycine max
  Peptide Sequence Number=SeqID_159487
ttctatttctcgatggaggcaagggatataactcagcggtagagtgtcaccttgacgtggtggaagttatcagttcgagcctgattatccctaaacccaatcgaactccagtcgaatatgaagcgcctggatacaagttatgccttggaatggaagagaattccgaatcagctttgtctacgaacaatgaagctataagtaatgcaactaggaatctcatggagagttcgatcctggctcacgatgaacgctggcggcatgccttacacatgcaagtcggacgggacgtggtgttcccagtggcggacgg

SEQ ID NO: 42710 - DNA, 312 bp, Glycine max
  Peptide Sequence Number=SeqID_159488
ttttccttgaccgagtctaggaaggctcaagaagacctcatcaaggctgagaaagatttggttgaagttaccaaagaacctttaaaagatgacctaaaaaaggtgatagactcagctcaaacttttcaagatgaggttgaacgtcttaatcaagagtttgcacttttcaaggctgagatccttaggactcatgaagccagttttaagaaggctctccatcaagttaagttctttttgaaagatgttgatatttccttctttgatgttgacaaagacattgatcatcaaggggaattggttaatgaagcttaa

SEQ ID NO: 42711 - DNA, 642 bp, Glycine max
  Peptide Sequence Number=SeqID_159489
atggatatcattccagacaagtatcccctaagcgtgcagaatatcaaatttggatctaaattgtatgtcaacgctgatattacagagatacacgaatttcgtcaaagtttgtctgtcccattttattctggtgggataatcaatgataaagatggttctcagtcccaatctagccagagtaatgtggtggaaaaatttctgcagaatgctcaagtggattgttactgcttaactgttggaacagttgacgaaatcattattgatgctccatggagttatgacagttgtcctaactgtactaccacatttgatccatcaaaaggtggctcagcttgccgttcttgccataccagtgtgatcgatacagttccacggatgaagcataatgaggacaaaggagacttccttctctgggatgcaacatgtatcaagctgtttggtaagactgctggagaatgtcgagatgagttgataacggctggggatgatattaaggtatttccaacgtgtgttgatgaaatcctgtcgcaaacttgggctgtcagatttaagttccgttcacaattacgccaatcatctgtgttggatgtgagtgaagtactccatcatattcaatcattgatagccacccttgggttgtag

SEQ ID NO: 42712 - DNA, 615 bp, Glycine max
  Peptide Sequence Number=SeqID_159490
atggaggaaaaatgttctttgaaagataatcagataaaggcattggaagagcaactagcaactgcggagaagaaactgcaggtgtctaatatatctgcatacgagacaaggacagagtacaaaggacaacaaaaatttgtgaatgagttacaaagacgcttagcagatgcagaatatatacttatagaagaggagaggctgaggaaaaaattacataataccattttggagttaaaagggaacattcgtgtattctgtcgagtgaggcctttattagctgatgaaagttgtagcacagaaggcaagattttcagtcatccaacatcaatggaaacttctggacgagccattgacctagcccaaaatggccaaaaacattcttttacatttgataaagtttttacaccagaggcatcacaagaagaagtttttgtagaaatttcacagcttgtacaaagtgctcttgatggttacaagacagggtcagggaaaacctatacaatgatgggaaggcctggacatctggaggagaagggcttgatacctcgttcattagagcaaatatttcaaacaaagcagtctcaacaacctcaaggctggaaatatgaaatgtag

SEQ ID NO: 42713 - DNA, 648 bp, Glycine max
  Peptide Sequence Number=SeqID_159491
atggatagatttcctgcttttctccagagtcttgaagatatgaataatgttgatatgatgtataaggttgatatgtccgcatcaacatcagtgattactaaagcactggttttaaaagccgttaagccttttgttggcgataatgattatgtatttagactagtaagttctttacttgagctacctatctatacaaaggatggggataaagttttagtagggtctgatgatattcctcctcctcttggagaggtttccagattgctattcaactttgtattaatggacttatttgatcgggagtttgtcaaatgttttccagaaataagatttagacgattttcccatgaggtcttcgtagcaactgctgatatttatgatgtctttttctctgaaaagagttgttatgctttattggggaagataggtttgagaggcgaaatctattctatttcacgagggggagggtaccttacctccgggggagtgaacgagattctgcttcaagttactagagtcaattatcataaaccagctcttacaaagcttatgactgcaagaaaatcaattgagaccttcacaaagatgttgggaaattccctaacaaaagaccttattgaattgatgcattcaaacgctaaagaatga

SEQ ID NO: 42714 - DNA, 273 bp, Glycine max
  Peptide Sequence Number=SeqID_159492
atgcttcagagcttacacagggggcaggtggcctggccaggagctcagccttctccttctagagggggtggggccttcacagcccaggagcctgagccaaaggagcccgtcgtagcagttgaggagccagcagagggggaggatgagctcactcctcccgagcccttttattatgatacagatgtaccctctacagatcagatgccagagccatcccctgcaccagctcctcaggagaccttgccatcagtactgttggatcaagtggcctag

SEQ ID NO: 42715 - DNA, 201 bp, Glycine max
  Peptide Sequence Number=SeqID_159493
atgtggctccgcatgccaccagactcttgggtcacgatttacgtagttcttgataactgtgagactaaaaatagtctcggtgttctcttcactaaaatgcgaacatgctttagtaaagagacaaaacttccaactgatcagagcagcatatgctttttggatgaaaaacaatgtgtctatcggggaatgagagtatgctga

SEQ ID NO: 42716 - DNA, 1064 bp, Glycine max
  Peptide Sequence Number=SeqID_159494
aggactacacgtcttcgccttcagtgtggctacacgccctcgcctttagaggactacacgtcctcgccattggagggctgcatgccctcaccttcagagtactacatatcctcgcttttagaggactacacatccccgccttcagaggactacacgtcctccccttcagaggactattcgtccgcacctttagaggactacacgtcctcgcgtttagagggctacagtacctcgcctttagagggctacacgccgtcgccttcagagggctacacgtcctcaccttcagatggctacacgccctcgctttcagaggactacatgtcctcagcttcagaggactacatgtcctcgcgtttactaggttacatgtccacgcctttagagggctacacgccctcactttcagaggactacacgtcctcaccttgagagggctacacgctctcgtattcagagggctacacgccgtcaccttcagagtgctgcacgccgtcaccttcagaggactacacgtcttcgccttcagaggcctgcacgtcctcgccttcaaagggctgcacgccctgcccatcagagggctgcatgccctcaccttccgagaattacacgtcctcgccttcagaggactacacctcctcgcctttagaggactgcacgttcttaccttcagaggacctcacgtcctcactatcagaggattgcatgtcctcgcctttagaggactgcacgttcttgccttcagaggacttcacgtcctcactatcagaggattgcatgtcctcgcctttagagggctacacgtcctcaccttcagagggttgcacgccctcgccttcaaaagagggctgcacgccctcaccttgagaggactacacgtcctcgccatcagagggctgcacgccctcaccttcagaggactagacgtccccaccttcagaggactaaacttcctcgacttcagagggctgcactcactcagctttagaggattacacgttctctccttcagaggactgcacgccctcacctacagaggagtacacgtcctcgccttcagaaga

SEQ ID NO: 42717 - DNA, 667 bp, Glycine max
  Peptide Sequence Number=SeqID_159495
ctgggcgctgggccgtgagccgcacgccgacgagcagcgcgacgcacgtgcgctgttcgacaaacattacgccgcgacggtggaagctggcagtacgctgtttccacaggtgcaggagacgctggctgcgctgcatgccagcggtctgccgctggccatcgtcaccaacaaacccacaccgtttgttgctccgctgctgcagtcgctcggcattgccgactacttttctctgatcatcggcggcgacgatgtggtggtgaaaaaaccacatccggcggcgattttcctcgttctcggccgtttcggcgtgcttccaggacaattgctgtttgtcggtgattcgcgcaatgatattctcgctgcccaggcggcgggcgtgccaaacgttgcgatgaccttcggctacaactacgcggcgcccagccttccgggtgaactgaccattggcaactacatgggtgcgctgcgtcagtgggtgcagatgcaggatgatttccactgcatttactgcatcgtcgatctgcacgccatcaccgttcgtcaggacccggccgcgctgcgcaaaagccacgctggatacgctggcgctgtaccttgcctgcggtatcgatccggaaaaaagcaccatctttcgtgcagtcgcacgtaccggagcacgcccagctga

SEQ ID NO: 42718 - DNA, 456 bp, Glycine max
  Peptide Sequence Number=SeqID_159496
aaagaccaaggtctaggcatcttagaggctgcaccttctaagcccaaaggtgataaggggaatacaatagaaaagcaactccctaaggctagtatgcaagagaagactagctctataacgtgctttaaatgtcttggaagaggacacattacttctcaatgccccaccaagaaaaccatgattatgaggggccaagacatttatagttgccaagatgaggctactacttcaccttcctctagtgaatgtgaagaagcaaaaggggaagaatctagcgaagaaatctacccccaagaagaaggacaaccattaatggttaaggaggagtgtaaggagacaattgttagcattgccacacctcttaggcttgagtttattcctcaagtaaaagagttgttggatgtggatttggttcgcaagagcttaaatccttgtgctttgttgtgcccaaaatag

SEQ ID NO: 42719 - DNA, 363 bp, Glycine max
  Peptide Sequence Number=SeqID_159497
atggtcattcccaagttcaaggtgctggactttgacaagtacaaggggactacttgtctcaagaaccatctaaagttgtattgtcagaagatgggggaatacgcaaaagatgaggaattgctaatacattccttccaagaaagtcttactggggtagctgttacctggtacactaacttggaaccttcccgagtccattcttggaaggacctaatggttgccttcattaggcagtatttggtcttcgccagtgaaaggatcaatgtgggtccgaaaagaggcaaatttgatcatcctactaggacgactgagaaaactggggcaaataaagagggtgaggacgagggagaacccatgctgtga

SEQ ID NO: 42720 - DNA, 324 bp, Glycine max
  Peptide Sequence Number=SeqID_159498
atgctgtttttggatgagtggagctcaactttgggtcatgcttccgtgtatggattccttgagccacaatcgatacacaatgcaaaggatcgatgtgctgaatgtgagcattacttacaagcatggctcaaggaatcacaacgagaggtgtacctaggagcttacttaaatcatgcaatgaagtcaacgaacacaaccgcggatggtacaaataatccagccactcctaagtggattgaagtcaagagccatgttcaaagcggggggtatgagtgtggctactacgtgatgcattggatgtggaacatcgtcagtaggggttaa

SEQ ID NO: 42721 - DNA, 332 bp, Glycine max
  Peptide Sequence Number=SeqID_159499
tgccgctctcgagtttgacaaccatcgtttcaggagcgctgagcaccagcagcgtttcgaggccatcaaaggatggtcgttccaccgagagagacgcgtccagctcagggacgatgagtacgaagattttcaggaagagatagctcgccggcgttggacgtcgctggtcactcccatggctaagtttgactcggatatagttttagagttttacactaatgcttggcccacggaggagggcgtgcgggacatgcggagtgcgagtttagtcagagaaagaactaggccgatggatttgacgaggaggccattgcccgacgtttcccctgagt

SEQ ID NO: 42722 - DNA, 252 bp, Glycine max
  Peptide Sequence Number=SeqID_159500
atgggccagacaactaccttaaggggattattaataggtcttgatgatgttccacaacctaaatcaaaggcttctgctaggtggattgtcgtcaagtgtaatagacaaaaaggaagtactgagtgcggctactatgtgatgcactggatgtccaccatcattttaggaacttttaggaataattgggaagcgtattttaacgatcctagaccattggagccagagagattaaaggcattgcggatccagtag

SEQ ID NO: 42723 - DNA, 324 bp, Glycine max
  Peptide Sequence Number=SeqID_159501
atgtcatatacttggaagctcaatagtatcttagaattgcaaaagcaagcttgtgtcgcactttcaactgccgaggctgaatatgtagttgtaggaagttgttgtgctcaaagtctttggatgaagcaacaacttgaagactttggagttatcctcaatcacattccttttaaatgtgataacacaagtgctattaatctaaccaagaacctagttatgaattctagagctaagcacatagaaataaggcgtcatttcctaagagatcatgtgtctaaaggtttttcaaaactttttgttttaatcgattacgccacgctttaa

SEQ ID NO: 42724 - DNA, 375 bp, Glycine max
  Peptide Sequence Number=SeqID_159502
atggaaggtaccttgtactctaccatcaatggcgtagagatggtgattaatgttgtcgtttggaaagcagtagtaggtatagacatgggtgaagtttgcaagtttgaggaatctacggatggctgcagcaaaatacagacgtacagaggtatgcttcttaatcctgcaagagtattgaggaatagattaggtgttggtgatttaacagctgaagacagaatgttggtttatatcattacgtatattctggcaccaagatgcaacaatcatgctcaagtcatggacaatggcttgcaaatcatatatgggttgaaattaagtattcaaattaactgggcactgttgattgaagatatcatgcttgtcataccctaa

SEQ ID NO: 42725 - DNA, 337 bp, Glycine max
  Peptide Sequence Number=SeqID_159503
atgtcagcatctttcgaccgagacatcgaaaaagtgtcatttactatccgtcaaactcaaattccggtagcatacaactcaaagtccggtagcatgcatcaaaagaagtatgtagaatacattctgaagaggttcaatatgatggagtgcaattctgtgatcacaccaactgaaactggaatcaagctacaaatagacggggatgagaaagaagttgatcctaccttgtacaagcaaattgtaggctcattgaggtaccaaggtaacactagacctgatattgcctattgtgttgggttgattgtttggtttccagcaagtgcaccggatcacacaa

SEQ ID NO: 42726 - DNA, 243 bp, Glycine max
  Peptide Sequence Number=SeqID_159504
atggtagttgaagaattgagggattttgaatatccaggacatggcatcagacccattgaaatgggggatgttaagggacgtgggacgagagatgaccttattgagtttggaatatatggaactttgcgtgcttgtgagggcactctggttttgggtcaggattgtaacggcttccttaagctgagagagagtatgagtgagtgctatcggccatggggaggaggcaatgaaagcaccaattga

SEQ ID NO: 42727 - DNA, 399 bp, Glycine max
  Peptide Sequence Number=SeqID_159505
atgggtcttcctccttcattacatcttcatcttctcgcccgatattcgccacgaggtcttggttttttaaccgctatcactggttcaagccactgccctagccaaacttcaggaggacaagctcaacgattctcactgactctctcgtcaccgtcaagctattcctctattggcatctcccatcagctcattacctccatcccaacttccactacttctcccggctccactgaaaacctccttcaaaaagcttacaccggcagaaatggcgttttgcttagtcaaaatagtcataaggaaagtgcctttgttggtcatctgcttgctggtcatctgcctggtcctactattgttgttggtggtgctgatgccgctggtgaggttgttgttgatgaataa

SEQ ID NO: 42728 - DNA, 147 bp, Glycine max
  Peptide Sequence Number=SeqID_159506
atgacccctcttcaggaagatttgaatggaaatattactttggcaggtgataactcaaaatggaaggggaagctggcaaccctgggtgataaggtgaaagaccttcaagttaaggtgagtgatgctgaggtgggtgataagggatga

SEQ ID NO: 42729 - DNA, 302 bp, Glycine max
  Peptide Sequence Number=SeqID_159507
atggttagcatcttcagggaagcagaagatattcactcaagggaatcttcaaacacatacattaatagtttaggaagttatttcattgatttcaacttgctagtggatcttagtaacacttcaattgggtcattggattctagttatagttcagatgcctctatggtcataagccaatgccatatgttggcatatctggaggccatcaaccacatctttgttttcccagaggagctgttttcaaatcatgggcgacatgtgtatattataaagatatgggaaagaggtggtatatttttgtg

SEQ ID NO: 42730 - DNA, 575 bp, Glycine max
  Peptide Sequence Number=SeqID_159508
atggatttcgaaatctgccctattatgcagaaaaatgctgttgaattgtgcaacaaatttttgatgtgtgcagaaaaatgcttgtgcattgctggttatgggaaaggtgctgagaggaacgaggataagggctacgtaggaagtggtacctggagatatgtcgctggggtcaggagaccttggggacatcagggtgatagggcactggtaatcgattaccagtttggtgtaatcaattacacagtgctacctgccactggtaatcgattaccatttagtgagtttgggagaccctcgaaggcaatgagaggtgccgattccgtggcacaattcgactcactgctacttcatccggaggaacccgcacgcacacttcagcagtccgtggagtggatactacctacacctactccatatcgactagtggagccagttcaagtgataaaggtgtcatcctctggagcagcctgtggggttcggcattggcggcagtttgggaaacatgcagcaactgaccctcacggaggccgacagggcggcggtagccgagatagggaggttggtgagcaagttcg

SEQ ID NO: 42731 - DNA, 579 bp, Glycine max
  Peptide Sequence Number=SeqID_159509
atggaccaacaaaattgggctgctaagttactgggatatcgatttgatatcgaatataaattagggcttgagaataagggcacagatgctttatcacacatgtatgaggaggttgaattccataaaattatccattatcctaattgggagggcctcaaggcaatactggacgaggttcatcaagatgccaaattgctaaccattattgaagacttgaagcaagggaaggagtatgaatcagggttttcctacaaacaagcttacatcaatcctaaacttgctccctggtactatggtcctttcaaggtgctggagcaagtaggcaaagtgtcctacaagttacagctgctcgacacaactaaaatccattcagtgtttcatgtgccactttttaagaaagtcgtgggtagttactctatggaggagcccctcccattgagcctaagcaatgatgagactataagtgtgattgttagcaaacacaaaacattaaatgctcaagccgacatcgctgcggcagggaagacgtcgacatcggagtgcaaagactggagttctaagacttgcttttacaagtag

SEQ ID NO: 42732 - DNA, 1107 bp, Glycine max
  Peptide Sequence Number=SeqID_159510
atgggtatgggtttagatcctagtgagaagcccaaagtctggagggtttatagtaggaggaataggggtgcaaagaaaggagttgaggtagctgaggtggcaagtcagcgaatgccactggagaagattgaagctaaggttgttgcactagaaatgcaactcaaggtagatgcgaaacatgccaagttgcttgagttgttaaaaaaggttagggaacaagaaggcaatagtttatgccctcaatcctcattagtggtctattttaacaatcaaggaacctcacatgaggtgaaggtcaatctggcccaactatgtatggaaggtcttacgattcatattttcaaatctctccttgatgagcaaaagtgtttgacatgggacgagttcaagagtgagctgcttgagcattatggaagtatggtgaagaacaatgaggaaattggtcttggtttcacaatgatgggttttaaggaggaaacaagatggcccagttgggtcattttggtccaattaggcacaatggtagtaatgggccgggtcaacatcatggagtggatgtgggctcaaactgtccaaaccgagaatgagggtgacgacacccaaggagaggccaacgtggtggtaatcaatgatgaatctgagactgaaatggaagaggaagagtgcatcatgttgtttttaaggactgcaatgggggttgatttgattttgggaatcgcatggctagcacccttagggaacatgttgttcgattgggtcaatcaaatcatgaagttcaaatggcaggaccaatgggtgagaatacaaggtgaagggtggcacgatgaaggacatatggcattgccatatcggtaccctcagaaccacaaaaatgaacttcaaaagcaagtcttagagctactcaaaacaagggtgaccgctcctaataagtttcccatttcggttattgatgagctgcttgatgaattgcgcgatgctcggtttttctccaagttggacctcaaattcaaataccatcaagtgagggtcacggagagtgatgtccataaaacaacattctacatgcataaaggccattatgaatatatggtgatgccatttggttag

SEQ ID NO: 42733 - DNA, 4293 bp, Glycine max
  Peptide Sequence Number=SeqID_159511
atggcggaaatggcagtgtccttcgctcgagacaaattgctttcactactaagcaatgaagcaaaactcctttgggacttgcacacagaatttgcagaaataaaaactgaactggatttcattcaagccttcctcaaggatgcagatagaagggctgaagaagaaggagacagcactaatgaggggatcagaacattggttaaacagttgagggaagcctcttttcgcatagaagatgtgattgatgagtacttgatctttgtggaacaacagcctgatgctcttggatgtgcagctttattctttgagtgtgacattacacacttcattgaatatttgaaacgtcgccaccatatagcatcagagattcagcagattaagtcagttgttgatggtatcatgcagagaggtaaaaaatataacttccttagacaaccttctgtagaacaaggacagagcagtaatgcaggtagccaaagtattcagtggcatgaccctcgaatcgcttctcgttaccttgatgaagctgaagttgttggctttgaaggcccaagagatgaattgattgattggttagtagagggaccagcagagcgcactgtcatctctgtggtaggaatgggagggcttggaaaaaccactcttgccagcagagttttcaacaaccaaaaggtggttggacactttgatttccatgcatggatcacagtgtctcaatcctacacagtggaagggatgatgagagacttgttgaagaagttatgcaaagaaaaaagggagaatcctcctcaagatatttctgaaatggaccgagattcattgatcgatgaagtgagaaactatttgcaacagaagaggtatgttgtcattttagatgatgtatggagtgtagaactttggggtcagattaaaagcgccatgtttgataataaaaatggaagtagaatattaatcacaactaggaagacaggtgttgtagaatcttgtaagaactctccctttgataaggtgcatgagctggaacctttatcatcagaaaaatctatggaactcttttataaaaaggcatttcaatttgatttcaatggatgttgcccagaccatctcctgaatatatcttctgaaattgttaaaaaatgcaagggcttaccacttgcaattgtggctattggtggccttttatctggcaaagaaaagactacatttgaatgggagaaaattaggcaaagcctaaattcagagatggagaaaaaccaccatttaattggtataacaaagattttaggtttcagttatgatgatttgccatactaccttaaatcatgcttattgtattttggaatatatccggaagactataaagtgaaatcaacaagactaattcgacaatgggtggctgaaggatttgtaaaagatgaaggaggaaaaactttggaagatgttgcacaacaatatttagcagagttgattggtagaagtttagttcaagtgtcttctgttaccgtagatggaaaagccaagagttgtcatgttcatgacttattatgggatatgatccttagaaaatttaaggatttaagtttctgccagcatattagtaaagaagatgagtcaatgtcaagtgggatgattcggcgcttatcaatagcaaccaattccattgatttagtagggagtactgaaagctcacacatccgatcactacttgttttttctggcaaagaatcagcattaactgatgaatttgtgcaaagaatctctaagaaatgcaggctattgaaggtacttgattttgaagatggtcgattgccttttgttcctgaaaattgggaaaatctagtacacttgaagtatttaagcttaaggccgttagggatggaaactaaaagtcttacaaaattcattggtaagctccataacctcgaaacgctggacgtaagacatgcaacttctatggaattgccaaaggaaatttgcaagcttacaaggctgagacatcttttgggtgatcatatgaggttgtttcaattgaaaaatagttttggagacatgacatccctacaaacactgcatcaagtaaacgtagatcctgatgaagaagagctaattaatgatgatgatgttgtggagttaatcagagaattgggaaagctgaagaatttaaggagcttaggcttgactggtgtgaaggaaggactaggaagtgctctatgttcatcaataaatcagatgcaaaacttggagaaactacatattcgctcagcatctaatttttatgtggattccacaactacaaaatcttgtaaaattgactttgatatgttcccacttaacagaagatccattgaaatcactacagaatatgccacatttgttgttcctccgtattggccccttagcctatggagttccatcatcatcgataaaggatcactgaattctttggaaacactacactttgagggaataggtgcactcaagacagtaccttgtggcatccaacacttagaaaatcttctagttcttcacatacttgacatgccatctgaattcgagcaatgcattgctcccgaaggaggaccagagcactcaatggccctgaaactctccagaaggttggaattgaaaaacccagatgggccaaacgctgtaattgagattctcaggaactatgggttttctgatacccagctatgtagccttgtaaagaaaatccctttggtgcttttgtcaaaacctgaaaagacccttttgccaaaactcaagttcttcctttctattgggttttcaaccactgaccttcccagattcctcattggaaacactacatttttgggattgagcttgcacaaaaccattatcccccgttaccagatcatcaagagtctagttcacagtgataaagaagtagtttccactttgaagaatgataggaggtactttaaccgttggatgtcaatcgatgcggttcgaaatgtagggactttgagacaccttggggtgcctcaacgttccatttcgttattggtaaccaattttcctagtgtaacatttatggagcattcgaggttttttgaggctgtggagaaagtgaaggtaactgggtttgatcctttgaaatcaaattttgtattggcacttcaagtgcttgcaaagatgaatgaggcaatgtgggaatccaaattaatggtttttgagaagtggggatggtccagagatatctgtcttttagttttcaaaaagcatccccaatttattatgttgtcagaagagaagattatgaaaatattgaacttcttgatgaaagacataggtttgcccgtagagaacatcgctggatgccctgaggttcttaaatgcaacctggagaagacagttatgcctagatttgcagttgttgaaattttgaagtcaagggaaaaggcacagaaactcgccaataggttgaaattgaaaaaccctaatgggccaaatgcggtaattgatattctcaggaactatggattctctgagactcagctatgtagccttgtaaagcaacgcccttttgtgcttttgtcaaaacctggaaagacccttttgccaaaactcaagttcttccattctattgggttttcaaccactgaccttcccagattcctcattggaaacattacattattttattttagcttgaataaatccattatcccatgttatcagattatcaaagttagaaatgtaggggctttgagacagcttggggtgccacaacgttccgtttccttgttagtaactaatcatcctggtgcaacatttatgaagcattcaagatttgttgaggctttggagaaagtgaaggaaatggggtttgatcctttgaaatcaaattttgttatggcacttaaattgtttgcaacgataaatgaagcaacgtggaaatcaaaattagaggttcttgggaggtggggcttttctagagatatctgtcttttggctttcaaaaagcaaccccagtttatgatgtcgtcggaaaagaagattatgaaaatgttgaacttcttggtgaaagatatgagtttgcccccagaagacattgctagatgccctgaaattcttggatgcaacttggagaagacagttattcctagatttgcagttgttaaaaatttgaagtcaaggggtttgataaagagtgatctgaaaacaagttcctttattaagataagtgagaaaatgtttttggagagatatgtgacccgatttcagagaaatgagccactactattggatgcatacagaggtcagaagtga

SEQ ID NO: 42734 - DNA, 359 bp, Glycine max
  Peptide Sequence Number=SeqID_159512
atggagaaaaaatccacatttagttggtatatagcaaagattttaggtttcacttgtgatgattttccgtactgtcttaaattatgcttcttttactttggaatatatcttgaagactatgaagttcaatctacaagacttattcgacaatggatagcaaaagcactagtaaaagataaagatggaaaaactttggaggatgttgcacaacaatatttaacaaagttgattggtagaagtttagtgcaagtgtcttcattttccatagatggagttgttgtgttcttgaaaaagtttagtgcaagtgtcttcattttttttttcatattcttgtccgccatcatatcgactccgctcat

SEQ ID NO: 42735 - DNA, 1464 bp, Glycine max
  Peptide Sequence Number=SeqID_159513
atgaaggaaggagacatcatttttggaaatgacattgtttccaacaacgacgaaggaaacgatacccgcgatgacaacaagcaattcacaatggccagcgccaatgcattgtgctcgtggcccagtgagagaagctccatcgccattgtcgtgtgtatggatatcgtcgtcgtccggaagtgtcacttttccattagaaagagtggcagcagcttcaattccagcattgtgaaagagggtggtgagggagatgatggttcactcctctgtcctcttcccgatgtcttctctcatatagcgactctgcaatgtggtacttttgacatgtcaaaccctatcacttttctggtgagagtcttcgagttcgtctccgaacacagtgactttttggagacaaagagcgccgaaaaggaggtagcatcgttggtgtgcgcagttgagaagaagagggagtttctcaaggtggagagagaaaaggttgagaagaagaagagagaggacctcaaggcctcgaaggagaggggaaaatccgacaagaggttgaaggaagagaagaaatccaaagccgaagacaccaacaaagacaaaagcacctccagagttccaaacaaaggtaatggcttggatttggagaaatactcttggactcaatcacttcaagaggttaatgttaatgttccggtgccaaatggaaccaaatcaagagcctatgcttatctgcttaatgtccttgctcctgaacattgcagtccggtcaccttggataccaaggatggcaatgaaagggcaaatctggttcttgatcacgcagagagaatgggctgcaaaagatacttgaccccaagggatgttgcagaggacactaaaaagatgtcctatgctgagatgatgacggatgatgtacaaacatctagagaagagagatgcttccaactgtggatcaatagtcttggaatttctacacatgtaaataatatgtttgaggatgtcagaaatggatggatacttttagaagtggtagacaacatatttccaagatcagttaactggaaacatgcaacaagacctccaattagaatgccattcagaaaagtcgagaactgcaatcagctcatgcgattcacaatgcttcaactgttgaaaattttgagatctgattcccaaggaaaggagatcactgatgctgatatcctgaaatgggtgaacagaaaagtgaagagcactggcagaacttctcaaatagagagcttcaaggcctggacagaggcatcatctattccaagagcactagtttcaattattttaagattgccaagacttaaatttacgattgtaaccttgggaaaagatggctgcataatgcttgagaaatgtgtggatgatgctaatgctattttggcagtatcagtatcacttgctgtctgtaacgctggtgcggcagtgaagaaaattcctctgtacaag

SEQ ID NO: 42736 - DNA, 330 bp, Glycine max
  Peptide Sequence Number=SeqID_159514
atggagttatactcagtagcagatggaaaatacatatttgagatttgtcactttgtttcgattcaatcttcatatgaaactatcgtagaagatgataccactcatcaaaatgtgtggaaaactttttttaagtggccagacaaattgccgctacaagtacttgacttttgctgccaaataaaagaggttcttaccagcacttgtaaaaatgtcggcaatagctttactgatcctggatacgccagccttaactcgattgtcggtaaatatattaatggctattttactgccgctaaagggaaaataattgccattaaaagtaacttttag

SEQ ID NO: 42737 - DNA, 225 bp, Glycine max
  Peptide Sequence Number=SeqID_159515
atgtggaaaatagaattaacaagaataaaaaatagcgagaaatttagatttgtcttcggattaagtaacagccatgaggcggtctcggcctcctcgggtgttgaggtcaacgtcggagaagaagtgaaggccatcgaggaagtacggactcaaagaacggcgcgacggggatgcgctggtggcggcaggcgaggcagagcatggcagcgacggccttgcatgtga

SEQ ID NO: 42738 - DNA, 270 bp, Glycine max
  Peptide Sequence Number=SeqID_159516
atgggtacatcctttatgttcaagtggagggtacatccaattgggttttcaaagagaacaagggagggtacatcccttgtggatctttggcttgtaaaggattttataagattgaaagaaatctcaagaactgtaggttgcttagggattggatgtaggcacggtcacttgatccaacacttaccccatcgtggtgaatggcagaggcaaccccattcctgcaacagtggaaagaaaaaggtgttttttaagggaaaaagtctcgcttaa

SEQ ID NO: 42739 - DNA, 218 bp, Glycine max
  Peptide Sequence Number=SeqID_159517
gcactgcttatggatttttggggaacgaaagagcccttacaaacaatgaaaatgtttggagggctattgtgcttgattgtaagagccggaaatgtttctttaatgtggaccaagacacaaaaatggcaaaaactattttggatgcaatcgaaaagtcagatcaatttgattatttgcttgatgcaaatagtgtccattttaaaaatgcgctgtggaag

SEQ ID NO: 42740 - DNA, 1830 bp, Glycine max
  Peptide Sequence Number=SeqID_159518
atgggaaactgcttctccgaagtcgccgcaggccgcgccgccatcggcggcaccgcccgcgatttccataatcttgccggcgctccaaacgacgccgtcgataacttcctcaggtcccacggccaccacggcctcttctctcagatcgagttatcgttttccgcttctggcttgcgtgatcgtgatctgctcttcaagagtaatccaatgatggttctttatgcaagaggaaaaaatggagcacttgaggagcttcgccgcactgaagtagttctgaattcatcaagccccacatggattactaaacacaccctcatttatcattttgaggttgttcaggctttagtgtttcgtgtgtatgatgttgatactcagtttcacaatgtagatataaagatgcttgagctagatgagcagcaatttcttggcgaggcaacctgtgtactatctcagataatcacacaacctgataaatcattgactatagatctacacacagaagattctatcggatctaccctttccaaaaacagtgggaaactcatggtgcattctgaggaatgtattagctcaaagactgcaatagagatggcattcaggtgttcagatttggaatacaaggatctcttctcaagaaatgacccctttttattgatatcaaaagttgtggaaggtagtgcccagattccaatttgcaaaacagaagttataaggaatgatctcaatccaatatggaagttggtgtttgtgaatattcaacaagtgggaagcaaggacagtcctttggtagtagagtgctataacttcaatagcaatggaaaacatgatttaatgggaaaagtgcagagatctttggcagagttggagaacattcataataatggccaaggagaaaatttatttttgccttctgctgatggacaaaaccatgataacaaggtgctgaagagccaactatttgtggataaatttactgaaagtgtccaatacactttcttggattacttggcagggggatttgaattgaacttcatggtggctgttgactttacaggagtctggatttgtccagtttaccttgaggaaccattgtggattccccaaaatgctaatcctctgaggccgttgttgtcaggctcaacagctgcttcaaatggaaatccacgccttccagattctttgcattatattgatccttcaggacggccaaatgcataccagagggcaattgtcgaggttggggaagtgttacagttttatgattcagacaaacgatttcctacttgggggtttggggcacgaccaattgatggtcctgtttcccattgtttcaacttgaatggcagtagtcattactgtgaggtggaagggatccaaggaattatgatggcttacacaagtgccctgcttaatgtatctcttgcaggacctacactttttgggccggtcataagcactgctgcactgattgccagccaatctgtagcaaatggtggaaggaagtactttgttttattaataatcacagatggagtagtgacagatctccaagaaacaaaagatgctattgttaaagcatccgacctgccattatcaattcttattgttggggtaggaggagctgatttcaaagaaatggaggttttggatgcagacaagggagagaggctagaaagttcatatggacgcgttgcttcacgtgatatagtccaatttgttccatttcgggagcttcaaagtggattttcagttgttcaagcacttctagcagaattaccggctcagtttttaacttacgttcggagcagaaatatccaaccaagcctctag

SEQ ID NO: 42741 - DNA, 366 bp, Glycine max
  Peptide Sequence Number=SeqID_159519
atggcgataacggtcatggcgatcgagctggtggtgattgacaacagtgatgttgtagttgacaacaatggtgatggcaacaatgatcatgatggtgcctgtagtggtagtcatgatgatggtggtggtggtggcggcgacaacgatgaaggtcatcacaataaaagtgtgactgaacggtgggtgtggacattcaggaggagaagcttcatggctttatattcatgtgtaatagaattacgaaaccgagttttcgggcttcctgctgggagaaaggatgttgtagagaagatcaatcccgggacatacctttttctgtttgacacatttcaagcttctctatggcaacctcgaccggaatgctaa

SEQ ID NO: 42742 - DNA, 672 bp, Glycine max
  Peptide Sequence Number=SeqID_159520
atgcttgatgaagcggagaaaaggttgcaagattctgaatccaaattggctcgccttcgaggtcagacagtgtcatctagaagtaccttagatgatggaatcaaaactttaaagacagagcgcagatcaaatagtcccattgatagaaatgaaggttctaccaaaaaccgacatcaatctaaaccagaacttcttattccttcagcgaatccaaaaatatcacaacctgtactgttgccaaagtctttttcaaaagcttcaataacttccagttctgaagccactcctggagtccatagttctcctatcacaggtggtagctctaggggaaaatctgacaagtctcatagtaataggctttcttctgagcagcaaaaaactgaagtcaaggagaaagggacaaaaaggaaatttgaacaaaaagaacacaaggaattgattcctttaatacgcaagagttcttcgccaagcttggtaacctgtcaaacaagcaaccacatctcaagtcaacacaagaggaaattgcggagtattgctttatgtcctgtgaatgatcagctttttgtgaccaggaatcgaactcaagtactaaggggtttacaacaactcacgcatactgttcaatcaactgacctagatcccctaggtcgtataaatctactctacaagtga

SEQ ID NO: 42743 - DNA, 321 bp, Glycine max
  Peptide Sequence Number=SeqID_159521
atggcgaatataggaagtggttatgctcaattattgccagatccccaacacacacatcagaatgcccaaaatactcaacctgatttcaaatcttccttggtgaatatgggccatgccaatgttgcgatgcaatcgaatgctgggtcatcattatatcatccatatgttcctcaagaagttgtatcttccgggtattcatcgcaaggtggtcaacaaactggaatgggaagtgaatattatcagtcatctctgcagaccgtggggaacacccaagagaattttgtcagccacctgaattcagaaaattcaatcggtgcttag

SEQ ID NO: 42744 - DNA, 838 bp, Glycine max
  Peptide Sequence Number=SeqID_159522
cgcctatagcggagcattgccgggcgcggcgcttaaagacaacctgctgctcgaccagcgccgcctcaatccggacctcaaacactggacggtggagccgcatcatctggccaccagcaacgccatcgccatcgacgaatatctcgcccagacgctggatgccagcaatttacagctcacctataaagccagcgccagtattccgctgcgcggtatgaaagcggcgctgctgctgatggatgacgtacaggggcgggttaacggggccagcgcctgggtaaagcgcggtgatcgcgtgcagtgggatgtgccgccgccgccctcaattccacagctgccggcaccaatgcccgcacccgcgccgctgacgcagcaggaaaccaccggcctgatcgattacggaacctggcgcatcaataccgataactgctcgctcgatccgctgcggcgggaagtcagcgttgcgccactcaccgacagcaaagcactgctgctgataagctgcgaaaccggtgcctacaacgtgatcgatctggcgtttgaagtcacacgcagccagccgtatgtatcgcgcggcatcacgctcaacctgccgtttactccgccgtcgcgcactgataatcagctggagctggtgaacgccgagttcgatgccagtaacggccagctgtataccttcagcaaagggcgcggtttaggcgattgcggtgtggccacacgctggcagtttgatggtaatgctttcgtactggcggagtatgctgaggagaagacttgtgacgcctggcatagtagtgatgattggcccaccctctggatttcacagcctgcgtcataa

SEQ ID NO: 42745 - DNA, 282 bp, Glycine max
  Peptide Sequence Number=SeqID_159523
atggaaggaagatcaatatcacattcttctgaaagagaagaggaatatgatttgttcccaatatattctgaaaggtctcagcaagacatgtcagccatggtttctgctctcacacaagtcattggtggctccaatagtgattctcttcagcagcatgaaggccttttaacttcttcacataacaacacctcaacccagaataataatgaacaatcccaagcaccacaacaagaacaagtcttaagagcgagctttagcgcagtcctaaaggttgctgcttag

SEQ ID NO: 42746 - DNA, 660 bp, Glycine max
  Peptide Sequence Number=SeqID_159524
atgaagtgttttgaaattgttggatgtttaaatattactgctcaccaaaaagaacagtttccaaagctgacaatctatcattctcttgggagtgtaagaagaagacactacagaggagtgaggcagcgtccatggggaaagtgggctgcagagattcgcgatccgaagaaagcagcgagggtatggcttggaacctttgaaacagctgaagctgcagctcttgcttatgatgaagctgctcttagattcaaaggaagcaaagcaaaactcaatttccctgaaagggttcaaggcacagctagcgaatttggttaccacctcacaaatcagcacagcactagtagtcatgatcagcaagcttctaaccctattattactccacactttgctactactcaagaaacttattcaccaagtcatcactttcaatatgcacaacaacaactcatgggtggtgggagtaacagcttcaataacaaccaagatatgcttcgtttctatgggggacataacatgtttgtttcttctcagcaatctgcatcatcgtcttcttccactgcactgtctcagaatcagcaggatgagttgctgagattttcgatgcaatttggagcttcttctcattctgaccattcagggaattggaggggtggacaatga

SEQ ID NO: 42747 - DNA, 300 bp, Glycine max
  Peptide Sequence Number=SeqID_159525
atgtcggttatatttggcagccagtggaacatattttgcttgactaattttaacaagaataatacggatgacacaatcacaaagcatagatacgcgtcgaatgggattcttatgagggcatgcgaggaaccagtgggtggaaggggggaaatggggcacatgcatgactttgacttgcgggtggatgtgctaggtttaggagctaagagttgtaactggataattcacttcactcgtacggacagaaaaatggacccctcacgagagttcctgacttgtcacgtgttccgtggaacgtga

SEQ ID NO: 42748 - DNA, 207 bp, Glycine max
  Peptide Sequence Number=SeqID_159526
atggtagacctagcagcaccaatatcgtttccttgcacggcatgtccaagaaacaagaagcatggcattggcatttgttgttacaatttaggaaatataaaagaatgcaaacaagtattgcctagtacaaattactcacaattagtcgaacctactacacattggttttgtgattgctatgcaaattgcagactagctcaggcatga

SEQ ID NO: 42749 - DNA, 411 bp, Glycine max
  Peptide Sequence Number=SeqID_159527
atggcttattgttccggcatcaagtctattaggttctccagattcaaggtgacaaatcaggtgtttaggtacgcgaagaaggctggggcaagctacatcaacaagccaaagatgcgacactacgtgcactgctatgccttacactgtctggacgaggaggtctcaaacgagcttcgaagggcgttcaaggagagaggggagaacgttggagcgtggaggcaagcatgttacaagccccttgtggccattgccgcgcgtcaaggttgggacattgacgccatattcaatgctcatcctcgtctttccatttggtatgttcccacgaagcttcgtcagctttgtcacgctgagagaaacagtgccgcagcttcaagctccgtgtctgctggcagtgctcaccttcccttctaa

SEQ ID NO: 42750 - DNA, 456 bp, Glycine max
  Peptide Sequence Number=SeqID_159528
atgtcggaatcaaggtctattaaaagggatgagtgcaaccgaccgcgagtggccacgaggagttctattgagtgtgggaagcaacgtcacataaaagcgaattgtccaacctacctcaagaaacaacaaggaggtgataagaagcgaaaaaagtcatttaagaagagaagaacatacatagcatgggatgataatgatgttagttcttcaagtgacttaagtgaggaagaagaagcaaacttgtgtctcatggctgacattgatgaggatgagaccaaaagcaatttacatgaggaagcacaaagacttttctttgtgatcaagactttaaaaggcctagttagatggtgtattgagaaacttaccactttaccaaaggaagtccatgatttgaaaaaagagaaagtggatttagaaaaatctattgaggactccatttgtaaatgtaaaatctaa

SEQ ID NO: 42751 - DNA, 696 bp, Glycine max
  Peptide Sequence Number=SeqID_159529
gtgttttatgtccaagatccttgtgatgaaaggtggtcagcggttctacatggaaaaaccattggtgttaatcttgaagatgatgattcaacccttaatgcttctcacattcctttgtccacacacatgcctaccatcaatggagaagatgaagttgatgatatacatggaaatcgtaatgcaccttcaccatctacgtccaagaggactagacaagccacatggctcagatcattatttgccagacctgtgggtttggtgagaccactggttcatgtggagcctaacactaggaaagctactggcaaggatgatgatgatgagactatgtgtgacaagtatggtattaacaaagacaagtggaaccaattatatgaaagccatagagacccttcatgggaagatattagaaagaaggcacaaaccatccaaaaacacaacactacccctagtgtattgtcttatggggggtacatcctttgtggcacaagtagagggtacatctacttgggttgttgtactgagaacaagagagggtacatctcttgtggatccgttcaagtggagggtacatccacttggttgttcaaagagaacaagggagggtacatcccttgtggatctttggcttgtaaaggattttacaaggttgaaagaaatctcaagaaccgttggttgcttggggactggatgtag

SEQ ID NO: 42752 - DNA, 279 bp, Glycine max
  Peptide Sequence Number=SeqID_159530
atgttgtcatttagtcattgcaattccagcaaccacatcctgttgagccagatgtaccttcttccatgcccattttatgtgcaattgtcagttgtacaccacgtgtgtttggccaatgatatggtgatggtaggtgttaaagaagttcaagatgttgatttttgcatctctatacctattgaagagggtaaacatgtaccaaagaaaccaaagaagcttgttgataagctggaacctgatgatgatcccatataccaaatgactttgatgatctcgtaa

SEQ ID NO: 42753 - DNA, 294 bp, Glycine max
  Peptide Sequence Number=SeqID_159531
atgaccaaatttggtctccgcttgtcatcgggcccgccgcctctggatgacaaaagggtgcggataaccgtaaggtatctccgcgtatcatcgggcccgccgcctctggatgatacaagggtgcagaatgaccaaatttggtctctgcttgtcatcgggcccgccgcctctggaagacaaaagggtgcggataaccgtaagggtgcggataaccgtaagggtgcggataaccgtaagggtgcggataaccgtaaggtatctccgcgtatcatcgggcccgccgcctctggatga

SEQ ID NO: 42754 - DNA, 423 bp, Glycine max
  Peptide Sequence Number=SeqID_159532
atgggacaattggctacacagttaaatcaacaacagtcacacaattctgacatattaccttctcaacctatccagaatcccaaaaatgtgagtgccattacattgaggtcgggaaatgaacctgcccaacttcactctactccagaaaaagatgatgacaaaaatttaaagacaatttccaacaacaaaatggaagaggcagagaatgagatattggaaacatttagaaaagtagaggtaaacatacctctcctggatgcaataaagcaaattccaagatatgctaaattcttgcaggagttgtgcactcataagcggaagcttaaaggaagtgaaagaattagcatgggcagaaatgtctccgcattgattggtaaatttgttccccaaatccctgaaaaatgtaaagatccagtcaactga

SEQ ID NO: 42755 - DNA, 126 bp, Glycine max
  Peptide Sequence Number=SeqID_159533
atgtggaaattaacattgaggccaccaagaaatattgcgtccctcgggcatcggcggaacaaggtcaacagactatacaaagcaagagaaaagatacaaatactaaacagcaagaagccagcatag

SEQ ID NO: 42756 - DNA, 730 bp, Glycine max
  Peptide Sequence Number=SeqID_159534
atggatccagacgcattcaccgccagcctattcaagtgggacccacgcaccgtcctcccgcccgcgccccccccgccgcccccgcgacctcccctcctcgaatacgcggtcgctccgccgccagtgaccccgtcgttccatccctcgagggcggcggcgccgcgcgagctcggaggactggaggagctctttcaggcttacggcatccgctactacacggcggcgaagatcgccgagctcgggttcacggtcagcacgctggtggacatgaaggacgaggagctcgacgacatgatgaacagcctctcccagattttccgctgggacctcctcgtcggcgaacgctacggcatcaaagccgccgtcagagccgaacgacgccgcgttgaagatgacgacatcaagcgccgcaataacaacaacaacctcctctccgccgacaccaccaccaacgccctcgacgccctctctcaagaaggcttgtcggaggagccggtgatgcaacgagagaaggaggcggtggggagcgggggagggagcacgtgggaggtggtggtggcggcggaggagaggaggaagcagcagaggagacggaggacgaggatgaagacgaataatcttcatcacgaagacaacgaggagcttgaggatgatgaaggagaacagaatgacgaaggaaacattaacactggtgggggttgtgagaggcaaagggagcatccttttcatc

SEQ ID NO: 42757 - DNA, 159 bp, Glycine max
  Peptide Sequence Number=SeqID_159535
atggtcggagcacccactagagacactgctcactggcatgcacgtccacttcccttaagggcgaatgcggcagttgcgcgtcaacaagatcgcaccagtgcatggcgatctgtgagatctgcaaccaaagtcgacaataccatgcatgtcacctataag

SEQ ID NO: 42758 - DNA, 453 bp, Glycine max
  Peptide Sequence Number=SeqID_159536
atggtggtcgcaaaggggagggaggagagtgtgagggattacgttggagggaggagagggtgggggtttggttcacagaggaagcagatggtggtggtggggttcacgaaagggagggaggaaagttctcaaacatttccttcaataccacaaaacaccttcaccacgttccataagtcttccaatagttctagtcatgcacaaactccttcaaatgaaaaagttgatatacaattttctacccaaattgggttagaaaatattacaatagaggaaggaggacggagttcttcagagaagaaaatggcctacgagtattcttttcaattaaagaggataaacttctcattagttcgtgatttaatgtttcactcaattcaattgtcagtgatggaagatctcaaaaaggagtgtgaaccaaatatttggagaaaaatatctgagaaggtctaa

SEQ ID NO: 42759 - DNA, 243 bp, Glycine max
  Peptide Sequence Number=SeqID_159537
atggtgaaaaattcaataagatcagcaatgagaatcaccttggacatgatgaaggcttcaagtgccttctggagacaaaggacccagggatgtgactctaagaaaacagacttctttgtgtggttcttttgtagtggaaaactatccaacactttgaggacaggatactccgtgaaaataataatgactctcctctttcacccagtcgagcagttctaccaactctgcatcatgaattcatga

SEQ ID NO: 42760 - DNA, 897 bp, Glycine max
  Peptide Sequence Number=SeqID_159538
atgggggcgaagaagcagagccagggagtgaaaaataagggtaatggcgccaacaatgatgttttcgcgtcatgctccttctccagccttggacttgattccaatttatgtgaacaacttcgtgataggttggggtttgaagttccaacgctggtgcaagctcaagcaattcccgttattctctcggggcggcatgcattggtgaatgctgcaacgggcacggggaagactgttgcgtatttggctccgattattcatcacttgcagggttatgaaaatcggattcagcgctctgatggaacatttggatacatcatgggtggtgaaaagagatcaaaagagaaatcaaggctgcgcaaaggcatatcaattcttatagcaactcctgggcgccttttagatcacttgaagaacacaacagcattcttgtactcaaatttacgctggataatttttgatgaagctgaccggattttggaattgggatttggaaaagatatagaggaaatactagatcttttaggctcaaggaaaaaagggcatggtgatcaagagaatacagttctaacacactctaaaattcaaagacagaatttgcttttatctgccaccttaaatgagaaagtgaaccaccttgctaaaatgagtctagacaatccagttatgattggtcttgatggtaagaaaatggaaccaatttcaacaattaaaaggcttgattcttcagaatctgatgaagacagtgaagataaatattccagtaaagtaccaacagttggagattacaaagtccccatacagttgattcagagatacatgaaagtgccatgtggttcacggcttcctgtacttctttcaattctaaagcatctctttgaaagagaaccttcacaaaag

SEQ ID NO: 42761 - DNA, 252 bp, Glycine max
  Peptide Sequence Number=SeqID_159539
atggtcgttgtgcaatgtatcaaggagacattgttggggtgtgcctctggcctgcagcttgtccaagccatttgcagaatgattttggtgatgggatctgtcactatcatgcatgtctacagggaagcaaaccagtacccgaatgctcttgcaaatttagcttgtgatatggactctgatgttatgagttttgagcatgctccagctatgttgaagcgtttgcttagctttcatgttaggggaatcccttaa

SEQ ID NO: 42762 - DNA, 327 bp, Glycine max
  Peptide Sequence Number=SeqID_159540
atggacgaaggaggaggtggtggtggaaatagagaggatggtgaagtgccaaacgatgcagtgggtgctttacttggtgttgctgatattggcgtggggcattggaattctaatgctgctttatctccctctctggttactaggccggtgccattttcgtgctttggagtgctgaagaaggagaagcacgttttgttgcactctatagcagatgtcgtgattgaacaaggtgacggtatttgcagttttcttatgtgttgtagtttggatgggttttttttaccgtactacaccctctctctccaaaatatgcctaatatacactag

SEQ ID NO: 42763 - DNA, 270 bp, Glycine max
  Peptide Sequence Number=SeqID_159541
atgagaaccgacgggaatgcaccgctgacggcggagaacgcaatgagagttatggagacgctgcgcagcgtgtccttcgctggagtggcttcctattgggctactcgagatcctgatgatcgtgcaaactatggtggggaagtgaatttctttgtgtttggtggacaggcgatagatgaggttgaggcggcaaggagggaggcccatgcgacgaggttgtctcttctccctcttattctaactctcttcttctctgatccacaaccttaa

SEQ ID NO: 42764 - DNA, 399 bp, Glycine max
  Peptide Sequence Number=SeqID_159542
atgcctccttcatattgctggaccagtaatgaaacaatacgtcaaagtccttatttagatttttttgccaagtccagcaaagaaaaactgcatcctccagtatcttacagcataattgaaaatgttggagttaggaggccacccagtgatgatgttaaaatccagggtgttgcaaatccaaatgatttcaggaaggctgttatgatgcgtctatcgaacatgagaaatgagattttgtcaagacaggtctctacattagaagatgttccacatcatctgatgatgtctccatcaaagtcattaaaacatgattctaatccttctggggagctgctaccaatgcagaaactggaggaagttggaagctctgtcaaggcaggaagtaaacatgagatatag

SEQ ID NO: 42765 - DNA, 1301 bp, Glycine max
  Peptide Sequence Number=SeqID_159543
atggaactgaaattcgttctctttctactccctttgctagttgttgctgctcatggactcgcttccaatgcgacactgaacgagacttgtggatacttcgatggttctctcaatagggaccctaaagtaccttgcccgattggttgggttatggacccgaacaaaaccaagtgctttctccatgttgggaggccccaatcttggaatgactcagagacctgttgtagtaagtatggtggacatttagtgtcattgacatcgcttcaggagctacaatttgctcaaagcctatgtggtgaatctataaatagttgctggattggtgggcaaagactcaactctacagctggttatcagtggatgtggtctaacaattcaccgtggaacaactccatattttctatggtcaatgttccaccccattgtaatggaactggaccgtcctgtcataggaacagtacagacaatttgtgtacagtagtgactaataattcaaactctctcataactgagagatgcgacaatcctcatgcttctctatgtatacttgatatagatacaaaacggaaccaaatgcaccgtcgcagagaataccttatcatcctcacagtggtgagtaccttgatactctccacaacattatcagtggtagtttggcttcttgtatataagcgaggcaagaaaagaaggcggtctagaaaactatctattccaggagcttctcttccatcatggaaagtctttaccaaagaggaattaaggtcaattacaaagaatttcagtgaaggtaaccgtcttgttggggatgccaagactggtggtacatacagtggggttttatcagatggttcaaaagtcgcagttaagagattaaagaggtcaagctttcagaggaaaaaggagttctattctgaaattagcagggttgctcggcttcgtcatcctaatctggtggctgtgatgggatgctgctatgatcatggtgaccgctacattgtttatgagtttgtagctaatgggcccttagataaatggctacatcatataccaaggggaggtcgcaacttagattgggctatgaggatgaaaattgcaactacgcttgctcaaggaattgcgtttctgcacgacaaggttaagccacaagttgtgcatcgagatatacgtgctagcaatgttctgctggatgaggagtttggagcacagcttatgggtgttggtctgtccaagtttgtgccatatgaggtaatgcacgagaggactgtgatggcaggtggaacttatggatatcttgccccgga

SEQ ID NO: 42766 - DNA, 156 bp, Glycine max
  Peptide Sequence Number=SeqID_159544
atggaggagtacaaaaatttctgtgatcgaccaagggatcagcgtccacagccggaagaagtcattgggactatcacaaaaagccataaaggccaagaatctaattggccatttttgaggttgatagaggcagtatggatattgcagaacatttga

SEQ ID NO: 42767 - DNA, 189 bp, Glycine max
  Peptide Sequence Number=SeqID_159545
atggaagtggatatcaggacaggagcaacccccagaatcagtcagcgcaaacctgtgcgggaaagagttaagaaaaaccttgatatccattctgctcctgaagtaagagcaacgcctggccaaccatgggtaagaggctgggatgatatcaagaaaggacaagatggtcctgtttctggaaatcagtag

SEQ ID NO: 42768 - DNA, 1038 bp, Glycine max
  Peptide Sequence Number=SeqID_159546
atgaatgatgaggagcttgctcactttgtggagcatgttgataaggataacaatggaattatcacttttgaagaatggagagattttcttctactttaccctcatgaagcaactattgaaaacatatatcatcattgggagagggtgtgccttgttgacattggagagcaagctgtcattcccgaaggcatcagcaagcacgtgaaccggagcaaatattttcttgctggtggaatagcaggaggtatttctcgtacagcaactgctcctcttgatcgtctgaaggtggtcttacaagttcaaagcgaacctgcttccatcatgccagcagtaacgaagatatggaagcaagatggtctgttaggatttttccgaggtaatggattgaatgttgtgaaggtatcaccagaaagtgccatcaaattttatgcttttgaaatgctgaaaaaagttattggagaggcccacggcaacaagtcagatattggtacagctggtaggcttgttgcaggtggtacggctggtgcaattgcacaggctgctatctatccaatggatctcattaaaactaggttacagacttgtccctctgaaggtggaaaggttcctaagctgggaacacttacaatgaatatatgggttcaagagggacctcgagctttctacagagggcttgttccatctctgcttggcatgattccttatgctgccattgatctcactgcttatgataccatgaaagatatatccaagagatatattcttcaggatagtgaacctggtcctctagtacaactaggatgtgggacaatttctggggctgttggagctacttgtgtctatccattgcaggcacaaccttccaacacttccgatgcttacaagggaatgtttgatgcctttcggagaacttttcagcttgaaggctttataggtttctacaagggactctttccaaatctcctcaaagttgtgccagctgcaagcattacttatgtggtctatgaaagtttgaagaagactctggatctggattag

SEQ ID NO: 42769 - DNA, 366 bp, Glycine max
  Peptide Sequence Number=SeqID_159547
atggggccttgtacactggcgaccccagttaatgccgcaacaacatgctacatgcttgtagtatcatgcatacacgagctcttaaatcttaattacatatttttgttggtggttgacattctaataacaggaacaacccatggtattggtactgagactgcaagagttcttgctttgcgtggtgtacatgtgattatggctgcgagagatgtgattgctgcaaaagctgtcaaagaagcaatacttaaagagattcccacagccaaagttgatgccatggaattagaccttagctcaatgacttccgtcagaaagtttgcattagagtatatttcatctggtcttccattgaacatcttgatgtaa

SEQ ID NO: 42770 - DNA, 159 bp, Glycine max
  Peptide Sequence Number=SeqID_159548
atgggttcttctgggttttcatcatcttctactgcagaggaagttactcaaggaatcaatgggagtggcctaactgcaattgtcacaggtagcccgcagcctgaaataaatatagaaaaattctttatgggagtggtcccgaaggcaatctttccttaa

SEQ ID NO: 42771 - DNA, 147 bp, Glycine max
  Peptide Sequence Number=SeqID_159549
atggagacttgccaaacaatagctaaaaggttggagcggttgctcaacctaaggatagtgagtgaaggcacagaaacatacgatgtcatgcaagactgcctaaagattactagaggtgtgactgcagattgcaatgtatatgtgtga

SEQ ID NO: 42772 - DNA, 336 bp, Glycine max
  Peptide Sequence Number=SeqID_159550
tggcttgttgaatacaatgcagcattagcgtgcatttgtttcatgacactgctaggatttgtcgatgatgtccttgatgtcccatggagagtaaagttactactcccatcaattgctgcacttcctttgttaatggcatatgctggacacacaactatagttataccaaagccacttgtcccacacattgggattgagaatagaagatacatagtaccagaggtactacaagaagccacaggaggtaggttctcctgggacagaaaagtaaataaaattatgcaacatcccaacagaaacaattcaacccaacccaacaacactatcactacttaa

SEQ ID NO: 42773 - DNA, 257 bp, Glycine max
  Peptide Sequence Number=SeqID_159551
atataggagctggaagtggtatctgtgtaggtgtaggaggaataactggagctgaggaaggtactggagctatggaagaagaaggagttggcgtctcaggtggtgctgaaatggtaggggcctctgatctcttacccttggccttccttggccctctaaatgtcactgttggatcatcaagattccaacaattcttcttaatatatgccacgttaatggtagggctcaagctctccagggatctagagtctgactga

SEQ ID NO: 42774 - DNA, 3156 bp, Glycine max
  Peptide Sequence Number=SeqID_159552
atggcatcagcggcgagtggggccaccggatggtacaggggaagagtgaaggcggttccttccggggactgtttggtcattgtggcgatctccagcaccaaacctggtcctttgcctgagaagaccattactctatcttctttaattgcacctagactggcgcgtagaggtggtgtggacgagccgtttgcatgggaaagcagagagtttctgaggaagctctgcatagggaaggaagtgaccttcagagtggactacaacgtgccgtccataagtcgggactttggaaccgtttttctcggggacaagaatgttgccatgctggttgtttctcaaggatgggttaaggtcagggaacaggggcagcagaaaggagaagcgagtccgtacctggcagaattgttacggttggaagaacaggctaaacaagaaggccttggccggtggagcaaggtgtgttttttgccacaaaaattgataattagatgtgaattcgttgctgtcctggcaacttggtgtacttggaaaccaaagtgcattgtgttcggcatctttgctgatgtaaagcaagtgtttactactgccattgtcttgaagttgtacatattgcatgttcccggtgctgctgaggcatcaatcagaaatttaccaccttctgcccttggtgaccctagtaactttgatgctatgacttttttaaatgcaaacaagggattgcccatggaggcagttgttgagcaggttcgtgatggcagtacactccgaatctatttgctcccggagtttcagtttgttcaagtttttgttgctggaattcagctaattgttttacctttaccccaggctccacaaatgggaaggagagctgcacctgaaagtgttgttgaaccagagttggtatctgatgacaccaatggagatgttcctggggaacctcaagccccacttacatctgcacaaagacttgcagtttcaacatctgctgaaactgcagctgatccttttgcacatgatgctaaatttttcactgagatgcgtgtattgaatcgagatgttcgacttgtcctggaaggtgtcgataagttcagcaatttaattgggtcggtgtattatcctgatggtgaatcagcaaaggacctagcattggagcttgtagaaaacggttatgcaaaatacgttgaatggagtgcaaatatgatggaagaagaggcaaagcgaaagctgaagactgcggagctgcaggctaagaaagacaggttaaggatgtggacaaactatgtaccaccgccttcaaattcaaaggcaattcataaccagaatttttctggcaaggtggttgaggttgtgagtggagattgtattgttgttgctgatgattccattccatatggtagtcctctagctgagaggcgagttaacctttcaagtattaggtgtccaaaaatgggcaatccccgtcgagacgaaaaaccagctccctatgcccgtgaagcaaaggagttcttgagaacacgcctcattggtcgtcaagttaatgttcaaatggaatattctagaaaggtttctcccacagatggatctgtagttccatcagcagcttctgattcccgagtaatggattttggatcagtcttcctattgtccggtgcaaaggttgacaatgatgatgccccatcatctgctccacctgctggaagtcagcaaaatggggtgaatgttgctgagttaatagttggccgtggctttggaactgtcattagacatcgtgactttgaagagagatctaactattatgatgctcttcttgctgctgaatcacgtgcaatttctggaaggaaaggcacccactctgccaaggatcctccagtgatgcatataactgatttgaccacggcatcggctaagaaagccagagacttcttgcctttcctgcaccgaagtagaagagttcctgctgttgtggaatatgtgctcagtggtcatcgttttaagttgttaattccaaaagaaacttgcagcattgctttctctttttctggagtcaggtgtcctggtcgtgctgaaccatattctgacgaagcaattgctctgatgaggagaaagataatgcaaagagatgttgagatagaggttgaaaccgttgatcgaactggaacattcttgggatccttatgggagtcgaggaccaacgtggcaattacactgctcgaagctggtctggcaaaactccaaacatcctttggcagtgatagaattcctgattttcatcttctggatcaagctgaacaatctgctaaaaggcaaaagctgaaaatctgggagaattttgttgaaggagaggaagtatctaatggtgcagcagttgagaacaaacagcaagaagtacttaaggtaattgttacggaagtcttgggtggtggtaaattctatgttcagacagttggagatcaaaagattgcatccattcagcaacagcttgcttctttgaacctaaaggatgctcctgtgcttggtgctttcaatcctaagaagggtgatatagtcctttgttattttcatgctgacaaatcttggtaccgggcaatggttgtcaacacaccccgaggaccagttgaatcccccaacgacttgttcgaagtattctacgtcgattatggaaatcaagaagtagtaccctacagtcaactacggcctgttgatccatctgtgtctgcggcacctggtcttgctcaactgtgtagccttgcatacatcaagattccaaacttggaagaggattttggccaagaagcagctgaatatttgagtgaactcactttaaacagtggaaaagagttcagggccaaggttgaggagaaagatacttcgggaggaaaagtgaaagggcagggaactggggcaatccttgctgtaactcttgttgctgtggatgctgaaatcagcgttaatgctgccatgctacaggaagggcttgctaggacagaaaaaagaaacaggtgggacagaaaagacagacagacagctctcgataatttggagaatttccaggatgaagcaaagaccagcaggcgtggaatgtggcagtatggagatattcagtcagacgacgaggacactgctcctcctcctagaaagaccggtggtggccgtaaataa

SEQ ID NO: 42775 - DNA, 399 bp, Glycine max
  Peptide Sequence Number=SeqID_159553
atggagggtcttctgcctcttgtttataaagcaatcaagagaaacaaaacacgaaggcaatacgagtgtctttcatcaggaacttctctagggtacaacatcagcatggccgagatgtaccctcaaactcaggaacatgtccttcagaaccagacacatgcccagaaagtgtttcaccaccaccataatgaaagtcacaaaattggtcacaggagatataactctgttggtgatcatttcgattatgggttccaatcttctcagatgagaacagaaccaaagggtgatgtcaatgtgagacattttcttccaaaggaacccaatctaaaggaaggcaacgtcaaagttaagtataaccgcatcactatcaggaagccagaactgaaaatccatccatga

SEQ ID NO: 42776 - DNA, 921 bp, Glycine max
  Peptide Sequence Number=SeqID_159554
atggaaacccccgaaaacgccgcatactgttcgtcgtggctgccgccggaagacgaaaacgacagtggcgccaaattggcaaaatcggtgaacaaactcaacgacctcgccgttgcgatacaagccttcaataacaggtacgaagaattgcagaaacacctcgaattcatcgaacaagccattgacacgaggaccaaggagctccgagcactaggctacaattctactcaaggaaccgccgaaaacggcgtcgttcaatcagattcaaatccgaagccagaagaagccaaggcggtagagaaagagaaagaaaaggtaaaagaagaagaaaaagaaaaagaagacgagcttattacgctttgcaaaacgatgaatagccgaggcctgcgtaaatacgtgttaacgcgtctatccgaaacggcgtcgcttcgggaacaggtacccgttgcgctgaggagcgcggcgaagccctcaaggctggtgtttgaatgcattgggaggtttttccttcaggggagcaaagcttacacgaagaactcgccgatggttcccgcaaggcaggtttcggtgctggttttggagcactacttgctctctggctgcgttgggaatgagaaggacgtggaggcttcattgaagagggaggcggattccgccgcggttgcgtggaggaagaggatgtttgttgaagggggtttgctgaaggcagctgaggttgatgccaggggtttgattctcttcgtcgccggcttcgggattcccagtgttttcaaggatgaggatatatacaacttggtttgtgtcagcaatggcagagaattctccgatgccctgctccagtctcagcccctgcttaagagggtttcagggcatggaacccttgagggtaatgtaagcgctttaacttcttccattgaatga

SEQ ID NO: 42777 - DNA, 1355 bp, Glycine max
  Peptide Sequence Number=SeqID_159555
atgttgcagatgggatgatgaaaaagggcatggccgttaaagctgttgatttggcttatacctttgggtttgaagagaaatattctcctcagacagctctgacttcatttctgcagaagtctgaagaaacttggaagaaagccaaacaagacgcacgtgattttcctagtgcactggtagcacatgaaaaatatttggctgctttgcaatctgtagttaaatgtttggaaggtcacaagattgaccctgtaaaatttctgcctgggtggcaacttaagaataagattaccaacttggagaaagatattagtgataccaataaaaaaattgatgagaagtcaatgctcaagagaaaagtggataaaaacaattcatctaacaagatgaagattccagaggctaaacgagcaaggttcaccgggaaagatgcatctgtgctatcaccttcacttgctaccttgcaagagcaaaggatttttagtcgcatggatggcaatagctcatatgatggttcattgtcggcacatttgctggatggtagatcctatggcaattacccgaataattatctcactgcagcatctgcttcggattctttggctgaaaaatatcttggaagtgcagtggcaagtggggctaatatgcttggaggagctatgggtggttcattttctgggtatcagggggatatgtatagatatcatggaattggggaaggggcattgtctcatgataggtcagttggacagagttttgtgggacaatctgcatcaacattgaataatttgtatgggaaaacatccacagaaggttttgcaggtgtgccagagcacctctctgttggtgcttctagtcgcagtggaggttctgatttatatggctttgctgatgctgcacaggccgcgtgtgccttgcgtttgggacaaagggttttcttcacttcttttcctagcactagcagtgagcgttactctgccgccggcgctgccactcttcaaggcttcattgaagacacgtcgcaccgccagtcttcgttgccacttgctcactcctccttcttcgccgtcgcaccacccaagtctccaactcagcctcgccattcgatcattgcgaccggaagcgtgtttatggagaagaaatttttgagaaattgcagcaaagttaggcacattgaggatattgttgtggattctagcattcgtgggaagcatttgggaaagagaatcatcaacttcctctcggatcatgcacgttcaatgggatgctacaagctaattcttaattgcagtgtccagaacaagacgttctacgagaaatgtggcttcctgcagaaatctgttcagatggctatgtaa

SEQ ID NO: 42778 - DNA, 2064 bp, Glycine max
  Peptide Sequence Number=SeqID_159556
atggattcaaagcaattcgatcgcgcgagtcgcaaggttcgggtcgtcgccaggattcgcgggttttcggtgggtcccgaggctaattccgaaccttccgcttcgagagcggtggagtgggtttcggtgaaccgcgaaaatttggatgatgtcaccatttccttcggagatcaatcttccagtcggtatttggtggactattgctataaggaagatgaagataatgaattgatatattcaagggaggtgaagcctcttgtgtctgcagcttttgatggtcataactgcactgttattgcacatggtgctaggggtagtggaaagacgcacataattcagggctctgctgagagaccaggtttggcagtgcttgctatcactgagtttctttcagtgactgagcaaaatgggaaatccatagctgtttctttctatgaggttgatcatcaggagcgacccatggatttattaaatccagagaagccaccaattttggtttttgaagatcgtagcagaattcagtttaaaggactaactcaggttcctgtgaaatccattgaggaatttcagaatttgtactcctctgcatgttttgcactgaagggagctcccaaaaaaggaggctgtgaacgtgttcatagaagccacatgggattaatcgtgcatgtcttttcccataatggaagtcttctcagcaaagtgaattttgttgacttggcatcttatgaagatgctagaaagaaaagtagtgatgtctcctgccttgctgagactaacaaaattaacaagtcaatttatgccttattgaatgtttgtcatgctttgagtacaaatgaaagtcgtgttgcctatcgggaaagcaaaattacacgcatgctgcaggattccttgagggggactagcaaaattttgttaatttcatgcttgaacccatcattttgccaagacactatttacatggttagcttggcatcacgatcgtgtcattggattcatcgggcatctttagattctaccaagataagtgcaagttcagcaaaacaaatggtgaattctcataagaaccagatacctaaaagtgtttcaggaacagcaaagaaattatatggttcttctaaattacttgataaaaaagttgttgttgcaaagaagtctgcgataaaaggaaggaaattgtttgatgaagccagcaactctgctactaaagctgagaaggaagctcaatgcatcagttggtatcaaacgcaggacaattcattgtcagagactggaaatgatgtcatactcaactctggagtggaaaagaacactggaaatcatgttgtaatcaactttggaatggaaaaggatgactcattttcaaaagctagtgagaacgggaaacatatgcaggatgactctatacaggatgattcatctttgaatgctaacattgaagtggaacttaatccccttgctgatgaaggcattttggtggatgaagaggatcatcaaaaggatccttatgctagtaattactctgaagcattgtcaaaaatagttcaggaagaccatagcatgaacaaggagaacaacaattcaagggcaattggagatcattcatcggctactattagttcaccacctatcagttctcagttgcgggatctttctaatagtcttaaaatgctatattcttcaaccccatcatgcatgcagataccagaaaaggagcccattccacttgatattgttgaaccaaaaactcctacaattgaacaaaacatgagcattaacagattggatgcaatgaatgccaaaagtccctgggagacattcagcatgcgaggttctggaatgaagagttctcttgttcaagaatacctcaggtttttaaatacagctaacaaggaggaattaaaaaaattgaagggaattggagagaagagagctaccttcatacttgaactccgagaagaatctccagaacctttcaagagtctggatgatttgaaggatattgggctttcagcaaagcagattaaaggaataatgaagaaggaagtcggagagcttttcagttag

SEQ ID NO: 42779 - DNA, 696 bp, Glycine max
  Peptide Sequence Number=SeqID_159557
atgttttggcatgctaaagtctatttacatcatttacacccacccccgcctctccccccttcctgctttagaaaaaactctatgcttggaaaagacttcatcattaactggcatgctataaaaagtttgccatgcctattgtgcttgaggtgcatgagggatacatgtattccagaggagaagatgctgaaagatccaaggagactctatgcacctggtcgcctttatcacattgttgagaggaagccttttagaatgggaaggttccccccagtagtgaggacagcagtgccagtagatggaaggtttgagcatatagtcctttcttgtaatgccacatctgatcatgccatcatttggatagagaaagaagcccaaagggctctggatttgatgctggagaaagatgaaaccattgaagcccctgccaagcaaaagatggagcgtcaggaaaccctaaccagacacaatgacgaatataaagcagcattacaaagggccaaaacattagatgttccacatgcttatacaccgccatcagagtatggcactttcaatgatgagggagaggagaactcaacaagatctcaaggcgagtcttctaataaaagttcagtggacgaaagctgggatgcgttgattgagcgtcatttcgataaggatgaacatggccacactgtgctgaagaaagaatga

SEQ ID NO: 42780 - DNA, 270 bp, Glycine max
  Peptide Sequence Number=SeqID_159558
atgaagttcttgagatcaagaatcatagtggcagaaatgatacagatggatctatttttgggttgtaaagagaaggcaagccctacgtttgacacaaagggagagccaaggactgaactgatggcaacaaagaaggcttgggaagcactggtctgcatggccacacaacttggtatctcaagttgtccaatcaagagaccgccaccaaaaccaccaaattcatattcttccatagagtgcgatgggatgatgggtcatcatcaaagatag

SEQ ID NO: 42781 - DNA, 351 bp, Glycine max
  Peptide Sequence Number=SeqID_159559
atgacttctatctcccttcttcacgccctgttcgtgttcttcttcctaattgccacttctcttacggaaagtaggaaggaattaaggagcaagcaggaaactgcattacaaatgttagagcactcaattcattattccaacagaattaatccatcacgtgttgtccaaatctcctggcaaccaagggtttttctgtacaaagggtttttgtcggacaaggagtgtgactaccttgtttctttggcatatgctgtgaaagaaaaatcctcagggaatggtggcttttcagagggggttgaaactttcttggatatcgaagatagtaggatagttaatactagaccaatgtga

SEQ ID NO: 42782 - DNA, 1977 bp, Glycine max
  Peptide Sequence Number=SeqID_159560
atggcgtccctcacgtgcacccccacctccctccagctccgattggccttcgccgcccccaaattcccgcaccccccgcacgtgcgaatgcgcaacttcaagctcaaccgacttcgccctctgcgcgccgcgcaagacggcgtcagctccgagtgggccgggcccgggcccaaacttgatggcttctcgggctggtccgacaccgacgccgagcagcggcccaacaacgccccaaagaaggactcgtatggaggagttgtgggagtaggagtggctggagtacttctactttcagggcttacttttgctgccttatctcttggcaaacaaactggttccagacctgagcaacacatgaagaccttgactacacagcaggaggaacttttgtcttctgatgaccataatgatgaaataactgaacaagggaatgttgacagcatggtggaacaaggaaatggtaaaatggaaggtcagatagatatatctggggattattcttctgctgagtctagtaatttttacagtgacaatagtattgttgatgattctgatataggatcccagttgatatatgatagtaaaaacccctccgatggtgttgatgatgctactaaacatatatctgttcaagaagatttacaggatgagttagcttttggtaacaagttagtttttgccagtgaaagcccagtgccacttgaatctgaaaatactatcgattcttttaatgcttatggatttagagattttgatagcaaccctaatgtagatacagcagaatctactgcgaatcttaaagaaaacctattcaatgttgatccaggagacgcgcctaactatgatgatgctaagccactacaccttaatactgagcagcatgatgaaataaccagttcaagtggaagtgtaagttttggtttttctgaaacctattctagttcgggttctgataatgagactggtattgttagtgttttggtcaatcctgagtcaaataacatgatttcagatcctaagtttttcaatgaagctggccaagagaatattctgtcagcttcaaagaatgaaaaccttgacctgaacaaaattccacaggtctctgctgagggaaatgagccatcctttgaagagcggagcgttcctggaaatgacctgtttgaagaatcatctatttcatcatcagtcaatactttggtagatgagcaggttacaaatgataattatgaggttgatgaagttaaatctaaatctccaaattctggatcctttttctctgttcccggcattcccgccccatcagtagtttctgcatctgtacaagtgcttcctggaaaggttttggttcctgcagctgttgatcaagttcagggccaagcactagcagcactgcaagttttaaaggtcattgagcctgatgttcaacctagtgatttatgtacacgccgtgaatatgctcgctggttggtgtctgctagcagtgctctttcaaggagcacagtttcaaaagtgtatcctgccatgtacatagacaatgttactgagcttgcatttgatgatgtcatccccgaggaccctgatttttcttccattcaaggcttggcagaagctggacttatcgaaagcaggctttcaaggcgtgatatacagttgtctgctgaagaagatgatagcccattttacttctcccctgaaagtcctttatcacgtcaagatcttgtcagctggaaaatggccctggagaaaagacagcttccggaagctaacagaaaggtgctgtaccaagtttctggttttatagacactgataagatacatcctaatgcatgccccgccttagtagccgatctgtcttctggggagcagggaataatagctcttgcatttgttttcacttatgcttataattttggggttgggcgtgggattgggatattcaaggttatacaagattgttccagccagataaaccagtaa

SEQ ID NO: 42783 - DNA, 780 bp, Glycine max
  Peptide Sequence Number=SeqID_159561
atgtcaatcctttgtggccttcctcttgtggaatgcgtgtactgtctggcttgtgcgcgttgggcttggaaaagatgtcttcatactgcaggccatgacagtgagaattggggctttgccacggcagaagaatttgagcctatacctcgcctttgtcgctacattttagctgtgtacgaggatgatcttcgccaccccctttgggcacctcctggtggctatggaattagccctgatttgttacttctcaaaaagacgtacgaagatacccgtggtagggcgccaccctatgtactgtatcttgatcatgagcatgaagacatagttcttgccatcaggggtcttaatttggcaaaggagagtgattatgcggttttgttggacaataaattggggaagaaaaagtatgatggggggtatgttcacaatgggttgttgaaagctgcgggatgggttttggatgcggaatgtgaagttttgagggagttggtggcgaagcatccaaattacactctgacttttgttggacattcccttggagcgggtgtagcagctatgctgacaatggtggtggtgcagaatcgagatagattgggaaatattgataggaagagggtcaggtgttacgccattgcacctgctaggtgcatgtcgctgaatttggctgtcagatatgcagatgtcatcaactccgttgtgctgcaggcaagttatcgttttttttttcctatttatttggttgttgatgagtttagaatcctgtgcaaatccttgatttaa

SEQ ID NO: 42784 - DNA, 435 bp, Glycine max
  Peptide Sequence Number=SeqID_159562
atgagggagagtaaaattgtcaaagagcctggccttagtttggttcacattgatcaagtggctcatgagtttgtatcgggagataattctcatccgcagtgggaggagattacaagatttttaggttcagttattgacactgtgaaacttggaggctacacccctagtactaaaaatgtgctgcatgacattcaagaggaagagaaggaacattctctgggctatcacagtgagaaattggcagtggcttttgtgcttctttatcatagggatagaaaaaccattagggtcattaagaatcttaggatatgttatgactgtcatagtttcatgaagcatgtttcgggtttctttgacagagatatagttattagggatcgaagtcggttccatcattttaggaagggatcgtgttcttgccgagatttttggtaa

SEQ ID NO: 42785 - DNA, 318 bp, Glycine max
  Peptide Sequence Number=SeqID_159563
atgataaccgtgatagtatacacattaccagtgttctactatgaaaagatgatgggctacacactttcaagctttgccgatttagttttcatcgacgaatggatcgaaatgggtctgaaaagaggaaaatttaatcatcctgcttggacaaatgagaaaactggggcaaatgaagaggatgagaaaaaaggagaaacccatgctgcaactgtcgttcctacatggaaaatcccccaccagctcaacaacatcattactcagccaatatcaacccttctcattacccaccacccagtcatccacaaaggccatccctaa

SEQ ID NO: 42786 - DNA, 1722 bp, Glycine max
  Peptide Sequence Number=SeqID_159564
ggtatcgctgacactaagctaaactcaggacaagatgatggtgagtgggaggtatatgcaaggaaatccaagaacaaggctggaagcagtgctgcaaaaccatgggcccccccagcccataattctaatcctagggcatgggggaatgcagaaatggctcaaaagccaggcatccggggtcatggtggacttggaagatcttcgggaaatccctggcagacacaaaatgctaactttaggagaccagctggcagaggaaatggaaggcctcagttagcaacaagtggatatgaaagcaactatgttccaaatcctgcaattcggcctccacttgagcatggctggaactggcaatccagacctggtgcattgcagtccaatgcaagggatgaaatttcaccagaggaccttcaaaagaatgatgatgttgatgacgatgatggggaggaggactctgatgcttttgaagataccgatgatgatctgatgagtgatgactatgattcagatgctagtcaaaagagtcatgagacacgtaagaaaatcaaatggtttaagaagttttttgagattttggatggcttgactgttgaacagataaatgaaccagaaagacagtggcattgtccagcttgccaaggtggtcctggagctattgattggtacagaggactgcagcccttggtgacacatgccaaaacaaagggatctaaaagggtgaagattcacagggagcttgctatacttttggatgaggaattacgcagaaggggtacttcagtaattccagctggggaagtatttggaaaatggaaaggtttgaaagaagaagaaaaagaccatgacatagtttggcccccaatggttgtcattcagaatacaaagcttgaacaggatgaaaatgataagtggataggtatgggtaaccaagaacttcttgattattttagcacatatgatgctgtgagagcacgacactcttatggcccacagggtcatcgtgggatgagtgttttgatatttgaagcctcagctagtggctatctagaggcagagcgtctccacaagcattttgcagagcaaggaactgataaagattcttggttcagtcgccctattttatatctccctggggggaatcgccagctctatggatacatggctacaaaagaagatatggactttttcaacagacattcccaaggtttcatttcctctttcttggctgtgaaaggtgcaaaacacacaaaagctcttgaagaatctattggtataatgtctgagaagctgcggaagacaatggaggaaaatcgcattgtgaggaggagaactaaaatgcaacatgaagagaccaaagaagagatgtatatgcaagaacaattcttcaaggaccagatcaaaatcattcatgattcaagggatgcaaaggaagaagatttcgagaggatgcaacaggaggaacgtgagaaggtgaagcagtcaagtactactggtcatgtgaatgctgaggaatatagactcaaggtggaagagtatctgaaatttgttgaggtccaagataaagaaatggagaactttgttgctgaaaaggagaagctgttacatgctcatggcacgggttatgctgcaatgaagcggaggcattgggaggaagaagttcagtatgagcagaagtttgatgaggaattggctaacctcatggaaaagtactccccgtcgtag

SEQ ID NO: 42787 - DNA, 2628 bp, Glycine max
  Peptide Sequence Number=SeqID_159565
atgcttggacgcgatttcaagacgtggggttccgtcatttggagcttgtgtttagaagcaaaacacagtgaagccttgtcccttttccaccactgcttaaagggtcatgaagctttcaaaccagatcacacagtccttgccgcaattctcaagtcttgttctgcccttttggctcccaacttgggtagaactctgcatggttatgttgttaaacaaggccatggttcttgccatgttaccaataaagggttgctcaacatgtatgccaagtgtggcatgcttgttgagtgcctcaagctgtttgatcagctcagtcactgtgatcccgttgtttggaatattgttttgtctgggttttcagggtccaacaaatgtgatgctgatgtgatgagggtgtttaggatgatgcattcgagcagggaggctctgccaaattctgttaccgttgccactgtccttcctgtttgtgctcgtttgggggatctggatgctggaaagtgtgtacatggttatgttatcaagtctggttttgaccaagacacccttggtggaaatgctctcgtgtcaatgtatgcaaagtgtgggctggtgtctcatgatgcatatgctgtctttgataatattgcctacaaagatgttgtttcgtggaatgcaatgatcgctggcttggctgagaataggttagtggaggatgctttcttgttgttcagttcaatggtgaaaggacctacgcggccgaattatgcaacagtggcaaatattcttcctgtttgtgcttcgtttgataagagtgttgcgtactattgtggaaggcagatccattcttatgtgctgcagtggcctgaattgtcagctgatgtttctgtctgtaatgctttgattagcctctacttaaaagttgggcagatgagggaagcagaagctttgttttggacaatggatgcaagggatttggtcacttggaatgcttttatcgcgggatatacgtcaaatggtgagtggttaaaagcactgcatctgtttggtaatttagcatctctagagactttattgccagattctgtcactatggtcagcatacttccagcttgtgcacaattgaaaaacttgaaggtggggaaacaaatccacgcatatattttcagacatcctttccttttttatgatacagccgtgggaaatgctttagttagtttctatgcaaaatgtggctatacggaagaagcgtatcatactttttctatgatatccatgaaagatttgatttcatggaattctatttttgatgcctttggagagaagaggcatcattcaagatttctcagcttgttacattgtatgcttaaactcagaattagacctgactcagttacaatattggccataatccgtttgtgtgcctctcttttaagagtagaaaaggttaaagaaatacatagctattcaattagaactggatctttattaagcaatactgcgccaacagttgggaatgcaatacttgatgcatattccaaatgtggaaacatggagtacgctaacaaaatgtttcagaatctatcagaaaaaaggaatctggtcacatgcaattcactgatatctggttatgtaggtttaggatcacatcatgatgcaaatatgatatttagtgggatgtcagagactgaccttaccacatggaatcttatggttcgagtatatgcagaaaatgattgtcctgagcaagctcttggattgtgccacgagttacaagctcgagggatgaagcctgacacggtgactatcatgagcctccttccagtatgcacacaaatggcatcagtacacttgctgagccagtgtcaagggtatattattcggtcttgttttaaggatcttcaccttgaagctgccctcttagatgcatatgccaaatgtggtatcataggtcgtgcatataagatatttcaattgagtgctgagaaggatctggttatgtttactgctatgattggtgggtatgctatgcatggcatgagtgaagaagcactttggattttttctcatatgctcaagttgggaatccagccagatcatattatctttacttccatattatctgcttgcagtcatgctggccgagtagacgaaggactgaagatattttattcgatagagaaacttcatggtatgaaaccaactgtggaacagtatgcttgtgtggtggatctcctagctcgaggtggccgtattagtgaagcatactctcttgtgaccagtttgcccattgaagctaatgctaatctttgggggacattgcttggtgcctgcaaaacccatcatgaagtagaattggggcgtattgtagcaaaccaactcttcaaaattgaagctaacgatataggaaactacattgtattgtcaaatttgtacgcagcagatgctagatgggatggggtaatggaagttagaaggatgatgaggaacaaagatttgaaaaagcctgctggatgcagctggattgaagttgagagaacaaataacatttttgtggctggagactgttcccaccctcaaagaagcattatttacagtacactacaaacattggatcgacaagttaaagaacccgtggagtttttagcttaa

SEQ ID NO: 42788 - DNA, 780 bp, Glycine max
  Peptide Sequence Number=SeqID_159566
atggcgccgcccacgccagcagttgaaggcgcccaggcgccgcaagggcggcagcaacagccgcaaggagggtttggcctcaccggaatcatacgcatggtcgttttctggtacttcgcttccaaattcttttcccccaaaaaacctaccgaaccttccgctctcatctccaatctctttcagaaagcacagcctctggatatgtggctttatctctccgagcacgagaagttcaatgactttggcagtgaaagttctcttgtatggcatgaaaccaatgttccatatgctgtttggggacctgagagtaccaggactcatactttgaagtatcatccgtcggagtctttgaagcataatgggagtctatatgctcatgttttctttgcgcactctggcttttcgcctgacccaagtgatccggagtaccaacctcaagcagcgtttggaaggacgcatcctgttgtgacgtacttgcccaagtcaaaagcagataaaaagaaaagtctgctgggaagttcaccagattctagtgaggctcaagtggcatccaaggtggttgatgaatctgaagatgatgatgattctagtgatgatggtgattctaatgatgatggtcctgtggagtgggcttcatattggaaaccaaatataacaataaacttggttgctgacttcactcaccttccttctctagaggctacatctgagctccttcaattagctatatcctacagcatctcagtcaaattgatctcaaatcatcaacatgcgacgtaa

SEQ ID NO: 42789 - DNA, 237 bp, Glycine max
  Peptide Sequence Number=SeqID_159567
atgagtgtgaccctcacaaatgagatgctttgggagagaataattggcgccagcggggaaaagaatgcaatggcttcaacaagagggaaagaaaggaagaaaaggggtggtctattgtatcatggcatgcatgattggagactgaagaggacgcgtttgaggagtgcgtgtggttgggagaggagtgaggtggaaaatgatacttggaagaaaaaagaagaaggaagaaataaatag

SEQ ID NO: 42790 - DNA, 1932 bp, Glycine max
  Peptide Sequence Number=SeqID_159568
atgtgtgagagagaaagacagaaatcagagagagagaggggttggtgcgtagtttgtaagttgcttgcttgtagcattttgctgattttaatttacagtgagcacaggaaagaagaggtaaagaagagagaagtggtaacacaaaacacaaacacaaacatgttcgatggagtaccagaccagttccaccaattcataactccaaggacctctctacctcttcacttacctttccctctccatacttcaggaggaacccccaatacgaccaccttcccctccaattttgatccctataaccatccccatcaattgccactccaacccaacaatctcttgcacccattacaccacaaagatgaagacaaggaagaaaacaccaccgtcccgatgaacttggaaatccaaagggatcaaaggcaacaacttcccgagctgattgatccctggaataacgatgaagtgcttgcgctcttgaggatcagatctagcatggaaagttggttcccagaactcacttgggaacatgtctcaaggaagctagcagagcttggatataagaggagtgcagagaagtgcaaggagaagtttgaagaagagagtagatatttcaacaacattaattacggcaagaataataataataataataatagtagcaattatcggtttcttagtgagcttgaacagctttatcaccaagggggtagtggtgatcatcatcttgaaaatacgactcagccaccactgcagaaacaagacaagatgggccaccatgcattggagttggaagtagaaggggattctagaaacgttgttgacgcattggtgacaaaacaaaacgagcaaagcgacgaggcactagcagtggaaaagatcacaaaggaccgcaagaggaagaggcctgataggtttgagatgttcaagtgtttttgtgagagcattgtgcacaagataatggctcagcaagaagagatgcacaacaagctccttgaggacatgatgaagagagatgacgagaagttcactagagaggaagcttggaagaagcaagagattgagaagatgaacaaggagcttgagatgatggcacgtgagcaagctattgcaggtgatagacaagccaacattatccaaatccttaacaaattctcagccacttcgtcccctgcaagccacaccctcaagaaggtaaacaatgattcaaacataaacacacacattacacaaaaccctaatccttcacaaacagaaaaccctaccttaagtgttgcacaagacacattacaagtgattccttctacttcttctacttcaactccagctcttccccagaaccctagtacttattctctaaatatccagaataataataataatattccagtagagacaaattcggttttgaataaagggaatgagaaagacgatgttgggagaaggtggccaaaggatgaagtgttggcactgataaacctgaggtgcaccagtgtgaacaacaacaacaatgaggagaaggaagggaacaacaaggtccctctttgggagagaatctcacaagggatgttggagttgggatacaagaggagtgcaaagaggtgcaaagagaagtgggagaacataaacaagtacttcaggaaaaccaaggatgttaacaagaagaggtcccttgactcgaggacttgtccctactttcaccaattgagcagtctctataatcaaggaaaacccgttctgcaatctgaaagccacttgaatagtccacctaatcagaatcccgagcaagtgacaccagatcaaacaacacaagctcacgagtcttcttctcaggtggggtctggtggtggtttcagtgtgcagcagcagcaggttgatcatggaggtgagaaaaccttgatgcaagtaccttctttggatttcgatcagttttaa

SEQ ID NO: 42791 - DNA, 466 bp, Glycine max
  misc_feature (388)..(388): n is a, c, g, or t
  Peptide Sequence Number=SeqID_159569
gtacatcatgagttcggttataacagtgttgtatttcgatggaaggagcaatttacatggtgatgaagatgatgatgatgatgatgattatcttgtgtctaactcatacgttgaagagtctttagaaaaagatgataatattgacggtatatctaatacagacgatgacgatgaagtcaccgacatgattcaaccagtaagaattgttcacccagtagaaggtgtacaaggaattcaaaatccattttggaatgatgctttgcattataacaatatcaactggagtcatcctgatgaagaggacatttgtggtttggagatgccatcgagtattaatgttggccaaaaattatatgttggcatggattttgatagtaatgatgcggtncaaaatgtagtcaaacaatatgttatgaaggtgcatcacagtttcaaagttgttgaaagcaaatcgaacaagtatgtc

SEQ ID NO: 42792 - DNA, 336 bp, Glycine max
  Peptide Sequence Number=SeqID_159570
atgattcgactcactgctacttcattagtacatccggaggaacctgcatgcacactgcagcagcctgtggagtggatactacctacacctactccatatcgactagtggagccagttcaagtgatagaggtgtcatcctctgaagaggatcctgaagaggacccaaaggagttacctcctgaacctgctatggatgcccttgacttacctgaggatgatgaagacccactccctgatgttgattctccagaggatattatgtcagcatctgaggcagactctacagaggagagtggccctggagggacaacgattagtgatgactcttcatcgtag

SEQ ID NO: 42793 - DNA, 243 bp, Glycine max
  Peptide Sequence Number=SeqID_159571
atgggttttcacccaacaaaactcaatttcgtgcctagcgatgcggatgaggcgccacccgatgtttccatttgcctgcatgcctttggtattgtggggtgtggttcgtttagtggtgtcaagtcttgcgaactgaacgtgggtggtctagtgcccccactttgttccttaaaatcggttgtctcggatgacgcttgccctggcgcttgctttgttcaacgcgatgctactactcttagttag

SEQ ID NO: 42794 - DNA, 332 bp, Glycine max
  Peptide Sequence Number=SeqID_159572
atggccaacatcgatcccgtaaatgagccatatgatgacaatttgtattttgatccctcggttttggatcaaaatgaatatgaagatttctctcactttttccaagttgatattgtgttcgacagtagggaagaattaatcaactgggcgaaagaaactgcagttagtcattgtcaccgtttgatttgtcagtctagaagggagaatgcacagtacatgacgtgtgacaaatacggacatggccgacaaacgaatatcgatatggaagatcctagaaacacaggaacaaaaaaatgtggttgtccgttcaaattgattggcaaaaggtcaag

SEQ ID NO: 42795 - DNA, 126 bp, Glycine max
  Peptide Sequence Number=SeqID_159573
tgttcgttgcaattcaaatcaattcttccaccgttcgcagctgataaagcggtgtgtgagttggtcttccgcggcgagtctccgtctccgagaaaggacactgctttgctgttgtttgagtcgtga

SEQ ID NO: 42796 - DNA, 1035 bp, Glycine max
  Peptide Sequence Number=SeqID_159574
atgtcaagttaccttaactttgggtgcccagacttgaatgtcgatcctcttactgggaactactatccaattgtttatttcaatgagttctggttactcagggataagctgatacctttaaacgagacagtgactgaattatcacttaacctggaagttggtcccattagtatgacaaagtggcagttattcctgcagattgaccagtccttccagattcaccgtagttatggaagcatgcttgaaggcgaggctgatgaactcaagggtattcttggaagggaatccttacctcctggcaattaccatgtctttaagaaagcacctccaataaggaaatgcatatggatttggttagaggtacagcttattatcttcctttatctgcttgacaatgacacctcttggatgattcttgcaagctctggaattggttgtgttattgagttctggaaaattggaaaagccatgcgcatagagattgataggacaggaaggatacctatgttgaagctccgcgatcgagagtcatatgtacggaataagacaaaggaatatgatgatattgctatgaagtatttgttctatgttctatttctccttgttgctggtttttctgtttactcgctgatgtatgagcgtcacaagagctggtattcttggattctgtcttcgctcacaagttgtgtatacatgtttggctttattatgatgtgccctcaattgttcatcaactacaagctcaaatctgttgctcatctaccttggaggcaaatgacatacaagtttctcaacaccataattgatgacctttttgcctttgtcattaaaatgccaacactccatcggctttctgtcttccgtgatgatcttatctttgtcatatacttataccagaggtggatttataaagtggacaagaaacgtgttaatgaatttggttttggaggcgaggatgatcaggttgtggcagagacagacgccacaaaggaagaagagaacactacaacggaagaagagaagaaaactaattga

SEQ ID NO: 42797 - DNA, 348 bp, Glycine max
  Peptide Sequence Number=SeqID_159575
atggatttggaaagtataaagatgttagaggaaggaagcgaaagcgaatggaatgcctgcgaaggttggtcgcttactcaagaattgatagagaagaccgatagactctgtagtgaggagagtagaccagatggagagaagacaaacaattcgaggcagaggaagaccaaaaagactataagagaggttatcaaaaaggatctcgaaattaatggtttgaatagaagtatgttagctaccactccttgtccggttgcaacagttgtttccaaagaacaagtaactcttgcgagattcactggtcagtggagaaacacgtcagttgatgaaatagccattttcttgtga

SEQ ID NO: 42798 - DNA, 849 bp, Glycine max
  Peptide Sequence Number=SeqID_159576
atgtgtaccctcgaacccgacgtcatcggcatccgcggcttcgagctacgcctcattcgctgtaccatcactttctcacagccctcggattcccgccacgaacttgaatcgttggatggccacatcaacgacctcttgaattccatcgagcgcggcaactacgtcgaagcactcacctccgaaccttccttctccctcgtattccgactcgacggccatgaatcgctgccactcgacgcggaccgagtctactccgagttggtccaccgcgctgagtccttcctcagagacgccgccgccgccgaacagcgtcgcagggcaatactcgtcatgtgtattgccatcgccgcatttctagggttcactcaatccaacttcaccgggcctttgaaaggaacagagctatcgaaatgtcttctgtgtttggatggaagtgatgaatgggacaattgggcgcggaatcagttcatgtctgctggttctgacttacttggaaagttctccaatcttcagtacttagttcttgccaagatgttgcttatgcggatgaaggatttgtccgtcgagattggaagcctttcatggtggcttgccagggttttgcttcttcaactgagagttttggacgagcggtcttcgtccttgtctgatctcttgcacgtttatatgggcgaagctttgcagcaattcagcacttcgaaactagttcggagttactgggaggatgatctacgtgatggggagagctctgcgattgtctccgtgcttcatttagaggctggaattatggaatatttatatgggcgagttgactcttgcaggttagttgctatcaacagtgaaccatga

SEQ ID NO: 42799 - DNA, 1599 bp, Glycine max
  Peptide Sequence Number=SeqID_159577
atgtccaactccaccaccggcaccaccgcggccttaccaccgaagcccacctgggtcctcccataccgaaccgagaatctccgcgaggtctacaccctaagccgaaagctcggccagggccaattcggcacaaccttcctctgcacgcacaacgccacgggacgcaccttcgcctgcaagtcaatcccgaagcggaagctgctctgcaaggaggactacgacgacgtatggagggagattcagataatgcaccacctctccgagcaccccaacgtcgttcgcatccacggcacctacgaggacgccgcctccgtccacctcgtcatggagctctgcgagggaggggagttgttcgacaggattgtgcagaaggggcactacagcgagcgccaggctgcgaagctcatcaagaccattgttgaggttgtggaggcttgccactcgcttggggtcatgcatagggacctcaagcctgagaactttctctttgatactgttgaggagggtgctaagctcaaaactactgattttgggctctccgtgttttataagccagtcactatcagatcaactggaaacccttccatgttatgtatgcttaacacagtgatatacttctcaggtgaaaccttttgtgacgttgttggaagcccgtactatgttgcaccagaggtcttgcgtaagcattatggtcctgaagcagacgtgtggagtgctggtgttattttgtacatcttattaagtggggtgccaccattttgggctgaaactgagcaggggattttccgacagattttgctaggaagaattgacttccagtctgagccatggcctagcatttcagacagtgccaaagatctaattcgaaaaatgcttgatcggaatccaaaaacaagggttacagctcaccaagtactctggtacaaagctgtggcacttatgtggttttctgtgtcaggtcacccatggattgttgatgacaacattgcaccagataaacctcttgattctgctgttttatcacgcctgaagcagttctctgcaatgaataaacttaaaaagatggctttgcgtgttattgcagagaggctctctgaggaagaaattggtggtctgaaggaattattcaggatgattgatgcagataatagtggaactataacattcgatgagctaaaagaaggcttaaagcgagtaggatctgaactaatggagtctgaaatcaaggatcttatggatgcagcagatattgataatagtgggacaatagactatggtgaattcattgctgctacagtccacttaaataagctggagagagaggaaaacctggtgtccgctttctcctattttgacaaagatggaagtggttacataaccattgacgagatacaacaggcttgtaaggattttggtttggatgatgtccatatcgatgaaattgtcaaggaaattgatcaagacgatgatggacagatagattatggggaatttgctgccatgatgagaaagggcaatggaggaattggcaggcgaaccatgaggagcacgctcaatttcagagatgcttttggaattatagaccatggatccgattaa

SEQ ID NO: 42800 - DNA, 1170 bp, Glycine max
  Peptide Sequence Number=SeqID_159578
atgggcgagtcaagcgactctgtctccattgacattgatttgattcctttaggaggaaaggaatgcacggtgaaaacaagtaaaggctccatgtctgtgcttgtttgtggggatcgagaaaaacccgctctaataacctacccagacgtggctctcaattatgtctcttgtttccagggtctgttgttctgcccagaggcagcttctttgttgcttcataacttctgcatttatcacattgatgctccgggacatgagttgggggctgatgtcatttcttcagatgaaccattgctctgcgtggatgaccttgctgaccagattgcagaagtgcttgatttctttgggctaagggaggttctgtgcttgggtgtaacagctggtgcttatgtcctcactctattagctatgaaatacaaagaacgagtgcttggattgattcttgtttcacctatttgcaaatctccttcatggactgaatggctttacaacaaggtcttaatgaatttattatacttctatggtatgtgcggtgtactgaaggaatgtcttctgcagcgttacttcagcaaagtattcttcacattctttcccttcatccctcattatgaaggtggaatcatttctgaacttaggtgcagtgttcagggagcagaatcagatataatactaacttgccgaaggcttttggatgaaaggcaaggtttgaatgtcatgcgatttctccaagcaattaatgcaattcgaattggtaatagttgttattccatacagtttattctacgggactggagaaccaaattctattctgtggctaccgacttgttggatttttggcaaaccaacatggcatgtgagagtagtccattccatgctgaatctgtgtacatgagctcaaaaatgaaccacaaaatctgcgcacttgttgaggttcaggcttgtggctcattagttacagaagagcacccaaattccatgataacaccacttgagcgtttcttaatgggttttggctaccacagacaaacacatgctgcttcctcatcaagcaacggttcaaatccagcaagccccactagccattcatgcatagcaccagaactcctctccccagagagtttaggaattaagctcaagcccatcagaacccgtgttgatgttcaaatctaa

SEQ ID NO: 42801 - DNA, 594 bp, Glycine max
  Peptide Sequence Number=SeqID_159579
atgaatctaagtcttgaaaacattcggcatgtggaggcactggaaggtgtccagatgattttgaatatgagcaataataagagagttgattgcgaattattggaaagaatcactaaggaggtggaaaagcggctttcaacaagtaacgtgccccctttgataactgacaataagcctaaaacagatcaattctgcattgttgatcctggatcagaaaatcaagagcaagtatctggagcatctattacaggaagatcacgtgaaactgaacaattattgttattacttggaaaagttttacagcagataattaaaactgggagtggatgtggaccagaaatctggggcttatatgccaaatggcacagaattaatggagatctcatgatgtgttctgaagccctcttaaagcaagttaggtcactccagggatctgatacatggaaggaccgagaccggttcaaaaagtttgcaaaagtttctttggaactttgccaggctcagagcttcaccgatacagaagagttcagggatcttcaggcttgctatgatgaagtgaaaattaaactccaatcgaactcaatgcctagctaa

SEQ ID NO: 42802 - DNA, 243 bp, Glycine max
  Peptide Sequence Number=SeqID_159580
atgccaaagtaccaatgtgatgcagatgcgagaaaagcaccaaaggggcaattcgttgtttatgtgggggaagaactaagaagattcaccttaccactatcttacttgaagaatcctagctttcagcaactgttgaagaaatcagcagaggaatacggatatagtgactcaagaggcatagtccttccatgtgatgaatcaacctttgaaagcttcttcatgaattccaagatgaggatatga

SEQ ID NO: 42803 - DNA, 1374 bp, Glycine max
  Peptide Sequence Number=SeqID_159581
atggatcagtgggatgctcatcatcgactcatgttcattggtcggcatgaggaagatggaactgctgatacttctaagggagaggaatcaaatgatgaagaaaaaataagtaaaactgaacccgtctttgtgcctgaaactaagaaaaggaaacgccttagccttagtcagcttaaagaggtgaaagaggagtcacatgggaagcaaagcagtagcaagtctaagagaaagaagcatgatagtagggatagatggtcagctgagaggtatcaattggccgagcaaaacatgtgggaggtactaaaggctgaaggggcgacatttgaaaacccaataacccgacctgcactaagattagctgcccgcaaacacattggagatactggacttttagaccacttactgaagcacattgatggtaaagtggcacctggagggactgagcgtttccgaagatggttcaacaccaatggaatcatggagtattggttggagagtgctgacttggacaaggtgcgccaggaggcaggggtgcaggacccttactggataccgccatctacatatagggaagctggtgccccctcccagaatattgattcttctggtgaattgaaacagcttaaaatagaattgatgcaaatgaagaaagatatgcatgagctcattgccaagaaggaagagaaaagtgatattaacatggtggagcactttatgatgttttgttttgagttgctatggcaggagacacacaaggaatctgtaaagtggaaatttatgactgaccatcgccttactgaaatcatgacttctttgaaggatattcaggggaagtatggtgaattgatgatttggaaaactacagttgagcaacaacttatggaaataactgataaattgaatgatcttcaagcatctagggagtgcaccactaatagtcctccttcagaaaggtggaaagattggatagaaagtaccaacctagacaatattcaggaagatgcatttgcaacttggattgggaatccggagctacttaatgttccacaagaggttatacttgaagatcccaacacaaccataccaacacagccacccagtgaagaactgactaacaagaggagcgatgtgctggagttagtacctggtaaactagaagatcaacctaatgtaacccctgattcttctacaactgttaattcgaagtcagaccatgacaacaactcattgatcatgtttcagcacaatgtattcaatatttatgatgttttctcacaggagatgtttatggatttatacaaatggaaagaaaaaatggaacagcagctgttggaggtatcgaatactgtatatggtatgctggcaatgaagtag

SEQ ID NO: 42804 - DNA, 294 bp, Glycine max
  Peptide Sequence Number=SeqID_159582
atggtgaccacccacataaaagaatgggacaatgtggaagaaaatggtaactgggttgaacttttggaaggctgttgcttttacctgacaaggacacatgaacgaacaagagaggagccactcaaggtggcttcatttctcaagttcggggaaattctgagtaagaaatgttatgttaaagttgaatgtaaattccctatatttggcatgtatgtattcaaagggagggaaggagtgaaaggttcagaagcggttcctcagaagtggagcccacactctcgtgtaaaaacgtaa

SEQ ID NO: 42805 - DNA, 2871 bp, Glycine max
  Peptide Sequence Number=SeqID_159583
atggcaaaaagtcggttgaaaactctaactgagttaagacgtgttagagtggatagtcagatcctaatggtacatcgctgtggcaagtgggtaaaactctctggtacagagcttttgcctggggatgttgtctccataggtcgctcttctggtcagaatggggaggagaagtctgtaccagcagacatgcttctattggctggaagtgtgattgtgaatgaagctattctgacaggcgagtctacccctcaatggaaggagacattgtcagcaaggcaagataaaaaccatgtgttatttggtggaacaaaaatattgcagcacactccagataagagttttcctctaaaaacacctgatggtggctgcttggctgttatcttgagaacggggtttgaaacaagtcaaggaaagttgatgcgaacaatcttattctctacagaaagggtgactgctaatagctgggaaagtggattcttcattttattcctggttgtatttgctcttattgctgctggttatgtgcttgttaaggggctagaagatcccacaaggagcaagtataaacttatactaagttgttcacttattgttacttctgtgattcctcctgagttaccaatggaattatcaatagctgttaatacttccctgattgcactggcacggcgtggcattttttgcacagagccttttcgaataccatttgctggaaaggttgatatatgctgttttgacaagacagggacacttacttctgatgacatggaattttctggaattgttgggttgaatggaactacagatttggaatctgatacgagtaaagtgcctctgcgaactgtagaaatcctggcttcttgccatgcattggtatttgttgagaataagctggttggtgatcctcttgagaaggctgcacttaagggaattgactggagttataaatctgatgacaaggctgttccaaaaaaccctctgtcaatgttttatcctgatatgctatcaaatttcaggggaaatggccatcctgtccaaattgttcatcggtaccattttgcatctcacttaaaacgaatggcagttgttgttcgcattcaggaggaatttttcgcctttgtgaagggtgccccagaagttatacaagataggctcgttgatataccgccatcatatgttgagacctacaaaaaatacacacgtcaagggtctcgtgttcttgctctggcttacaagtctcttgctgacatgacagtcagtgaagctagaagcttggataggggtatagtggagagtggacttacttttgcgggttttgtggtatttaattgtcccataagatcagattcagccactgttttagctgaattgaaagaatcctcgcacgacttagtgatgattactggtgaccaagcgttgacagcttgccatgttgctagccaagttcatattatatcaaaacctacattaatccttggcccggcacaaaatggtgagggatataattggatgtcccctgatgagactgaaaacattcgctacagtgagaaagaggtcgagtctttatcagagactcatgatctctgtattggaggtgattgcattgagatgttgcaacagacatcagctcatcttcgggtcattccctatgtgaaggtttttgctagagttgcccccgagcaaaaagaacttatcatgaccactttcaaaatggtgggacggttaactttgatgtgtggggatggtaccaatgatgttggagctttgaaacaggcccatgtaggaattgctcttctgaatgcattgcctccaactcaaagtggaaactcctcttcagattcgtctaaggaagaaggttcaaaatctggcaagcaaaagaaatctaaacctgcagcggacacatctgggaagactgctggtgaaggcacttcaaaagccaaagttgcttcaaaatcagattccgctagtcactcatctggtaaccgtcatcaggcagccgttgagatgcaacggcagaagcttaaaaagatgatggacgagcttaatgaggaaggagatggtcgtgcacccattgtcaagcttggtgatgcctcaatggcatctccattcactgctaagcatgcatctgttgctcccaccactgacataattcgtcaaggtcggagtaccctagtgacaaccctccagatgtttaaaattctgggtctcaactgtcttgctactgcatatgtgttgagtgttatgtatctggatggtgtcaagctaggtgacatacaagccacaataagtggtatcttcactgctgcatttttcctctttatctcacatgcacgccctcttcccactctttctgctgaacgtcctcaccccaacatcttctgtgcttatgttttcctttccctcttgggacaattttctattcacctgcttttcctgatctcatctgtgaaagaagctgaaaaacacatgccagatgaatgcattgaacctgatgcagattttcatcccaacctggtgaatactgtttcctatatggtgagcatgatgcttcaggtggccacatttgctgtgaactatatgggtcatcccttcaaccagagtatttctgaaaacaggccgttccggtatgcacttgttgctgctgttgttttctttactgtgatcacatcagatctattcagggacttgaatgactggttgaagttagtgccattgcctgtgggattaagggataaactattactttgggcgtttctaatgtttttggtttgctattcgtgggagagactgttgaggtgggccttccctggtaagatcccagcttggaagaagcgacaacggcttgctgtatctaatttagaaaagaaacag

SEQ ID NO: 42806 - DNA, 2154 bp, Glycine max
  Peptide Sequence Number=SeqID_159584
atggcagttatttctgctagtactgtctctgggacctcaggattgagccagtttcttcctatttccagaagagtattaaaggggctcaaggaatatggaaggaaactggttgacctggagttattcagtcaatatcttgaggagtgggtcttggagaatctaaatggtgattcagaagatgggatgcaaagttttcgttctcccttcacaactgatgaattgtgcaaacttgatttggcattggagggggtaccatttcagcaactcgtccgtatgccattctttgctgacgtttctgatgagcttatagaagatcagtatctagctgcagaagatttccttcatgctattataattggactttggcgtacgttttggcataaaagtggaccactgccattatgtgtctcttgcccctctcatattggttcgaggttcagtagtgttgaaaaggcaatatcaaggggaagactgagggaaatgcgtggtttaggtttaatatcaaaaattgctactgattcaaaatttaaatgggatcatatggtagagtttgccttattcaagccagaagtattcttggacaatgattcaagactatcagccagcactatttgtgaagctctcttttatggtttccatgttcttgtttctcggagtttgagcaagattagttctgtcaacagtgattctgttttccttctagttctagattctaaatgtggagtagtgataaagttcagtggtgaccttgggaaacttgatttattgaattcaagtgatccatatctatctgttgctgaatggatcaaaactaatgctgaaatttgtgtcaccccagtggaaccaatatggaaccgattaggaaatccaaattggggagatataggaactctacaggtactattggcaactttctactccattgcacaatggaatggacctccgcgaaaatcagtagcctcattgatttcagatcatagtctccgccttcagaagcggagaacagaatgctgcatcattgagactgaaaatgcattggtgccttatcatgagacatctgaccatcaagcaggagaaattgttgagcttgatcaaaatgaattattttcccataaccgagcttcacgtttgaagctcaagtgtggtgacatattggccttggatgatccacagcagggacagaaaagtttccaaattcatgaatctctggtaggagggaagtattatctctatagtgcagtttgtcttgatcatccctcggagttattgactttatatgtgggtgctcatccatctagacttgagccttctttggaggatatgagcctttggtaccaagtgcaacgccaaacaaaagttctaaacattttgaggaatcagggaatcttgagcaaatacttacctgaaattgttgcctctggtaggattttacattctggaccttgcaagaaagagagccccgggggaaggtgtgatcacccttggtgtgggactccaatactggtgatatctccaataggggagccgctatcatctgtggttgctaatgaggggtcattttctgcagatgaagcaacgcgcttgtgccgggattgtctagctgctctaagaagcgcagccatggctaatgtccagcatggtgatatttgtccggagaacatactacgtgttgttgaaaaacaaggtgtgagaaaccaaactatgtatgtccccatatcttgggggcgtggtgtgttggaagacagggacagccctgccataaatttgcagttctcatcatctcatgcacttcagcatgggaagctgtgtccttcttccgatgctgaaagcattgtgtacatcctctattttatttgtggagggactatgtctcttcaagattctattgagtctgctttgcaatggagagaaagaagttgggcgaagcgatcgatccagcaacatattggtcaggtttctgctctcttgaaagcatttgctgattatgtggatagcctttgtggaactccataccctattgactatgatatatggttgaaaaggttgaacaaggctgtggaaggctcagcagataaaggtaaaatgatcgaagaagtacctataacattaagattagaggatgctgcggagtcttcaggagcttctggcccttga

SEQ ID NO: 42807 - DNA, 660 bp, Glycine max
  Peptide Sequence Number=SeqID_159585
atgcatcagcatcctttgaactgcagcagcccggatgtcaagttccttgttactgactgggagagattacctggatttggaattggggctcagattgctggcatgtgtggacttcttggtattgcaatcaacgaaggaagagtccttgtcactaactattacaacagagctgaccatgggagttgcaaagggtcttcccggtctagttggagttgttacttctttcctgaaacctccctagaatgtcggcaacgtgcatttgaactcatgaaaagtgaagaagcgtggagtaagggaattgtgaccacaaaagaaaattatacaacaaagcatatatgggctggacctactccaaggaaatgggggcttccatggaattatttgcaacctacaactgatataaatgggactctgttagcttctcatagaaaaatggatagacggtggtggagagcacaggcagtacgctacttaatgaggttcccaaccgaatacacatgcaatttaatgaacgaggcccgccacgctagctttggaaaattagctgcaaaaatggtccttgaaagtcttgctggggattggccaaaggttgtagttaaatttgcactatttttcttattggacgtgaaagaattaaagagtggaagtagtacattgtaa

SEQ ID NO: 42808 - DNA, 201 bp, Glycine max
  Peptide Sequence Number=SeqID_159586
atggagaggtgggacaccaactcaaaaaaggttgttgcatgggaaggtagtgtattagcaaatataaaaaagagattgatgttggaatccaggaatacaaataattggcttcccaggatggctagggaccatttgtttgaagtcatactcatcacccaacttgaagacaaatttacaatgaacttgcaaactcaagaatga

SEQ ID NO: 42809 - DNA, 512 bp, Glycine max
  Peptide Sequence Number=SeqID_159587
atgaacggagtatcacccgaagcattgcaactccgcctgttcaagcactccctacaaggagcagcccgagaatggttgcaaactcgtgcaccgcactccatctcgccgtgggcccagctagctcaacttttcatgaacacatacaactccccaacaaaaactgagagaatccggtgcccgaatcacggacttcaagagtggcgccaactgcaaatattttacgatggactgcaagacaactcgaggacagtgctcgactctgcagctggaggtatgttcatgagtctgacctatgacgaagcatacgaactcttggagcgaattgctagaaataaatacatgcgagcatcggaccggtcgaatagcggagcagtcaagacgggaggaattttggagttagacggagtcactgcaatcacggcccaattggagaagctatcgaagcaagtagcggctttgcaaactcagcaagtccacgcagtccaagctcccgatcaaagcgtagacgaaac

SEQ ID NO: 42810 - DNA, 300 bp, Glycine max
  Peptide Sequence Number=SeqID_159588
atgtatgttgttttaatttcgctggaagcgcaaagagccaactcgctcggtactacgaacccgcagcgagacaactcccacgaggagccaactcgctcggtactacgaacccgcaacgagacaactcccacgaggagccaactcgctcggtactacgaacccacagcgagacaactccctcgaggagccaactcgctcggtactactaacccgcagcgagacaactcccacgaggagccaaactcgctcggtactacgaacccgcagcgagacaactcccacgaggagccaactcgctcg

SEQ ID NO: 42811 - DNA, 435 bp, Glycine max
  Peptide Sequence Number=SeqID_159589
gagttcttctcggagaagaaagtggtagacatcgtagaaggtaccgtgaaagggatcagtaacgcaggtgtcgaagttgaaatttcagagggagtgagggggttcattcccaggagacaactctgctacaacaccagaatatctcctgaagacttagtgaaacctggccagaacataacagcgaagattatcgaactggacaaggagaaaaagaacgtcatcctcagtttgaagaggctcatgcccgatccgtgggaaaaagtggaagagaagtacccggttggaaaagtggtgaatggagaagtgatttcgattcatccgttcggattttttgtgaaactggagcccggtgtggaaggacttgagcccaggtctgaagtcttctgggggaacacagtaaaaagtcttgacaatgtgatgagtgcaggagatctg

SEQ ID NO: 42812 - DNA, 549 bp, Glycine max
  Peptide Sequence Number=SeqID_159590
aaaagtaagaaattccaagggaaacgagatgatccaacttacgggagcaaattagtgacattcttactcggccccttccacaaaaacacggcgatcccagctgaggatagggagatacctcttatcgtagggagaccgtttttagccacgtcgaaaactctcattgattgtgctagtggtgatcttacaatgactgtgcatgatgaaacgatcaaatttaatgttttttatgctaataaaaatccatgtgagaataatgagtgttttactattgagcttatggattttacaaatcatgaaaaatttgatgtttcaactttggaccatgggaaagcatcgttgagtgcaggagatgacgacggaaaaaggaatcggaaggaacacatttattgtgcggactcaagttcaactcctccgagagatagtcaaaagagttggggcgctaacggtgatgaacgtgcaaggaggatgtggccacctaaaaaaatcaaacgagcatcatcggggagaggaattcaattgccaagtgacttcggtcacgtagcttga

SEQ ID NO: 42813 - DNA, 201 bp, Glycine max
  Peptide Sequence Number=SeqID_159591
atgactttgatcgctgaatacgcgggcgatgttggttacataagaaatcgggaggaagatgattgtgacagtatgatgactcttctttcttcagtcgaccagtctaaaagtcttgttgtatgtgcagataggcttggaaacatctcccgatttgttagtggcattaacaatcacacaactgtattaatattcaaggagtag

SEQ ID NO: 42814 - DNA, 457 bp, Glycine max
  Peptide Sequence Number=SeqID_159592
cattggatcattgggaacacgtggagagaccgacattgtagaggacgtgcatgtggagaattgtactttgaccgaaacattaactggagtaagaatcaagacatggcagggtggagctggatatgctaggaggatcacgtttgaaaagattagatttgttcgagccaataaccccattatcattgaccagttttattgccctcatagatcggactgccaaaaccagactcgagcaatcaagataagtgatgtaacatacaaaggaattgttggaacatcattgacggacaaggcaatcaatttgagctgtgaccaaaatgtaggctgctccaacattgtgcttgatcatgtttacataacaccttcagttccagggcagaaggttttttcctattgccataatgcacacggaatagccacacacaccaaaccatccgtaaagtgcttgctgaagtag

SEQ ID NO: 42815 - DNA, 423 bp, Glycine max
  Peptide Sequence Number=SeqID_159593
tcgtggcaggagtatagaggaggaggaggaggggagaagaatggggatgttagggttggtggttttaatcctaagttgatgaggagtaatagcagtgtgagttggaggaatgggcagagtatgataggtggtgttggtggagggtttgggaatgtgagtatgaggaagagtgatgtgcaagggaatgaacttggacttgggcttggtggaaggaaggggagggatgagtttgttgggttggagaggaaccgtagtgccaggtattcctcgccgaacagcatcgataacaatggtctcttgaggctctacttgggtggcaggagaaacggtggaattggtgctttgtatgcctttggacacggcgtgtttttctttttctgtctttatgctgcaaaagggtggctgattggtggtgttgagagg

SEQ ID NO: 42816 - DNA, 147 bp, Glycine max
  Peptide Sequence Number=SeqID_159594
atggagaaaaatgtcccgcaaatacaaccatcagcatcagccttcaccagctttgaggtattgacatctgtatttccagtgtggaagacacacagaggtgatgttcggtgtaaagtcaacggcaaagaattattggttttcatttag

SEQ ID NO: 42817 - DNA, 1212 bp, Glycine max
  Peptide Sequence Number=SeqID_159595
acttcctccactgccgccgcagcccttaaggccatcttccgcccctccattgcagcccgcaaccgccctcccccctcctccttcctcccggagctccgccgcacaaaatccttctccgcctccaaaaacgaagccctctccggcttcttcgaaccacagagaaaatcctgcgacgtccgcggccgcagcacactcttctccctcttcaaccaagaagccgccgtcgccgtcgaggtcgaaacccgccacaacctcccttcatcttccgtcgttcagaaacccgtcctcgagtccgaagaagaagaagaacaagaacaagaaaacaacaacattgtcgttcacaacgtgaacgacaacaacaacactagggttccagactcactacaaccacaaccagaagcaaccaataataccttcaccgaacacagagtttcggtttcagaaatcgtagaagaggaaccggagatagtactcgaacccgaagctgacgtggcagctgcagaagaagacacactgaaggagacgaaggaccacatggatctggattcctcccaaacaaagaaaccctccggcggccgcgacttgaagggcagcttctggtccgcggcttcagtcttcagcaagaagctccagaagtggaggcagaagcagaagaacaaaaagcgcgagcgaaacggcgtcgttgtgggctccggaaccctcttacctgtcgagaaaccgatctcgcggcaattccgcgagacgcagtcggagatcgccgactacggcttcgggcgccgctcctgcgacaccgatccgcggttctcgctcgacgctgcccgaatgtcgttcgatttcgaagagccgcgcgcttcctgggacggttatttgatggcaaggacgacatcatcgttcgcggcggttcctccgaggatgcctactatgattgaagacgcgcctgcgccggttcaggttctcagaaccgattctcttatccccgtggaggagccggaatatgaggacgctctcattctcaatctcaatcttaatcctaatcctaatctccctggtggttctgctcagacgaaggagtattattccgactcttcgcgcagaaggaagagtcttgatcggtctagttctattaggagaactgctgctgctgttgttgctgaaatggatgagttgaaggctgttgcaaatgctagtgctaatgctaatgctaatgcgagg

SEQ ID NO: 42818 - DNA, 414 bp, Glycine max
  Peptide Sequence Number=SeqID_159596
atggttttaccaacattacaaggaaaggatatagattacccttggaaacaagacgtcataggtgatccaacaacaaatgtcataacaaattggcaagttaaggatggtgagttaatccaatcggaattacctcccgcaacacaatatcaactaccaaatatcaaagacagtaacaataaacctgtcatggcaatcccattcaagacaaaagatgtcaacgaagaagtaacctctaaagacatcaagagcctagtggaacaggcgaattataccaataaatatttacaagctttaggagaaaccataaaaactaaggtagttcctaaacaaaaatcaattgaggaagcttcgccaagtatccccattgaaaaacctttattcaaacctttcaaagttagtgagaaggctaaatga

SEQ ID NO: 42819 - DNA, 780 bp, Glycine max
  Peptide Sequence Number=SeqID_159597
atggatcctggtctcgaacctcaccatccctccggttattgtgatcgccaccctgaggagcaattcatcggttattgccctgaatgtctttacgaagagctcacagttcatgatgaaaactcttccacctccacccaagtggagtcccatgcaacttcctccatcatttcttccaccaaagctatttttcaacctttcactgccatgtgtggacccaatcgaccttgctcctcctcctccttcctcctcatgcttcgccgcacaaagtctttatttggcaccttcaaatcgcaaagaaaatccaacaactttccaacccacaacaccttattgtctctcttcaaccaagatgatgaatacaaaattcccagagaggaaccagaagttgaaatgcttaatctcgcttcatcttcttctatcgttcaagaagttgaagaagatagaggaacaagagaaatcaaaggaaatgaaatcatagaggaggaattagaggtggaggcaaaggagacaccagaggcaatgaaggacaccatggatttgggttcgcaagcgaacaagagttatggccatgatttgaagggaatatttcaatttgtttctttgtttaaaaatggaaccttggagctaagaccccattttgagacactggacagtgaggatggacccaagttgctagaagcaagtgttaatcttggacataaaatcctaatatatcaaacaacccttcatcaagagaaagtttggttaagaaaacttaaggaaagtgcgagttttgtctaa

SEQ ID NO: 42820 - DNA, 598 bp, Glycine max
  Peptide Sequence Number=SeqID_159598
atggtttcggcgatgcccggcaacggccacatcgccacgtacgccagcacccaccagggcgcccagcgtccggcgcggtcgtcgcgcacgatgacggcagggtcagccggcgaggtcggcatagaggcggagggtatcgcgctgcatggcctgcagggtaaacgggatgcgggtcggcaaggacggcggctgcgccagcagggccagcgcgcgttcacccaatgcgtgcgcatcgcccagcggcacggcacctgcgggttgcagctgccgcagcagttcgccgacgccaccgtggtcccagcccagcaccgggcggcccaccgacagcgcctcgaccacagtacggccgaatgcttcgggcttgtccgacagctgcagcaccagatcgctggccgcataggcctgggcgatgcgcgcggtcggtgtgctgatctgcacggcatccatcacgcccaaagcagcggcctgccggcgcaggtcggccacgtaggcttcgcggcccggttcatcggtgcccagcatccacagctgtgccggtacaccggccgcgcgcacatccgccagcaactgcagcgcatgagcatgtcccttcaaccgg

SEQ ID NO: 42821 - DNA, 428 bp, Glycine max
  Peptide Sequence Number=SeqID_159599
tcaaagaaaattcagttgataaagggagtgaactgggagaaaccatagccgtgtgcaaggaagcattcggtagcttggatgcagcagctgagagtgtgctgcagttatttttaaaattggaaaatgttcacggcaaagaggtcgcaacgggagctggagctcaatttttagacgaggccactgagctacttcccctagttgttaataaagttaatgctgttgctagattggtgcaatgtaggaagaacagtaagtgtgaaactagtagaccaagtgtccaagaaattgaccagtttggtagatttgccgcaggcagaggcacaagggaaaggattggtggcggcaacgagaacgggtgttgcggtgaagaggaagatagagagaagaagagagtgagcgaggggagaaggggaagatggggacattaa

SEQ ID NO: 42822 - DNA, 288 bp, Glycine max
  Peptide Sequence Number=SeqID_159600
atggaccaactaacagtgcctggtgcagaaacagcgtctacgaaatccacgacacttgccacccgtgaagccttcaagatggcaaaccgaagcgcagttctagctaaaaagagagtaaaccgcaagtacaagacatttctaagacttgacgtaaactacacagggtttggagctaatcaacggcactttcgcaagcacgatgctcactgctcagggaagccgaaagggtctagtttcgggagtaatatatatactttcgaaggaaaaattggaaaattatcaaagtag

SEQ ID NO: 42823 - DNA, 360 bp, Glycine max
  Peptide Sequence Number=SeqID_159601
atgatcaggaacatacctgagggctgtgcaaacaaccaatatataccaaatcatcaatccaaagcagttaagcatacggcggataggatccatgttctagagcagaaacttatctcattaagcccagtgcatccgttatgcagtgtggggacagaagccatccagatagaatctgaacagggatgcttgttgtacagaggctcttcgctatgcgaaggtataggggagggatgttgtacgcagccttacccttgcatatgcaaagaggctgtttccggattcgaacccatgaccaacaagtcaccaaagcacaactttaccgctgcaccagggctcgccctcgtaaaacccatatcatag

SEQ ID NO: 42824 - DNA, 432 bp, Glycine max
  Peptide Sequence Number=SeqID_159602
tccttatgacctagacatcaccgtgacttcactagaggaccagctgtatcgtgacctgtccctgagttccaccgaggaccatcccaagggccagtgttcgtgcagtccaaaatctagtgggaggtcttgcacaaacacaacacacgaactaaaccctagccgctctcacctctctcggccgatctcaacccgcggccaccaccgtcgccgtcgccaccatctcgccggaatcggccatccgttggccgatccctttcgtgtacaaggtgaaatccgagaggaggaagatcgaagatcgaagaatcgaggagcagcgcacgagccgaagccgcatggatccccacgcaccgcccgaagaccacacgtgagctacacgcgccgccgtggccgtcgcgccgctgctgctgctccaccggctgctgccccgggatt

SEQ ID NO: 42825 - DNA, 567 bp, Glycine max
  Peptide Sequence Number=SeqID_159603
atgaaagctcaacacttgaaacctacccgtgaagcattcagcgctttgattcttgcatatgctgaatctgggtctcttgatagggccctccagttattccatactgttcgtgaaatgcataattgttttcccacttttgtcgctagcaatttgttgctgaatggtttagtcaaaagcgggaaagttgatgttgcgcttcagctgtatgataaaatgcttcaaacagatgatggcactggtgctgttgtggataactacaccacctccataatggtgaagggattatgcaacttggggaagattgaggaaggtaggaggttgattaagcatagatgggggaagtgttgtgtgccacatgtggtgttttataatatgattattgatgggtattgcaagaagggtgatctccaatgtgcaactagagctctcaacgaattgaaaatgaagggggttttgccaaccgtagaaacttacggggctttaattaatggattttgcaaggcaggggagttcgaagcagttgatcaacttctgacagaaatggctgcacggggattgaatatgaat

SEQ ID NO: 42826 - DNA, 309 bp, Glycine max
  Peptide Sequence Number=SeqID_159604
atgggcaaccccgtcgagagaacaagagaagggtcgggtcgaagcccaatcgaaaaacttcaaaccgagttctgcgtcatggactcggtcgatgacgaaatgggcaacgtcggaaacgacaaccttggattctgcgaagcgagattcgaggggatcctgccattggtgggttttactagttctaaggatttggatgacgtcggaaacgaggtggttgatgcggggaggcaaagaggaggaggaacctttggggcggtgacgaggtttgattcgagaaagaatggccttggacatttgaaatcaagttga

SEQ ID NO: 42827 - DNA, 1473 bp, Glycine max
  Peptide Sequence Number=SeqID_159605
atggctgagatgggttgtgggccagatattacaacttacaatattatgattaacttttcatgtaagggtggaaggattgaggaagctgatgaactcctagagaaggcaaaagaaaggggattgctgcctaataagtttagttatacccccctcatgcatgcttattgcaaaaaaggggattatgttaaggcatcaggtatgctttttaggattgctgaaataggagaaaaatcggacttggtttcttatggagcttttatccatggagttgttgttgctggggaaattgatgttgcactgatggtcagagagaaaatgatggagaagggcgtttttcctgatgctcaaatttacaatattttgatgagtggtctctgtaagaaaggaaggattcctgccatgaaactactactttcagaaatgcttgatcgaaatgttcaacctgatgtgtatgtttttgccacattgatagatggttttattagaaatggtgaacttgatgaggcaattaagatttttaaagttataattcggaagggtgtggaccctggcattgtggggtataatgccatgatcaaaggtttctgtaaattcggaaagatgacagatgctctgtcttgcttaaatgagatgaatagtgtgcatcatgctccagatgaatacacatattccacagttatagatggatatgtaaaacagcatgacatgagtagtgcacttaagatgtttggacaaatgatgaaacataaattcaagccaaatgtgatcacctacacctctttgatcaatggattctgcaagaaagcagatatgatcagagctgaaaaagttttcagcgggatgaaatctttcgatttggtgcctaatgttgtcacatacactacactagttgggggtttctttaaggctggtaaacctgagagagcaacatccatttttgagctaatgctgatgaacggttgtcttccaaatgatgctacattccattacctgataaatggtttaacaaatactgcaactagtccagttcttattgaggaaaaggattctaaggaaaacgagaggtccttgattttggatttcttcacaatgatgcttttggatggatgggatcaagtgatcgctgcttataattctgttattgtttgtctttgtaagcatggaacggttgacactgctcaattattgctaactaagatgctcactaaagggtttcttatagattctgtatgtttcaccgctctgctacatggcttatgccataaaggcaaatcaaaagaatggagaaatattatatcctgtgatctaaataagattgaacttcaaactgctgttaaatattccctgacattagacaaatacctatatcagggaagactctcagaggcttcggttattttacagaccttggttgaagactccaagttttcggatcaagtagagaaagatctaaaggttatagcaagacagtga

SEQ ID NO: 42828 - DNA, 481 bp, Glycine max
  Peptide Sequence Number=SeqID_159606
agcgttgtctgaaggttctagaagcactgagcgaaaagggaaggttgacccctctagggaaggccatggctcgctatccaatgagccctcgtcattccagaatacttctaaccgttattcagatcatgcaaaaggcgaaacattgctcgagtgcaaatcgagtttggcacacgctgtcgcagcagctgcagctttaagcttgtcgaatccctttcaaatgcgcattgaagatggtacaagagaggattcgaacgaaaaagttgtcgacatagaagaaaaaccgaggaaaatgaacttctctaactcaactagcgatgctttgaccatagcttccgcacttcagtgtttcgaactgaatgaagaggaaaaagtcaaaatcaaggagattctgaggaaggctatctttgctggttgggcagatagagttgctaaacgaatgaaaggagcttcaatcttgtcacaaggaggtgggatcctctag

SEQ ID NO: 42829 - DNA, 279 bp, Glycine max
  Peptide Sequence Number=SeqID_159607
atgaaaggtgttggaattgatgataaatccattaatcctgcagaagacgttgatattggtctctttagcgaagctgaggcttatgagaaccctaaattccaaagaacctgcgctcatgtcactgcacatacttgtttgactgctcctaatcttgctgcatcacttttagcagcttgtctcattccatctcttaatcaatgcgtaaatcccactgcaggtaccccacctattattggcccatctattgtgccattaaatgatctcagacataaagggtaa

SEQ ID NO: 42830 - DNA, 339 bp, Glycine max
  Peptide Sequence Number=SeqID_159608
atggaaggcataacagagggtgtgaacaacatcaacattaacatctccgattcgtataagaagaatcgcattcaggtctctaacaccaagaagcccctcttcttctacgttaatctcgccaagagatatatgcaacagcatgatgaggtcgagctctcagctctaggaatggaaatcacgacatcaactgttgacataaaggatgactctagaggtcgacctgttcaaaaggccaagattgaaatagtactcgggaagacagaaaacttcgatgagttgatggctgctgcggctgctgaagatggtgaaaatagagatgttgaagagcagagtgcatga

SEQ ID NO: 42831 - DNA, 213 bp, Glycine max
  Peptide Sequence Number=SeqID_159609
atgggagtggtgcagcgggtggcgttgcggcaggtggtggttccgatggtcttaagaaacggtgtcgtaatgagtagcagcagtagcaacagtgagagtcggagggaggctgagagcattgatatgaagtcagagaaagtgcagaaaatcatcgttttgcttatcttccaccctttatccagattctgtactgcatgtgactgtgacacttga

SEQ ID NO: 42832 - DNA, 981 bp, Glycine max
  Peptide Sequence Number=SeqID_159610
atgcttgtttcgagggttccgaagggagcaaacaaggttcaaggaccgaccgcaagtactctcggacgaaatttgggtatgacacacgccctcgccttcagaggactgcacgtcctcaccttcagaggactacacgtcctcgccttaaaggactacacgtcctcaccttcaaagggctatatgccctcgccttcagagggctacacgccctcgccagagctacacgccctcccctttagaaggctacacaccctcaccttcagagggctacacgccctcaccattagaggactacatgttctcgccttcagagggctgcacgccctcgccttcagagggctacacgcctttgcctttagaggactacacgtcctcgccttcagagggctacacgccctcaccttcagaggcctacacgccctcgccttaaggactacgtgtcctccccttgagagggctacacgccctcgccttcagaggactacacgtgctccgcttcagaggactacatgtgctccccttcagaggactacacgtcctcaccttcaaaggactgcatgccctcgcctccagaggactacacgttctggccttttgggtactagtaccctcacctttagaggaccacacgtcttcaccttagaggggtacacaccctcgccttcagggggctgcatgccctcaccttcagaggactacacgtcctcgccttcagagggctgcacgccttcaccttcagagagctacacgccctcgcctttagaggactccacgtcctcaccttcagagtactgcatgttctcaccttcggagggctacacgtcctcgccttcagagggttgcacaccttcaccttcagagaggtacacaccctcaccttcagaggactccacgtcctcgccttcaaaggactgcatgtcctcgccattaaggggctacacgtcctcgccttcagaggactacacgtcctcgccttcttag

SEQ ID NO: 42833 - DNA, 204 bp, Glycine max
  Peptide Sequence Number=SeqID_159611
atgattccactaagattgaatttagccattcttgatcctgcgctcattgttgtttccaaaagtgctcttgtgctcattgttggagactcatttgtgttgaaacctccaactcagatccatatcttctgtcacttcacaatgccaccaacatctattaggacagtagccactaggatgctaatgcctaataatatgctatgctag

SEQ ID NO: 42834 - DNA, 578 bp, Glycine max
  Peptide Sequence Number=SeqID_159612
atgcaatctcagggacttgcagtgcctcctgagcctctggttggtcctggtccctccggtcctcgaatcctgcccgtctggttgccatgggggagagtttatgagggatccactcttgttcataacactcctttgttgcctggccaagtaaaggtgagtgtggaggaggttatagatgcagatgctccagttcctgtacccactgatgaggtttccttagtggggcaggcacttcacaccatctttgcttggtcgacacatctggtagctgtgtctccgccaaaaccacctccgaagccccatccggaggtcgatgatccgctgtatctgatgacattgaccatccaagagcttttcttgaggccttatcaggttagatgggatgccaccgtgttcggggttgttaatccagatttccccctgtacataaagcacgaagacctcttcgaaattgcacacggtggtcaatgtctcagcatatcagtgttacagttgtggattcaacatctcactgaaacatgtatgcgagcggggaattctgatatctatgaattcctcgagcaacagtccattcagag

SEQ ID NO: 42835 - DNA, 789 bp, Glycine max
  Peptide Sequence Number=SeqID_159613
aactggcgatgcgggatgaaccggaagctgggttacggtgcccaactgcgcgctaacctagaccccacaaagggtgttggtcgattaagacagcaggacggtggtcatggaagtcgaaatccgctaaggaccccgatgagtaggagggcgcggcggtcgctgcaaaacccagggcgcgagcccgggcggagcgggtcgtcggtgcagatcttggtggtagtagcaaatattcaaatgagaactttgaaggccgaagaggggaaagggacgggggaagcccgtctgatagcgctctgtgcgcgtactccgaaagggaatcggcctgcccaccctggaaacggctcagccggaggtagggtccagcgggctggaagagcaccgcacgtcgcgtggtgtccggtgcgccccccggcggcccttgaaaatccggaggaccgagcaagggaagtcggcaaaatggatcccgtaacctcgggaaaaggattggctctgagggctgggcacgggggtcccagtcccgaacccgtcggctgtcggtggactgctcgagctgcttccgcggcgagagcgggtcgtcgcgtgccggtcgggggacggattgggaacgggcccttcggggcctcttccctgggcgtcgaacagtcaactcagaactgtgctctgaatgtcaaagtgaagaaattcaaccaagcgcgggtaaacggcgggagtaactatgactctcttaagcgaaaccacagccaagggaacgggcttggcggaatcagcggggaaagaagaccctgttga

SEQ ID NO: 42836 - DNA, 138 bp, Glycine max
  Peptide Sequence Number=SeqID_159614
atgtggatggaccgatttgctcttactttgaacgggagtcaagaacttcctcgattgctagccaaggccaaagcaatggcggacacctactccgcccccgaggagatccatggacttctcagctattatcttgcctag

SEQ ID NO: 42837 - DNA, 315 bp, Glycine max
  Peptide Sequence Number=SeqID_159615
atgaccaaacttggtctctgcgtgccatcggacacaactgtgtctgaatggcaaaggggtgcggataaccgtaaggtatctccgcgtatcatgggtatctccgcgtatcatgggtgcagaatgaccaaacttggtctctgcgtgccatcggacacgactgtgtctgaatggcaaaggggtgcggataaccgtaaggtatctccgcgtatcatgggtatctccgcgtatcatgggtgcagaatgaccaaacttggtctctgcgtgccatcggacacaactgtgtctgaatggcaaaggggtgcggataaccgtaag

SEQ ID NO: 42838 - DNA, 711 bp, Glycine max
  Peptide Sequence Number=SeqID_159616
atggataatcgcgggccgcgctcggcgctgctggagagtcaacgctggctggagtatgcctttcagcctgccggtcagccggcaccggccgctgcggcttacggacagcagcggcacagcgcaaaagtggtgctggccggacaaaaccggccgccgaaaagttgtgaatccgatggagtgatcagtgacgatcatcagccggttgcggtttacaccgctgactgtctgccagtgctatttgccgatgtgaaaacgcatcaggtggcggcggtgcatgccggcttgcagggtacgctcggcggcgtgctgagcagtgccctcgatcagctgctggcgggtggcgcgacgccggcatccctgctggtggcgatcggtccggcgatcggcccgtgctgctacgagctgggcgttgatcgcatcgcacagatgcagcagcgcccggacctgccggcgctaagctggtcacagcaacagccgcataatccgcaggcgattcgacctcaggcacaggcgcatcatcagggagtatggtttgatttgcctcagctggcgcagagcctgctgttacagcgcggcattccggcggcgcagattgatcgcgtggcggtgtgtacttattgcatggcggaggcgggttcgagctatcgctataacacccattttgacagcggctatcagtcacgtttctcgtggattcgccgccgcgcgtaa

SEQ ID NO: 42839 - DNA, 813 bp, Glycine max
  Peptide Sequence Number=SeqID_159617
atgatgaaaaacacctcctggctggccgcggcgggcctgattgccctgacgctcaccggctgtgcccaaccgcaaaaacagcaggctcagcagcaacttggtcagcagtcggtgctggcagtcaactggttccagcagtctggcgagtatcaggcgctgagctggcaggcgttcaacacggcacgcatggcgtttgataacgctccttcgctcaccggcaaacccaaagcggtgattgttgatctggatgaaaccatgatcgataacagcgcttacagcgcgtggcaggcaaaaaacggccagccgttctccggtaaaacctggtcagcgtggacgcaggcgcgtcaggcgaccgcggtgcccggtgccgtcgaatttgccaactacgtgaatagccacggcggcaccatgttctacgtctcgaaccgcgatcagaaagactacgcggctacggtcgataatctcaacaagctgggcttcagcggcgtaagcgacaaaaccgtgcgtctcagcaccggtaactccaataaacaggcgcgtttcgacgcaattaaaaatgccggctacaacgtggtgctgtatatcggcgataacctgaatgacttcggcggcgccacctggcatcagggtaacgcgcagcgccagcagtttgtcacgctcaaccatcagcgttttggcacccagttcattgtgctgccaaatccactgtacggcgactgggagagcggcatggctgaaaactacaataagttaaccccggaacagcagctgcaggtgcgtgaatcccgcatgaaagcctggaacggtaaataa

SEQ ID NO: 42840 - DNA, 594 bp, Glycine max
  Peptide Sequence Number=SeqID_159618
atggacacggacggtgtcgtttcgttcaaccatgtctcgccggaggattcccacgaggttcatgtcttggccgtcgacgacagcctcgttgatcgaaaggtcattgagcgcttgctcaaaatctcagcttgtaaagttacggctgtggatagtggaatcagagcactgcaatttctggggctggatgagcagagaaggacctctgaatctgatggttttgtcccggatttgaaggtggatctaattatcacagactactgcatgcccgaaatgaccggttacgagttgctcaagaaaatcaaggaatcgaccatgttcagagaaattccagtagtgatcatgtcttccgaaaacattttgccgcgcatagacagatgtttggaggaaggtgcagaggatttcatagtgaagccagtgaaattatctgatgtaaaacggttaaagggttacttgacaccaaaagaggttattaaggttgacagaagaagtgatggttatgttaacggtggctgccaaggtggtgatggtggtggtggtggtggtgtggagataaacaacaaccaaaggaagctggaagagcaagacacatctgac

SEQ ID NO: 42841 - DNA, 165 bp, Glycine max
  Peptide Sequence Number=SeqID_159619
atgctgaaccaaaccgcgccgtcaaatttcggaaccggtgacacaaagtcacaaagaacaaaaaccgctttcacgacgtcgtttttcaccgttccttgtttggttgctgtttacaatgtagtagaagatatgctgatgttggagatttcaccattaaggaagtga

SEQ ID NO: 42842 - DNA, 267 bp, Glycine max
  Peptide Sequence Number=SeqID_159620
atgggtgtcaagtacctcgaagtggtcaagcgagggtcgcatcccaataaacagatggctcaacgcacgactggcgctaagcctgaatccacttacccgagcaaaggtatagactttaagcagatgattgacacagattccagagcacatcacagtgcctacttcaggaaaagagctctggaggcagcaagaggagaagcttttgcagagatacctaggttttgtaagcttattattgttagggtttcttctgtaatggctggctaa

SEQ ID NO: 42843 - DNA, 504 bp, Glycine max
  Peptide Sequence Number=SeqID_159621
atgaccacccttacgtggatgacgttgctatttagcaacattctgcccagcgaccacaatgccaatctccccttgcagatggatcgtgcccacaagacacccagtggacccggagaagtccaacagggccctggggaatggcacccacaagacacccagtggacccggagaagtccaatagagccctggggtttccagctctggttacgggcctctgtacggtgcctgttccccccggcaaggtcatgccatcgtgacataggatcgcacccacaaaggcaccaagtggacccagagaagtccaacagggcccttgggtttccagttctgggatcgcgcctgcaagacacccagtggacccgaagaagtccaacagggtcttggagttgtcaagctctaattacgggtctttgtcagttctacggagttcctgtcacctccatcaagggcatcaggccccctactaatcgagctttcatcaagaagtactgcgtccccaggtag

SEQ ID NO: 42844 - DNA, 886 bp, Glycine max
  Peptide Sequence Number=SeqID_159622
atgggtttagaggcttacattactggaaatcgagtttcttcataccgtcaaggtagtgacctcccaatgggtatccaatcagctagagactcaacccgtgcatcatctgtcattgcaatggacacaatatgtcatagtgtgaatggtgattctatggaaagtgttgaaaactaccctggagaccttgatgatgttcatttcccctcctctagcatgtatggcaatgtggacatgaatgaaacatctgaactgaataacagcaatcaagctcagcaaagcacttgcttacaaacagctactgaagttgcccgtggtgatgtgggtgtcagtagtacaaactatggggaagaacttttcaatgcagaaactgtgactgctcaggctcgtgatggaatcagtttgggcatcagtggagggagtgttggaatgtgtgctagtcatgaagctgaaatccacggggctgatatatatgtgcacagagctgatagtgttgttggtgaaatggaacagagagtagaagatgctgaaaaccagggacagacaggtgagtctgttccagatccaggtctgatggatgagattatccctgatatgaacagggaagatcctattggtgatagccaggagatgatgtctcactctgcaggaagaacagacagtgggtcaaaaattggctgctctacagaatctgttgaaagtggtgaaaagattagtcaaaactgcaatcttctacctgctaatagtagtcacccttctcgttcttgtaatgctaatatttactctggttgtgaaaatactaaggaagagatcatgaagcgtgataaatcatcatttgccaacaatagtgctctccctgaatcagattttgccattgcaaatgggatag

SEQ ID NO: 42845 - DNA, 351 bp, Glycine max
  Peptide Sequence Number=SeqID_159623
atggctttgtgttcagtttttctcaatcttcatcttctgctttttgtttgtttgaccatagaagcgttaggtgtggcaaagccttcagtagctagttaccttagccaggagatactggcagagcaagaagctgatagagtgcatggattacctgcacagcctccggtgaagttcaacaatatggtggttatatcactgtcaatgaaactcgaggaagagcactgttccattggtttttcaaggccactcacaatccagaacaaaaacccgttctcttatggctcaatggagaatcacaaacatgaaggtcaggaagtgagtgcagcaggagtaaacattgataatccatga

SEQ ID NO: 42846 - DNA, 243 bp, Glycine max
  Peptide Sequence Number=SeqID_159624
atggcttcggatagaatgcagctacagaacatgtgtaagaaggagcatgaatctttcaaagaatacgctcaaagatggatggatctagcaactcaagtagcgcccataatgatggagagggagatgataacaatgatagtagacacgttaccggtgttctactatgggaagatggtgggttacatgccttcaagcttttctgatttagtgttcactggcaaaaggatcaaagtgagtctgtga

SEQ ID NO: 42847 - DNA, 371 bp, Glycine max
  Peptide Sequence Number=SeqID_159625
atgaagacaaccattaagtccttccaagaatggactcgggaaggttccagattagtataccaggtgacagctgccccaaaggtagtctttccaccgcaaaatgtaagggttgtggttgtgggcgatactgagggccccccaaagtgtttggctggggtatgccaccaaacgcctgcccctcagtggcatattcgaggcaaggcttggagtcggctagagtatggtctcgggtacttcatgtgtctcccccatgggttgaaggacctgtacctgaccagattggggttgttggctctcaatgagtatgggagcggagttatcgacattctcatcaggagcatgtgcaacattgggtggtgtatagttgggat

SEQ ID NO: 42848 - DNA, 354 bp, Glycine max
  Peptide Sequence Number=SeqID_159626
atgtcaacagtgtctacactggggaatcaaaagatcagcaattcctccaactggggaagcagggggtcagatgtttctgcaactgatgaatcaggaggggcagccacttcatttgatgatgcgtcagagatcacaatcagaggaggagatgggggaactgcttcaagctcaggagaagaaggtggattcaccactggagattgtgggtcagttggctctggattgacctgcacagggaaaaaagttagtgagctttggacatcctatcctacggttactgacgaaggagctggagtggatgatgatgggatgtcctccgttctagctctttttctcgatgccatctgtaactaa

SEQ ID NO: 42849 - DNA, 831 bp, Glycine max
  Peptide Sequence Number=SeqID_159627
ggctacacgccctcaccttgggtactagttaccctcaccgtcagaggactacacgtcctcgccttgagaggactactcgtcctcaccatcagagggctgcacgccctcacctccagaggactacatgtcctcgccttgagagggctacacgccctcaccttgggtactagttaccctcaccgtcagaggactacacgtcctcgccttgagaggactacacgtcctcaccaccagagggctgcacgccctcacctccagaggactatacgtcctcgccttgagagggctacacgccctcaccttggaggactacacgtcctcgccgtcaaagggtcatgtgccttcacctttgtaaggctacacgccctcaccttcagaggactacacgtcctcacctttagaggactacacgtcctcgccatcagaggactacatggctgcacgccctcgcctttagaggactacgctagtttccttttatcagttcctgggccacccccagatattggagggcgaccaactgtgcgagcacaaccaaagaggaaggctatcttgcagctactatgcataccggggaaaaatttcgcccgtgccgctgcaaagaagcaagtgcggatcgtgcacaccaatatgaccaatcttacacagatatggatgacattgctacttagcaacattctgcccagcgaccataatgtcgatctccccctgcggaagggtcgcacccacaagactcctagtggacccgaagaagtccaacagggccctggggtctccaactttggttacgggcctctatcattcctacaaggtgcccgtccccccagcaag

SEQ ID NO: 42850 - DNA, 439 bp, Glycine max
  Peptide Sequence Number=SeqID_159628
tgtctactcctgatgttgatgagtttgaaagatggcaaaaggagattgaagaggtagacatacaagtggaaggttcggaatttggatccttatctggcaatgttggtcgtactggggataaacttgcactgaatgtgaccactaaacaaggaaagacattaaaggatgtacaaggagatgtattccatggtttagattggtgtttctatggaattgatacttacaacattagagagccacttggtgtatgtgctggtgcttctgtaatgcttgcagaattggcaatggaagctggtttgcctaatggtgtcttaaatatagttcatggaacccatgctaatatgggggccaaaaatcatgtggttgtaatgcctaatgcaagtggcaatgctactgtaaatgctttagttgctgcaagttttggtgctgctggtcaaag

SEQ ID NO: 42851 - DNA, 216 bp, Glycine max
  Peptide Sequence Number=SeqID_159629
atgaggcctcagtcatcaaactcgtctggtttaagatttatcagtgggattatttgtaaatccaaggttcttaggtttgaaaggatgttgttttgtgctatgagaggcaatatgcttttcattcaggcaccgactgatgaacaaatcatggatcttgtttcagctgagatggttttgttccttcttattacttctaagcaagaaccaagattttga

SEQ ID NO: 42852 - DNA, 429 bp, Glycine max
  Peptide Sequence Number=SeqID_159630
atgagatggaggcaatttaagtcctcccttaccactaaatatgtacatgttgacaaagacagtgaagataaccatgatccatctgctaagtatggttttgatccaaagacttgggaacaatttgcaaagagccgacaaatccctaattggcagggaaaaaggaaaaacctcaagagattcaaaaattcaatgattgcccccacttactgtctcgtggggggtatgattgtagaccctccatccccgattgcaagacatgtcaagtggaagatggcccgaacaaagcgatatggccagatgatatctacagcggcacaagaaatctctgacaaaattgacatattgaatactgcacttggccgagcagaacatcttggacgtgtttgtgttgctggacatggtgtcaccattggtcattacttcgaatag

SEQ ID NO: 42853 - DNA, 1551 bp, Glycine max
  Peptide Sequence Number=SeqID_159631
atggccttagattttgaatctgcgaaagatggtgatttaactgtaatgtcaaatggatctcctaagaggactttcaagtttgatgttgtctttggtccacgccaagctaagcaaggtgatatttttgaagatgcagcaccatttgcaacctcagttctagatgggttcaatgtatgcatttttgcatatggacaaactaggacagggggacaattagttgaatggggaatgcacgagaaccaagttatggttgaggacctagccggcagtgaacgagtggcaaagacagaagtgcatggcaatagactaaaggagacacaaaatattaataggtctctctctgcacttggtgatgtcatatcagctcttgcaacaaaaagttcacacattcctttcaggaactccaaccttacacacttactgcaacactcattaggcgcacattcaaatgcactcatgtttgtacagatcaattctaatgaaaactatttgagtgagacaattttctctctaaactttgctagtagagtaagaggaatagaattgggatctacaagaaagcagttggacactattgaacttttgagacacaaacaaatgcttgagaaagtcaaacaagaggtaaaactgaaagatttgcaaatgaagaagctggaggaaacaatccatggattggagtccaagatgaaggaaagagacaataagaacaaaaatctccaagagaagtcttcctttcctgaagtagatggattctcttggacttcacttgcaaatgtctcatcattgtccattttcactttcaaggtcaaggaaccggaatcacaacttttggttgagagaaagctggcgcgtcaacatgtagactcaaagatagttgaacagcaccaaatgaaacatcaagaaaagcaaaacaatacacttctgagactagcacttgcaagtagaccactaggaagtcttaagaatttcaatgatccagttaatggtgggtggttcaaagaccaacaaataaattcagctaaaccactcactaagaaaattatcttgaaaccttgtatacctatttccacaatggagacgtccatcaagtgcattgatcatgctgagaaagaaaacaatggtgacatggctgacaaagccctactgccaaaaaggcttggaagaccttctatctgcatgatgacaccgcatgttccttcagccgttgcttcaaggagaaactctctgattcgactcccaagtatacctagcttaacacaattccagtcaccattattaccaaagttaacaaaccaatttgatcagaaggatgccaatggggaatcagaaaccaactgtgtgcttgcacagactcatttcttatgtcctaaagaagttagaagtggtgctaagaggattggtagcatactaagaagaagccttcacaagaaaatacaggaatggagaaagttagagtttccattggaagtaggggagattggtagtagaggaggagctaaagatattcaacaaaagaatagtcaaaaggaaaaggaaaggggatggatctaa

SEQ ID NO: 42854 - DNA, 1686 bp, Glycine max
  Peptide Sequence Number=SeqID_159632
atggttgctttcaccctctttgttttgtgttctgtccacaatcttttatccaaatggaataatagctccaacactgcaatacccaagaaaaccacaccaccatctcctccaaagcttcctataataggaaacctccatcaacttggcacactcacacaccgcactctccaatccttagctcaaacctatggtcctttgatgctacttcactttggaaaaatgccagttcttgttgtctcaactgctgaggctgcacgtgaggttatgaaaacacatgacctcgttttctccaacagaccacatcgtaagatgtttgatatcctcttgtatggttccaaagatgtggcatcttctccatatggcaactattggaggcagataaggagtatatgtgtcttgcatcttctcagtgccaaaaaggttcaatcttttggtgcagtgagagaagaagaaatctccataatgatggagaagattaggcagtgttgttcttccttgatgcctgtgaatttatctgatttattttctacactcagcaatgacatagtgtgtagagttgctcttggaaggagatacagtggagaaggaggaagtaaccttcgtgagccaatgaacgagatgatggagctattgggatcttcagttataggggactttataccttggcttgaatggttgggaagagttaatgggatatgtggtagggctgagagggtgtttaaacagcttgatgagttttttgatgaagttgttgatgagcatgttaataagagagaccatgatgatgatgttgatggtgaagcccaaaatgattttgtggacattttgttgtcgatccaaaggacaaacgcagtaggatttgagattgatagaacaactataaaggctttgatcctggatatgtttgttgcaggtactgaaactaccacctcaatcttagggtgggtggtgacggaactcttaaggcacccaattgtgatgcagaagctacaagctgaggtaaggaatgtggttggtgatagaactcccataactgaggaggatttgagtagcatgcattacttgaaggcagtgattaaagaaactttccgtttacacccgccagttcctttattgcttccaagggaatccatgcaagataccaaagtgatgggctatgacattggaactggcacacaaataatagttaatgcttgggcaattgcaagagatccttcatattgggaccaacctgaagattttcagcccgaaaggttcttaaatagttcaatagatgttaaaggacatgattttcaactgatcccatttggagcaggaaggaggagttgcccaggattaatattttccatggctatgattgagaagttactagcaaaccttgttcacaaatttaattggaaaatacctagtggagtggtgggagagcagacaatggacatgactgaagctactgggataaccagtcaaagaaaattccctcttgtggcagtttcatctatccctagctacatacatatgaatgacgatagacactttgtgactggcacctttgtcgatggtgtggcactaaacgcacttggtcttgaagatcttctcatcgttcttagagttttcgggagtagcttcatcgaacaacaaaagttagaagcaatagatggaagctctgtcatggtgggacaagagtga

SEQ ID NO: 42855 - DNA, 444 bp, Glycine max
  Peptide Sequence Number=SeqID_159633
atgaaaatgtttaatggaatattggtacttccaatctctctaatggtgcaatatatatctgagaagggacgtgtaaggtgggatgaggctaatattggagaaattgaggcaaacaaacctgtgaggcagaaaattactgagcctaagactccatatcatcctatgattgatgatgacagtatcaatcttctgaaaatcagcatgtattacctaatttttctaggttctctatctcctgtacgaggaagttttgatgcatgtattgataatgaaaatcgtgctgaagcaatatggagtgctctgaatgatgtagcctccagtagcagaagaggcactggacaatctggtggttggacatcatctgaggatgagccagaagcaatggagcaagatgatgatggtactgtactattatttgacattcatttgctgtttttcacatag

SEQ ID NO: 42856 - DNA, 342 bp, Glycine max
  Peptide Sequence Number=SeqID_159634
atgaaatttttcaacttgttagaaagtacaactacccttttagaagtctcatggttacattatcccagacagattagctcttcaaacaccaaaagtatgcaaggcaatcctgaagtcgctcgatcaactggaaaaacattagaggtttatgcacgcttctccgataggcgcattctccataatagtgacacgtggcatgacgtgactagcggtggaataggtctggacgcgctactgacgagggcgcttcaggattggatgcgtcggcgatgctggagctttagttggcgctctgcgtgctggcgccttaggacacgctctgcgtgcaaacgcgttcgttag

SEQ ID NO: 42857 - DNA, 420 bp, Glycine max
  Peptide Sequence Number=SeqID_159635
atgattgaacgttttgaacaacaacaagaaagaggaggtagtggtggggaagggggaaccaagaaggcaataaggagtggctggttggtgggggacaaggctggggggaaggtggggaacaagaagcactggttgtggctggggggggggggggaggagtggcttggagggggggcgcgggccgtgtttttaaagaagctggacccgcctgggaacctaacgcgaaccgtcgcacctggaaagggaacgcttacgaaagcgcctggccgccaaacgcaaaccaaagctcccacaccgcccaagcatccaatcctgaaacgccctcgtcagcagcgcatccagacctgtcccaccgctagtcatgtcatgccacgtgtcactattacagggaacgtgcccattggaaaaaacgctttgtag

SEQ ID NO: 42858 - DNA, 1983 bp, Glycine max
  Peptide Sequence Number=SeqID_159636
atgctctccacggattcccttttggaaaatttccctggttctgtaaacggattcatatttgaaaacggtcctgtctcggtgttttcgaatcagaatccggcaagtgggtttgaggtggatgattcagtttccccttcagaatctgccactgattctggtccttcttctggggcaagctcgaatagagaacatgtagagagtactaaacactccaatccaattctcagatacataagtgatattctcatggatgaagaggatgatttggagagaaaaccctgcatgctgcaggattgtttgagactccaagctgctgaaaaatcattctatgatgcattggttcgaagttacccttcatcacctcgtcaatttgatgataaccctgaccaagatgataattttggtggaactactagttctgagagttttagcagttatacgactgataattcatgcgagtctgattggtttaacggtgctagtgactttgattcctctttcatacaaagatctctaatttattctccggaacacgcatatgtagctcctgatccgtttagagagacacaagctggggtccatttttcaaatggagcctggaatttgattcacccacagaacaagccgcgtgtgattgaggatggtgtgatgcagggttctgtaacagccacaggattgagggagaagaggagttatctcatgaatgatatgtcacatgaagaagagagaagcaacaagctttcttctgtctactccgatgattcggagccatctagcatgtttgatgaggtgctgctttgtaaggatggtaagagtccatccattttttatgctggccgtgaaccatcaccatcgcagattgctgactcaggaggatctaatgggaagaaaacacgatcaaagagaggttccaataaggggacaagggcaagcgtgacgacggtggatttatggactttgctaattcaatgtgcacaggctgtggctagctttgaccaaaggactgcaaatgaaacactgaagcagattaggcagcactcttcaccttttggcgatggacttcagcgtttggctcattacttcgccgatggcctcgagaaacggttagctgctgggacaccaaagttcatttcctttcagtcagcatctgccgcagatatgttgaaagcataccgagtgtatatctcggcatcaccatttctaaggatgtctaatttcttggcaaaccgcactattctgaagctagcgcaaaatgaaagcagtcttcacattattgactttgggattagctatggtttccagtggccttgcctcatccaacggctttcagagaggccaggcgggcctccaaagcttcttatgacaggaattgatcttccccagccgggatttaggccggcggaaagggttgaggagacggggcggtggctggagaagtactgcaagaggtttggagtcccatttgagtacaattgccttgcacagaaatgggagactataagacttgaggacctcaaaattgataggagtgaagtaactgtggttaactgtttgtacagattgaagaacctttccgatgaaaccgtgactgcaaactgtccaagagatgctttgctgaggttgatcaggaggatcaatccaaacatcttcatgcacggggtcgtcaatggcacttacaatgcaccatttttcgtgacaaggttcagggaagcactcttccacttctcatcattgtttgacatgtttgaagttaacgtgcctcgtgaagatccatctaggcttatgattgagaaaggggtgttcggaagggatgcaatcaatgtgatagcatgtgagggggcagagagggttgaaaggccagaaacctacaagcagtggcaagttaggaaccagagagcagggttcaagcaacttccattggccccagagcatgtgaatagagtgaaggaaatggtgaagaaaggacatcataaagattttgtg

SEQ ID NO: 42859 - DNA, 399 bp, Glycine max
  Peptide Sequence Number=SeqID_159637
atggagcagcgtggccatggaatgtactacacgctaccaacattttctcagtatccttcgcagatgtatcagtatcctttcgaaggttatgacactgatatgtctgcaagcgaacattcgtatggtggtgttgcggaaacacatcctcatttttcatggctgaccatgaccccttcacaacaacatgatgccccaatggcaacatctaatgccccattagctccgcaatggaatgtgttgatttgcgtcacgagttttctgtcgaggctgagcaacaaggacggcgacagcgcgcaagaagaaatcctgatcgtcaagcctgaaggtgggatcgaccatgtggcacatcctcacgccatcacggacaccataatgactgattttgatgtctctatttaa

SEQ ID NO: 42860 - DNA, 174 bp, Glycine max
  Peptide Sequence Number=SeqID_159638
atggcgagttcgctgtgcaacatccacgtggcaggaggtgcaggccgtaggcacgttttttcagtgataggcttgctttttcagagaaagaggagttgcaactaccattggcgagttaagggcaagttgcaactcccattgatttgtctgcataaggtttcatatttgctataa

SEQ ID NO: 42861 - DNA, 426 bp, Glycine max
  Peptide Sequence Number=SeqID_159639
atgagggaggcacatgaaataccccaccacaatctagccgacttcgagccttgcctcggatacgccattgagggacaagtagttggtggtgtacccctaccaaacactttggagggccctcagtttttcccacaaccacaacccttgaattttgcagtggggagagtccctcctgctatggcggaaaagggaaagttggatcagatagaggaaaggctaagggtcgttgaaggatgcggagattatgcctttgctgacatggaagatttatgcctagtacccaacatggtcattcctccgaagttcaaggtaccagacttcgataaatacaaggggacaacttgcccgaagaatcacctaaaggtgtactacaggaaaatgggggcatacgcaaaagatgaaaagttgttgatgcatttcttctag

SEQ ID NO: 42862 - DNA, 318 bp, Glycine max
  Peptide Sequence Number=SeqID_159640
atgattgtgaggggtcaagacatttatagtagtcaagaggagactacttcttcccctccctctagtggaagtgaagatgaagttaggggtgaagagtctagtgaggaagtctacccccatgaagaaggtgatctcctaatggctaatgataaattgagctacttgacactagttgtcgcgcaattcgaaaggtttttcgatgtttcggaaaaggatacggaaaatacccaaaagggagggcaaaagggtcatttggaagctttttctgacccctggctcgcccaagctagcctctggctcacctgggcccccaaataa

SEQ ID NO: 42863 - DNA, 451 bp, Glycine max
  Peptide Sequence Number=SeqID_159641
atggatttgaggaacggttcatggtggcctagtcaaatacttggccttgatcacctttctacttctaatcttacttctcctcgttcaggaactcccgttaagcttctcagaaaggaagatcccaacatggcggagtccacccagggggagtgtgcttattgcaactttttggctgatgaagagagtgaatatgcttttatggatgttgttgaatatgattctcttgaaattggttctactaatgttgattcggattcctctgaaatggaacttgacatgggtgatgagatgactacactttcaaggagaccagtcagggtcactctgttttgcgagaatgttccaaccatatgggatcaacataggcttaaaggagcactcaaaccgggtgtatttacccccaaggcctacactccgaagagtccgtcaggacctctccctcctgattcaa

SEQ ID NO: 42864 - DNA, 471 bp, Glycine max
  Peptide Sequence Number=SeqID_159642
atgaaaacgacagacttccatcgtgaagatgatcactcagaggaagaagaaaatgctctcaacgaaggagaaaaactctctttgatccatattctagaattcaggtctcgaaggaggaagatgaatcatatatgttgtaacgcatggaaaggcactctcatatatagtttcgctcttgtgcaaaatcaaatttcagaagtatggaaatgtcttcctattaatgaaagaagatcatgttttgatactctcgtcaataatgaaaattatgataacgaacaaattgttgaaaatgatcatatcaaagcagttagtgatcacaatcaatcactaggactcactacggtcaaagtaagggaccccaaagttggaaaaaaattcaccaataaatacaatgcaggtggatactcattcaaccatggaaaaagatcctctgcagtttttttcagaattgcatcaaatatcagcccttaa

SEQ ID NO: 42865 - DNA, 522 bp, Glycine max
  Peptide Sequence Number=SeqID_159643
atgactaggcaagttagggcagccatggttaagcaagctctatgggttacctttgggtactactcatggattttaaatttcttccacttgaggggaaaattaccatgtggaagagacaaacacttgacgaggagattcttaaagtacaagtgtgaggtatcaatggaaggaaaagaaactgagggaatgttgaagatgacgacagataagagacaacagaagcgaagcagaagtgacagagaagaggaaagggacaggctgagtgagttgcctgactgtgttgtgctccacataatggaatttatggacacaaaatatgctgtacaaacttgtgtcttgtctaaaagatggaaggacctttggaagcgtctaacttatcttggattcaatacaaccctctttaacaatgttgtcaaattcaacaaattagtgtctcgcgttctgtctggccgagatggttcagtttccctgctcaatcttgaattcacgcgtcgcggtatgggagcccaagctcttcaatag

SEQ ID NO: 42866 - DNA, 2043 bp, Glycine max
  Peptide Sequence Number=SeqID_159644
atggaggccaactttcccagaagagctcaccagtttggtgaagaagaggagagcatattgtatgtctctgattctcttggttttgcagcgacggacccgtcgttaagggacccttctctggaagacaatgacttctcagaaactgcaaagttcataaaccaaatcctcatggaagacaacgttgaacagatgccattctatgattcactcaacttgcaagttacagagaaatccttctacaacgctctcactggcaacatacctctttcccccaatcaacatccccttgttctcagtccccaagctgaaaccactcccaccaccagcaacagcagcaacaacagcaaccacaactttttagatgaaaattctcgtgagttgaatccttctccagattctgtttctgttttggcttttcagtttaaccccaactccctttctcaaccaccttcagttactgttaatcatggcctctcaaatttggattcttccactgccaaactcttggcacacaatattttcaacgatgctgattccctttcccagtttaggagaggcttggaggaagctaccaggtttcttcctcctggccctaagcttgtagctggtctagattcaaagggagaggaaccaatcaatacattgggagagaattcctatgggtctaagggtaggaagaatcacgagcgcgaagatatagacaccagagaagaagaagaaaggagaagtaacaagcaatcagcacttagccttgttgatgagagtgacttgtcagatgcttttgatcgagttgtgctgcttagtgtggaaaatgtttgtaatgaacactgtagtttgcagagtgaaacagtgaaggctgtagagccaggtggagtgaagggtcgtcctaagaatcaagcgacaaacaaggaaacagtagatttgaggaatcttctgatgatgtgttcacaatctgtgtatgccaatgacaaaagagctgccaatgaattgctagagcagattaggcagcactcttctccctctggggatgcattacagaggttggctcattacttcgccaatggcctcgaagcacgcttggttggggaaggaatgttttcttttctgaagtctaagaggagcactgctgctgagtttctgaaggcacaccaagattttctatcagtcagccctttcaagaagtttacatatttctttgcaaataaaatgattatgaaagcagctgtcaaggcagaaaccgtccatattattgattttggtatccaatatggttttcaatggccaatgcttattaagtttttatcaaatagagagggtggacctcccaagctgaggatcacagggatagattttccccaacctggttttcgccccacagaaaaaattgaggagacaggttgccgtcttgctaactattctaagcgttacagcattccctttgagtacaatgccatagcatcaaggaactgggaaaccattcaggttgaagcccttaatattgagaccaacgagctagttgctgtgaactctctgatgaagtttgagaatttaatggatgagactattgaagtggacagtcctagaaatgctgtcctacacttgatcaggaagataaatccacatatttttactcagtgcattgttaatggaacatataatgcccctttctttaccacgcggtttagggaggcactcttccatttctctactatttatgatctgtgtgacactgtcatacctcgtgaaaacgaatggaggatgttgattgagagagaggttttaggccgggaggctatgaatgttatagcatgcgaaggttctgagagggttgagaggcccgagacatacaaacagtggcaggctaggaatatgaaggctggtttcaagcagctaccactgaatgaggaattattggccaaatttaggaatgagttaaggaaatcgtaccacagagattttgtcttagatgaagataagaactggatgcttcaaggttggaagggccgcattttgtatgcttccacttgttgggtgccagcataa

SEQ ID NO: 42867 - DNA, 2573 bp, Glycine max
  Peptide Sequence Number=SeqID_159645
actctccagtggatgagattgatttttctgccactgtcctacgctacataaaccaaatgcttatggaagaggacttggaggcaaagccgtgtatgttccatgattccttggctctccaagctgctgagaaatcattctatgaggtcattggtgagacatacccttcttcttcttcttcttcttccatccaaaactatcacaacgtggacagccctgatgaaagtagcttcagtggtacaacgactagcaccggtaactcgtttgggtcgcaatggaataacgtcgatcttgctgactacaagccttccatactgcaaaccacttttcctactgactttgttttccaggccagttcaatccaatcttcaatgaacaccacgagcaaatttgccgtaaccaatagtgaattcttggctagttccgcggctggatttttgggtccaggttcaacaaacttgtttagcaagagtgagtctgtactgcaatttgagaggggtgtggaggaagccaataagttcctgcctaaagggaatcctttggttattgacttggagaacccatcttttagaatggttcctcttcagcaggaggaaattaaggcggagagggatatagatgaaatttctgccgagtcaagaggaaggaagaatcacgagcgggaagatgaagaaacagatttacaagatgggagaagcaacaagcagtcagctgtgtacattgatgacagtgagatatcagaattgcttgataaggtcctgctaggcacgtggtgcagaaatgaaccagctccttcgtgtattggttacacagaccttcccagtggaccatccttgggtaaattagaagaaacaaacaagtctggtggtgggaagagccgtgttaagaaacaaggcaacaagaagggagttgtggatctgaggacattgttgattctatgcgcacaagctgtttcttcagatgatcatgtatctgctaatgagttattgaagcagataaagcaacatgcttctccactaggtgatgggactcagaggctggcccattgctttgcaaatgcccttgaagcacgcttggctggcaccggcactcagatttatactgctttatctcacaaaagaacctctgcagcggacatggtgaaagcttaccaaatgtatatttctgcctgtccattcaagaagctttcgatgatttttgcaaaccatacaattttgcagctagccaaggaagttgaaactcttcatattatagattttggcatccgttatggcttccagtggccagcttttatttatcgtttatcaaaacaacctggtgggcctcccaagctgcgtattacagggatagagctcccacaacctggtttcaggccagcagagagagtccaagagacagggcttcgacttgcaaggtattgtgatcgctttaatgttccatttgagttcaatgccattgcacagaaatgggaaaccatcaaaattgaggacttgaagataaaggaaaatgaacttcttgttgcgaatgctatgtttcgatttcaaaatctacttgatgagacagttgtggtgaatagtccccgagatgctgttttaaagttaataaggaaagcaaatcctgcaatctttttacatgctactgtcaatgggagctataatgctccattcttcgtgacacggttccgggaggccctttttcattattctactttgtttgatgtgcttgataccaatgttgctcgggaagatccaatgaggttgatgtttgagagagagttctttgggcggcaggtaatgaatattgtagcttgtgagggtagtgagagggttgagaggcctgagacatacaagcaatggcaggttaggaacatgagggctggatttaagcaattgcccttggataaacatctcattaacaaattaagatgcaagttgaaaggtgtgtaccacagtgatttcatgcttcttgaagatggcaattacatgctgcaagactcgtttggtggttttccaatcatcgatccttcttcactggaagacaacaacgacttctcagaaactgcaaagttcataatgattatgaaagcagctgccaaggcagaaaccgttcatgttattgattttggcatcctatatggtttccagtggccaaatcttgttaagtttttgtctgatagggagggtggacctcccaaacttaggattacagggatagagtttcccaacatggctttcgccccacagaaagaattgaggaaacgggtcgccacctggctaactattataacaactggttgcttcaaggttggaagtgccgcattttgtttgcttccacttgttgggtgccagcataatgagaagctactggactcgcttcgaggtatagtcccactagcacttgctgatcacttgagtcttgagatatttcagcatgttgcaatggtgaagcttgttttgctggttatattgtttgatgttctggtacctacttgcttaaccttcagctgctgcggtgaagattgtaccaagctttacatcaagttactccgtaaaattatggcacgacttttcgggtag

SEQ ID NO: 42868 - DNA, 2031 bp, Glycine max
  Peptide Sequence Number=SeqID_159646
atggagtcaaactttccaggtgcttatcacctgtttggtgaagaccagggcataccgtatctctcagactcgcttggttttccaaccatggatccttcttcaccggaagacaacgatttctcagaaactgtcaagttcataagccaaatcctcatggaagaaaacgttgaccagaggccattctatgactcactcaccttgcgagttacggagaaatccttctacgatgctctcactggcaaccaacccccttttgttctttgctccgaagctgaaaccaacaccataaccagcaacaacagtggcagcaattttttaaatgaaaattctcgtgagttaaacatcccttccccactctctgtttctgtttctgctattcactttaaccccaatcctctttctcaaccactgccatcagttacagttagtgaccgggtctcagttttggattcttctattgccaaactcttagcgcagaatatttccattgaggttgattctgtttccaagtttaggagaggcttggaggaagctaccaagtttcttcctccggagcctaaacttgtaactggtctggatttatatagagagcaagcaatcaattcgtccggagacacttcgtataggttgaatagtaggaagaatcacgggtgtgaagtgagagacaccagagaagaagaagaagaagaaggagggagaagtaacaagcaatcagcactttcccttgttgatgagactgacctgtcagatgcttttgatcaggtgctgcttcacgaggaaaacttgtggaatgaacacacttgtttgcagagtgaagcagagaaggttgagggaccaaatggagggaagggtggttcagacaaaaaagtgaggaagaagaagaaaacagtggacttgaggaatcttctgttgatgtgttcacaagctgtgtatgccagtgacatcagggctgccaatgaattgctaaagcagattaggcaacactcttctcccattggggatgcatcacagaggttggctcattactttgccaatggcctcgaggcacgcttggttggggatggtacaagtacccaaggaatgtatacttttctgagctctaagaacaacactttttctgagttactcaaggcataccaggttttcagttcctccagccctttcaagaagtttgcatatttatttgaaaatacaatgattatgaaagcagctgcaagtgcagaaaccgtccatattattgattttggcatcctacacggtttccagtggccaatgctcattaggcttttgtcaaatagggagggtggacctcccaagcttaggatcacagggatagagtttccccaacctggctttcgtcccacagaaaaaattgaggaaacgggtcgccacctggctaactattgtaagcgttacaatgttccctttgagtataatgccatatcatcaaggaactgggaaaccattcagcttgaagccctcaaaattgcaagcaatgagctagttgctgtctactgtcaccagaggtttgagaatttactggatgagtgtactattgaagtgaacagtcctagaaatgcagtcctgcatttgatcaggaagataaatccggatatttttactcactccatcactaacggatcatataatgcccctttctttaccacgcggtttagggaggctctctttcattattctgccatttctgataagaatgacactgtcatatctcgtgaaaacgaaaggaggttgatggttgagagagagctctatggcagggagattatgaatgttatagcatgtgaaggttctgacaggattgagaggcctgagacctacaaacggtggcaggttaggaatatgaaggctggtttcaagcagctaccactgaatgaggaattaatggccaaatttaggagtaagttaaaggaataccacagagattttgtcttagatgaaaataacaactggatgcttcaaggttggaagggccgcattttgtttgcttcctcttgttgggtgccggcataa

SEQ ID NO: 42869 - DNA, 555 bp, Glycine max
  Peptide Sequence Number=SeqID_159647
atgtctcttgccactctctttgggaaacttcaagaacatgaaatggaagttacgagactcaaccaacatgaagagaatgacaaaaagaagaaaggagttgcactcaaagcctcatcctctattcatgaagaaagtgacaaaaaagacatgaatgaacaaaataatttagaagaagatgatgatttcagtctctttgtaaaaaaatttaataaattttttaggaacaaaggaaatagaaggagatcgaaattcaatccaaggaagaaaggagaagattcctcctcagttccaaaatgttatgaatgcgatcaacctgggcacctgagatttgattgtcctatctttaaaagaagaatggaaacatccaacaagaaaactctcaaagataagaaaggaaagaaagcatatatcacttgggaagataatgacatggattcatcaagtgattcaaaaaacgaaatcgtaaatctaagcctcatggccaaaaactatgaaagtgaagaagagatgcattcaatgatttgcataaagaatctatcaaacttgccaaattag

SEQ ID NO: 42870 - DNA, 204 bp, Glycine max
  Peptide Sequence Number=SeqID_159648
atgaaagttggatatgtattaagaaatgcaattgcgcacactttcaccgttgggatgtacgagataatattcgtggagggagaaacagaatcgcatgaagacagtacaagtggaggtttcaatcccttctccgtctctctgacgtttgggaactctatcggagcagtcagaggaaaaattggaggaatctcagggaaccgctag

SEQ ID NO: 42871 - DNA, 288 bp, Glycine max
  Peptide Sequence Number=SeqID_159649
atgcctaatcctgcaaagttcataactgagacacccatctcccgacttgcagggcacattaggcatggtaagcatggtgaagagcaacttgtgatccatgttcagaatggcagaatagaagagtatcctattctagtacatcctggccaaatcgcaaaggcaattggccttctgccacgaaaccgcaatctattgaagatgttggggagttatgatgacaaggacgggacctgtggtggtgactatgaggctttgggttcaacggcaggagtatcaaagggagcttga

SEQ ID NO: 42872 - DNA, 408 bp, Glycine max
  Peptide Sequence Number=SeqID_159650
atgactacaggtgatccaccccaacagaagacaagtcaaggaaatgagaaaaagaaagaagatgagaatattactcaaggcgatccacctcaacgggagagaagtcaaaaaattggcataaagaaaaagttcaagaaaatgacacaagctttcttcctctctcttgatgtcgaggtagagtatggagatgcgcgacagagttccaacaggctagctagggttttgaaagtaagaataacatgcgatgatgatgaagagagatcaagtctgaaagcaagcaggggctattctcgttcttcaacttgccaagtctgctcaacttgttactgtgaagggtgcatcaagtgccgctttgaggattgcaattgccaagaatgcagagactttatgctatatgctaaaccttaa

SEQ ID NO: 42873 - DNA, 150 bp, Glycine max
  Peptide Sequence Number=SeqID_159651
atggaacctgcgctccttctcgcatctcgtgcaacgcaggaactcatccctgtgaaagttttgtttcctcattgcagagtctttctgaggtgtcttccaaagtggaactttgtcttcatcttcgcaatgaacccatatgtttctttataa

SEQ ID NO: 42874 - DNA, 362 bp, Glycine max
  Peptide Sequence Number=SeqID_159652
ggtatcttcccagtagaatttgtggtcatggatatctctgaagatattgacatccctgtaatcttaggaaggccgttcatgttgactgcaagctgcatagttgacatggggaagagaaagctagagttaggttttgaagaccagcaaattgatttcgacttgtttgtggaagacaagcctgctctagaacacaatgtttgcttgcaggtaatgggagaaggtcaagaggttctgaaggaggtggatcctactgttgagcatgaggacatgggtggcgctgatgggatggactccttgttctccgagctcgccggcgcgattcccaggattgatgaggccatgagctttgctgagatgttgaa

SEQ ID NO: 42875 - DNA, 177 bp, Glycine max
  Peptide Sequence Number=SeqID_159653
atggaggaagaggcgcgcctccacacacattttggatacatctgtggaataactcgttcaagatctacctttcgccaagatgcagccattgaagttcatgaggatgtgggagatttcagtgatgatggggatctcatgccgttcaagatcaccttctaccaagatgtcatcggttaa

SEQ ID NO: 42876 - DNA, 877 bp, Glycine max
  Peptide Sequence Number=SeqID_159654
atgggtttaaaattaggacccttctcggacagcttatgcaaaaatccttctacaacattgggcaagttgagagcaagggctaccaacttcatacaaagggaggagatgacaacattcagagcacaaatacataaggaaccctcaaagaaacaagtggagcgagaggagaaaattaagagcggccgaagccgaggaaaatcgggagctaacaggctgcctcaatctaaactcggaaattatactcccttaatagaaagtcacaataatgaaggatgcactaccctgaaggacaaaatagagaagttgagaaacttcatagatttgttaaagacaaggaaccttcttgtgatgaagattgagaatgaaaaaagagtcgagaaagtagttgaactcgagaaaccactaaggcacaacaatgcgatgagaatacccaacccaaaattcggttgtgagatgaccaactcggtggaagctaaaaagaagcccaccaaaagcaagccccctatcactttcccagatgaggatcttggaaacattgaacaatgccataatgatcatatggttgtcaagatagagcctaggcgaggtccaagtccaacatccaagcttgcaagtggtggtcatccatggtgttctgaccccaaagacgccatcaatgtggttctaacatcctcaaacataaccattgaggggttctattccagtccttcaatagtgattttcagccatggatttgaagcgaaagataaaggagaagagcatggaaggtgtgactctagcacatgggaagcttccttgagaagcaagaaaggtagcatcctagggaagcgaggaagaaagcttcctttggaagcgacgaagaaagcttccgctagag

SEQ ID NO: 42877 - DNA, 297 bp, Glycine max
  Peptide Sequence Number=SeqID_159655
atgtcattgcctagcgctgttcatgtgtcctccattatcaagcgcggagcctctggtgactgggaaatatgttcttctgttgttttccggatcggttccttcgctaaacatgtcaaaaaagaaggagtagagacgagaatcgtcatcacggaaagggcaggatggacgaaatcagtgtcttatctttgctttcctcttatctccgatgagagatatttggcacccttttgttgcacaatatgtgaagtcccgagacgtgccgaaaatcaaaaggaagcaggcttacgcaatccgtga

SEQ ID NO: 42878 - DNA, 153 bp, Glycine max
  Peptide Sequence Number=SeqID_159656
aagcaatttggtgatgctgatccttattcatttgtaaaacagattttcaatggtgtatttctcaaagttaagaaagccacagtgaacatgctgcacaaagttgagccttatatgacttatgagtatgttaacttccctgcgatacttatttaa

SEQ ID NO: 42879 - DNA, 462 bp, Glycine max
  Peptide Sequence Number=SeqID_159657
atggcacgcagagaaaaattatggtcattttgcacccttttgtcatccagaggcggcaaccccgatgacatgcagagacaaattatggtcattccgcacaccttttcgccatttggagacaattgtgtccgatggcacgcaaagacaaattatggtcattatgcacccttttgtcatccagaggcggcgagcccgatgacatgcggagacaaattatggtcattccgcacaccttttgccatccagatacgatcgtgtccgatggcatgcagatacaagttatggtcattatgtgcctttcatcatccaaaggcggcgagcctgttgacatgcggaaataccttatggtcatccgcgcctttcgttaatcgagaggaacgaattcggcgatatcaggatgatgttggttccgctggcgggaagattgatcggctgaatgatgttccgctcgaacgaaattag

SEQ ID NO: 42880 - DNA, 717 bp, Glycine max
  Peptide Sequence Number=SeqID_159658
atggaaaacccaagcatcgatctggtagcccaaaaaatctcaggagatgtaaatgttgaaaactttgaacccattcccaatgttgcagaagcgaaatattacccaatcactgctgctcagtacagattttgggtgatccagcaaaattatgaagcttctgccacttataatgtgagtgaagcctataaattaaaaggagatctggaagcatctaaacttgaagaatcattcagattactggttttaccttttgataatattgattttaagattgagaatattgatttatcatcctctcagaataaggatcaggagttagctgagcttttgaataccaaaaagatcaattttagattagatgaatttcctttattcaaagtatatcttattaaagttgataatgatgaatacattctttggttcaatacccaccatatcatttgcgatggatggtcaagcaatctttttgcttcagaaattataaaaacgtacaattctttagtacgaaatgaatctcccaacctaccggatcttaaaatacagtataaagactacgcagattgggtaaataagaaaaatgttgaagagagcagggatttctggatcaaaacgctttccgatgatataaaaagagttgagctgcctttttcaggaaaaagaaagaagtatcagactttcaatggtgataaatttgcatttgtaattgatggagaaaat

SEQ ID NO: 42881 - DNA, 258 bp, Glycine max
  Peptide Sequence Number=SeqID_159659
tttgatgagttcaaggaggaactcgaaagatgccactgggacaaggagtggactgactttggggatggcaacattgatgttgccattgtgaaggaattctacgtcaacctctatgaccccgaggacaaatcacctaagcttgatcctcaagagttggccactaagctctgtatcctagggaagggattcgagcttaatgttgatgggcagcccctcaagattttggggaagaacatgaccaccttagctcagacatga

SEQ ID NO: 42882 - DNA, 312 bp, Glycine max
  Peptide Sequence Number=SeqID_159660
atggatgaccctcaagaagaattaagggaacctactagattaaacgtcagaaagaaccatccaatagctcaaattataggtaatccaagtgaaagcatccaaacaaggtcatcactcaaatcacaaggtcataatgcattgatctcagaagtggaacccaaacacatagataaggcaatgcaagacgagaaatgggtgaagactatgcaagaagagcttgaccaattccaaaagaatgacatttggaagttagtagcgcaaccaaaggacaaggaggttgctggagttaagtgggtctggacaatccgctga

SEQ ID NO: 42883 - DNA, 225 bp, Glycine max
  Peptide Sequence Number=SeqID_159661
atgaacttcctcaactgttacataggatcttcatgggaaacaccactaaaaaggaaaagccccatactttcatatcctagatcacctccacaaatgacaccttctgaaccatcccgagagctatcctcccccatccacctcagtgacaagttccttattccaatcccttacttattgatttacattggggacaatcttgtgtcaaataaccttgagttggagtga

SEQ ID NO: 42884 - DNA, 186 bp, Glycine max
  Peptide Sequence Number=SeqID_159662
atggaggaaaacataatgttcacgagcgcacaatttattgaggtcatagaaatgcttaaacaacagaaaacaatgttggaagaacatcaaaaattgatcgcggatctgcaaacagaaaaggatgatgcacaaaaggaacattcgaatgcaatggaaggtgagggagacttgttgacaaggaaaaag

SEQ ID NO: 42885 - DNA, 757 bp, Glycine max
  Peptide Sequence Number=SeqID_159663
atggatcagtacattagagacattggaaactttctgcaaaaggagaaagagagtctacctaaagcttggaagaggttgcaagagatgataaaaaattgttcataccgtggcattactcaacaaaggttggtccatatcttatatggtgaagtgtcctcacataataggacaatcttagatgttgtttgtgggggcaatctcatgttaaagccacatgctaatgccatcaaaataattgaaggcatgtgctctaacccctacaataactcaggggatatcatgaatagaggcatgcaccaggtggagacatatggatcccaaactgagttgggaaagcaaatgcaagatctatcaatgaagattgagatactcatgagagctcaagctcatatcctcattactacaccttcattcccaacctatgataaatgtgggattatgcatgggccaagagaaggcactattgatgacaagttatttgcagccatggatgagatcaactttgttgggctaaagaaggagaaaaccactccaccaccaaaagtagaggttattactgaagagagccaaaaagaaaatggagaaggtgagaagaagattcaaaaacaaaggcaaaaggaagggcaaaatggtcttttcacaaaggtttctgatcctaaattcgcccaagctagcatccagcagctcgcatgggctaaagatgtaacttcaaccctaagcaagcaactcgcctgggcgaatttccctagaccccttg

SEQ ID NO: 42886 - DNA, 588 bp, Glycine max
  Peptide Sequence Number=SeqID_159664
atgggtggtggtgcatggccgttcttagttggtggagcgatttgtctggttaattccgttaacgaacgagacctcagcctgctaaatagctatgtggagatcattgcaattgttggtcttcaacgaggaattcctagtaagcgcgagtcatcagctcgcgttgactacgtccctgccctttgtacacaccgcccgtcgctcctaccgattgaatggtccggtgaagtgttcggattgcggcgacgtgagcggttcgctgcccgcgacgttgtgaacctgcggaaggatcattgtcgatgcctcacaatcagattgacccgcgaacttgtttattcatctaccgtcgggagggaggggatgaccacggcgccccgtgcgcccggcctcctcgtcctcgcgacaaacacaaaccccggcgcttcgtgcgccaaggaactcaaatctgttaagtgcgactcccgggggcccggagacggtgtcccgcgggagtcgtcacgacacaacatttacatacccctgactctcggcaacggatatctcggctcttgcatcgatgaagaacgtagcgaaatgcgatacttggtgtga

SEQ ID NO: 42887 - DNA, 514 bp, Glycine max
  Peptide Sequence Number=SeqID_159665
atggtggcccaagcccgggctgttgatatgctcgtggagacgtcatcatcgcgattgtggatggcagcgcgcgcccttggcgtgcctcggcacctgcgcgctcctggcgtcggcctgtgggctccccattcggcccgtcttgaaacacggaccaaggagtctgacatgtgtgcgagtcaacgggcgagtaaaccccatacctgtcgggacccgaaagatggtgaactatgcctgagcggggcgaagccagaggaaactctggtggaggcccgcagcgatactgacgtgcaaatcgttcgtctgacttgggtaggacggtgcggctgctctgttgagccgcgccatggaatcgagagctccaagtgggccatttttggtaagcagaactggcgatgcgggatgaaccggaagctgggttacggtgcccaactgcgcgctaacctagaccccacaaagggtgttggtcgattaagacagcaggacggtggtcatggaagtcgaaatccgctaagga

SEQ ID NO: 42888 - DNA, 534 bp, Glycine max
  Peptide Sequence Number=SeqID_159666
atgcagcgggcaggacagcagaccgcagccatgacatgcctgttgttgctgctgtgcctgctgccgatggcggcgctggcggcaatcccggtgccggcgctggacgatcccgtggtggacacggccaacgtgctgtccgctgaaacccgcgccaccctgcgcaggcaggcgctgcagctgcaggtgcggaaaggtgcacagctgcaggtgctggtggtacccagcgtgggcaacgagggcatcgagccctacgcacagcgggtgtttgatcaatggcagctgggccgcgccggtatcgacgacggtgtgctgttgctggtggcggtgcaggaccgccgcgtacgcatccagaccggctatggcctggaaggtgcgctaccggacgcgtacgccgctcgcatcatcgacaacgcgatcgtgccgcgcttccgtgaaggcgatttcgaccagggcgtgcttgatggcacgacgatcatggtggcgctgatcgaaggcgaggacctgcctgcatgggaagcgccgtcggccagcaat

SEQ ID NO: 42889 - DNA, 177 bp, Glycine max
  Peptide Sequence Number=SeqID_159667
atggctagaagctatggagcccgaaatagaatcaatgaagataaaaaaaagtatacaagaaaaagatttgaggagatgagaaggtcgagacctacaaagtttgctttgttgccaagggatatcatcaaaagaaagattcttcttgctatagcagcatactatgattatgaaatatga

SEQ ID NO: 42890 - DNA, 360 bp, Glycine max
  Peptide Sequence Number=SeqID_159668
atgaggatcaaaaggtcttttaaggttgtaatggggccaaggacaaggtatggagaaatatggaataagtggctaaatcccaaaggaatagaggagcaaaggggaataacctttgagaaacaacatttcattcagcatgcttgtagtgagcttcaaaacaaggaaagggaaacaaggctcaaaagggctatcaaaggaattaattcaaggacgcatcaacaagaatcaagccaaggctattgtgcaagcaatcaatggggcaaaacacaccaaatgattataatgatggatggctcaaattctcacaaaggtaaaatcatcactttcaaattgagctttcaaaactatcatgacatgtag

SEQ ID NO: 42891 - DNA, 336 bp, Glycine max
  Peptide Sequence Number=SeqID_159669
atgaaaggtcagactagggtttctttctctaccgaaaccgcaagccaagtggaaaatccgcttcggtatgaagggtcctctcggtgtgggtctcaacggagaacaatggcgaaatgctctcgggaacggaagcttcgagcacactacagacatcttctcaaagatcccaacggtcagatcgtggacacgtgtctcgtaaagctacacaccaaatttcgagacgatccaacggttaacaaacgctgggcagcatttttaccaaggaagcttcatgtagcttcctcaagaagcttcattaagaggcttcctcaagaagcttccccgtggcttctttga

SEQ ID NO: 42892 - DNA, 2637 bp, Glycine max
  Peptide Sequence Number=SeqID_159670
atgttggagattctacgtattgcagagaataaccttttcggttccattcctcaagaaattggaatgttgacaaatcttaaggatattgatttgtcattgaacttactctctggtactctccctgaaacaattggtaatatgagtaccttgaatctgcttcgtctttccaataactcctttttatctgggccaattccatcctccatatggaacatgactaacttgacattgctctaccttgataacaacaacctttctggatcaatccctgcttccataaaaaaattggccaatttacagcaacttgcacttgattacaaccacctttcgggatcaattccttccaccattggaaatttgacaaagctcatcgagttgtatttacgctttaacaatctttctggatcaattcctccctccataggaaatttgatccatttggatgcccttagtctccaaggaaacaatctctccggaacaattcctgccacaattggaaatttaaaaaggctcaccattttagaattgtccaccaacaaacttaatggcagcataccacaagtcttgaataacattcgcaactggtctgccttgttactagctgagaatgatttcacaggccatttaccacctcgagtttgctctgctgggacactagtgtactttaatgcttttggcaaccgtttcacgggttccgtgccaaaaagcttaaagaattgctctagtattgaaagaatcaggctggaaggaaaccaattggaaggagatatagcacaagattttggtgtatatccaaagttgaaatacattgatttgagcgacaacaagttttacggccaaatttcgccaaactggggtaagtgccctaatcttcagaccttgaagatatctggtaataatatttctggtggtataccaatagaacttggtgaggcaaccaacctaggcgtgcttcacctttcttctaaccacttgaatgggaagcttccaaagcaattaggcaatatgaaatccttaattgaactccagcttagcaacaaccatctttctggaaccattccaacgaaaattggatcactgcaaaagcttgaagatttggatcttggagataaccagttgagtggaacaattccaatagaagtcgtggaattacccaagttacggaatttgaatttgagcaataataaaataaatggaagtgttccctttgagtttcgccaatttcagcctcttgaatctcttgatctaagtgggaatttgttgagtggaacaataccaagacagcttggagaggtgatgcgactggaattgttgaatctgtctcgcaataatctttctggaggtattccatcaagttttgatggcatgtcaagtttgatttctgtcaacatatcatacaaccagttggaagggccacttccaaataatgaagcctttcttaaggctccaattgaatcattgaaaaataacaaaggcttgtgtggcaacatcactggcttgatgctttgcccaaccatcaacagcaacaaaaaaaggcacaagggcattctactggcattatttattatcttgggcgctcttgttctggtattatgtggagtgggagtttcaatgtatattcttttttggaaagcaagcaagaaagaaacccatgctaaagaaaaacatcaatcagaaaaagctctgtctgaagaagtgttttccatatggagtcatgatggcaaaattatgtttgaaaacatcattgaagctactgatagcttcaatgacaagtatcttattggagttggagggcaaggaaatgtttacaaggctgagttgtcttcagatcaggtttatgcggtgaagaaacttcatgtggaaaccgatggagagaggcataattttaaagcatttgaaaatgaaattcaagccttgaccgaaatcaggcaccgtaacattataaagctatatggattttgctcacattcacggttctcatttttggtctataagttcttggaagggggtagcttggatcaagtactaagcaatgacacaaaagcagttgcatttgactgggaaaagagggtgaatactgttaaaggtgtggccaatgctttatcttatatgcatcatgattgctcacctccaataattcatcgtgatatttctagcaagaatgttcttttggattcacaatatgaagcccatgtctctgattttgggacagctaaaattctaaagcccggttcacacaattggacaacgtttgctggcacgtttgggtatgcagcaccagagcttgcccagactatggaagtgaccgagaaatgtgatgtatttagttttggagtgctttctcttgaaatcatcacggggaagcatccaggagatctcatttcttcattgttttcttcgtcttcatcagcaacaatgacttttaatttgctactgattgatgtgttagaccaaagactacctcaacctctaaaatcagttgtcggggatgtcattttggttgcaagcttggcattttcttgcataagtgaaaatcctagttctcgcccaaccatggatcaggtgtctaaaaagctgatggggaaatcacctttagcagaacagttccctacgattagatttggacaactcttctag

SEQ ID NO: 42893 - DNA, 192 bp, Glycine max
  Peptide Sequence Number=SeqID_159671
atggatggatttattgtgaatggattatgcataaagaaaccatttgcttcactgtctgcagctgcagggtgtattagaaagaccaaaagaatctgccagcaggctagaatcttgatggataccatgatacacgtattgcaggatttttgggcttcaagaataccatcagaggctgcagattcttgcaagtga

SEQ ID NO: 42894 - DNA, 390 bp, Glycine max
  Peptide Sequence Number=SeqID_159672
atgcataacctgcaagagttggctcataacaggccaatcatacctatggagcattttcttgagcaagtagcttggtctgaagctcaacttccattggtgagacccaacgagggttctcctcctgatcccacacctgtgcaggttgatccagagccagctggcccacaatctccagtggtgaatccacccccttctcctgagcttgaagtagttccctcatctccacctctgattgtcatctccgatgcatcatcagatgaagtggctgcccttcttgattcactagttggagaaacagctgacccccctgcttccccaattgaaggaattgtcgatctttctgattcgtcatctggagaagctgttgctctcactgattccccagtttag

SEQ ID NO: 42895 - DNA, 429 bp, Glycine max
  Peptide Sequence Number=SeqID_159673
atggtgaaagttggaacctcttacgtgccgatcaacgtctcattttcgccaaaagttggcccagggcttcccggtatcaacagggacaccaggatttatttattctgcgaagtgatcttccgtcacagctgtccctcctgttcagctactgacggggtgggcgaattggagctccaccgcggtggcggccgctctagaactagtggatcccccgggctgcaggaattcgatgttcatccgccgcccgaacacggaattcctgacagtcccgagcaatcccacctgccggtgcgcgtcaccctagagaagctcggcatcaccagggcaacgttctaccggtggtacgacgcctatcagcgcggcggcatcaagcttatcgataccgtcgacctcgagggggggcccggtaccagcttttgttccctttag

SEQ ID NO: 42896 - DNA, 198 bp, Glycine max
  Peptide Sequence Number=SeqID_159674
atgactaagatcacattgcatgtgaaaatgaggctaagtcatgaagtgctaaaagtgacagttgagcttagctcatcagcgcagcagttgtcttcagccaggcttagcgcacgactggcgctaagctcaaatccacttacttgcactgagcgcgagggtggcgctaagcgcaacatcgtgaattcagagcctatttaa

SEQ ID NO: 42897 - DNA, 282 bp, Glycine max
  Peptide Sequence Number=SeqID_159675
atggcgttttggttggccaaaagcgccagcaccagcagcgatttgcgttgcttgagctgcttaaatccccccttccccgtagaccattcacgtgagaaaaaaaaaaacagaaaagagaagcttgctggtgttgtgtttgagcaaaaacgaagaaggattgttgttgtggtgtttgtgtttgagcaaacttcttcatttaatatgtttggaatggggaagcagacagaaaactacacatcagacgagcagtgccgacgtatcaaggtgaagaacaaatactag

SEQ ID NO: 42898 - DNA, 195 bp, Glycine max
  Peptide Sequence Number=SeqID_159676
cacatgcaaatcgcagggggcaatggcgcgttccgtctcgacgcgccacctgacagtggtgtcgccagcttcaatgacgcagcagaggctgtttccaagggggttgcagtctgcaacgctgcaggatgttgtcagcttcaatggcgttttggttggccaaaagcgccagcaccagcagcgatttgcgttgcttga

SEQ ID NO: 42899 - DNA, 282 bp, Glycine max
  Peptide Sequence Number=SeqID_159677
atggaattctttgcctctattaagggtcttacaatagcaaagttgtattgtggaacccagctactggggaattcaaggtcattcctcccagcccaattgagtctgtaccaccttatatggacccttggagtagctttcatggatttggttgactgtgttatagatgactataaggtgattaggcatgtagatttttttgaaagaactgacttggaactcttggaggaatgggaatctagatcctactgccccttatgggaatatgggatatatatagcttaa

SEQ ID NO: 42900 - DNA, 135 bp, Glycine max
  Peptide Sequence Number=SeqID_159678
atggtagatggtagcatgatgggtagccctcctagggcagggtttggaggactttgtagggttcaccatggaagctttcttgtgggcttatatggtcatgttggagggcaagagatcttatatgctgagatttaa

SEQ ID NO: 42901 - DNA, 204 bp, Glycine max
  Peptide Sequence Number=SeqID_159679
atgtatagcaatgagattgggcttatcaagaagttgatgcctttgtgtgaggtgcagcacactctccatgagggaaatcagtgcgcagacgtgttagcaaaactgggagctaattctttgagtcctcttgatgctttgcatgatcccccagttgcaggcagatgcactgagggttgccttcccaaggctgtaattcacttttag

SEQ ID NO: 42902 - DNA, 429 bp, Glycine max
  Peptide Sequence Number=SeqID_159680
atgtcacgccttctaactccgaagcaacagtgccgtccaagcatttgcataggggaaatcgacaacaaagttgacaccgcacacggccatgactcacacatgtgccgcctgagcatgcttaaacacaacctcactctagacgaaactaaactggagttgcacaaggctaaaccacatggtcagatcagagaaggggctgatgaaatagaagagaagactgcgaagttgaaaggaagtgagaaggctctagttgcacggcatgaagctcgtcatgctgtagtaggtactgcagtagcaaaccttcttgctggacagccacatgttgaggtgtggactttgggatatcttattttagaattcatttatcttgttttatggtgggaaattaaagaaaagtataaatctgttatgtgtgatattaagcgatga

SEQ ID NO: 42903 - DNA, 351 bp, Glycine max
  Peptide Sequence Number=SeqID_159681
atgtctaaatgccctaggtgtggggtatcatggtacaaagcgaaggatgatgatgagtgtagcagtgatgaaagcacaacaaaaggctccctagcgaagcaaaaatacatgatgttgtctatgatgatatcaggcccaagacaaccaagaaatgacattgatgtttatcttagtcctttgattgaagacttgacaaagttgtgggacgaaggggttgtcgtggttgatgggtatcgaaatgagacattcaagttacttgtaatgctattttgtaccattaatgactttccaacatacgagaatttgagtggatataatgttaagggctatcatgcatgcccttatctatga

SEQ ID NO: 42904 - DNA, 276 bp, Glycine max
  Peptide Sequence Number=SeqID_159682
atgggtgacttcgagaaatgtgggttgcatgtcaatgaaaatcctccccgcttagttgcccttggaagagtttatgaagggtcgaaccccgtccataacatccctttgggaaatgatcaagtcaaggtcagtattgaggaagttcgagatgccaatgctcgcgtttctatacccactcaaaaggataaacagagaactgagggatcgatgaaacctgcagatagactgtatcctaatgttgatcccctatacctgatgacattgaccatcatgtaa

SEQ ID NO: 42905 - DNA, 1029 bp, Glycine max
  Peptide Sequence Number=SeqID_159683
atgactaagaatagggtgttgaaagagcataacaagactttcctaaattggtttaaggatataatctttggtggcgataatacttctaaaacactaaggaagttagcagatgggcctaaaagaaatgttataacttggcaaggatacaatatcaacaagttttcattctacatgaaatcacaagacaagaagagtacaatgcaaaacaatgtgtgtaggtgggttgatagcaatatcagtgtgagaatcgatgattttcgatttacgttggtagatctaaagaagctcgcttatcagaatgagcctttcatcatggcagaacaagctaaacagttgttttatgttcaagatccttgtgatgaaaggttgtcagtggcacatggctacaccaccatctcccatcctcctccttatgagtcagcagtaccttcgccatctacatcgaagaagacaagaaaagcaacatggcttagatcattagctactagatcagttagggcagagataccagtggttcatgtggatcttgccattgggaaaacagatgatagcaaggagggcgaggatgataaagtatgtcaaaagtacgacataagcaaggagaagtggaaccagttttgtcataactgtaaaacccttcatgggagggattatgattatttagaagaaaagtcgatggaggacaagaaaaagaaacgattggaggaagcagcccaatccgagagcactaacacaatcgttgatcctctatctctcattagacgacacatgaagtggaagatgacccacacaaaaaaatctggtcaaatgatgtctgaggcaacaaaggaaattacagataggattgcctcacaagaaagctttgtcacccatggatgtcaggatgtattgactgttgtcattaggcgaccagaataccctggtcgtgtctgtgctactgaagccagtgtcacgatcaaacaatactttagaccgacttcaaggaactcccttatgtttacatccatggctcccgaagacctggagtag

SEQ ID NO: 42906 - DNA, 252 bp, Glycine max
  Peptide Sequence Number=SeqID_159684
atggcatggcattgttcaaaacaatcgatttctgcgttgggagcaagagtactatacctagcagggcaggagcagggattgaaggacattaaattgggatgcatcccccagacaggcgcttccatggaacacgcgacacgtggcacagcgcggcgcacgaggcagcatggtagcgcccttgacgcgggcgcgtctggaagcgacctgccgctgggcgcgactggtagtgcccagcgcgtgggcgcgaactga

SEQ ID NO: 42907 - DNA, 714 bp, Glycine max
  Peptide Sequence Number=SeqID_159685
atgctgcggtcaccgccggcgaagaagcgcagatcgggcggcactttttcgaaatcgttggtttcaatccagccaaggttaccgcgcgccacaaagcgatgcttctcgcccagcgtgcggatccacacgttctgcgcctgcaggatcaggaagtcgacgtctgaaccccaggccgccgcgcgaacgggtgcggttcaggctgacgcccggatagagcagcatggtggtgttggtgacgctgccctgagtaaagtggtcgagactccagcgcaggttaaccgcgcgctgccagccggagctgctgtcccagttacgcgacatcgccagcgtggtggtgtccgatttggtgtcgttgagatcggtgcgtttcaggccgccggagaaggtgtagtactgctccagcggacttttcagcagcggcactttatagctgagatcaagctgctgctccggcgcggagatataggcgctggaggtcaggctgtggccgctgtcattgatccacggctttttccacgtgcctttcagccgcggtccgacgtccgtcgagtaaccgacaccggcttcgatggtgttctccacgcgcggcgacacggcggcgctgagcggcagcactttggtctggcgccctttatcgaactcgggtgccacgacgacagaattaaaccagccggtggcggagaggcgacgattgagttcggccagatcgcgtga

SEQ ID NO: 42908 - DNA, 609 bp, Glycine max
  Peptide Sequence Number=SeqID_159686
atggtcatccgcacacctttttgccatccagagacgattgagtccggtggcacgcagagacaaattatggtcattctgcaccttacgtcatccagaggcggtgagcccgatgacatgcagagacaaattatggtcatccgcacaccttttcgacatctggagacaatcgagtccgatggcatgctgagacaaattatggtcattatgcacattttttcatccagaggcggcgagctcggtgacatgtggagacaaattatggtaatccgcacacgttttcggcatccagagtcgatcgagtccggtggcatgcagagacaaattatggtcattctgcaccttttgtcatccacaggcggcgagcccgatgacatgtggagacaaattatggtaatccgcacacgttttcggcatccagagacgatcgtgtccggtggcacgcagagacaaattatgatcattctgcaccttttttcattgagcggctgcgagaatgatgacatgcgcagacaaattatggtcattctgcaccttttgtcatccagaggcggcgagcccgatgacatgcggagacaaattatggtcatccgtacacctttcaccatctag

SEQ ID NO: 42909 - DNA, 964 bp, Glycine max
  Peptide Sequence Number=SeqID_159687
tgcggggttcaacttgtcagcgttgtcttctttctatgttctgtttgtgaatgttttggagttggggtttgaagggggtgctttgatttggggtaaggctaatggggatgctgacgtaaatttgtctcttcttgttgtcactgctgcacagggtttgccttggtttgtgttgagcttgttggtcttgtattgcaagttcaaggtgtcagagaggttcccatttttgttgagagcttggtggtttttgtcctttgttatttgcttgtgtactttgtatgttgatgcagcagaagcaactcttagaagaaggttacatgcatatcaaaagaaagatgattttattcctcttgagagtgtcattactcctcttgaaggagaagtttacgaaatcctaaaggaaaaagcaaagctgctaagaggcatccacaaagacttttcagacatcaaagatgaactagaaagcattcaagccttcctcaaagatgcagatagaagggctgcagatgaagcaaacaccaatgatggaataagaacttggctaggtgggaaatgtccagcagagcttcaaggtatgtcaaacaatattgttagaaaatgtgaggggctagcgttggcgattgtgtccattggtggtctattatcaacaaaatctaaaactgtgtttgaatggcaaaaggcagagatgcaacatttgaaagataagctagctatatcagagataacagcaaaggcagagtcaaaattgaaggataaactgaagctgaggttaacactgaagctgagcgccaacagaagaagaacgcgcaaagtcgtggtgaagaccaccaccaccacgtcgccaacaatgttgaagaagaacgcacaacaagaacgggctcaagaaccacgccgtcgacagccaaagaacgcacagaagaagatgaagtgcagccgcggaaggaagaaaaagtgttgggtgcactga

SEQ ID NO: 42910 - DNA, 732 bp, Glycine max
  Peptide Sequence Number=SeqID_159688
aaatccatgaaggcaccctaatgtctgaggtttatgggattaagatggtcattgaccagtccctattctatgatttaacccaattgccaagcgaaggtgtaccatttgaaggtgcactaattgacgattggaagtttgatttctctgtacatgatgcccaccggttggtttgcaccaaccaagcggatatgaccgaaaggcttcttgccgaagatctcattgttatgtgggcctttcataaaggtctacaaattgattgggcacatcttattttggacaggtttgatggtcttcaaacctttgttggtgaaaggtttgacactttggaattacaagtggatatgcgcttcaatgagatggagtcaagaatcaccaaagttgaagaagataatgagttcaagatgttcaagatgtttaagatgttcaagattgaatcaagaacacttcaaggttcaagaggaaatttgattccaagaatcaagaatcaagattcaaggttcaagcttccaagaatcaagatcaagattcaagaatcaagagaagacttaatcaagataaggtacatcctttgtggtacaagtagagggtacatctacttgggtttgactgagaacaagagagggtacatctcttgtggatcagttctagtggagggtacatccactaggttcaaagagaacaagggagcgtacatcccttgtggatctttgcttgtaaaaggatttttacaag

SEQ ID NO: 42911 - DNA, 444 bp, Glycine max
  Peptide Sequence Number=SeqID_159689
gttaccaagctctcgatcgagaacctcaacgatgtgctggtaaacgagaaagaaggggaccacgtgagtgtagagccaggactatgccacagagcgattttgggcgatggagctgaccatgtagttggggattgtgaggaagagggtggtgttgctgtagaggaggctgcaggtgatggtggggtcaacgtcttcgaggcggggggatcttgcgttgaggtggcgaagcctggcggcaatgcgctccggggagggggacaagtgctgcagggtggcagtgggggaggagggagagagaggaagtgggacggtaataagagtgccgttgaaaaacttatttataacttatttgaatttattttggcaaaggaattccgatgctttgatgtatatgcaatgatattttattgggttctaactctttgtttgaggataccactataa

SEQ ID NO: 42912 - DNA, 285 bp, Glycine max
  Peptide Sequence Number=SeqID_159690
atggcggatggcggatggcggaaggccaaaattccgccatataaacacaccattgcaccttatggcaccaccatggcgggccttccttcacaaattgcctttggagaaagtgtaaaggatttgcgagatagtggaactcctaagcgggtttcttggggactggacactccaacgaatacggcggtcacgaaccccagcgacgatgatggtgaggagcagatggcggtgacaggttgcaaacgacagtcacaggtcacaaacgacggtgataggtcttgcgggtga

SEQ ID NO: 42913 - DNA, 447 bp, Glycine max
  Peptide Sequence Number=SeqID_159691
atgactgtgaagcaaggtttcttctctctgcgaggctcactcctcttctttgcaatccttacccttctctccttaacctatctttctctcaaatactccaccccaacacaggttaccaagctctcgatcgagaacctcaacgatgtgctggtaaacgagaaagaaggggaccacgtgagtgtagagccaggactatgccacagagcgattttgggcgatggagctgaccatgtagttggggattgtgaggaagagggtggtgttgctgtagaggaggctgcaggtgatggtggggtcaacgtcttcgaggcggggggatcttgcgttgaggtggcgaagcctggcggcaatgcgctccggggagggggacaagtgctgcagggtggcagtgggggaggagggagagagaggaagtgggacgggaaatctactacttattctttttga

SEQ ID NO: 42914 - DNA, 357 bp, Glycine max
  Peptide Sequence Number=SeqID_159692
atggcagcggaatggagaaggaagagagagaggagacgccacttcaatgagaagatgagtctagaagaagctcaccaccataggaggccatggataagagcttggaggaagaaggagatgaatgaagcctatgtgcccaaaatctaccctaaggctcatgagaaccttagggtcttctcttgcatctctggcccaatcttcttggagtcttctatccaatgcccttggggggtaggattgcatcaactaaggacctgggagatcacactaacatggcgctcgagaaggaggaagtgtattgcgagactaatagattcacaaattcacgacaatttatgtataaaatctctagactaa

SEQ ID NO: 42915 - DNA, 279 bp, Glycine max
  Peptide Sequence Number=SeqID_159693
atggagctgccttggttgatgagggccttggacaccatgaagttggcgattatgatggagacgaccatagtctctatccgtgaaagtgataggaggaagacttcgtggcgatggtttatcgacatagttgatgttgatgtcccatatggcatggaggtggtgcttgtgggactggctagattgctctctgtaggagaatcctcccgtaatggtgttgatcacccctcttatttgttgggcgggttcctattcttgcggaggttgtcgatcgcgtcttag

SEQ ID NO: 42916 - DNA, 291 bp, Glycine max
  Peptide Sequence Number=SeqID_159694
atgaagaagatcctaggcctacaagctccactggagcttacatcattagtgacctacacgggacatactaactcaaatctccaactcaagacattacctctcacatcaaacctcattggggcaaacttgtacaccaatgaagatgaaatcctatgtcgtgtcttcccaacgtccctcaaaggggcgacattgacttggtacggtggacttcctccaaggttcatcgacaactttgacactttatcgagcgtttcagtgcgcaatatgcaaccagtcggtcacaacatatga

SEQ ID NO: 42917 - DNA, 275 bp, Glycine max
  Peptide Sequence Number=SeqID_159695
aacaaccacctatagataatactgacaacggtgtagaaaaatcacctagagatgatactgaaaatggtgaaaacgtgatagaacaaccacctataaataatactgacaacacaaatagtcataatttcaatcaagaactagaagacaatattttagaaataggagtagaagggaatgttgagcataataacacttctagtgaagtacctacaaatatttatgacccaggactatggaaaaatattgatggaaaatttagagatttaatgatataa

SEQ ID NO: 42918 - DNA, 240 bp, Glycine max
  Peptide Sequence Number=SeqID_159696
aagtccaacagggtcctggggtttccaactctgattatgggcctcttccagttatacggagtgcccgtcgcccccagcaaggcaggtgtagggcgagacaccacaacagcctggggatggccgacagcgggcaacaggcgcactggcgccacctccaaagcccctcatctcatctacaaaggctggagcgttgcctatgacccgtggccgactggcaggcgaccaagtccaaagccaaag

SEQ ID NO: 42919 - DNA, 141 bp, Glycine max
  Peptide Sequence Number=SeqID_159697
atggagttcaacgggggtgggggtcacaacccactctttgaggattcacctagtgagtctggtagtggggccgccactgtgagatatgggctaatctccaatgacactcacgaagcaagatgcaagtgcaaggccgtgtaa

SEQ ID NO: 42920 - DNA, 467 bp, Glycine max
  Peptide Sequence Number=SeqID_159698
ccagcgatagcagcatctctagcggttccctgagattcctccagttattccccgactgctccgatagaattcccaaacgtcagagagacggagaagagattgaagcctccacttggtactgtcttcatgcgattcctttttctccctccatgaatattatcccgcaaaatcccaacggtgaaagtgtgcgaaattgcatttcgaataacatatccaaatttcatgaaaatccaacgattaacgaaaccgggatcctcaaacatgatatcaaaattcccaacggtgagaatgctcggaattgggcttcgaacgtagtgctcaaatttcacaatgatccaacggtgaatgagttcgagatcgtcatttttctgagacaggttaggtggccttcgggaaaaagagagggttttgggagaagagagaagaaacgaaattgtgaggcagaggagaatgaggagtcagtctga

SEQ ID NO: 42921 - DNA, 447 bp, Glycine max
  Peptide Sequence Number=SeqID_159699
atggataagtggatgaatataaccgacatgagttatgtggttgcatcaaggtataatgtcatccttgtttctctttttctccaacaaagcatgacattttgtcctcttagaagtcaaccaccaagagattattttgtacatcaagttatatgcatcggtcatgtgcttgaaaatcattttgttcaagtatttctaagagaagcttgtcccttaccgccaacaactttgttgtggtcaacatattgtcattatcatctccatgtggagcttgtacgcctaggatcttcttcatcaatggattccttttcttcttggaagatgaatggtagcggaatggagaaggaagagagagaggagatgccatttcaaggagaagatgagtctagaagaagctcaccactacaagaggccatggataagagcttggaggaagaaggagatgaatga

SEQ ID NO: 42922 - DNA, 147 bp, Glycine max
  Peptide Sequence Number=SeqID_159700
atggccttttctctcactctgctttgtcacagcttagagggcaatgctggtgaactcacaaattttgaggtccttgatttcttacgagctaaaggggcttcaaaggatccaacaagagttattgccaaagtagcgcttttaaagtga

SEQ ID NO: 42923 - DNA, 920 bp, Glycine max
  Peptide Sequence Number=SeqID_159701
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatcgaagattcttacaactatgccctgaaagataatatcgaacccggatctacctttaaaaccatttctcttttagcagcaatggatgacggattcatcgatgaaaatacaacggtaaacgttggaaacggtgtctggacctacgcaaaacaatcaagcttatcgataccgtcgacctcgagggggggcccggtaccagcttttgttccctttagtgaggtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 42924 - DNA, 171 bp, Glycine max
  Peptide Sequence Number=SeqID_159702
cttttggagagtaagatacaggaggcaaggtcgaagaaggatactctcaaagcaagagctcaatcagcaaagactgcaaccaaggtgagtgagatgctgggaaatgtcaatacaagtagtgctctttcagcttttgaaaagatggaagagaaaggtaagaaaattcattga

SEQ ID NO: 42925 - DNA, 485 bp, Glycine max
  Peptide Sequence Number=SeqID_159703
ccttagagtttgatagtcaccatttccggagtgccaagcaccagcagcgcttcgacgccaacaggggatggtcattccacagggagaggcgtgtccagctcagggaagatgagtacacggacttccaggaggagatagctcgcaggaattggacatctctactgactcccatgaccaagttcgaccctaagatagtcctcgagttctatgataatgtctggcccacagaggaggcagttcgggacatgcgctcatgggtgaggggtcattggattcccttcgatccagatgccctcagccagttcccgggcgacctgctgattttggaggaaggccagcagtgtgagttcagccagaggaggagccaggcagacggttacgatgaggaaggattttgcccggaccactgtagggaggcgagtgcggatcatgcgcaccagcatgactaccttgacccagatatgtgtagatgcaattggctttga

SEQ ID NO: 42926 - DNA, 288 bp, Glycine max
  Peptide Sequence Number=SeqID_159704
atgtcgcggaacttcacggattgcttaacgatgggtgtcaagttcctcgaagcggtcaagcgaaggttgcgtgccatcaaacaatggtccccggatgaaattaggatatctccgcatgcaactgactcgctgtccctggatgacaaaggcgcagaattcgtctatgcgtgtttaccacccaacttgctgctcttgaatgataaaggtaaaaatgcgagaccaactggttctcgcatgtcatcgggcccgccgcctcttgatgacaaaagatgcagaagacgacgttag

SEQ ID NO: 42927 - DNA, 885 bp, Glycine max
  Peptide Sequence Number=SeqID_159705
atggctaacggtgagtctggcgctcgtgctgacctggacgatcaccgcggggatggtgttcgcgatcctggtgtggcaggcgggtgtccgcggcatccgtatcgatgtgccgtggtcggatcaggtgctgcacttctggctgcccgccgtgacggtggccgcctgggcactcgcccccggccatcgcgcggtgccgtggcgtgtggtcccggtcgcgctcgcctatccggtgatctggggtatcgccaccatgatccgcgggccgttcattggctggtacccgtactacttcctcgacccgcggcaggtgagcggcccgatggagttcgtggtgtcgtcggcgatcgcgctcgggacgttcgccgccgtcgccacggccctcgtgctcatcagcaggatgccgctgcacgggcgcctgggcagcgatgccgaggcgatcaccgatgcgctcccgacgcctgcggcggagcacgcgggcgaaagggtctctcagacgtagagggtgagcgatgcgagggcggcctcgatcgcctcgtcctccgcgagcttcgcgaactcgacggctgccgctgcaccgacgataccgacgaggacgttctccccggtcgacgggcgcaggttgatccaggtggggatcgccacgtcggcgccgacggcgtgccagatcgcctcgtcgttctcccagaacggttcgtcccaccacagccagaccgtctcgatggcgcccatgccgagcgcggcgaccgcgccacggttggagaacggcaacggcgggtcgaactcgatgctgccgtcctggagcacaccgagcggcacggtcacgacgacgcggtcgaacgagagcgcctcgcgggtacccaggcgcacactcacgccggagtcgtc

SEQ ID NO: 42928 - DNA, 297 bp, Glycine max
  Peptide Sequence Number=SeqID_159706
atggtggaatctgaaagacttagctatatcagaaacaaccaaaagaagcttagagttgataagtattctagcttacaaacttcattggatactggaacagctaaaggcttaaccaagggaaaaagagtcatcttaccctcaacgtttgttgggagcccacgttatatggatcaactttactttgatgacaggccagatattatatcacgaattttcagattaaaatatgaacacatgctgtcagacttaacaaagggtcaattactgggaaaagtggttgcatatattaatggctaa

SEQ ID NO: 42929 - DNA, 177 bp, Glycine max
  Peptide Sequence Number=SeqID_159707
atgggtcaaaacacaaaaacatcaagagcactcaagtttatcaatcaattctcatcagaacatcaattgagaggagaagggattgaagccttcactccactgtctacgtgcgatgagtatttctcccttcatagacaatattttgaaaatcccaacggtgaaggtgtgaggaaatga

SEQ ID NO: 42930 - DNA, 237 bp, Glycine max
  Peptide Sequence Number=SeqID_159708
atggctcggaacttcacgaattgcctaacgatgggtgccaagtacctcgaagtggtcaaacgagggtcgcatcccaacaatggatggtccccaaacgaaattaggatggaaggctacactccaacccatagttgccttgtccactatagaggcagtatacatggctctatcaaaagcactgaaggaagctatttagctgaaaagtcttattaccaacctcgaatttatacaggatag

SEQ ID NO: 42931 - DNA, 215 bp, Glycine max
  Peptide Sequence Number=SeqID_159709
gcgcagaaaacgacgttagtctctgcgtgctattaggcttttcgacttatagacagcaaaaactttatacggataaccactcgggtatttccgcccgtcagcgtgactcaaaagtcaatatgacagatcttgtgagcgcggaagatgacgtaaatctccgcatgtcaacgggcttgtcggccccgattgacgaagggcgcagaagacgaccttag

SEQ ID NO: 42932 - DNA, 854 bp, Glycine max
  Peptide Sequence Number=SeqID_159710
catcagcgctggcaagtgtagcggtcacgctgcgcgtaaacaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttggggcgaattggagctccaccgcggtggcggccgctctagaactagtggatcccccgggctgcaggaattcgatgctttcggtgcggccggaaacgatgcgcaaaccgcgtttgaccaattcttccgccatcgctgcggcgttgattttcacctgtttcgcgtattgtttgaactcgggttgcagggcttctttgaacgcaacggctttggcggcgatgacgtgcatcagcgggccgccttgcaggcttgggaagatggaagagttcaacgctttttcatgcgtgttgtctcggcacaaaatcacgccgccgcgcgggccgcgcagggttttgtgggtggtggtggtcacgaagtcgcagaatgggacggggttggggtattcgccgccggcaatcaggcctgcgtagtgtgccatatcgacaaagaggtaggcaccgactttgtcggcaatttcacggaatttcgcccagtcgatttgcagggcgtaggcagatgcgccggcaacgatcattttgggtttgtgttcgagcgcgaggcgttcgacttcggcgtaatcgaggacttcgttttcatccaagccgtaggtaatggatcaagcttatcgataccgtcaacctcgagggggggcccggtaccagcttttgttccctttagtgagggttaa

SEQ ID NO: 42933 - DNA, 655 bp, Glycine max
  Peptide Sequence Number=SeqID_159711
atgatcgttgccggcgcatctgcctacgccctgcaaatcgactgggcgaaattccgtgaaattgccgacaaagtcggtgcctacctctttgtcgatatggcacactacgcaggcctgattgccggcggcgaataccccaaccccgtcccattctgcgacttcgtgaccaccaccacccacaaaaccctgcgcggcccgcgcggcggcgtgattttgtgccgagacaacacgcatgaaaaagcgttgaactcttccatcttcccaagcctgcaaggcggcccgctgatgcacgtcatcgccgccaaagccgttgcgttcaaagaagccctgcaacccgagttcaaacaatacgcgaaacaggtgaaaatcaacgccgcagcgatggcggaagaattggtcaaacgcgagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgg

SEQ ID NO: 42934 - DNA, 594 bp, Glycine max
  Peptide Sequence Number=SeqID_159712
atggcgttacctggaaaaaaaagtacttccgaacttaaaattcatgataacagccagcggaagttatgcaaaatgggtgcaataaatccttttaggggaattgataaagcaattctggctatgcatcatattgatgatgttgttttcaagattgcaggagatggtcccaaaaagaaggaatatgaagagctggtagctcgtgagaatctacagcataaagttgagtttttgggcaagctggtgcctgaagatctaagaaaaattactcttaccgcagatgtggggatgagtatcgaggaaaacggcggggacagctacttatactcccttccgaataaagtcttggactgtattcaggcaagggttccattaattatggctgatctccctgaaatgcgtaatataagaatgcagtttgatgttggtgagatcattaaggaccatcagccggaaaatattgcagatgctgttttcagaattttaaataagggaagaaagggttatcaggatgaattgaaaaaagcctcggaattgctttgttgggaaaatgaagaactaaaacttctggaagtttttagaaaggcatctcaataa

SEQ ID NO: 42935 - DNA, 339 bp, Glycine max
  Peptide Sequence Number=SeqID_159713
gctgttagaaaattgcagacactaaaccatacacttgtgagcagagggaaacaccagccttgtgaggaaaatacgaaaaataaggttgcatttagcaaaagtggcacagaaaggaagaaaaaagaagaaattctgaagcaggcccagtccaataggggcgctcagcgcgcatcaggcgctaagcgagcaactaactggaggcgctgggcgtggcagaaaccgttacgcgcgctaagccagccaggcgcccagcgtccgatccaacagaagcacaggcccagcgtgcatggcgcgcccagcgcgcgatctgaacgcgctaagcgcgaggtgtggcgctga

SEQ ID NO: 42936 - DNA, 869 bp, Glycine max
  Peptide Sequence Number=SeqID_159714
gcaaaggcgaatgggccccgttcatagacattctcgcactattgatctttggaggagtcctctttccgaatgtggatgggctggtggacctagcagcgatcgacgcttttcttgcctatcataaccacaaggaaagcccggttgtcgctatgctagccgacttatatgacaccttcaaccgaagatgtgaaaagagcaatacaaagattgtttgctgtactccagctctttatgtatggttagttttgcacctttttctccaagaggtgaggcatgcttgcccgctagaaggtcactgctcatgcacagagaaaggaggggcaaattgggaccaactcttagcaaacaaagaaggagcgtctatcaactggttccctcgatggaaagaaggaagagtcggagttcttatttcgtgcggagggtttcccaatgttccctcgatggggacgaggggttgcatcagctacaatcccgttcttgctataagacaacttggctaccgtatgagaggggcgtcgctagaggaagagatcgcgcctgtcatttcacgaggtttcaataagaccaacgtggagacgcttcagaaggtccgcaaggcatgggaggttgtgcaaaagaaggacaaagaactcagaggcagtttggattggctcccgagtttgagaaccgctaaaagggaggaagttgaggcaccggaggaagacgaagaggtgcaggcccttagggcagaactcgagcaagcccaaacagtcaaagaaaggttcaaatcagtagctcttaagatccgaaaggagaatgccgaactgagagatataaatatagctaccaccaaggccttggaacaagagaccaagagggctcgtaggtaa

SEQ ID NO: 42937 - DNA, 533 bp, Glycine max
  Peptide Sequence Number=SeqID_159715
ggaggattgcatcaactactatgcatactggggcaagatttcacctgtgccgctgtaaagagatgagtgcggatcatgcgcgccaacatgaccactcttacatagatatagataacgttgctacattctgcccaacgaccgcaatgctgatctccccctatggatgtatcagttggtctgtctcgttccgacatagggatcgtgcccacaagacgcccaatggactcggaggagcccaaaatgttcctggggtttccagctctggttacgggcctctgtcagtcctacagggtgctcgtttcccccagcaagggatcgtgcccacaagatacccggtggaccaagaggatcccaatagggccctggggtttccagctctggttacgggcctctgtcagtcctatagggtgcccgtttcccccagcaagaagtactgcgacctcaggcaggcgcagggcaaaacaccacaacagcctggggatggccggcagcgggcaacagacgcaccaccaccacctctaaagttcacctaa

SEQ ID NO: 42938 - DNA, 375 bp, Glycine max
  Peptide Sequence Number=SeqID_159716
atgattttatgcattctaagggagaaagattctttcggattagaagaacatagtggaatagatctgagtggtaacactgatgcagaacatgatatatccaacaacactcaagaaaatgcatgcaagaaacaagtggaaagtcctaacaacaacattgaagctgaagatgtgaaggaaatttcacatgttgtgtacaaggagacaggaaaggcttcaaaagttgaagtaaaagatgtgaaattgaatcatccaaaggaagttcaggttaactctgtgagtaagggtagcaatgcagccaagactaagaacaaatcaatgctacctacttctaaggcatccccaatttcaacaccaaaaagttcaaagcctgcataa

SEQ ID NO: 42939 - DNA, 354 bp, Glycine max
  Peptide Sequence Number=SeqID_159717
atgaacggtgcaaaggtggtggcagttttttgctatgaatgtgatggtggatacaaaactcaagtgaaggttctcatgctgggtaccgatttgtggaggaggattcaagagtttccttttggggttccttttgatgaatcaaggaaatttgttagtggcactgttaattggttggcatctaatgattcaaattcccttgttattggggtgggttattttctgttggatacgaggaagaaggggagaaagggttggacgacacaatggtgtctttcgacggtggtggtttccgttggaaaagcgaaagaaggggagaaagggaagaaggagaagggggagaaggtgatgatatga

SEQ ID NO: 42940 - DNA, 743 bp, Glycine max
  Peptide Sequence Number=SeqID_159718
atggacgaggttaatcctattgcttctcctatggttggaggctgcaaattatctaaatctggttcagaaacattctcagatcctacactttataggtctgtggttgcattggcaagcggtcaagagaattatcagatatctgaatgggactctaattccgggattaaggaaaagaaagacaaaggaaacaaagaagaagccaaagataaaaagaagaaagaggagccaccaccagaaatagtgctcaaagttgatatgcactgtgaggcctgtgcaaggaaagttgcaaaagcattgaaaggattccaaggagtggaagaggtaagtgcggatagcaggacaaacaaagtggtagtgaaaggaaagacaacagaccccataaaggtgtgtgagaggctacaaaagaaaagtggtaagaaactggagctgatttcacccttgcctaaacctcagaggagaaagaagaaccacccaaagaagaaccaccaaaagtggagaaaaaaatatgagggtacattctttgtggtacaagtagagggtacatctacttgggttgttgtaactgaggacaagagagggtacatctcttgtggatcagttcaagtgaagggtacatccacttggttgttcaaagagaacaagggagggtacatcccttgtggatctttgcttgtaaaggattttacaaggtggaaagaaatctcaagaatcggtggttgcttggggactggatgtaggcacgg

SEQ ID NO: 42941 - DNA, 105 bp, Glycine max
  Peptide Sequence Number=SeqID_159719
atggcccctttgggatcaatgaaagttcccttcacaagggattgtcccaaattcggtcccatttttatggtaaaggaacttgtggatgaccttggtgcatggtag

SEQ ID NO: 42942 - DNA, 315 bp, Glycine max
  Peptide Sequence Number=SeqID_159720
atggcagcaatttacagtctttacatcatcaataaatctggtggattaatctattataaggattatgggtctgctggacgaatggataccaatgatagcttgcgggtggcgagtttatggcactcaatgcacgctatctctcagcagttatcacctgtttcaggttgtttaggaattgaacttctccaagcagatacatttgatcttcattgctttcaatcactgactgagtactacagcactgcaaagcacataaccacaaagctggtaatgggcataacagaaatgccacctaagataacagaattccactaa

SEQ ID NO: 42943 - DNA, 510 bp, Glycine max
  Peptide Sequence Number=SeqID_159721
atgtgcacacgttatctgacatttcaagaggttgaaggtgcacatacaagactaaagaggttgcttcgtgatagtataagagatttgtatacttgttgggatgcaatgaataacatgcttatactgcaacatattgaacttaaggtgtcatttcagaatagcatcaacacgattgaccataggtttaataaaccattttacaagagactatgggactttgtttcaacacaagcacaaagtttaatctttgatgagttgaatcattctacaaccattggtgttgacagctctgcttgtggctacacactcagaactactcatagtctatcgtgtgcctatgaacttgctagattttcacagcttgacatggacaggaaagtaacattgaataataaggtttatgaacttgcattttcaaataccacttcattgtgtccccctccagagaaagtaaaaacaaagggtgcaccaaagtctatggaatctactaaatgtacacctttaatgtag

SEQ ID NO: 42944 - DNA, 477 bp, Glycine max
  Peptide Sequence Number=SeqID_159722
atgaatgaaattagcactctttgtgggattgaaacatgtgctataatctatagtccaaatgatcctcagccagaggtttggccatctgactctggagtccaaagggtgctttcaaggttcatggaaatgcctgaagtgagacaaagcagaaagatgttgaatcaggagagctttttgaggcaaatgatcaccaaaggccaacagcagttgacaagacaaaggaatgaaaacaggaagaaagagatgaccaatcttatgcttcaatacctgaccgctggaaaggttgttggcaatcctagcttggtggatttgaatgatctctcatggttgattgatcagaacctcaatgaaatagaaaagaagatcaccatgctccaaatccaagaagtggtgataccagtgattgaaaatgaaggacacatgaatcatgttcaagggctggagagcaacatggacaccaagaaaaagcaacattga

SEQ ID NO: 42945 - DNA, 657 bp, Glycine max
  Peptide Sequence Number=SeqID_159723
atgtctaaacaaaggcgacatgtagaagctcatgtggtggaccctttggagcaacctatgctgttaagcaagtggagcttggtgagcatgttgatcatgtatagcttgcagaccaacaggagccataaccacctattgtctttcctgatacgtgatgtggtcaaggggtctgatttatttccattgactacatgcagtcatcaaacaatagacaaggaactcttgtctgcttttgtagagagatggcgcaaagagacaaacacctttcatttgcctattggagagatgacaataatactagatgatgtggcattgttacttaacattcccactactggcgctttttacaattttgaaaatatggataagggagaggcaattctcgtgcttattgacttacttggagttgaatacaaggatgcctttaatgagacaaagaaaacaagaggtggacaagagaggtgccagaaaaggagatgggatgaagtagcaagagcctatttgtttcatctagtcaattgcaccttatttgctaacaagtgtgaaacctatgtggaggatgtgagaggtattcattgggtgacatatctttatgagcatctaggtgatgctagttttgatggcacaaagaaaattggtggctatgccactctttaa

SEQ ID NO: 42946 - DNA, 327 bp, Glycine max
  Peptide Sequence Number=SeqID_159724
atggcctttgaacctttcaagtactcaagaaaaggtagcctatacctgttggttttcatcagaatgtgtctgtcgcaacctacccttcggcgggagggtgacgctagactcatgggtgcgtcttccaagaaaggattacgcgcggagtcgccaccaacgtttattttgaggaaaacgtcggaaaaaaccggaaaagatgtggtctacgaacttgaggtgaaaggttcgggagttgtatttacgcacggggaaggtataagcaccccacgtgtccgtcacaaaggacgacaacctttaatcaagtgtgcgaatatgacttcaatttga

SEQ ID NO: 42947 - DNA, 321 bp, Glycine max
  Peptide Sequence Number=SeqID_159725
atggggtgcctcttcacaaagggggtcgtagtgatcaggcttgggcgactgtttatcaaaaacacaggtctccaaaaaatcatatatgatcttggaaagaagatttggacatcaaagggagaagaaaaagaagctatcaagaatgagttcatagaggcccttaaattgttggaggaacagctgggagataagacttattttggaggagacaatattggcactcattatttatttagcaagcatcagttttttatttttgcaaaccctccttctgttaatactcagtatgaatttaacaaattaatcataatcctcttgtag

SEQ ID NO: 42948 - DNA, 714 bp, Glycine max
  Peptide Sequence Number=SeqID_159726
atgcgcaaaggaagaagggtgaacaaggagccacaacgtcgtgagaagggtgtagggggaaggaggtggcgagggagaaggaggagctgttgcaaaagggagaggagtcgttgcgggaaggaggtgtctcatagtgggggtgttggggttatgagttttctaaaggaggtgttagagttggggaaagggtggcaatggatcagagcaggcatgagtaatagctacccactcagtacccatttagaaattactcaaggagtatcgtctttgtggaattgggtctcacgaaattggaaaaattgttgcaccaacaaccctaggagtgactcaaatcatgaaccagaaaaccacagtttaaagtgcattcaacatggagtaagattgtgcaaagaagaggtaattgtggtaatgcaaaagctgggaataagtgttgagctacatggggatgggatagaggactttggagaacaagaaattgctaacatgtttgaaaatgatgttagtgtggaagaggtgaaggaagctttcaatgtgtttgatgaaaacaaagatgggttcatagatgctgctgacttgcaaagggttttattccgtttgggtttggagagagactttgtgcagtgtcagaaaatgattaatattgttgatcaaaatggagatgaactaattgaccacaacgagtttttcatgttgatggaacagagtttttgttga

SEQ ID NO: 42949 - DNA, 321 bp, Glycine max
  Peptide Sequence Number=SeqID_159727
atggaggcttggggaactattatggactgccctatagagttggactatgaagatcgtctgaaaaagtttgaagttgtctatgaaccatggcatgagtttgttgtgtatgcattgaatcatattgtagatgaggttcatagaatgaagtttgttagtgtagatatgtctcattgtggatgcattgtaagatctacccatggtttgccttgtgtctatgaactagttaggtatgttttaggtggcataccacttcaagtagttcatttgtactataccatgctaagtttgaacaacatgggtcaatatgcatcagtgccttga

SEQ ID NO: 42950 - DNA, 258 bp, Glycine max
  Peptide Sequence Number=SeqID_159728
atggctgagctttgggggttgtatgaagagttaaagcttgcatttagtaaaggtatatcttgtttggaagtgcatgttgattcaaaatctatggtggatagcataaagggaggaattcaacaacttttggctcaggagtggacaattaaacttgttagtatcttcaaggaggctaacaagtgtgtagatgctattgctaatgaagcatgtgagatggaggaggatctgatgatttttagcaatctccggcctttctaa

SEQ ID NO: 42951 - DNA, 666 bp, Glycine max
  Peptide Sequence Number=SeqID_159729
atggaaagtgagaagagaaccacctcaagttggggagtgggagggtcgtcttctatgactagaatggttttcgtcatcgtgaaacatgagagtttgaagcatgtgggaattagaggaggtgcgtgtgagcgtgagtgtgagtttgagaaggagagtgtgggtgagggtttgactttgatggatggaaaggttaaagggttggaattgaaagcgggaagaagatttgggtggagaagtgtcatcgataagtgttcatttcatgatgcaacacaaacaaacagaggtggttttgatagaggactatccaaggagaaagagtttggcttgggtgggctcaacatggatggacaaatcactagaacgaggagtatggcttctacaagcagagatgctactccaccatttccaaaaaccgcaaggctcatgacaaagatgattaaacttggtgatcaaatgagaaaaatgaattatgaaaatgaagaaaggatggagagaatgagaaaggagaatgaggagagttttagaagaatacacaaaagtagtgaagttttaaatgtgaggattgaaaatacagagcaaagaagtgagaatatatcatctaattcttctcatggagaagatgaagggtatgaagaggatgagagaggaaagaggaatgagaggtaa

SEQ ID NO: 42952 - DNA, 1579 bp, Glycine max
  Peptide Sequence Number=SeqID_159730
atgggaatgaagggtgcccccgtctgtctctccgtcgacgacaacgtcgttctcaagtccccaaacgaccgtcgtttgtatcgcctcatccacctccccaacggccttcgcgccttgctcgttcacgatcctgagatttaccctgaggggcctcccaagcatgctccaaatgaggatgaagttgaagaagaagaagaagatgatgaagaagatggagaatatgatgatgatgatgatgatgatgaagatgaagaagaagaagaagaaggagaagaagaagaagaagaagaagaagaagaagaagaagaagaagaaatggatggggtgaagggtggtggtgctgttgctgctcagagcaaaaaggctgcagcagctatgtgtgtaggaatgggcagcttttctgacccggatgaagctcaaggactagcgcattttttagaacacatgctcttcatggggagtgatgaatttccagatgaaaatgagtatgatagctatttgtccaagcatggtggctcatcaaatgcatacacagaaactgaatacacctgctaccattttgaagtgaagcgagagtttctgaagggtgccttgaaaagattttctcagttctttatttcacctcttgtaaagatggaggcaatggagcgagaagtacttgcagtagattcagaatttaaccaggttttacaaagtgatgcttgccgccttcaacaacttcagtgccatacttcagctcataatcatcctttaaatagattcttttgggggaataaaaagagcttggttgatgcaatggagaagggtattaatttgcgcgagcaaatattgaaattatacaaggattattaccacggtggattgatgaagcttgttattattggtggagagtctctggatgtgcttgagagttgggttgtggaactgtttggcgctatcaagaaaggtcaggcaaacccagtgttcacagtggaaggtcctatctgggaatctggtaaagtttatcggctagaagctgtcaaagatgttcatatccttgatttatcatggacattgccctgtctacaccaagagtatttaaagaagccagaggattatttagctcatctccttgggcatgagggcagaggaagcttgctctcctttctcaagtccagaggatgggctacatctctatctgcaggagttggggaagaaggaatttatcggtcatctatagcttatgtctttgtcatgtccatacacctcacagactctggtatagaaaagatctttgatatcattggctttgtctatcaataccttaagttgttgcgtgaagatactccaccagaatggatatttaaggaacttcaaaatattggaaacatggatttcagatttgcggaagagcagcctccagatgattatgctgctgagcttgcagaaaatttgcacttttatccaccggagcatgtaatttatggtgactacgtgttcaagacatgggatgaacaattgttaaaacaagttcttggtttcttcgttccggaaaacatgagggtagatgttgtttcaaagtcattccttaagtcagaag

SEQ ID NO: 42953 - DNA, 1065 bp, Glycine max
  Peptide Sequence Number=SeqID_159731
atggttgtggaagaagggaagatgagggacttgctgtatgtggaagaacttctacactgctggaaaaacctcaagtgccctgtcttcaaatacttgttttcttcttacagtgaggaagccatgcaaatcgtagaaggtattggcgagttcggactgggggtgacacgtggcactggtctcgccagtgccaccggcgatttgagctcagttgagcaggatttgcttggccgaagtaagaagaaaattaaaggggacggggaaggtttctttggggagtcttctcagcatgtctcttatgttggtattcatgaacccatagaagataagatggttgggcttaaaggagatgagtataaaaatgctctattagggggtagtgatgaagagttttccttgctcattgaagaggatatggatgatgattggaatgtagatgaagaagaaaataaggagttggagaatattaaggtggaagatatcttgcatatgattgacattgggaatgactacttcctagtctacttctctcataaagaggatatgatgaaggcacaaattgaggggccatggcttatatatgaccattatttggttgttcgtgagtggatgccaaacttccatccttcaagtgaggctctagaaaaggttgttgtacgggattacccgatggtccaagaaattgggaagtctcaattagatccccagaatagaaaaatggactttcaagaaggcagggaggatcttcgtcattcctctaggtctcctgaccaaggaattgagactttggataagcttcctttggactttcctaacattattgtgggtagggtgagttcaaggataagggtgatggatattgtgatggagacaattcctttgcaaggagctgataggggtaggcgagaggaatccttgttgtctagaagtcttcaaatgttcagggtggaattcttggatcatcatcctattttaatttccctagatgagaagaactcttggcaaaatgacggtccattcatgaataatattcaattgaagaataatcttgttgtgtggagaatgaag

SEQ ID NO: 42954 - DNA, 438 bp, Glycine max
  Peptide Sequence Number=SeqID_159732
atgaaccagaacccgcaatcaagtgatggaaggaacgatgacgattctgctctctctgatttcctcgcttccttaatggattatactcccactatacccgatgaattggtggagcattacttggccaagagcggttttcaatgtcccgatgttcgattgtggccttacccttgcatatgcaaagaggctgttttcggattcgaacccatgaccaacaagtcaccaaggcacaactttaccgctgcaccagatgaaatatgcaaattgactaggttggtagctgttgccactcagaagtttgtagctgaagttgcaggagatgcacttcagcactgcaaagcaagacaagcaacaattccaaaagacaaaagagacaagcagcagaaggataagcgccttgttttgacaatggaagacctttcaaaggcattgcgtgag

SEQ ID NO: 42955 - DNA, 267 bp, Glycine max
  Peptide Sequence Number=SeqID_159733
atggtgcaacacttgaaattcataatggctgagcagcaaatctttagtgattttgcttcttcctctaactcttctagaaaatatggtgtttttctaagctttcgatgtgaggacacccgtaagaacttcacaagccatctttatgaagctttgatgcaaaagaaaattgaaacctatatggactaccagcttgaaaagggagatgaaatctctccagcaatcgttaaggccatcaaagattctcatgcatcagttgtcatcttctga

SEQ ID NO: 42956 - DNA, 688 bp, Glycine max
  Peptide Sequence Number=SeqID_159734
atgggaggcataggcaagaccacccttgctacggctctatatgtcaaactgtctcatgagttcgaaggtggttgcttcctcacaaatggaactgatgttgttgaaggcataattttagatttggatacattaaccagggatctaggtttgagctctgattcccttgcaaagataactaacattgaaagccttcatgttcattcaaaatctctctgtgaacttgatcttaatggtagtttatctctcaaggaattctcagtgatatcagaggaaatgatgggttgtaacaatcttaacactgaactgagtctgtcattcttacaagcactccctcacaagattgccaatttatcgtctttacaaatgaaacttatgtctctgccagagcttccatcatccctgaaagaaatgagggcctttaactgcacttctttggagacagacttcactcaacggctagtgttacaacacatgttacagagccacctgcacaacttacctgatggcgaggattatgacagtgggtatttcatcttctcgggagaccatgtcactgatgagttgtatccctcagaattggggttgaagctgtttggtagtagtagcaaggaaatatttgaattggaaatcattactcaaatctcggataatgagtcacagtctagagcaattggaaatggagttggag

SEQ ID NO: 42957 - DNA, 2649 bp, Glycine max
  Peptide Sequence Number=SeqID_159735
aagtatgcagttgagatcattgaacgggctggcatgtcatcatgtaagccatctcctactccggttgacatgaaaccaaagctcaatgctaattccaacacaccatatatcgatccatctcattatcgaagccttgcaggggctcttcaatatcttaccttcacgagactcgatattgcttatgttgtacaacaaggtacttttgatcatgacttgcatctttatccatctttcacatccactcttctttcttatatagatgctaattggggtgttgccaatgtggttttggagtcttattggttacaaaaccttcttctagagcttcattgtcctattcgaaaagctaccctggtatattatgataatgctagtgcgatatatctctctacaaatcttgttcaacatcagcgcactaaacatatcgagatggatattcactttgttcatgaaaaggtttctcgtggggaagttcaagtcttacatgtctcgtcacgttatcatattgcatatatttttacaaagggtattcccttggttctatttgaggattttcggaacactctcagcgtacaacaacctcccgctttgactgtggggatgaatgaagaacaagatgaatctctcagttttcatagttcttactacctgcactctagtgaaaatccagcaatcgcattagtttcgcctcttctgcatccaaggaattacaattcttggagcagatcagctctcacggcattgagtgcaaagaataaagtggaatttgtttatggttcccttcctcgaccaaccttgaatcatagattgtacggagcttggaaaagagcaaataacatggtggtttcatggattgtacactcagttgcaacttccatttgtcaaagcgtcttatggatggacaacgcaattgatatctggaaagatttgaaagcccaattactcataagaaaaatttgggatgagcttgagagttatcgacccgatcctatgtgtacatgtgcttctaaatgtggctgcgatgctcttgttgaagtaaagaaaaggaaagatcaagatagaataatggagtttatgtgtggtctcaatgatcaatacaatcattttagatcaaacatactcatgatggatcccttgccattgattaacaaagctttctcttatatggcacaacaagaaaggcaatttgcaagttctaatgcacttggcaatctgagtttagttaatgctgctgctaatacaagattatctaattcttgtagttattgtggtagagacaatcatacagtagaaacatgttataagaaaaatggtattccacctaacttcttctccaatagaggaggtggaggtagaggttttggtagaggggggacaggaggcaaaagcaccaatggtaaagtttgcacccactatggtatcactaatcatacagtggatgaattctataagaagcatggtcatccacctggtcagaagttctataatcctcaaggagcttcaattaacaacactgttaaggaagaagaaaatgtttcaagttcagagactagtaatcatggccaagacattaaaatcactcagcaacagtatcaagccaacaataatagttctcatggatcacaggctaatcatacttggattttgactgacctccctcctaacaaatatgttattggatgtaaatgggtttataaagtcaaacacaaggctgatgggtcagtagaaagatataaggctaggttagtagccaaggggtatactcagattaaaggtcaagactaccttgatactttttccccaatggctaagataactactgtgagattgttacttgctttagctgctgtcaacaactggcatttaaagcaattagatgtgaataacgcctttttgcatagaaaccttaatgaagaagtttacatgactttgcctcctgatgacattgtcttgtcaggcaatgatcttctagagattaagtacatcactcagcttctggatgaagtctttaaaatcaaagaccttggtgacttaaaattttttcttggacttaaagtggctcatagtaaacaagggatcaatatttgtcaaagaaaatatgctcttgatatattgcatgatgcaagcatgttaggaagcaaacctgtctctactccaattgattatgttctcaaagcatttagtgactctgactgggcaggatgcattgataccaggcaatctatcactggctactcagtttatcttggtaattctcttatttcttggaaatccaaaaagcaggccacggtccctagaagttcttccgaggctgagtatcgggcactagccagtgctacatgtgaattacaatggttaatccatttgcttaattattttgggattgtttacactcgaccaactcttttgttttatgacaatcgctccattcttcacattgctactaatcttgtctttcatgaacgcacgaaacatattgagatagattgtcacattgtgcaagagaaactgcattcaggccttatcaagttgctactcattgcttttgctcaacaacttgcagacatatatactaaagcacttccactaggtgccttcaattttcttcaatgcaatatgagaatgtcagatatacattctccagcttga

SEQ ID NO: 42958 - DNA, 114 bp, Glycine max
  Peptide Sequence Number=SeqID_159736
atggaggctagacagcaagttgtgggttgggcaagacctgttgggccagttggtttgagcctggcggagaggtcaaatggtggaccacataagggaagggtccatcgtccataa

SEQ ID NO: 42959 - DNA, 507 bp, Glycine max
  Peptide Sequence Number=SeqID_159737
atgggagaacatgcccagctggtgaacccagtgtttctggatgaagttgtgggtgctacccccatcaaccaggtcacaacttggtggcttgcaatcgagcccaacaatctcaaggggggaattggtgtcattctcttcatcatatgcaataagcaaaaacaccttctagaagcatttgtggccgcgatgtggtgggaagaggggacgaggccgaggggaaagggtagcgcgtgtctaagaacttctcttcctggagtcgtgctaagccagtggcctggactagtgttagaggttgcaaggcctagacttcgcggtggatcacctgtggggtcatcatattgggttggggcaaatcgtgtttgtaaggcttgtaggaaccctggccaggaggctcaggggaacggggttgtggaagaggacacggggatagttggtgagtggcaagtttggctatggcatcttcaaggagaagagagtgttggcttcgagggccagtggcctccttaa

SEQ ID NO: 42960 - DNA, 1005 bp, Glycine max
  Peptide Sequence Number=SeqID_159738
atgaagttttcccgtgatggccgtgtcgttgaattctgcggagacacttcttccaccctttcactactcacaccacctcagctctgtcgtctggttcgcaagagtggtgctagtgccctattccacatccgtatccttcctacgacaatcccttcagaccaaaccacacccacccagttgccactggaaatacaaaccttaatcactaaattcatagctctgtttcaaccacccacctcactacctccttcgtggcaaactaatcatcatatccatattcttccccaatccaatccagtgaatgtcaggccatactgctacccccacttccagaaacaagagattgaagcacaagttgacgcgatgctcgaacacggggttattcgtcccagcacaagtccattttcttccccgggatatcaccaaatcctaatgcatgaagaagatatctacaagaccgcattcaaaacccatcacaaccactatgagttcacggtgatgtcgtttggcttatgcaatgcaccatcatcgtttcaagcgacaatgaactccctcttccgtccataccttcgtcgctttataattgtgttttttgatgacatactgatttatagtcaatccttcaatgatcatttgctccatttggaactggcttttcaggtattattgcaaggacaatttttcattaagctttcgaagtgctcttttgcccataatgaggtggagtacttgggccatgtggtctcaagccacagtgtcgcaccaatcacccaaaagatacaagccatacaacaatggccaactccacgtactgctcgagccttgcgcagtttcttaggcctggtcagattttaccaccggttcatcaaagggtatgccaccctcgtggccccattaacccagttgacaactcaagatccctttgaatggtccacaacgactcagtctgcgtttgataaactcaagagtgctctgacttcagctccgaattcttgttcttcctga

SEQ ID NO: 42961 - DNA, 448 bp, Glycine max
  Peptide Sequence Number=SeqID_159739
atggctcaaggaattgtccgatcaactcaagaacgtaggcgcaccagtgtcgaacaactgtcttgtcttcaaatggtggtcggcctcaccgaggcttacaatggggttgccacactcatttgccaaagcgatcctcttccaccattctatcaagctcactctatgctcaccttagaagaagttggtctcacgaagaaggttttagctggcgggggtgctgccatgggggttcacgacaatgatgactctcactccctctccaaaaattctcatcaaaattggaatcatggtggtaaaaaggatcaaaatcacaacaacggtggcaaaaacaatggtggcaatcgcggtggctcaagagtagcgatggtggtggtcacaatagtggctgacaacaacaatccagctagcaacaaccggggcaccagcaatggcctaccggataatggca

SEQ ID NO: 42962 - DNA, 414 bp, Glycine max
  Peptide Sequence Number=SeqID_159740
atgtctccttatgagatcacttttgggaagaagccttttactttgccggaatatcttgtcggaatgtctaccgttgccgccattgatgatatgttgtcatacagggaagttgtctttgccgccgttcaaaataagctcttgaaggctcaagcattgcctgagggtgcccgcattcaccctgtttttcattgctcgctactcaaaccatttcatgcttccaatgacaccactgactctccattgcaactccctaagaacttcattgataatcatcccttagttacaccattgttcattttagggacccgccaagacccctcttgtgcaaactcgaaagtccaagtcttggttcagtggaagggcttacctctagatgacacaacctgggaagactgggaacacttacaaccttga

SEQ ID NO: 42963 - DNA, 255 bp, Glycine max
  Peptide Sequence Number=SeqID_159741
atggagcatggttgggttggaatcgggtcagggaaacccagcccaacctgtgattatgcaacagggttggaaaaccctagttgcctcacgcagaaaacgacacaaccaaaagggaaccaccacggagggtggcacgcagcccccgataccgctagtgttgggccggacaataagagatcaccacaagggaggcgacaacacgatgacaacaaaggtttcgcggtagtgcaaacaaaaaagagagaaaaaaaatga

SEQ ID NO: 42964 - DNA, 249 bp, Glycine max
  Peptide Sequence Number=SeqID_159742
atgaaatatgagcggagaattgaacatggcttggtgtactttgaaggcaaaacaaaagtttccctagattgggcaaggaggttcctaggtggaccagggtcatccccaccacaatgcacctctaagtgtggcaaatgtacaccgtgcaggccggtccatgtgacggtgccgccgggtactccggtgaccgcagagtactaccctgaagcgtggaggtgtaagtgtggcaacaagctgagcatgccttga

SEQ ID NO: 42965 - DNA, 207 bp, Glycine max
  Peptide Sequence Number=SeqID_159743
atggaagtagaacatatgcagttggcatgccaaataaaggcgtatgataatgtagtgatttatgtgaatgcaatgcatgaatatgatgcaggaacgatatgcccattacgatgccatgaagagatgcatgatgcaataaaggaatatgccaaaatgaggcttcactgtgatcaagcgagtcagagacccagcatgaccatagattga

SEQ ID NO: 42966 - DNA, 302 bp, Glycine max
  Peptide Sequence Number=SeqID_159744
agggtgtcacagatgccattggaacggcggcgcatgcttggctgaaggagagaggaccatgccagggttggactggatgggcttgcatcagagatgtagagaggcgaggttggggtgggccaagagtagtgaggaatggggaaagtgtttactcaaaaaatttgacctctatctctgctcacaaaacgccaacgtgcattacacagaagcataattttaaaagcagggccctggtgactcatccggtggtgacacttatcactagatcaactatatcagtggtcaaatcattgagtcactag

SEQ ID NO: 42967 - DNA, 516 bp, Glycine max
  Peptide Sequence Number=SeqID_159745
atgggtgaaataaaggaggtacaagagcggatgaaggccgacatggaggccatgaaagagcaaatggccacaattatggaggcgatgatgagcatgaaaaagatattggaggtcaatgcggctgcagttgctactaccattgttgttgatgaggcggcccccattttgtgcaaagaattggggaagtacgccactgaggggcaagcagttggtgtccttgctgctatggtagaaagggggagatttgatcatatagaagagaggctaagggccattgaaggaggtggagattatgcctttgctgacatggaagatttgtgcctagtacccaacgtggtcattcctccgaagttcaaggtgtcagacttcaataagtacaaggggaaaacttgccccaagaatcacctgaagatacgcccaaagatggagggatatgacaactcaagtagcgccgccaatgatggagagggagatgataacaatgatagtaggcacattaccagtgttctactatga

SEQ ID NO: 42968 - DNA, 916 bp, Glycine max
  Peptide Sequence Number=SeqID_159746
atgggaaataacaggtttagactgtcagatatgatgccaaatgcatggttttataagctcaaagatatgagcaaatcaaggaagagaaatgttcctcatgttatgaagaacaaagtagcctcaccaacaacatcacaaaggtcacagccaagatactctcattatttctccattgaaccaaacatagctggtaagttatacaagtctcctattttttacaccaaacactcagataacactttcactgattcaccaaggtcatccaagagaaaggctaagagaaaaaccatttataagccttctccaacagttgtgtcttcaccagtcatggaaagttttagttgtcattccacaaacaattggattaagccaaatgaaccgcagtctccagactattatctctcctccttggagagttctttttcttctgaatcaaaccttaatgatgaatatgtttcatctgagtctgagtgtgataagttcactattcctgacctgcttaatggggtagcctctgaatgcagctgtagagttagctcttccaccaatgacatcatcattgacatgaaaaatgaacccttcactggaaattctgatagccttgatggcttcgacacaatttcacaattaggccttgctccaattttgacaaagccagtgaagtttgatgataaggtcattgaagccactgagttgagaagatcaactaaatttgatgagttaaagtctcatcagtctctatctgtcaaaattagcaaagaggaaagtagaagaagtaagagagagagaaaaacaagtccagtagctagaatttcctctgccaattctacaggtataaaacttagagtcaattctccaaaacttgcaagcaagaaggttcaagcctatgcaaggaggagtgtgtcatccaatgcat

SEQ ID NO: 42969 - DNA, 471 bp, Glycine max
  Peptide Sequence Number=SeqID_159747
atgtcagtgaattgggggatccattgcaagtgcaagaggtgtaggttcgagggggaagtgttctcaaaacaagaaataagagagattgagattggccttgagagagggatggatgtggggggggtggtgttcaagttggaggagcaaatgaagagaatgaaggttaggggaaaggaaaaagggtatttgagggcttcattttgggaagcatattctgaggcttataggtctgagagagcaatgaagaggtgggggaggaggattcctacaatggaggcggtggttgatagcatcagtgatgtggtgggaggggatcacaggttgcttaagatgatggtggaggagttgaagaaaaatggtggtggagttgttgagagggagaaggttttcaagatggctagagatgtgtttgggaaggtggtgaaaaagcaagcaatgaagacacttcttgaactttgcattggtgattga

SEQ ID NO: 42970 - DNA, 255 bp, Glycine max
  Peptide Sequence Number=SeqID_159748
atggaaaagcttcaattgaatgatgattcacctaggactgaaatgtcaataactgggaagctaaatccagaacatcacagtttctttctaaaagtgcaaatttccgacaaggatggttcttgtaggaatgtatatttgccctttggcatatacaatgacactctaattgatgatgcaatggagatggtgaaggaattggagatcacagatttgaagtcttctgatattgcaaatatgattgaaggagagatgtaa

SEQ ID NO: 42971 - DNA, 447 bp, Glycine max
  Peptide Sequence Number=SeqID_159749
atgggattagttgtccttaccgaaagcagtgacaaattttcattggggaccttgagcgcatatgaggacctcaaatgtggtaacatttttgttaatggccatcttggacaagtgaaaattggtgacctgggtctagcagcaattctccatggttctgaacctgctcacagtgttataggcacccaagagttcatggcaccagaattctataaagaagaatacaatcaacttgttgatgtgtactcatttggcatgtgtgttctggaaatgcttacatctggttatccatatagtgaatgtgctaaccctgcacagatatacaagaaagtgacatcggggaagctaccagcatcatttttcaggattgaagacatagaagcacaaatgtttattggcaaaatgtctaatgactgcagcaaagagaccatcagcaaaagaattgtttag

SEQ ID NO: 42972 - DNA, 246 bp, Glycine max
  Peptide Sequence Number=SeqID_159750
atggaagcattatatcctttgaccatggtggtgaagattggtataggcaatatggatggtcttgatttcaacatagggtgctcgaaggatttgaacacggattatccaccagagatgaatgtgctagaaaaatgggcaggggtagcctgcatgaatccttgtgacaagcagaatttgtataacagattttttttttgttgcttcataggggacctgactccaaagacgtgcatccaaatgccttga

SEQ ID NO: 42973 - DNA, 639 bp, Glycine max
  Peptide Sequence Number=SeqID_159751
ggctacacgtcctcaccttgggtactagttaccctcaccgtcagagggctacacgccctcaccttgagaggactacacgtcctcaccatcagagggctgcacgccctcacctctagaggactacatgtcctcgccttgagagggctacacgccctcacctccagaggactacacgtcctcgccttgagaggactacatgtcctcaccatcagagggatgcacgccctcacctccagaggactacacgtcctcgccttgagagggctactcgccctcgccttggggactagttaccctcacctccagaggactacacgtcctcaccttgagaggactacatgtcctcaccatcagagggctgcacgccctcacctccagaggactacacgtcctcgccatgagagggctactcgccctcaccttgagtactacttaccctcacctttagaggactacactagtttccttttaacggttcctgggccaccccctgatattggaggagggtcaactgtgcgagcacaactagagagggaggctatcacactgctactatgcatactggggcaagatttcacccgtgccgctgcaaagagacgagtgcggatcatgcgcaccaacatgaccactcttacatag

SEQ ID NO: 42974 - DNA, 261 bp, Glycine max
  Peptide Sequence Number=SeqID_159752
cacattgtttcacagcttagtgagatgctggatgaatacaacgtgcatgcaaaaactttcaggatggcgagagatagactgcaagatgctcaagtggataatatcaagttgaaattgattgttaatcgtgaaaaagatggttgtacatataatgtacctactgttcctgaagttgcagcactaataataggcgattttgatgcaaattcaaaaagagatatggatatagacctgatatcctacatagcagttgatcagatg

SEQ ID NO: 42975 - DNA, 468 bp, Glycine max
  Peptide Sequence Number=SeqID_159753
atggatgctctgaatttgactttaatcctcacattttgcatcattgctgccctctcacaagcaacgcatcatctagccatcaaatcttcgaagcttaaccaaacccagcagcagctcgacgagggttgtagttacgttgccaccataaagacaagttgcagttctactttctacgcgagaggtgaaatcgatcttatatttggtgacgcttatggcaatcaggtttatgttccagaactgcctggtcattttgatgattgttctacgaattcatatgatgtgatacagcacggtgcatgtacacaccaaatctgccatctacagctatactggactggagattctgatttgatactggagacagtgagcatatataaccacctcgacgaccctgttacattttactaccacactgttattcctccggcgggtggtccctatggctttgatgattgtcatgattattag

SEQ ID NO: 42976 - DNA, 408 bp, Glycine max
  Peptide Sequence Number=SeqID_159754
atggaggcacaaagtcatggtttcaacgcagaatcatcagatagtaacaagctgatggtgaagacagagatgtgcaggagattcagaaggggcgtagtggtcattagtcaaccatcccatacagtagcgctgaaagaagtcaagcaagcttggccacaagtagggaaacttgatccctactcttctccagaatccaagagaatgcgaacttgtgcagctgctccaagtgatgatggctgctcttctgcagaacaaaggataatgcaaacttctgctgctgctgatgctgctacaaatgcttcaactagcactgtggcaactaagaatgaaccatcatatcctgttaagttcattttcaaaaacaatgatctacaaaggatcagtcgcatctatgctgattggatttga

SEQ ID NO: 42977 - DNA, 231 bp, Glycine max
  Peptide Sequence Number=SeqID_159755
atgaagagaaaaagagagaatagagggaaggaagactcacatgaagccattgaaaacgtgaagcagaaagagtgtgtgtcacagagaagggtaaagggtagtgaagtgaagaaggtgaaaagcataagagtaagaagtgaggggaagaagacgacagaagaagagaggcaacaacatagaatgaatgaattgaggttggacggttacagctgggcagggctaccctcctaa

SEQ ID NO: 42978 - DNA, 264 bp, Glycine max
  Peptide Sequence Number=SeqID_159756
atggattggattcagcattcgaaaaacgggagcgtgactgcattgatatggggggcgtctcctcagactcggtctgatcggcgaaaggatcgagtggaaaccaaccctgaacagttggctgctgcttctgccttggctgatagaatgaccacatccactggaagaacaaccagagtcattggttggtaccattcacaccctcacattacagttctcccttcccatgttgcacatcgaaaatttctgacactaggcatgctatag

SEQ ID NO: 42979 - DNA, 828 bp, Glycine max
  Peptide Sequence Number=SeqID_159757
atggaaaccaaaatagccaagacaagacaagcaatttctgatcctcatctcccaatcacaacaaacacgctcgactttgacgaattgagtcctatcattattctgagaagtattttttttatatttcttcttatactggaatctgatgtggatcaaggcgaggttgcagttggaatccttcatgatgttgattcaagtgagccaactatgggagagaaacttgctgctctcagttttccagatgagaacaaattcaggagtgataaagagcaagattcttctgccccaactaagcctccaagtgcggactctgtacatgttttgcttaggcaagcattaaatgctgatgatcgcacccttctgctagattgcttgtatacgcaggatgagaaggttattacaaagtcaattgcacagttgaactcaccaaatgtcctcaaattcctacactctctcatatccattaccgagtctaggggtgcaattttggcatgtgctcttccatggcttaagtgtcttgttctacatcatgcaagtgtgataatgtcccaggaatcttcattacatgttttaaactcattgtatcagctgattgaatcaagagtttcgagttttgaatctgcggttcatttgtcaagttgcttagacattcattacacaagggttgttgatgaagtagtagatgatgatgttctaacagtgccagttatctatgaggatgatagttcagaagaatctgaggaattggaaactgatgaagatgacaatgatgaagcatttgaaggattcagtgatatcgaagatattaacgatatgatgagtgagtga

SEQ ID NO: 42980 - DNA, 1155 bp, Glycine max
  Peptide Sequence Number=SeqID_159758
ggagaaacatcttgcctgagaggaagtgtggagctctaccacaccgagttggatgattttaagactgagttggagaggcgtaatttccataaacgcctcaccaatttggtcgatgggagcatagatttagctttggtcaaagagttctatgcaaatttatacagctttgagggcccttcaccaaagcaagccagagtcagaggccatctagtgaagatcgacgctgacaacctcaacacattcctggcgacacctatggtgttgacagagggtgagtctttgcccacatactctagatactgtaggctgcccaaagattatagagagattgaggctgccttatgcataacaggccgaggtgttctctcatactccaacctggctcctacctcctgtacctctgatttgatagtggacagagctaggcagatctttggcttagtctcttgcatggacatgaacgtaggagctcttatttctggccaaataacttctatagcccaatctaactcttgcagacttgggtttcctgctctgatcaccgccctatgtagagccagaggggttgtctctaacagcctaacttttgtgcgcctgagctcggtcattaacttggtctacatcaggaagaactattggaatcctgatgatctgacagtttctatccgaggggctaggagggtgagggcgatgccagctgagctcccttccacatctgcagctcctactccagcatccacttcagcagctccttcagtcccagctcagagatccattcctactattgagcagtttctggcgagtgtagcctggcctgaggcccaaccttctcttcacagggaagatgaaggtcccatagcccaggtagcacaacatatggaggatgagtcatccgaggccaccattccagagccattcattgcaaaggaggaggcaggtcacttcagagcctcctgcaccagtggtggacctatcctcgcctcagtagaggagcatgcagtagacccctccgctcctatactagagatactagaggactcgaccacactagtccagactttgaacacctctcctctagctactccagtacttcatctaacagatgatgaggatgttcagacacaggacactcaggaccagtcccaggaattctaa

SEQ ID NO: 42981 - DNA, 207 bp, Glycine max
  Peptide Sequence Number=SeqID_159759
atgaagaaaatgcaggatagtgatgcccctttatacccagaagaagaagggtatggtggacttggaataaaacttagtgactatagagtgcagctgcaaccgcttagaagggtatccatgaaaaggagagaggtaaagacaaagacaaaagcaggaaacctttatgagcagagagaatcaaagcaaagcagagcagagcacaattaa

SEQ ID NO: 42982 - DNA, 378 bp, Glycine max
  Peptide Sequence Number=SeqID_159760
atgcagccattagaagagaatgaacatgcgataggaagtatgactgaaaatgttagtcagtttgtcagattgattgtgaaggaatgcattgaccgtatcccgatgagagttgtaggagagcatcatccacaggaagcgtggttcaaagcaaacttgtctcaaatttgggagagtaattatcaaggcaagtatggggtaggaatgaatgaaaaagtgaaggtttatctgtggatgaatgctctcctagaacctaagctttgtagaaacaaagcttcaagaattattttgatgatgccaaggaatttcaaagatcattcaagatggatttcaaggatgaagaaagcaagatgtcaagcaaaagcaaagatctcaagataa

SEQ ID NO: 42983 - DNA, 264 bp, Glycine max
  Peptide Sequence Number=SeqID_159761
atgaaaaatttgtctcttccggacattcttacagccaatttccggaagaacgtcctccggaatgtttccggaataagcttcttccggaagaattccagtgtcttccggaagaagcttcttccggaagtcttccggaagaagcttcttccggaagctgtgttctactgcgctatctttctttcttcttccgtctgctttgtttcttcttccgtttgttgtggtttcggtggtggtcccttcagcagtctgttggtggtcccctga

SEQ ID NO: 42984 - DNA, 600 bp, Glycine max
  Peptide Sequence Number=SeqID_159762
cgcgcggcgctggatgtgcagacggtaatcgcgcgctttggcctgccgctgtttatcaagccagccaatcagggttcatccgttggggtgagcaaagtgacgcagccggacgaattcgacgcggcgctggatctggcgttccgctttgaccgcaaggtcctgattgaacagggcatcagcggacgtgagattgagtgcgcggtgctgggtaacgaggcgccagaagccagcccgtgcggtgaaattgtggtgcacgacgccttctactcgtatgacaccaaatatatcagcgagagcggcgcgcaggtggtggtaccggctgacatcagtgcggaagccagcgaggccattcgggctgtagcgattaccgcgttccaggcgctggagtgctttggcatggcgcgcgtcgatgtgttcctcaccgaaaccggcgacattattgtcaacgaagtgaatactttacccggcttcaccaacatcagcatgtatcccaaactgtggcaggcggccggcctgagctacagcgatctgattacccgcctgattgagctggcgcagcagcgtcatcagcaatccagccagctgaaaagcagcgtgtaa

SEQ ID NO: 42985 - DNA, 2244 bp, Glycine max
  Peptide Sequence Number=SeqID_159763
atgtcggcgctggtagcggagctggaaacacctgactggctggcgtggcagaatccgtcggtgtgggtggtagcgattacgctggcgctggtggccagccttgaaacgctgctcagccaggaggcgctgaaaaaactgcgtccgcagcacccggcgccgtcaccgaataaagagatgttcgcgcagggcatcggtaacctgaccgccggcttgctcggcgcgatgcccattaccgcggtgattgtgcgcagttcggttaacgtcagcgttggtgcccaaaccaaactgtcgattctgctgcatggcgtgctgctgctgatttgtggcttgtggttcagcgctctgcttaacgcgattccgctcgccagcctggcggcggtgctgctgtataccggctacaagctggcaacgccgcgcctgttcgtcgaacagattcgcatgggcgcgcagcagtacgtgccgtttctcgccaccatcggcggcatcattgtgtttggcatgctggccgggattggcatcggtatcgcgacgcagattctgtgcagcatctaccaaagccaccgcaacgcgctgcagcttacccgctatgacgaccattacgtgctgcgctttcagcaaaacctgacctttatgcacaacccgaagttgcaggggctgctggcggagatcccggaaaatagcgtggtgattgtcgatcacgataacgccgagtatatggatccggacgtgaaagcggtgctgcaggatttcggggatagcgccgaatcggatatcccggatatccgatttttttatttatacggcataattgccgctcactgcgcctgcctgtttcacatgctgccggcggggctggtagctcatctctggctttcatggcagagtgagcgccgctcagtcgcagagcagggcgacgaataccgggttacagggttcagacgtatgcgcgttaagctgtttgaagagaataatgttaaaaagaatgctctttcgctgtgtcttattacgctgttcttctgctttgttggcagccacctgcgtattcccgaagagttttccctgttctggccggtgaatgctctcatcgccgggttgatggtgcgcaacccgtttttacacaccacctccagttatctggtgtgttttgccgccatgattttcaacgatacggttttttccggctgggcactgccagcggtgacgattaattttgccaatatcctgtttattctggtgtcggtcagcatgctgattaagcatctgcaatcgccgaccgcaaacagccaggtgttcaatgccatgcgcatctttccggcgtgcctgctcggcgcggcagcctgcgccacctggggcgcatgggcgcaggatatcgatttcaacgcgcgctttgtgcgagcagttctctacctcgctgatgctgctcccggtgatgctgacgcgtccgctgcgcagcgtgccgctgcggacgctggtacacccggccaggctgctgccgctgctcgccgtggcgctgtcgctgacggtgggggcgctgattggtggcgcgggcagtctgaccttcccggtaccggcgctgatctgggcgatgattcgctgctgcccatcagccatctcacttccgcacggctcggcgtggccaccgtggcgctcagcccgctgctggtggcggtgagcatggacgccattcgccagcttaaccatcgcctggcattgcgcgccaattacgatttcctcacccagctactgtcgcgctccggcctgtatgaaaacctgcgccagcagccgttttccctgcagcgtgaagccggcgtgattatgctggatgtcgactacttcaaagccattaatgataatttcggccatgatgccggcgatggcgtgctggaagaaattgcgcgccgtattcagcacgtggttggcagtcgcggtctggtgtgccgctttggcggcgaagagttcgtggtggtggtgtttgattacacccacagccagctgtttcagctggccgaagtgattcgtcaggcaatggtgaaagagaagttctggattcagggcaacaccgtgaccgtgacggttagcctcggcctggcgcgcggcggtgcggttaacgaacgtgaatggccgggggtaatcaaccggctggtgtcggcggctgataaacacctttacgttgccaagcgcaacggccgcaatcagacctcaccggcaatcgcgccgcgcagcatggcgcatgacgtggcctga

SEQ ID NO: 42986 - DNA, 552 bp, Glycine max
  Peptide Sequence Number=SeqID_159764
atggaggccatgaaagagcaaatgaccacaatgatagaggccatgatgagcatgaagaagataatggaagccaatgtggttgcaattgccgctaccagcgttgtttctaaggtgaacccgactccctcacctggcttcaaccaaatgaatcatccaatctcatatatggtagccaaagatttgggaagtacgggcgacccccatgatgtgcaaattcaaaacgagcacgctttcccgccatatggcttgccttccaactatacaccacccaatgtggcttacactcccgatgaagatgtcaataactccgctcgcatactcattgagagtcgacaacctcatcatgcacatgtctctcaacctatggggcagacatatgaaataccccaccacaatctagccaacttcgaggcttgcctcggatatgccactgaagggcaagcagttggtggtatacccctacaaaacactttggagggccctcaattttgcccccaaccacaaccttgcattctacagcggttaaaatccctcctgttatgggagaaatga

SEQ ID NO: 42987 - DNA, 543 bp, Glycine max
  Peptide Sequence Number=SeqID_159765
atggcactgctagggaagtggaaatggaggatgcttcaggaggattattctctttggaatagaattctggtttctaagtatgggggatggagagcattagatgtggagagggtcaaccggcaagaatcactatggtggagggatttaaagaagtcatgtggcgtctcggcggttggggagtggttcagtaaaggcatgaaactaaaaattggatgtgggagtagggataggtggatgtgggtggccgggagcgaaaatatatacactgttagaggggcttatgcatggttgtatgaggcggctggggttcaggtggtgccaagggaacattttctgcagcattggtactgtgaaagcggcagaattgatgggcagaggcagatggtgttgtgggctgctgtaacatggtgtatttggcgtcataggaacaagtacatttttaacaaccaggaattccgaggggaaacagtattggatgatgcaatgttcttcatctggtcgtggctgaatgcattggaaaagggttttaatgtcccattccaa

SEQ ID NO: 42988 - DNA, 357 bp, Glycine max
  Peptide Sequence Number=SeqID_159766
atggtgtcagtcaactcagctccagctggtggcaccactccgaagaatttcatcagttcagataatatgagatctcccgccatatttatccttgacaatgcttctctgaaaaagggtcttgttaagaaggctctccgttgcattctagatagccctcttaataaagctggcatggtaggggcaatatacgttaaaatggatcaacgaggagtgtttgaagtcaaaccacatgaacctataacacgccatttgcctgtcaactctcacatagtaggtctctcttatacttcagaaaagttggttgacatagaggaatatgtctcagtttggagcaatgatttgagtcctgtttttgtg

SEQ ID NO: 42989 - DNA, 283 bp, Glycine max
  Peptide Sequence Number=SeqID_159767
gcaatggaggtggtggcaacagactggcggcatagttggtagtgacgacaacaatagtggggggtggaatagtgttagccaaggcaatggaggtggtggtggcgataataacattaaaatgatgatggtagtgacaataatgacaatgtggaatagtgatagtgacatcaacgatgatagtgatagtggaatagtgttagcgaaattggtggaggtggtagcgatagttgcattggatggtggttgtggaggtggtagtgtcatggtggcagtggaatggtga

SEQ ID NO: 42990 - DNA, 228 bp, Glycine max
  Peptide Sequence Number=SeqID_159768
atggaaccagcagttttcgacgagttcaatggtgtcgaagatgctattagacgcgtcgtcatgcacaatgaaggcagccggagtttggccacgaaacctagaccattagacaaattagaggaagacgctcccagatctggaattttcgtgggaaaactcgccaaaaataaattttggcgccagttaatgatcattggaggttgccagaagggacagagagcacactga

SEQ ID NO: 42991 - DNA, 348 bp, Glycine max
  Peptide Sequence Number=SeqID_159769
atgggtattttggatgagactggtatgttggattgtaagctagttgacccttctatttacccaaatgttaatcttttactgggagatattggagggtacatctacttgggtttgactgagaacaagagagggtacatctcttgtggatcagttctagtggaggctacatccactaggttcaaagagaacaagggagggtacatcccttgtggatctttgcttgtaaaaggatttttacaagggtgtactggtaaaagctctcattcagctacacctgacccctatgattggtcgcctgctggtcagccacatgctacatataaagttccatcctctgcatgtgagtag

SEQ ID NO: 42992 - DNA, 444 bp, Glycine max
  Peptide Sequence Number=SeqID_159770
atggggtttctagataatcttcaagaatggttcactgcttgtaccaaaccaaaggagaaacttgtgcccaagaagacagttaatgtcagggtgaaaatggattgtgaaggttgtgaaagaaaggttaaaaatgcagtgaaggacttggaaggagtggaatcatatgatgtgaaccgaaagctacagagggtaagtgtgactggttatgtggattcagaggaggttctggaagaagtgaggaacacaggaaagaccgctgacctttggccatttgttccctacgatttggtggcatttccttatgtgaaaggggcatatgacatcaaggcaccttctggtttcgtcagaaatgtcccagatgcaatgggtgaccctaagtctccagagatgaagcttatgagggcctttgatgatgataacccacatgcatgttcaatcatgtaa

SEQ ID NO: 42993 - DNA, 273 bp, Glycine max
  Peptide Sequence Number=SeqID_159771
atggcacctgaccctgtgcttgtctgggatgcagtatttcttgatgaaggccctattaatatgcggccggatgaccttgctgggggcgacgggcactccgtaggactggtagagacccgtgatcagagcgggaaacgtcatccatatatgtgtaagggtggtcatgctggtgcgcatgattcgcacccatctccctgcggcggtccgggcgaagtcttgccccggtgccccaggaactggctgagggcatctgcgtcgaaaggaatccactag

SEQ ID NO: 42994 - DNA, 762 bp, Glycine max
  Peptide Sequence Number=SeqID_159772
atgcagagaccaacatggtcatctgcatcctttgtcgaaggctcaatgtctgtcgacagagactactttagtctccccttcgtcagccagaggcgaacgagcacgttgacatgcagagaccaacatgagacaatcaagtctgatgacacacagaggccaatatggtcatctgctcgttttgtcaaaggcacaatgtttgtcgacagagactactttagtctccctttcgccatccagggacaagcaactccaatggcacgtggggacaaattatggtcacccaccacctttgctatccagagacaatcaagtctgaggacacgcggagaccaacgtggtcatctgctctttccatcaaagactcaatgtctatcgaccgagactactgaagtctccccctttactatccagagacgatcaaatccgatagcatgcagagactataatggtcgttcgctttcattgttccgacactatcaaagtcctctatcatcaagagacaagcaagtccgatggggggtgtccttcagcactgggcccatcaggaagcaacctgctcgcttgggcgagcatgttgcttctggaggaagcctccagctcgcctgggtgagctgggcggcaacctcctctcctattttttctataaatggacgttgggggctgaggggaaggggttcaacaccctgtgtattcagatttcacttaaaattagtgaggagaagaagaaagaaggagaaaatcatggccgaggcgcttccgtaa

SEQ ID NO: 42995 - DNA, 279 bp, Glycine max
  Peptide Sequence Number=SeqID_159773
atgccaccgccggctcaagaggaggtaccgtctctgaggtccatcccagatcgcctgcagaggatagaactccagatgcacagggcagaggcagctgaacaagatgttctatcgttacaacctgcaccagtaaagtcaggaccccagtcctttcccttggcccactctcgagcagttcgaggccacggtggcctggcctggggacgagaccgatctagaggtggagacgaagctcaggataatgaggacatggttgacatgttggacttcctcctgtga

SEQ ID NO: 42996 - DNA, 279 bp, Glycine max
  Peptide Sequence Number=SeqID_159774
atgtcaggacatcgtatccgacatcttggatcctgcagcttcaatgcttcacttgacttttatcttgcattgtacagcaattccagtattctcgagcaggatccaacctttttaaactcagtagtgctaagcactaacactgactttcagggagagataccccacaggcattgggcaccacttgtgacacccatggctaatttcgatccggagatagtcatggagttctacgctaatgcatggcccatcgaggagggggtccatgatatgcgctcctag

SEQ ID NO: 42997 - DNA, 558 bp, Glycine max
  Peptide Sequence Number=SeqID_159775
atggaagatattttgagtagtatgcttagacatcaaaggcttcttagtagccaattaaagaaattgtttgagcatgttgaaatcatgcgattaggggtcagtcatccacaactggtaaattgtgatatttgtgaaggaaagcatttcaatgatagttgtcatctttactccatggaaaattattggtgggagcaagagatacatccttacaatcaatatgatgaagaaagactttcaaatcttgagaatgttttgatgcaattcatagaaacatcccaagatagcttcaaagccaatcaaaacacaattcaaaatccggagagttgggaagaaaacttagtagaggttaaagctcatgaggagagtcttgcagaagagcatgattcaagagaaagagatgaagaaaaaaagaaaaaggagtccagcttccctctgtcggcgggagacacctctagcattggtgatgatgatgctacaaatgttgaagctgatgatgattatgttgtagacatcactgatgctcgaacagcttgggatccacaacccactcaggattga

SEQ ID NO: 42998 - DNA, 624 bp, Glycine max
  Peptide Sequence Number=SeqID_159776
atgacacccacaccccaaccttttgtctatgaggagtgtggggagataggacatgtggttgtaggctgcccatacactcaggcccttgaggaagtgaactatgttggtggaaaaagctttacgattatggatataaacgaagatgaagaaataccaattattttgggacaatccatcctcaacacaggaggaaccttgattgatgtcagggaaaggaaattgacttggaggctaggtgatgaggaggaagtatttaaggtttttggtactgtaaagagctcattctctcccccttcctacaattacaagtcactaacaagatggaagtcactatggctaagcctcacccaagtgtggggaagaaagacccttccaggaacaaagtcattccaaaagaccttggatggagtaagaacaagggagataacatcaccgttcatgctcttggctttggaatgggtgattataccaaaggatcggtgcaaaaaggctcgggatgttaaacaagcgcttcctaggaggcaacttgtgggttctataggtatctcaagacctaaagttgattatgtgtttctacaacttagcaagagccatgctgatccaacacggcctatggtcaattaa

SEQ ID NO: 42999 - DNA, 162 bp, Glycine max
  Peptide Sequence Number=SeqID_159777
atgggtggtggagaaggaggtgttagggtttgggtggcatttggagaggaggagaggatcttgcttagtgagatcatctcgctaagtgggagtccacttttcgtgcttagtgcaactccctctgcactaagtctcgctcaatgcaattccctctcaggttga

SEQ ID NO: 43000 - DNA, 690 bp, Glycine max
  Peptide Sequence Number=SeqID_159778
ggtacatcctttgtggtacaagtagagggtacatctacttgggtttgactaagaacaagagagggtacatctcttgtggatcagttctagtagagggtacatccactaggttcaaagagaacaagggagggtacatcccttgtggatatttgcttgtaaaaggatttttacaagacccgtatgcacatctagccacttatattgagatttgcaacactgtcagactggctggtaatagtcttaagacttgggatgaagtggttgaaaaattcttgaagaaatacttcccagagtccaagactgctgaaggaaaagctgctatctcatcctttcatcaatttgtagacgagtccttgagtgaggctttggaaagatttcatggggggaaaactaaaattaaaaaccctaaagaagccatggaattgattgagaatatggctgctaatgaccatgcaatcttgcgtgatagagcacacatcccaaccaaaagaagcctgttgaagctttcatcacaggacgctttgttggcccaaaacaagttgttgtccaagcaacttgaagctttaactgtaacactaagttgtgttatatatggtggagcacatgattctcgctgctgcattcccatagaagatacaacacatgaagtgaactacatggggaaccaaccaagaccaaactttaatgcta

SEQ ID NO: 43001 - DNA, 306 bp, Glycine max
  Peptide Sequence Number=SeqID_159779
gatctgactgaagcaatgttgttgacagatctagagcaggacacggttgattttgttccgaattttgataattctcaaaaagaaccatcacttctaccagctcgccttccaaccttattgttaaatggttcttctggcattgcggttggtatggcaactaatatccctcctcataatcttggggaagttgttgatgtgctctgtgtgttgatacataatcccgaagctactctgcaagaattgcttgaatacatgcctggaccagattttccaacaggagggctgattatgggaaatcttgggtga

SEQ ID NO: 43002 - DNA, 141 bp, Glycine max
  Peptide Sequence Number=SeqID_159780
atggggctgaaggaattactgcaggcattcttagacttcagatgctctgttgttgagaggcgtgcaaggtttaagttatcacaagcacaagagagaagacatattgttgaggttttgctcaaggacttgtgggctaaatga

SEQ ID NO: 43003 - DNA, 246 bp, Glycine max
  Peptide Sequence Number=SeqID_159781
atggatttcaatattcacttaggatcaaaatttcagcctgaaattcaatcaccaaaactcaaattcacaatagacacaatcataaggaaaccaaaaagttcaagaaaaggttcacaatcaaagactctaagaattttgcatgaacattgtcgcaacctacccttcggcgggagggcgacgcgtgactcgcgggatgcgtgttccacgaaaggaatacgcgcggagttgccaccaacgtttatttga

SEQ ID NO: 43004 - DNA, 756 bp, Glycine max
  Peptide Sequence Number=SeqID_159782
ccgcttgaagagccagcacaagagccattgaatattgtgctggacctgggattgcctgtgcccaaaacgcccaaggtcacaccgccgccaccacaagagatgccagcgccggagcctgttccgcaacctaagccaaaaccaccgccaaaagcggagcccaagctaccgaaaaaaatcattcagtcgcaacggccagatagcccattcaaggtgccagagcctaaaccacaaccaaggcaggaacagtcacagcccacgcctgcgccacccgctgaggatttttcaagctttatcaagcgcaagcagacggaccgcaatgccgatgaaatggcggccaagcagatcaatgatgcggctgcggcagccgaacgtggcccgtcagaagatgagcggcgcatgaaaaacattctgaacaacctcaaggtaggcactaacggcttgttccagatcaggcgcatggatccctacaatgcgacgttcagtttcaaaggctgggtagacgattacacctctgccaatacgcagtatttcgaggtcgaggcccgcagcggtgaagatatccgcctggtgatgatacgccgcatgattgcgatcatccgtgaacattacaatggcgactttgactggatatccaaccgcctggggcgtacggtcacactctctgcgcgcaatggtgataatgctgcgcttgaggacttcctgatgagggagttttttggcaacaattataaaagccaggatatttacgggcgctag

SEQ ID NO: 43005 - DNA, 324 bp, Glycine max
  Peptide Sequence Number=SeqID_159783
atgcacgaacagcgcttgacaatcaattcgtggggctacggactcgatggtggaggatgcatgaacgacaatcaattcatggggctccgaataagatttgatggtggaagttgcatgaaccgcacttggcaatcaattggtggcgctccggactcgatggtgcgcttggcaatcaattcgtggggctccggactcgatggtggaggatgcatgaatggctatcaatttatggggctccgaataagatttgatgatggaggttccacgaacagcgctagggaatcaattcgtggggcttcggacacgatggtggaggatacatga

SEQ ID NO: 43006 - DNA, 390 bp, Glycine max
  Peptide Sequence Number=SeqID_159784
atggatctcattgaaaatatggctgcaattgacattgctattctgagagatagagcccacattcctactaaaaagagcttattggagctaacctcacaagatgcattgttggcacagaacaagttgctatctaagcaacttgaggcattgactgagacactaaattccagcatggacagcaatacaaccaacaatagggacaatggaggaaccatcctacgaatcaattcaataaagaccagagggaaccatccacaaggccacaacaacaaagggcctagtctctacgatcatacaacgaagctggaagacactctagctcaatttatgccggtttcaaagtctaaccagaagagcacagagtctgccataaagaatctggaggtctaa

SEQ ID NO: 43007 - DNA, 294 bp, Glycine max
  Peptide Sequence Number=SeqID_159785
atgagaattttcgaaaccggaaatgtaaggttcattgaaaatggtgaaataagtaagagtacagttccacgagatgtggaaattgaagaagttagggtgcaagtccttttagcttgtgtctctagcagtaaggtgattgatcctttagttgttgttctaaacaacaatgaagaagaacaacaaaataatgagcccatgatacataataaacctattgtggaagaaccacaagaagtatcattaaggaggtctcaaagagaaatgtgccatggagatgttgtggaagataaatga

SEQ ID NO: 43008 - DNA, 150 bp, Glycine max
  Peptide Sequence Number=SeqID_159786
atggtccatgacatctccgtcaaggtgaaactggaagtaacagggacctcgacagccctaaatgtgtttggcagtagacgaaggagcgataaatgggtttatgatcccaacatggttggctcatggggaaaacgcaagggtcatgcatga

SEQ ID NO: 43009 - DNA, 1023 bp, Glycine max
  Peptide Sequence Number=SeqID_159787
gtgccgagccatacggccttcaccaacgcccagctgctggagatcatgatggcgcaggacttccaggatctgaccggtcaggtgatcaagcgcatgatggacgtggtgcaggagatcgaaaagcagctgctgatggtgctgatggaaaacatgccggagcagccggtgaaggaaaaacggccaaacgacagcctgctcaacggcccgcagctcgaccagaacggcgtcggcgtgatcgccaaccaggcgcagatcccgcgttcccgcgaactgacctcggtactgatgctgctctcgggcctggcgatcatcctgatgtccggcagcaacatggcgcaacagctggcggcgatgctcacgcagggcttgaacttcgaccacggcatggcggtgctggcgctgttgccaatcatggcggggctggtgctggtggcgctcgccgcgccgatgctgttggggggcatcctgttcagcggcaagtcgatcaagttcgacttgaaacggctgaacccgttgtccgggttgaagcgcatcttttccagccaggtgctggccgagctgctgaaagggatcctgaaagcgacgctggtcggctgggtgaccggtctttatctgtggcacaactgggcggcgatgctgcatctgatgacccagcagccgctcgacgcgctgggcaatgcgctgcagatgattctgttctgcggttttctggtggtgctgggattgacgccgatggtggcgatattcgcgacgaattcaaggatcaggaaggggatccgcacgtcaaggggcgcattcgtcagcagcagcgggcgatcgcccggcgccgcatgatggccgatgtgcccaaggcggacgtgatcgtcaccaacccgacgcactacgccgtcgcgttgcagtacaacgataaaaaaatgagtgcgccgaaagtgctggccaagggcgccggtgaaatcgccttgcgcatccgcgagctcggcgcggaacaccgcatcccgatgctggaagcgccgccgctggcgc

SEQ ID NO: 43010 - DNA, 774 bp, Glycine max
  Peptide Sequence Number=SeqID_159788
atggggttatacgtgcaacgacaaaatactacagtgttggtggccttggggaaaatatgtgagggtggatcagccattcacaatgtcacttatgctgatgatgttgtgagggtgagtgttgacaaagttatagaaggtgacgccgaagtgcccttcccgacatcagagattcaatatgtcaagcaggctcttcaaacattcattgcatggccaacaaatcttgtgaaaaaagtgtcacatgaggagtccgatactagtccaaagaaacttcctgaaacagatgaaagagggacgaatgattttgaccatgatccgttgcgtcaactgattaagagcctatatttcatgtacgacacacctgttgagttgaagtgggatggcagcaaatttgggctttcaaatgttgatgcttcattcttcttgacattctctgatgtaaatgaaatagtagctggatacaaatgtttgaacatatctatactacagttatggatgttgtttttggatgagtggagctctactttgggtcatgcttccgtgtatggattccttgagccacaatcgatacacaatgcaaaggatcgacgtgctgaatgtgagcattacttacaagcatggctcaaggaatcgcaacgagaggtgtacctaggagcttacttaaatcagggccattggcaactggtagtactgtgtcctgcgaccaatgttgttgcatggttttgttcgttacgtaagaagcctgatactcatatcaaaactgcaattaacaagtaa

SEQ ID NO: 43011 - DNA, 237 bp, Glycine max
  Peptide Sequence Number=SeqID_159789
atgttgaatagccgtcagagcttgaagagtgaaatacacagaggcaaagaacatagcaaagaagccaagtttttatcttttaggaagatttgtgagtttttgagtgattgtgaggttcctagaggtggaggagacatccccactcctttgggctttagcattgaaagatgtattgtctccttagaacttgatagagcaggattaggttaccgtatgtctggacatggagtgcgatga

SEQ ID NO: 43012 - DNA, 460 bp, Glycine max
  misc_feature (329)..(329): n is a, c, g, or t
  Peptide Sequence Number=SeqID_159790
atggagcaagccaccatctttcttacgagttcaggatttctcaaaaacctgcttgatggggtagttcgtcttgactaccacttgatgactcgggaagtaaggcttgagtcgttgggccaagggaatgagtgggctgagctgataacttcgtcaatttctgagagatacaagagcaagggtgctcttggccttgatcgactcaaagatggtagtgtggttatggtcttcttgaaagctagaaaggcttggatgctagcctacgttgagcttctgaacttcttgtatgttggttgggctatgcatcacccgtatgacagtgcatttgtcgnggacttcttccttgtccgccacatgttgggggtatgcatctttggggcatgccctgttcagttcaatgtagtcgatgcacatgcgccatttgccgttggcctttttgatcatgacgacattggcgagctag

SEQ ID NO: 43013 - DNA, 364 bp, Glycine max
  Peptide Sequence Number=SeqID_159791
atgggtaatcagtgtactgatgaccttggaaaataccttagggtacctatttttcataaaaaggtatcacgaggaacattccaacttatcatggacgaagtccatcaacgggtgacccttgcgaaatctgttttgcaagctttaccttttcatatgatgcaaataactttgcttccgaaagcggtgtgtgatgatattgacaaggcttgtcacagatttattttgggagatatagataatggcaagaagattcacctagttacatgggatactgttttctcccctaaggataaaggcagtttatgtctgaggaaggcacgagatgtcaatatggcttttatgtttcgtgctaattggagattct

SEQ ID NO: 43014 - DNA, 405 bp, Glycine max
  Peptide Sequence Number=SeqID_159792
atggttcaactgatttctgataccatctattgtttgcaggaatcgcacccacaaagacacccagtggacccggagaagtccaacagggccctgaggtttccagctctggttacgggcctctgtagtcctacagggtgcccgttccccccggcaaggtcacgtcatcatagggatcgtgcctgcaaaacacccagtgaacctgaagaattctacggagtgcttgtcacctccggcaagggcatcaggccccctactaatcgagctttcgtcaagaagtactgcgtccccaggcaggcgcagggcgaaacaccacagcagcccttgtggatctttgcttgtaaaaggatttttacaaggttgaaaagaaatctcaaggaccgcaggtcgcttggggactggatgtag

SEQ ID NO: 43015 - DNA, 168 bp, Glycine max
  Peptide Sequence Number=SeqID_159793
gaatgtcttgagctgaagttatcctcccatggaaggaaggttgagaaatttgacaggcctgctctagagattggaggcttagtggctgccacaggattaagtcatctgatcgcatgttccttggacactggtgatcagggacttatatcggcttttgcggagaggtga

SEQ ID NO: 43016 - DNA, 339 bp, Glycine max
  Peptide Sequence Number=SeqID_159794
atggtgaagttaatgtgtgggagtcacaatcatgaattggccaagtcgttagttgggcatccatatgttggtcgattgactaaggatcagaagattattattgctgatatgacaaagtcaatggtgaaactaagaaatattcttctcacgttgaaggagtacaatgtcaatagttatacaacaatcaagcaagtatacaatgcaagaaattcataccatttttccattagaggtgatgacgacaaaggtgatgacaaaaagctcaaagatcaatcaagaacaattcaagagttcaagataagaatcaagaagaattcaagactcaagaagaaagtctag

SEQ ID NO: 43017 - DNA, 320 bp, Glycine max
  Peptide Sequence Number=SeqID_159795
gtcccaagagaagcttgtctcagcgtttatgcgagaccgagagcaacatgttagccatcgttcaacaagtaccaaggaaggaattaaatctaaccacagcccacgagcacaaagtggcaaacgagtatgcccgagtgtacgcgaaaaaggatgctagaggaagggtgatcgactcattacatcaagaggcaacaatgtggatggaccgatttgctcttaccatgaacgggagtcaagaacttccccaattgctagccaaggccaaagcaatggcggacacctactccgcccccgtggagatccacgacttctcagctatt

SEQ ID NO: 43018 - DNA, 775 bp, Glycine max
  Peptide Sequence Number=SeqID_159796
agggctgcacgccctcacctccagaggattacacatcctcgccttgagagggctgcacgccctcacctttagagggctacacgtcgtcgccaacagagggctgcacgcgctcaccttgagaggactacacgtcctcgccaacagaggactgcatgtcctcaccttgagaggactacacgttctcgccaacagagggctgcacgccctcacctttagaggactacacgtcgtcgccaacagaggtctgcacgcgctcaccttggagagggctacacgtcctcgccaacagaggaccgcatgtcctcaccttgagaggattacacgtcgtcgccttgataggactacacgtcctcaccatcagagggctgcactccctcacctcatcttcagaggactacatgtcctcaccttaagagggctacgcgccctctccttcgtagggctacacgccctcaccttccgaggactacatgtcctcaccttcagagggctacgcgccctcaccttcgtagggctacacgccctcaccatcagagggctgcatgtcctcaccttaagagggctacaccccctcgccatcagaggaccacacgtcctcaccttcgtagggctacacgccctcacctttagaggaccacacgtcctcaccttcagagggctacacgcgctcgccatcagaggactgcatgtcctcacctccgtagggctgcacgccctcacctttagaggactaaacgtcctcaccaacagagggctgcacgccctcaccttatag

SEQ ID NO: 43019 - DNA, 189 bp, Glycine max
  Peptide Sequence Number=SeqID_159797
atggagtgcctagagggagcttgggagaccctcgaaggcaatgcgaggtgccgattccgtggcacgatccgactcacggctacttcgttggtacatccagaggaaccagcacgcacgcttcagcgcactgtgacgtcatttgaggaagaccccgaggaggacccagaggagctacctcttcagcctgct

SEQ ID NO: 43020 - DNA, 165 bp, Glycine max
  Peptide Sequence Number=SeqID_159798
atgcctgatgggagattgatcgaaaaaaatgctgcagagaaagatgaccggaaaacaaccataggcgacatcggtcgtcaaatacagccgactgatattcgtcgagaaacatcatcgaaaatcatttaccaagaacggttgtttttcggccgacattgtgcaaag

SEQ ID NO: 43021 - DNA, 237 bp, Glycine max
  Peptide Sequence Number=SeqID_159799
gaagatgcacccgcgagtctcatgccgccctcccaccgaagggtaggttgcgacaataggtttcctctaaatcctggctgctccccggtgaaacaaaaactaagaagaatgaagcctgagatgtctttaaagataaaggaagaggtcagaaagcaatttgacgctggcttcttggcagtcgcccgatatccagaatgggtcgctaacattgtgccaatccctaagaaagatgggaag

SEQ ID NO: 43022 - DNA, 530 bp, Glycine max
  Peptide Sequence Number=SeqID_159800
atggtcaaaagaaaagtgattcacacaaggagacctaatcaattagcattgttatgcttacttggcagtttctattgcctaaccaatacagaacatgcctacactaatccgttaaagaatttgagaatagctagacatgggaaatttggagaaaattctgctaggtcatcagtacttgcatgggtatacagaccaactaaaccaaggccaaatgattttggtaggaaacccatagaattggtacaacctagccggccaaattcaattcaggcaagattgattccactagtgcagccgaattcagctgaaggcagttcagctaatacagccgaattcggtgcaagcaggaccttcttggatggttcagccaatatgattcaagcaagccaggctttgcaagtccaaccaaatttcactcaacatgtaccgtatagccattcttggcccaatcaggttcatccgccactaccaatcaattgcttgcttgaatcgctgtttggaggtttggagagcaagaacacctgttcacg

SEQ ID NO: 43023 - DNA, 654 bp, Glycine max
  Peptide Sequence Number=SeqID_159801
atgccaatttcccctacggaagtatcagttggtctgtgttgtcgtgacataggtaaggatcgcgcccacaagacacccaatggacccggagaagtccaacagggccctggggtttccagctctggttacgggcctctgtcagtcctacagggtgctcgtcctccccagcaagggatcacgcccacaagacactcagtgggcccggagaagttcaacagggtcctggggtttccagctttgattacgagcctctgtcagttctatagagtgcccgttgcccccagcagggtcatcaggcccttattaacagggctttcatcgagaagtactgcacccccaagcaggcgcagggcgaggcatcacagtagcgggcaacagacgcaccgccaccaccttcagagttcacctcagctcatccacaaaaaggctggagcgttgcctacgacacatggccgactagcatgcgaccaagtccaaagccaaagaagctccccgcgaagcggtccaggaagggcaccattgaagaggattccagtgtggccccacaagccgacgcaggctttgacaaacaccgattccaaagcgtggaacatcagtagcatttcgaggccactgagggatggtcattcctcatacagagatagaggcagctaa

SEQ ID NO: 43024 - DNA, 324 bp, Glycine max
  Peptide Sequence Number=SeqID_159802
atggggagagtccctcctgctacggtggaaagggagaaattcgatcatatagaggagaggctaagggccattgaaggaggcggagattatacttttgctgacatgattgagttgtgcctagtgcctcatgtcatcatccctccaaaattcaaggtgcctgatttcgacaagtacaaggggactgcttgccccaagaatcatttgaaaatgtattatcggaagatgggggcgtatgagaaagatgaaaaactgttgatgcatttcttccaagaaagccttactggggcagccatcacctggtatactaacttggagctttcctga

SEQ ID NO: 43025 - DNA, 601 bp, Glycine max
  Peptide Sequence Number=SeqID_159803
gacgccaggtatctcaaagcggctaaccaaaggttgcatgtcaacaagtaataatccccggacgaaattagggtatgacatgattgatgggagattctctacaaagtctgcttacgatcttttagcttgccctgatgtccagagtgacccctctttgaggaattgtctgtggaaaatccctggtagacctacaactagggattttcctgagaataagtatcgccatattcggggaatggctgagcataatgattggcccttgtgtgaccttgaacctgagtctgagttacatctcaggcccaatgtttttaatatggatctggctacatgggtggagctgaatataactttaaagggtgttatgggggtccaggacaatgtgtcgcaacgtgcccttcgcgggcgagcgagggcgaggctcacgggtgcgctttccaaagaaggaaagatgcgcggagtcgccaccaacgaaggtattagcacctcttacgtcgacaaaagtggggcttttgctcctacgtaccctcctttggagaggaaatcagacctacgtagttctttcttaagcgtgaatcaagcgattcttttacttgaagagtga

SEQ ID NO: 43026 - DNA, 186 bp, Glycine max
  Peptide Sequence Number=SeqID_159804
atgccatggagattattgatcgtgctggaatgtcttctttgcaataggtgtgcttattcatgcatgacccaaaggatgagcacatgcacgctctcaagcgcatattgtgctacattcaggctaaacgatagactactttgtccaggtctagtgcagaggctgaataccgagtggttgccaatgtag

SEQ ID NO: 43027 - DNA, 522 bp, Glycine max
  Peptide Sequence Number=SeqID_159805
atgtcacccccgcacgtctgttcctttcccccacgttccactccatggagaaaaagtgatgttggatcacgagctacgcgtttggatggaagtggtggtggaggggctatggggactcgcagagtaccaccagaagagaggggaaatagggaaagcagtgaagtgcctcaaagccatatgctaaagcgatgcgtcgttttccctatcatcgagcaattgcttctgaagtctattccgttttgcttcgaattgaagtgcagagcgtacagcttgctcaaccagtgttaccatctcgtcggagctattccgttgcaaaaacaggtcttgcacaagggactcgagctcattgcgtccattggatacgaaacacggcggaaggtggctttgaggaatataaggagagatgcattaaaagcttatgataaacttgagaaggtcgacaaaagcggggcttttgctcctacgtaccctccatcgaagaggaaatcagacctacgtagttctttcttaagagtgaattaa

SEQ ID NO: 43028 - DNA, 297 bp, Glycine max
  Peptide Sequence Number=SeqID_159806
atggcgttgccaattgctgtgatgcatgaagaagcttgtgctgacttgcagcagtctgctggcgaaaaaccaaacccgtttgcggtgttgaagcaacttaagcttgataacaataacatggcagttcagcaaaacaaaaagacaccgtccaagcgtggtatgcaccgttcccacgactttttgacaaacccaccattggctattgagccaaccacgggtgaagtacacttgcgtcatcacgtgagccctaacggtttttaccgtggccgcaaagtgatgccagcaaaaggcgaataa

SEQ ID NO: 43029 - DNA, 329 bp, Glycine max
  Peptide Sequence Number=SeqID_159807
acatcaagtgggaaagtacgacttcagagaagcaattattggtactggtgcaatggtcagggctatttctggaagacacttcatgggaaaagtgggaaaatctcacgaaagattacaaccttaaggacaaggtcgttttggaagcccgaggggatgttatgaatgaaaagcagaacacaaaacaatatgtaccaacaaaacattatgcagaattgaatgaagatgatgcaacaataacagagcatgaggcagaaccaagagaagaggacaaaaggccaaaaagggaaagcaataggccacgatacctcgaagactacgtggctaagtaa

SEQ ID NO: 43030 - DNA, 297 bp, Glycine max
  Peptide Sequence Number=SeqID_159808
atgttttcgcaggccgcagacgcgccgccacctcatcaggctggcccaactggatcatttgatacggagcagtatttacggcatttgttgagcctcagcctacagagccagggttttacttcttttccatgccctactccggatcagttcagggcagacgtcgcatggcccggagattggcctgaggcccgggcaggagagacaccagcagaggctcccgacgaggcagatgaggcccgcgaggatgaggagatgactgatttgcttgatttcttgggagggagcggagccacatga

SEQ ID NO: 43031 - DNA, 405 bp, Glycine max
  Peptide Sequence Number=SeqID_159809
atgtgcgaaaaggagcacaaatccttcaaaggatacgcccaaaggtggagggatatggcagctcaagtagcgcccccaatgacggaaagggagatgataacaatgatagtagacacattaccagtgttctactatgaaaagatggtggtttacacaccttcaagctttacggatttagttttcaccggcgaaaggattgaattgagcttagctcatcagtgggctaagcgcgcatccatcactaagtgcaacttcagtgcgcttagcgcgacagaagactctggcagggcatcaatatcaaggtcgcgcattaagcgcgagatcagtgtgctaagcgcagtagttgtcttcagccaggctcagcgcacaactggcactaagctcaaatccacttacttgcgctaa

SEQ ID NO: 43032 - DNA, 600 bp, Glycine max
  Peptide Sequence Number=SeqID_159810
atggtaccagatcgaacatgctcaagactacccatctgcgatgaaggcaaaagaagaacttcaagttgtacttcaacattgaaatgcccaatagagaacataaagttcaactggtcaataataaaattgcctaaggaaaagtttgaagctcgagtcatgcatttctttgagcagcaaaagccaaacagggctatttatgaacaaaagtggaaagacatgcttgaggctaaacaaaggaagaaagccaaaaccaagaaaaatcctgaagaggatgttgccatgattcaaaacattatagttgatcttgagcaatctggtgcaatggaaataggacaggaaatggatgcatccattcttgatttggttgctaaagaaccaatccatgagaccaatcaagtcgtgcactctcatgaagtcacctcaacacaacaagagatagttgtatactccacaagctcaagcaaccctaaagaagttgctcccatcaactatgttgaccctattgtagttactgaggaacggatcctagagatgttaactcaagccttgctaaagaaaaaagaagaaacccaacagaaacttaaagtcttcgctaaatag

SEQ ID NO: 43033 - DNA, 174 bp, Glycine max
  Peptide Sequence Number=SeqID_159811
atgaagaatgaagagttttcaaaagtccaagggatgctcagaattagaaaagaagcaagcacataccttagaattgccgatgttgaactccaagggatgctcgaacttgtggtggtgataaagcctaactcttcgagtagttgcgggtttagcggcgtcgagcaggacatgtag

SEQ ID NO: 43034 - DNA, 201 bp, Glycine max
  Peptide Sequence Number=SeqID_159812
atgccgctattcagactggcgagacatgctgagtcacctcatgtcgccattggtactggcgggacatgccaacgtgggcagtcccgccattggcgcctgcggaacactgtgagctttgttgtgtgcttcttgctttgtgctccttggttcaaatttggtgcgtggcttcctttccttcaagtgtgtgctcacccttacttg

SEQ ID NO: 43035 - DNA, 267 bp, Glycine max
  Peptide Sequence Number=SeqID_159813
atgttggatattcctggagggagaaatatagtggaatctttaattacccatggtcagtgcattgatggtgcccatgtttcatacttcatattgcatggaaatagtataaacattgtcattttcctaagtgagagtgtcgtgaggacatgcttaggatatttcttgacaaatggtaccacattgcattttagagttgaggtcaagagtgcatgctttatactgagcatgattgattggaattatggacgaatgatgactacttgttaa

SEQ ID NO: 43036 - DNA, 875 bp, Glycine max
  Peptide Sequence Number=SeqID_159814
atgaatcccccccaaccgccgcagccccaccgcccctccacctcctgcccccgccaccccgacgaagccttcaccggcttctgtccctcatgcctctgcgaacgcctcgccctcttagaccccaacaacaacccctccaccgccaactcctcctcctcctcatcctggaaacccgcctccaccgccgccgcccttaaagccctcttccggccaccttccctccccgaactccgccgcaccaaatccttctccgcctccaaaaacgaacccttctcctccttcgaaccccagcgcaaatcctgcgacgtcagagtccgtaacaccctctctaacctcttccaccaagacattaccattcacattaaccctccacgtgtcgttgaaccgcatccccaacaaaacgacaatcctccacgcgtccttgaccagcccgaacagcaagaagaagaaggagaagaagaagaggaagaggaagaagacagagaggagattagggttctagaggagcccgagcccaagccctatgtgaacgaaatcgaagaacttgaagtagagatactaaaacagaaagaaaaagaagaagagcttgttgctattgtaaaagaagaagacgaggggttgaagacaatgaaggaccacattgacctcaattcttctcagaacaacaagcagcagaaagcgcgtgacttcaaggagctcgcggggagcttcttctccgcggcctcggttttcagcaagaagctgcagaagtggcggcagaagcagaaggcgaagaagcggcggagcggcggcgcgctgccggtggagaagccgatcgggcggcaattccgcgacacgcagtcggagatcgccgactacgggttcggtcggcggtc

SEQ ID NO: 43037 - DNA, 1033 bp, Glycine max
  Peptide Sequence Number=SeqID_159815
atgtcgttcgacgacccgcgatactcgatcgacgagccgcgggcgtcgtgggacgggtatttggtggggagaagcgcgtttccgaggatgccgacgatgttgtcggtggtggaggacgcgccggtgccggtgccggtggctgtgaaccatgtggtgaggaccgatatgcagattccagtggaagaggggtcgaatgaagatgagagtgtgcctggtgggagtgcacagactagggagtattacgattcgggttccaggaggaggaagagtcttgataggtctagttcggctagaaagagtattagtttggaggtggatgagttagggaataatgggaatgagaatgggaatgggaatgggaatgggaatgctaaggtggctcctgctggggtggattatgtgcagggggtgagaatggggtttaatgatcgcgaattcgggtccaattcgatgcgggaggattgctgttctgataagatgtttgatgtgggagtgattgggaatgggaagggagggaagaaggggcggcggtggcggtggagcatttgggggtttatacaccggcgtggcgggaacaaggatggggatgaggataggtatagcagggtgaatggggtggagaggtcgtattcggagtcgtggggcggtggtggtagtggttttaatgggaggatgttgaggagcaatagtagtgtgagttggaggaatgttcaagggattgggaatggtggtggtagtggtggtgggtttgggggttttaggaggaatggtgttcagagcaatgggaatgggaagaagggaaaggatgaacttgtgttggaaaggaatagaagtgcaaggtattctcctaacaacattgacaatggcctcttaaggaaatcgtcaaatggatggaaccttaagattaagacacttgcatttgggcttaccgagacagtgaacagtggtgtggacataaggagggtggttaacaggaacaagacaacagtaaaagaatatataggggtaagagtgcagaaagctggccctccat

SEQ ID NO: 43038 - DNA, 501 bp, Glycine max
  Peptide Sequence Number=SeqID_159816
actcgcagagacccttcttggaaggatgtgcgcaaaaaggcacaggctatccagaaacagaacactggcccccaagtatcaagcaatactttggattggctccatggacgtcccggaccagctacaggagtccatcacagaaaacgtgacgcgacagctcatggcatcgttcagccagatgttgtcccagattcagtcccagggacttgcactgcctcccgagcctctggaaacgatcctgagacgggtgacttagataggtgcggcttgtacatcgaagcagatcctaactgcctggttgccctggggagagtttatgagggatccactattgttcataacactcctttgttgcctggccaagtaaaggtgggtgtggaggaggttacagatgcagatgctccagttcctgtatccactgatgaggtttccttagtggggcaggcaattcacaccttccttgcttggccgatacttctggtcaagtctttatcacagcaa

SEQ ID NO: 43039 - DNA, 500 bp, Glycine max
  Peptide Sequence Number=SeqID_159817
atggacttgaaggaaaattgtacttatgtcatgcacaattttgaagtgctaaaaaacaacgatcagtacagagtctatgatcaccaatttaaattggtgtttattggggtcattgttgtaaggcagtgtgttctagacgacctcccttttagaaaatacagcaagtttgaacctgggctattggttgatgttaatggtgttgtggaggaggttgtctttcaccatgtttcaggaaaaggtagaagggtagtctttaaaccaaaggacttgagccagcaattgctatcttgcactttgtgggatgattattgcttgcagtttttaaaggatatacccaattataaagttctattgacccatggtagaataaaggaagctcagggatcttatccgccatcggtcagcaattctttcaaggcttcaaagttagttattaaccaaccggtgatggagattcaagaattcattgaaaggcttgcagagttgggcattgaggcccg

SEQ ID NO: 43040 - DNA, 147 bp, Glycine max
  Peptide Sequence Number=SeqID_159818
atgacaagggctgagctgataacttcgtcaattactgagagatacaagagcaagggtgctcttggccttgatcgactcaaagatggtagtgtggttatggtcttcttgaaagctagaaaggcttgttcacaagtctcgttccattaa

SEQ ID NO: 43041 - DNA, 264 bp, Glycine max
  Peptide Sequence Number=SeqID_159819
atggaggatgagtcatccgagactaccactccagagcccttggtcagaaggaagaaaacagatcaaacacaagaagctgcagccacttctgagaaatctcttgaggccacttatgagccttcagaaccagtggcagatacagcttcagttcagcagacagtagaccctttcactcctgaggatcatactagaccagtcctgtctctgagcacctctcatacagctacccttgtgcttcacttaacagacgaggaggatgtctaa

SEQ ID NO: 43042 - DNA, 171 bp, Glycine max
  Peptide Sequence Number=SeqID_159820
atgtgggacttgggtatttcccaatacacccccttcatgcccaacacttattgggcttggtgtgtgaacatcaaatggtgggtgctcgtcgcagcggaagcgaaggcgaggtcccaggacatagaagttggaaagccacctttgatgcttgtttctccccaaagaatttag

SEQ ID NO: 43043 - DNA, 794 bp, Glycine max
  Peptide Sequence Number=SeqID_159821
atggaaaatgtctgggggtatcgaagcattcaaaaagctaaaaatgcggaagaatatattttggtaaaagaatcctatacagaatctcctgatattttcgcaacatcagatttcttggaacaacaaaaattaagcaatacaaacccacagcaagctctttataattgggggacgaatgaattggtcaactggacaacaccaaaaggcaattcatctacaggagttttgtacaagcctgaagatttcaatcccaacaagaaatatcctatgattgtttacttctatgagaagctttcggacaatctgaaccgttatgttgctcctgctccgacaccatcaagattaaatatttcttactttgtgagcaacggatatttggtttttacaccggatatttcatataccgatggttttccgggggaatccgcaatggaatatattaattccggagttgaaaaattaaagcagaattcatgggtagacggtactaaaatcggaatccaaggacaaagctggggcggttatcaggttgcttaccttattgctcacacagatatgtatgctgctgcgtggagtggtgctcctgttgtcaatatgacctctgcatatggagggatcagatggacctcaggaatgaacaggcagtttcagtatgaaaaatcacagagcagattagggaaaaatctttgggaggcaccagatctttacattaaaaattcaccgcttttcacgattaataaggtgaaaactccggtagtcattatgagtaatgataaagatggagcagttccatg

SEQ ID NO: 43044 - DNA, 411 bp, Glycine max
  Peptide Sequence Number=SeqID_159822
atgcatgacgaagagatcattaggtatgcatcaggaaaataccacatgaaaccacaggaattcaacaagatgaagccctccaaggtctcttaccaaaatataaaacacaaaatgaaattcagcaatcaagaattgccagtactcacaaatgagtttcactaccctagagttcctctcctcacaatagcctctccttctaggaaaggttatacagtttttgtcctattatcgggacctcataaaggtgtttacaccaactttaaagacctttacttggcaaagaagggtattcaaagcccaacctataaaggattttattctagggaagaagcagaaaaagtccttgaattaaatatcactaatatcaataagataaagaaggccctcgagccagagcctatggatgtctaa

SEQ ID NO: 43045 - DNA, 330 bp, Glycine max
  Peptide Sequence Number=SeqID_159823
atggctaagaaaagagggtttcccctagcggagagactcaaactttggatttcttcacaagagagctctaagacttggtgtgtccttcccttctgcttcctcctccaaacactcatgggatgtctgaagtcccaactagtttcattcctggtcagttccagctcaaaagaaaatctatcaaagaatttgaaagaagtcttacaacttctacaacaagaagaagatgaaggttcttcctcaaagaagaaagatactaattcttcagaagatgatgatcctttctaccaaaacgaggaagattgttttggtatttcgctaaataatgattaa

SEQ ID NO: 43046 - DNA, 432 bp, Glycine max
  Peptide Sequence Number=SeqID_159824
atggctccgagaaagctttctgcaaagagatccaggaaggacaaagcggctgaagggaccagtgccgctcctgagtatgacagccatcgcttccggagtgctgagcaccagcagcatttcgaggccatcaaaggatgctcgccggcgatggacatcgctggttacctccatggccaagttcgacccagacatagtcctggaattttatgccaatgcttggcctacacaagagggcgtgcgagatatgtgatcttgggtgagggggacgatgagtacaccgacttccaggaagagatagctcgccggcgatggacatcgctggttacctccatggccaagggtcagtggattcctttcgatgcggatgccctcagccagttcctgggataccctttagtgctggaggagggccaggagtgcgagtatggctag

SEQ ID NO: 43047 - DNA, 357 bp, Glycine max
  Peptide Sequence Number=SeqID_159825
atggctttacacacaaactctaccaatgccccaaccaaaatcatgcaagctcttaaagcagcgccagagcgcaaaaaacgtaggaatctgagagaaagagagaaatttgtgaacacgctacagcaggagttagatacccttgagaacaagaaggaagattttatcggtgacttcagtgaggtggctagtgaatcttatgaccaagtcaccttgatggtcagtgtggaggacattggaattggaattcctttctcagcccaagataggattttcatgtcttttgtagaatttttgggggaggctgagttgatcaaaattaaggctcaggagttgaagggtaaagaggtgagtgattaa

SEQ ID NO: 43048 - DNA, 135 bp, Glycine max
  Peptide Sequence Number=SeqID_159826
atggaggataatctcccttcaactgttttagatgggactgttgttgggatcaaatttggtatggctacacgccaggaaatttggcaactggcaactccttgcacacaggcaacaaaccaagcaatgctaaagtga

SEQ ID NO: 43049 - DNA, 462 bp, Glycine max
  Peptide Sequence Number=SeqID_159827
atgggaaatgaaaataatgagcaagtgcagaagacgccacagtggaggaccgacaacggtgaccaatggcgaacggcgactgagcttgcggcacagttcgaacctcacaccagagtgaaagaggtcaggatgaagcttgcaactgcattcggaatgaaagaggagatgatgaatgtttactctgtcatgagaattcagacaaacatgcatagactctcttcttctccatctaagcttcgtctttgcgactctatctctctctacagccttatcgccactatgacacctcaccaccgtacccagagtgagagagagggtgaggactatagaaggaagtggtggttgatacaggtagtgactagtgagcaacgaatgggtgatattagatataccttttggtcatacggccacacatggagttatccacaagttgcaaagcaaacgatgttgagaacaagttaa

SEQ ID NO: 43050 - DNA, 204 bp, Glycine max
  Peptide Sequence Number=SeqID_159828
atgtctaaagctgatgaaactgcgaaaaccatgaacagaagcacgatcgccatgttcatggtcgcggacgatgtaatagaactagctagaattgaaccccttttggttgagaaaaagaggaagatgaggagaatagtgagaatgcagaaaacgttcaagatgaatgtttgccatgcatttcctgacaagacggcgattaactga

SEQ ID NO: 43051 - DNA, 270 bp, Glycine max
  Peptide Sequence Number=SeqID_159829
atggataacgacgccgcgccgctgctgcagaagcgggtggtggtcagcaataagcgggaaaaggtgattaacgatcgccgctcgcgccagcagacggtgacgccagccggcagcgagatgcgttatgaagcgagcttccgcccggaaaatggcggactggaagtggtgttccgccttgatgcgccgcaataccacgcgctgagcgttggcgaccggggaatgctgagctataagggctcaaaattcgtcgagttcgtcgccgataactga

SEQ ID NO: 43052 - DNA, 543 bp, Glycine max
  Peptide Sequence Number=SeqID_159830
atgggatcaagtcaaaagccttcgtttaaaaagaggttctatcaagtcaaaatcaagagcttagaggtcactagtttacgagagttggggcaattaatgggtcaacttcaacggcaagccttccgcaaagcctatggaattagaccgccaaaggcaagtcgaaaatggggtggtcggaataccgagaaaatatttggagcgatcgacgtttttctcgcctatcataaccacaaggaaagtccggttgtcgctatgctagccgacctatatgacaccttcgaccgaagatgtgaagaaagcaatgcaaggattgtttgctgtactccagctctctatgtggggctggtttcacacctttttctccaagaaggtaggcccgtctatccgctacaaggttaccgctcgtgcgtcgaaaaaggaaaggcgaattgggaccaactcttggctagcatgggggggcgtctgttaattggttccctcgctagaaggaaggaagaatcaggattctatcttcatgcgaaggatgtccaaatgttcccttga

SEQ ID NO: 43053 - DNA, 706 bp, Glycine max
  Peptide Sequence Number=SeqID_159831
atggtgaagggtactacctcaggttcaggcaaggtgctcgtaaaaaaggcagggacaagttatgcaaaaactgatgatgtcacacaccaagtgtttgataatttttcagaatgcagtgctgattttgaatctttcccaaaggtttcttgcactttaggggacaatgattcaactactgatgatgattcatctcactcctatggctctaagtcatcaccgcagctagacgataataaggctcccactccttgggtcaatctgttcaaagataacagaaacccttccaaaggttttggaatgaagttctcctctccaccctctgatgatgaagtgttgttggaagaaactgatttgcaacccctgggagaggcttggggacatagccttattggctatgtggctggccgcttcccaggaaagaaagctctgttggattgttgccaaaaatggggagtcaagctttcatactcagctcatgaaagtggttggctggtgtttaaatttgagtctgagaacgatctgaaccaagtcctctctgcaggcccttacttcatatttcaaatacccctactgctgaagattatgtcagcattctttgactttggctatgaggagctcagcaagatccctgtttgggttaaactcaaaaatctttctctggagctttggaatcctcaagccttagggaaaatcctgtccaagattg

SEQ ID NO: 43054 - DNA, 995 bp, Glycine max
  Peptide Sequence Number=SeqID_159832
ggatggtcttgaagcagcagtcttgtttggaaattgttgattcaatggagtttgttgagtcgaaccctctcttccaaaaccccaaatccatgtcttattttgtgcttcttctccaacttggtgtgggattggcgtttggagggctgatttgtaaggacaagtctgccttttttggaggaggtggtggtggagagtgggagggtgtgggtatggatgaggatgggggtgagggtacactgaagatgggggagatgggttgtgagtacaccagccaacccactgctttcaaaaccaacagacctgagctcttgagtggaggaggatgtgccagcaaaggtagaatgggtgttgtgccacaactgcagaacatgagtgtaggttgcgagaggatgggatcaattgctgagattctaattgaggcattggtacgactcaaggaatttaatggacatgaagggcttcattcaaaatttaatggtgatgatgttttcatgctggaggaatctctcttaataactcatacaactttggttactgagatcaaagaaattaaagaaaagcaacagaaacaggatgatatttttcaatctattacagttggaaataaacagcctctaattccacatctggttttgaatgctggttctacattgacagatgaagaggctgcaagagacctagaatttcttgaccacattgtgcatagcttccatgtgtctttggggctatggctaagtactaatttacttttgggtgaatttcttgtggatgcaacaatgtttgaagataagaaggaaatttcacatgttgtgtacaaggagacaggaaaggcttcagaagttgaagtaaaagatgtgaaattgaatcatccaaaggaatctaaggttaagtttgtgagtaagggtagcaatgcagccaagactaagaagaaatcaatgctacctacttctaaggcatccccaatttcagcaccaaaaagttcaaagcctgcataa

SEQ ID NO: 43055 - DNA, 195 bp, Glycine max
  Peptide Sequence Number=SeqID_159833
gttcactgcgaaggatgtcaggggatggctcaggatttaggagcgattgttgaggatttggagcgggtcatcaacctccggatggtcactgagggcactaacttacatgagatcatgactcattgtccaaggagagctagaggtgatgccgtagatgaaagtcttaggccgtgccagagacgccgcatagattag

SEQ ID NO: 43056 - DNA, 240 bp, Glycine max
  Peptide Sequence Number=SeqID_159834
atgggccttgtttatttgagacccttgatgctattgaagttccaccacgaccctagcggtcctttcaggatgccaattattgacagagtcaaagacatgggagctgttgttatggggaaggttgaatctggtactgttcgtgtgggagattccttgttgctcatgccaaataaggatcaagtaaaagttgttgccatatttattgatgaggatcgtgttaaatgtgcgggagttagttaa

SEQ ID NO: 43057 - DNA, 1687 bp, Glycine max
  Peptide Sequence Number=SeqID_159835
atggcaccaagaaacagtcgcggaaagcccaagggagagaagaaaaagaaggaagaaaaggttcttccggttgtcatagatatcactgtgaagctcctcgatgaaactcatgttctgaaggtaagagggccacgtctgaaggacacggtggacgtgtccgcactgaagccctgcctcctcactttagttgaagaggattacgatgaagaccgagcagtggcgcacgtgcgaagactcctcgacatcgtcgcctgcaccacgagcttcggtccgtcgtctctgccgccgccgaagaatgattctggcaccgtcccgaagtccggcaagcctgaggcgccgccggcgaagcaatctgcgaaagatgcggaggcggcggcggctacggtggacattgaaggcgagataagccactcgtgccctaagctggagaacttctacgagtttttctctctctcacacctcactgcaccaatccaatatgtgaagagaggttcgaggaggcgcgtggaggagattttggaggaggattatctgttctcgctggatgtgaaggtgtgtaacgggaaagtggtgcacgttgaggcatgcagaaagggattttacagcgttgggaagcagcggatactgtgccataatctggttgatctcttgagacagcttagcagagcttttgataatgctttcgatgatctcttgaaggcattttcagaacgtaacaagtttgggaatctcccatatggcttcagagccaacacgtggcttgttcctcctgttgctgcacaatcaccctcatattttcctcctcttcccgtggaggatgaaatgtggggagggaatgggggtggtcttggaagagacggaaagtatgatttggttccttgggctaatgagttttcatttattgcatccatgccttgcaagacagcggaagaaagacaagttcgtgatagaaaagcatttcttctgcacagcctgtttgtcgatgttgccattttcagagcaataaaggccattaaacatgttatggaagagccgaattttagctgctcagttgtagaaaataatattatttacactgagagagtgggtgacttgaatatcaacgtcttgaaagatggttctgttgcaagctgtaagattgatactaaaattgacggagttgaagctactggagtgaatcaaaaggatctactagaacgaaatctaatgaaaggaatcactgctgatgaaaatactgctgcccatgatattaccactttaggtgtaattaatgtaagatattgtggttatgtggtcgttgtgaaagttgagggaggagttaatgaaaatgttgactctccatctcaacaaaatattgaattgtttgatcagccagagggtggtgccaacgcactcaatattaacagtctgagattacttcttcacaacacaacttcaccagaaaacaataaaccagtgtctcagatacaaacgtttgagagtgaagagcttggtgcttctcatgcttttgtggagaagctgattaaagaaaatcttgctaagcttgaggaagaagaaccaggtattgactattttgtaagatgggaacttggagcttgctgggtacaacatttgcaagaccaaaataatacagaaaaagataagaaaccatcatcggagaaggctaagaatgaaatgaaggttgagg

SEQ ID NO: 43058 - DNA, 396 bp, Glycine max
  Peptide Sequence Number=SeqID_159836
atggcggatagcaatatgactgctatgctaatattatacatatgtgctctgtggggtttcccttttgcagctaatccaataccagcactcactgagtttgttgctcagttggtgatccctcatcctcagcatttggatggtacaagactgttctgcacatccactgtggttgaggaatgtgagattgttgaacttttacagcaaattgatacaaagacaaagaagcctttgaaaaagaaagttctctttgtgaagaatggagctgttgtagtgtaccatgttcaggttaataactctatttgcatcgagaagttctctgattttccacaacttgggaggttcactcttcgcactgagggaaaaactgttgccgtgggaaaagtcactggtctgtga

SEQ ID NO: 43059 - DNA, 147 bp, Glycine max
  Peptide Sequence Number=SeqID_159837
atggaggggtgtatggcttacatattgaacacaaatgaggaggagagggtaaagggaaagacagttgaagttggaaaagcacattttgagactgagacaacaaggttcactattttggatgcacctgtgagtatctgcattgcatga

SEQ ID NO: 43060 - DNA, 2205 bp, Glycine max
  Peptide Sequence Number=SeqID_159838
atgatcaaagtttttggttgcttatgctatgcatcaactcataatcaaactcaaaagtttcaacctcgttcaagaaaaggggcattcttaggttttcaaaatggtaccaagggatatgttgttttagacattaacacaagagaaatattcatttcaagaaatgttgttttccatgaatctttctttcccttccacacaaaccaaaacctctctactagcgaagcccaaccacattcacatatagacccaatttcacatacactacatatagacccaatttcacatacgctacctacaccaccccaatttaccccatccacacctatcacaacaaacactcaaccaataattcctcaacccaatggctcaccatcacctttcccaaatccttcaactcctcctacaatcgacacaccaaatcccaacatcattgatcaacatatccaagaatcaccatctaaccatgctttaccacgtcgctccaaccgcgacactcatcctccttcttacctttctgattatcagtttcaaattccttccctcaagtctactcaatcatcatcaacatgcacatatccaattcagagtttcctctcatacactcatgtctctccttctcatcgccatttccttatgactctgtcatctgagcacgaacccaccagttttcatgaagctgtgaaacatcaatgttggtgtgatgccatgaaatgtgagatcaaggctctacagttaaatcaaacctgggacattgttcaaaccccttctcatgtacgaccaattgggtgcaagtgggtatataaaatcaaacgactaccgaatggcagtattgagcgtcacaaggctcgtcttgttgcaaaaggatactctcaaattgaggacatacattactttgaaactttctcccctgttgttaagatggccactgttagagttgttcttgctctagcatcgattaatcgatggcacctccatcaattacatgttagcaacgctttcttacacggggacctcagggaggacgtttacatggagatccctcctggcttgcttggttacacatcaagtcagagttgcaaattgaagaaatcactttatggattaaagcaatccaatagacaatgtctattcatcaaggctcataattttgaatttactgctttaattgtatatgtggatgacattgtgttgatcggtaattcctttgctgagattgaatgcattaagcatattcttcaaactaattttcacattaaggatttggggaaactgaaatattttttggggattgaagttgcccattttgataaaggaatttcattatgccaacgtaagtattgtttggatttactgaaagattcaggtatgcttgggtgtaagccatcctccactcctatggatagttctcttcgactccataatgattcctctggttttcttaatgatcccctatcttatagacgcctagttggaagactagtctatttgacaagcacacgcccggatattgcctttgctacacaacaactaagtcaatttatgtccaaaccaacaaaagcccatcatgctgcagctatccgcgttcttcgatatctcaaagggtgtccaggcaaaggcttattttttccaaggacttgctctcctcatctacttggatttagtgatgctgattgggcaacatgtattgactctaggcgctctattactggttattgcttctttataggtaattcgcttgtttcatggaaaacaaagaagcaaactacagtatcacgttcctcttctgaggctgaatatcgagcacttgcttctgcaacttttgaattacaatggctttcttaccttctaagagatctacgaattcccttttccaagactcctatactttactgtgataatcatagtgctcttcacattgctgccaatccagtctttcatgaacgcaccaaacacttggacattgattgtcatctagtccatgaaaagtcccaagttggactcatgttactgctcccagtcccttcttcaaatcaacttgcggatatattcacaaaggctctccctcctcaatccttcaacaccaatctttccaagctgcagttacaaaacatttttgcacctctagcttgtggggggctaatagaggaaacatataatcctagcttaaataaggaaacatataatcctaacttaaatgctacataa

SEQ ID NO: 43061 - DNA, 219 bp, Glycine max
  Peptide Sequence Number=SeqID_159839
atgaaggaagggggtgacagaggggtcgcgagagttgaggaggaggagctcttgggtggtgatgatggccttgatgtgctccaagttgataatgatggccctctcatggcccagaatagtatggatgcagtgggggcgaagcgagttaggggagaggaatcaatgaggttctcttccatcattggatatatgctggaggtgagggatgccaagggatag

SEQ ID NO: 43062 - DNA, 900 bp, Glycine max
  Peptide Sequence Number=SeqID_159840
atgatgatcatcactgcgctcatcactgccataattgcgggactttgcattggtccgatcaacggccggcggcggaggaagagagccgtggggttcttccatccgtacaccaacgacggcggcggcggggagagggtgctgtggtgcgccgtgagaggcatccaggaggaaagccccgaccttgattgctatgtgtacaccggagatcatgacgccacccctcaatcgctcatggctcgtgccctcgatcgctttggggtcacgctcctctcttctccaaaggtacttcccttggaacgatcagcagaaattcctgtattaatatctgttgcacaatttcgaccggagaaggcacacactctccaacttgaggctttttcagctgccattaagagattagatcctaccttgccaaaacctaagttccaaattgtgggtagctgtagaaataaatcagatgaagacagacttcaaatgttaaaggagaaagcaattgagctgaatgtgaatgaacatgtagaatttcataagaatgtaacatacagagatttggtgggacttttagggggtgctgttgctggcattcattcaatgacagatgagcattttggcattagtgtggtagaatacatggctgctggtgccattccaattgctcataattctgctggcccaaaaatggacattgtattagatgaagatggacagcaaacaggatttcttgcctgcactgttgaagaatatgcagatgccatggtgagaattgtatcaatgtcggagatggagagactaaagatggctgcagccgcaaggagacaggcgaggaggttttctgagcagaggttttatgatgacttcaaagctgcagtgcgtcctatcctgtctcatacttctaggtga

SEQ ID NO: 43063 - DNA, 654 bp, Glycine max
  Peptide Sequence Number=SeqID_159841
atgtttgaggacatggataatcagttgtcggatgcactgtgtgataaactgaagccaatcctttacacggagaaaagctacatagttcgtgaaggggatccagttgatgaaatgttgtttataatgcgtggaaaacttgctactgccacaacaaatggtggaagaactggtttcttcaactcctttgagatcaaggctggtgacttctgtggagaagagcttctaacaagggccttggatcccaattcctcctcaaatctacccatttcaactagaacagcagaaactatatcagaagttgaagcctttgctctcatgcctgatgacttgaggttctattccttgcaatggaagacatggggtgcatgtttcatacaagcagcttggcacagatacaaaaaaaagaaggctgagaagttggcacgtgaagcagaagaaaggatacaagctttggaaaatgaggaagggtcctcacctagctttgctgccacagtatatgcatcaaggtttgcttcaagtgtattgtgccacttgcgaagtggtaaacgctccagagtgccacagccaaagagattgctacccctgatgcctcagaagccagctgagccagatttcagtgcatatatatgtagacacagcaacagcagtgtgtaa

SEQ ID NO: 43064 - DNA, 1812 bp, Glycine max
  Peptide Sequence Number=SeqID_159842
atgggaaagcgcctccaaaacgctacttcctccggcggcgagattccgccggaaaagcggatccgccggagcaaaaccatttgctcttgcaactctcctcgccctccgtttctctctgctcactccactttctcctggttcgaagaagacatttggacagagattgctaagtttctggatggaaaatctctggtgatgctggcagccacaagccgatggttccgccgtgctattatggatgacggcatatggaagttcgtgtgtctgcgtgatcttcaggtcccacccccggaatgcgtggcattcagatggtgcaagctgtacacgtcaacctttgccgtcctggcagagagactgattcttccggggaagatacggaatggagaaaccatggaaaagatgttgcggtctcaaggttgttgcgtgctagacaatgttaaaactggaatctggatagctgacctgcagcttgtaagatgcccggtttgtgacctcaatacttgcgatggaacaatgcagactttagatgcaaggcacatagagctattcctctgcgaaggcttccaaaatgggagctgggattaccagcttgtaggatctcgtgatataaaaaaacgagcagatggggctgctggcgccatttttgacatgaaacacctaaaggattcttcaacttcggtgcataaagagatcaccttctgtttagcactatggaaccagaaagctgtatttgattacaagtcatggattgggagagcaaatgactggcaacccaaggcaatgattgctttccatgccgtagctgtgaacactaatttacaagaaaatgaaggtctccatgtgaaataccatgctatgagggcaggagccgatggagaagttgtttctattagaatctctcaacagctcctcatcaactacctcacacaaaagatacaagtctacgaccctgatgattgcctacccaaacgtcttctgagcctcaatatctcaggttctccttttatccccacttttactcgtgactacaccttcttaagctgtccatttcagaacgcagggtcacaattcattcccatagactgcctcagtaattccacaagttttgtatcagctatccctacactgagcttgatcaatccattgaatgagtcttgctatgttattacaagggtttcagtcccagtttcagggccagagcagcagtatgagaagaatttcagagatgagcttattgaagatcttcgattaacgtgggatacacctgactgcaaatattgcgaatcgcgacagcaattgtgtgggtttgatccaaataacaacggtcaactcttctgcttctctggttaccaaacaggtacttcaagacgtggaacccaagttttcagaatcatcacactatgcatagctggaccagcagcggtctttgcaattgtgatggcatgttgtgtgtgctacaaggacagactagccaacattcgtaacagtgccattacaaggtctgcacctgcagctacaatatcgccggagccacaaatcacgaccacgggtctggacgagtccaccatcgagtcttacgagaaggtggtgctcggagagagtcgacgagttccgggacccaacaacaatggatgctgttggatatgcttgtcggagtacaacagcaaagagaccataagactgattcctgaatgcaaacactgcttccatgcagactgcatagacgagtggcttcgaataaacaccacatgcccagtttgccgcaactctccctccccttctcctattcatgttacgtccattgacccttaa

SEQ ID NO: 43065 - DNA, 237 bp, Glycine max
  Peptide Sequence Number=SeqID_159843
atgttaatttttccaggttctattccccgcgatggaggaaatgggcagcatgtttcattcaagcatcttggcgcagatacaagaaaaagtaggctgagagctaagtttgcatcaaatgcattgcgccacttgccaagtggtaaacgtaataacagagtgccaaagccacggagattgctaccccttatgcctcagaagcctgctgaaccagatttcactgctcagaaaaatcactga

SEQ ID NO: 43066 - DNA, 1824 bp, Glycine max
  Peptide Sequence Number=SeqID_159844
atgactgcaaaggaaaagaaatttgtgaggttggattggaagtcactttcttcttcaagtattgagcacaatgattcttctaatgatggatttctcaaaagaaaagttcgaccaagcttaagttctctcattgatggatcaataacaaattcgtcttgtcagagccatgttcttgatccacagggggcaacacttcagaagtggaacaaaatttttgtaattacaagtgtgatggcagtctctgtggaccctcttttcttttacatcccaatgattgatgacaagaaacaatgccttgctttggatggaacactgaagattactgccagtgttctccgcacattctttgatcttttctacattcttcacatcatctttcagtttcgaaccgggtttattgcaccttcctctcgtgtacttggaaggggtgagctagttaatgatccttgggccatagtaatgagatacttaagctcttacttcatcattgatattctatcaattattccacttcctcagatggtcattttagctacggtctcaattccaaaatgctcagttccttatgtgggaaaggatttattgaagtacacaataataacccagtacgtgccaagacttctgcggatttacccgttattcaaagaagtaacaagaacttctggcatattgactgagacagcatgggctggagctgctttcaatctttttctgtatatgctagcaagtcatgttgttggagcattctggtatctattttcggttgaatcaaggttgcggtgctggcgaaggcagttgaagactactatgatctttcatgaatcctaccttagctgtggacgtaacaatcccattgttctatcgcttctcaaatattcttgcccttacattgatccagaaagcatagaaaacctggcaactttcaattttggaatgtttgtagaggctctaaagtctcgcgtggtggaatcaactacagattttactcacaagttcttctattgcttttggtggggtttgcgcagtgtaagttctgttgggcaaggtctcgagacaagtagttatgttggggagataatctttgctatcttaattgctgtctttggattggttctatttgcatcacttattgcaaacatgcagaaatatctacaatctaccagtgtgagagttgaagagatgagagtcaaaaggagggatgcagaactgtggatgtcccaccgtatgctaccagatttgctgaaggaaagaattagaaggtatgagcaatacaaatggcaagaaaataagggtgctgaagaggagacattgattcgcaacctccctaaagatctcagaagggatatcaagcgtcatctttgcttagaactacttagaaaagtaccaatgtttgaggacatggataatcagttgttggatgcactgtgtgacagactgaagccagttctttacacagagaaaagttacatagttcgtgaaggggatccagttgatgaaatgctgttcataatgcggggaaaactagctactgccacaacaaatggtggaagaactggtttcttcaactcctttgagatcaaggctggtgacttctgtggagaagagcttctaacatgggcattggaccccaactcatcctcaaatctacccatttcaactagaactgtgcaaactatatcaacagttgaagcctttgctctcatgtctgatgacttgatgtttgttgcttcccaatttcgacggcttttaaacagcaaacaacttcagcacactttcaggtgctgtagaaactatattctagtcacatcattaattatgttttga

SEQ ID NO: 43067 - DNA, 273 bp, Glycine max
  Peptide Sequence Number=SeqID_159845
atggggtacgatctaggagctctgggaaactatcctggttcaccatttttgccatctgattcagacattttgctagaatctcctgatcaacaggatataggatattatgaaacactacaaaatctgcttaaaagaggcaaaacagaaacagaaggcaagtggatgacttctttgttaattctgagcccccatgctctcaatcggatgaggagaaatcttgaggtgaggcgagttgcatgtttcacattaattgttaggttagggaaaaattag

SEQ ID NO: 43068 - DNA, 279 bp, Glycine max
  Peptide Sequence Number=SeqID_159846
atggggaactcttttctctttcttttctttcccatcttccttcttcctcttcccctctttcctttttggccaaatttgttgagtagaagatcaatgaagaagcaattaaaatggcatcaagtgaagcaaccattgattgccttacggatctgcgatcgtgaacaatccagaaaaataacccaaacatatccgcaattagaaccaccgaatagagcgaaaccacctaattttgattctttccaaatctggaatcatgcgtgctttagaataccaacttga

SEQ ID NO: 43069 - DNA, 516 bp, Glycine max
  Peptide Sequence Number=SeqID_159847
atgggaaattgccaagctgtggatgctgcagcacttgtgatccaacacccatctgggaagatagagaggttgtattggccagtgagtgcaagtgaggtcatgaggactaatccagggcattatgtttccttgatcataccattggctgtgcctgatgatcaagggcagatcaatcaggagcagcagaaggccgtgctttttacgcgcgtcaagctgctccggccaaatgagactctcacccttggccatgcttataggctggttgtgaaggcagtgaaagcaaagaaacatgcaaagatgaggaagccacaggtgaaggcaatggagggtatgcaaatagtgcagctggaaaagccagtttcagatagtgagagtactggagggatgttggacacaagaaatatatatcaggcaatgaggacagacagatacaggctaatgagttccacacatgctgcactgaagctgaaatcatggcgtccctctttgcagagcatctcagagtctgcaagttga

SEQ ID NO: 43070 - DNA, 294 bp, Glycine max
  Peptide Sequence Number=SeqID_159848
atggaagtacaagacattgttgataatttgaaagggtgtagcaaaaacaagcattggatattagaggcctacctagttaatagggcacttgcttcaagttacctgatatttagtgagtttttgcacaaggaatatggaggtcctgggacattgttggtggagccattcacggatatgatggttgctctaaagaagaagaaactaccaggagcagctctggctgcaagagcgtcactattatgggcacaaaattttgttgataaggattgggaagtttggaactcaaaaatttaa

SEQ ID NO: 43071 - DNA, 267 bp, Glycine max
  Peptide Sequence Number=SeqID_159849
atggacgcatccattgtgcttagggaaccaaagaagtgccataaagacatgtgttactccctcttcatcgacagcaaaagggtcaacccgatactattcatcactgtctacaagctcatcggtagaactgaggctaccgtcctccccaccaggtatgttgtcgagatcaatcacaccatgtggcacatccacgacaacttgccctgtatggacaacgacaacctctgtcgtgaaaagccaaacaaccatagggatgcgaaagaataa

SEQ ID NO: 43072 - DNA, 429 bp, Glycine max
  Peptide Sequence Number=SeqID_159850
atggcaaaagcatgcaagtcacatgaagaaatcttgagtggagctaccaaacatggtttgaaggctctgcagaagtgccatttgcttgaggaagctgctcatgctcctgctattctagctctttctagacccatcggctctgagtggaaagagaaagtcgagaatctacaagtggaacttcagcaatgctacaaagctcaatcttggctgtctgagcaacttgttgtggaagtagctgagtccagagcttcaaaagcattggttcaagagaaagaagatgcagcggcttatctgcagaaggaattgactgaattgagggaaggatgctctcaattaaaggtggacttgggagaaaagattaaatctctagaagtggttgtcagtgagaaatctgaacttaaaagcacaactggagcagatgactactaa

SEQ ID NO: 43073 - DNA, 6369 bp, Glycine max
  Peptide Sequence Number=SeqID_159851
atggcttccgcatcgactcctcctttgtccctaccgctgccattgtcattggcgaactcttccaaaacgttcacgctatcaatttctcataagttgcatttgaagaactatcttctttggattcaacaggtggaacctgtaattcacaatcttcatcttgaaggctacgtcattaatcctcaaattccccctaaatatgctttggttgaagattgcgattcaaataaagttaccagtgaatatcgtgtttggtacgaacaagatcagtttcttcttgcgtggttgcaatccactatttctggtgaaattcttccttgcattgttgattgtcgatcgtcttggcaattatgggatcacatcctgtcacattttcagtctctcacttgcacgaagattcgtcaagttcgcgatgagcttcaaaatctctctcttgataatcgctccatctctgattatcttctctgtgtgcaaactctagtcaatgtgctcacttccattggtgaaccagtatccaattttgagcatgttaatctgattcttgatggactccctgatgtatatgcattgtcaattttgctcattaccaacagatttgatccgttctttgttgatgaagttgaaactttgttgcttgcgcgcgaggtgcgtgatgttgtttctgattctgtgcaatttgtgaaccctaattctcagggtcaagtcaatctgaccactcagtccgtgtcggaggataactcatccaatgattatgctggaaatcattttttcaatggtcgcggtggttggggttctggccagaataatcgtggtggccagaatcctaaccatggcagtggaggctgtggtggtggttgtttcgctgatgtgcagtgtcagatctgttataagtttggacatggaggttcgtattgttatcatagattggaggaaaattacgttcctacccttccaccaccagcctatcttgctcctgcttctacacatacttctgctgctgtgcaacttgctcctgtgaaagttcataatgctcagcctgctcattcccaaactactgtagcttctgtacagactcaatatgtgtacattcaaccacctcagaccactcaactagcttctaaacatcctcaagtttatccagctagttcctctcacactccaactcaagggcagagttggtatcctggtgcttctcatcatgtgacaaatcaagtttatccagctagttcctctcacactccaactcaagggcagagttggtatcctgattctggtgcttctcatcatggccctgatcagatcactattggcaatgctcaaggtctcaacattaattcttcaggtgtttcctctttttcctctcctcttaatcctaaattttctcttgtccttagtaatctattgtttgttccttctattactaagaatctcattagtgattctaaacatgttcttctaaaagggcttgtgggaagtgatggtctctatcagttccctcaactactttcatctgtgccaaatgttgtacaaagtcctcttgttaatactgtcactagtaaatctgattttcagtctttttcttcaaataaagctgctgtagttgatgctgtacagtctgattggggaagggagttcagacctttcactaagttcttaactgattatggcattcagtacagacttatatgtcctcatacccatcaccaaaatgggatagtggaatgcaaacgcagacatgttgtggagttgggtctcactgttttgtctcaagcaaaactgcctcttcattactgggatcatgcctttgtctcaagtgtgtatcttataaacggattgccctcctctgctattggcaatgaaattccatatcagaaattgttcaacaagcaagctgattatttctttctcaagatctcaagaatgctattcttgggctattctccttcacacaaaggttccaagtgcctagctgctgatggcaggtcatacatatctaaagatgtcacctttaatgaaagtgcttttgcctatccttctcttttccctgaaccagctttgttaacttctgaagtccttgatactgcatcttccctcactgttttaccttctgcagtatctgttcacctcaccaatgcatcaccttctgctgccactgagaattctgcttcttccagtgatcagcaacctccttcaccacatatttcccatgcccagcctttatctgtttccaatacagccttacctgctcagccaaattctccctctattcccacacaaacaaccttccagcctactaacagacctgataatgcacatcctatgtgtactcgagccaaatctgctatgcaatctgagtatgatgcactcatgagaaatgacacttggaccttggttgatcttcctgcttccagaacaacaattgggtgcaaatgggtttttagggtcaaggaaaatccagatgggtctgttaataagtacaaagccaggcttgttgccaaagacttccatcagcaattggggtttgattataaggagaccttttcccctaaactagatgttaataatgccttcctcaatggtgttcttgaggaagaggtttacatgattcaaccccctggttttgtgtcttccaacaagcaacaagatcttggtgaattggactacttgggaatagaagttcagaggcagcaagatggttctcttattctaactcagtccaagtatattcgtgatctcttgaccaagaccaacatggatgagtccaatcctatatcttctcctatgtttggaggatgtaaactcaccaagtttggttttgaggatttttctgattcaactctttacggatctacagatctattgttggtgccttgcagtacagtttctttagggttacatttccaagctgcttccctgcagcaaccctttcctcttcatgcttattgcgatgcatattgggcatctgatcctgatgataggaggtctacatctggagctgttactttaattggacctaatttaatctcttggtggtccaagaaaaagtcagtggttgcctgttctgatacaaaggcagaatataagagcatggctctcatagcagctgaggtcacttggattcagtctcttctttctgaacttcaagttcttcatgcttattgcgatgcatattgggcatctgatcctgatgattggaggtctacatctggagctgttacttttcttggacctaatttaatctcttggtggtccaagaaaaagtcagtggttgcctgttctagtacaaagtcagaatataggagcatggctctcatagcagctgaggtcacttggattcagtctcttctttctgaacttcaagttcctcacaccattcctgtcattctttgtgacaataccagtactgtctccttggctcataatcctgttcttcactccagaactaagcacatggaattggagcaaaaatggatagaagttacggttgatactcaagtggatgaactcataaaggctgtgaatcacagattcagatctgaagatttggttaatgctggtggcattcacagaacaatggtgtttgccaacactgttgaggctgttgaagctgtggcaaagatattactccattctgggattgaatgttcacgttatcataagaattgcacattggaagagcgagcacagaccttagttgattttcatgataaaggtggtgttcttgtatgtaccgatgctgctgctcgtggtgttgatattccaaatgttttacatgttattcaggtggattttgctacttctgctgtagactttttgcatagggttggtcgtacagctagagctggtcaatttggacttgttactagcatgtacactgaatccaacagggagcttgttaatgctgttcgtcgggcaggggaacttgatcaacctgtgatgcaaagatgtttgaaacctaaagaagctttgttccgaaactccaagaaccaacttccctcatctcactctcaaattcaaaggaacactattaatcaacatatcagtaacgacaacaacacccatatccttgacaaccttacccgtttccatgtcgcacgtaatcaagtcgaacatgctcgccatgtgtttgaaaaaattccaaagccaagtgttgttttgtggaacatgatgatccgagcttatgcttggaatggcccatttctacaatctattcatctgtaccaccgcatgttacaactcggtgtcacacccactaacttcaccttcccttttgttctcaaagcatgttcagctctgcaagcaattcaagttgggagacaaatacatggccatgccctcacacttggcctgcaaactgatgtctatgtttctaccgctttgcttgacatgtatgccaaatgtggggatttgtttgaagcacacacaatgtttgatatcatgacccacagggatcttgtcgcgtggaatgcaatcattgccggtttttcgctacatgttcttcacaatcaaacaatacacttagttgtccaaatgcagcaagcgggaataacgccaaattcttcaactgttgtatctgttctacccacagttggacaagctaatgccttacaccaggggaaggctattcatgcttactctataaggaaaatcttcagtcatgatgtggttgttgcaactgggcttttggatatgtatgccaagtgccatcacttatcttatgcccggaaaatcttcgataccgtgaaccaaaagaatgagatatgctggagtgctatgattgggggatatgtcatttgtgactccatgagagatgctttggccctttatgatgacatggtatatatgcatggcttgagccctatgccagccactcttgcaagcatacttcgagcatgtgcaaagctcactgatctaaataaagggaaaaacttgcattgttacatgattaaatcagggataagttcagacacaacggtgggaaactcgctgatttcaatgtacgccaagtgtgggatcatagatgactcacttgggtttcttgatgaaatgataacaaaagacactgtgtcttatagtgctatcatttcaggatgtgtgcaaaatggctatgcagagaaagctatacttatttttcggcagatgcagttgtctgggaccgacccagattcagcaaccatgataggtttgcttccagcttgttcgcatttggccgctctacaacatggggcatgctgccatgggtactcagtcattcgaggcttcactgaaaatacatccatttgtaatgccattattgacatgtatgcaaagtgtggaaagattcatatcagtcggcaagtttttgatagaatgaagaagagggatattgtttcgtggaatacaatgataattggttatgccattcatgggctatacatagaagccttttcattgttccacgaattacaggaatcaggcttgaagctggatgatgtgacccttattgctgttttatctgcatgtagtcattcaggccttgtcgtggaagggaaatattggtttaataccatgagccaagacctcaacatcttaccaaggatggcacattatatatgcatggttgacctcctggcccgagcaggaaatttggaggaagcatactcctttattcaaaatatgccatttcagcctgatgtccgtgtatggaatgcattgcttgctgcatgtaggacccacaaaaatattgaaatgggtgaacaagtgtcaaagaagatccatatgctgggaccagaaggtactggaaattttgttcttatgtctaacatctacagctctgtaggcagatgggatgatgcagcacaaattagaagcatacaaaggcatcaaggttacaagaaaagcccaggttgcagttggattgagatctctggggcaatccatggatttattggtggggatcgatcccatccacaatcagtatccataaataacaagttacaggaattgttggtgcagatgaaaaaacttggatatcatgctgattctggttttgttctccatgatgttgaagaagaggagaaggaacagattctcctttatcatagtgagaaaatagccattgcatttggaattcttaataccagatttctggtgagaaaaagaaaaggtggaattgtaggtctatttagaatcacccagtggcaaaagttcttcttgtgccacttgctgcctgaaccagcaattgcaaaagcatgcaagtcacatgaagaaatcttgagtggagctaccaaacatggtttgaaggctctgcagaagtgccatttgcttgaggaagctgctcatgctcctgctattctagctctttctagacccatcgttttatatttgctatga

SEQ ID NO: 43074 - DNA, 276 bp, Glycine max
  Peptide Sequence Number=SeqID_159852
atgccgaaattcacaatgtcttccttgagagtttactcaagccccactatggtccaccactgtcaatttctctacctgctgaaattgttgacaaggatccagtccttgaaacacttgcaattcttgattggtaatgggttgatgatgctgatggaccaaaacagcaggtcctcatccagtggactgggattcaccctgaagaagccacgtaggaaggctactattatcctaaatgatcttgaccttgaggaaatattgatgccccttccaccttga

SEQ ID NO: 43075 - DNA, 564 bp, Glycine max
  Peptide Sequence Number=SeqID_159853
atgcaggccagtgataggtttaacatcaattcccagcttgagcatctccaagccaaatatgttggaactggccatgccgatttgaacagatttgagtgggcagtgaacattcaacgagatagctatgcatcatatattggacactaccctttactgggattctttgctattgctgaaaatgaatctattggaagagaacgctacagctttatgcagtgttctactgtattgggagagttcatgagggaggtggaatggggaaccattactagtgttgtaactgaagcagtgtatagaatttattctagcaattatgtacacgctccaccagactcaggcccaagggagcccgagactgaatcagagaagtcaagggcatctcaaaccaagattccatgtaacaattacattagagaagaggccagcgctcaatgggaaatggctaaaatcctcgggatgacatcaggggaagagcaatcaacaatcattgacaaaatcacaacaatggagatcagagatagaaaggaagctgaagcattgggaaagagaaacatctcatcatga

SEQ ID NO: 43076 - DNA, 804 bp, Glycine max
  Peptide Sequence Number=SeqID_159854
atgggggtggtggtgggatatgccaccggcgtagatgtaggggttgcggctggtggagaagatttgggagaagcaacgggagctagtgatttcggtactgtggaaggtgcttgggcgactgtagttgccggagtgttcgacgatgctgcagtgggagactgtccttcgatgccggtgactacaatgcagatgattgcgagagagaatgccattgcgatagcgaatgaaatatttatcaggatcaaagggatcaaaccacctccgacaatgccactgccatgtcgcttctctctttctcgagtggacttgttggcaatagtaatggctttagcggcgccactgaatcccattgccaacctactgaactatccttttttcttcctcctcttcccctgcatgatatggctgaaatttgttgttgttgaaagcacacgagcacatctcctaggttcaagtgcggtgcaaatttgggggttgagggagggaaacttgtgcagttgcgaagtggttcaacatgtgcgcgatgatggaggggttattgatggttgcgatcgcgatgacaatcatcctggacttggtgctcaccgtggagatcttgtttgcggggaggaagacgatgaaagggatccccgtagctgtgcagtaactggagagtgcgacggaggtagtggccgtggttgtggaaggtgcggtgtcgaagagaagaagaaaaaagtagttttcggaggttggttagagctcaaaggttcatacctatgctctgttgtaggtaaagattctcctcggatgcttgactcgttttga

SEQ ID NO: 43077 - DNA, 1689 bp, Glycine max
  Peptide Sequence Number=SeqID_159855
atgatgagtgggatggggaactcaagagtgttaattttctctttgcttgttcttgcaacctttcagcaagtggtgtccgatgagcaccaacccctctcaaaagttgccattcataaaacaacacttgctcttgatgaacgtgcttatatcaaagccactcctagtgtccttggcttgaagtatcaatatgccaatttctccagtcatggttacaagaacacaggaaaaggttccctgaagcttcagttgattaatcagagatctgacttttcatttgcacttttcacgggtggcttaactaatccaaagctcgttgcagtgtcaaataaagtatcattcatcaatccaaatgcaccagtatatccccgattagcacaagggaaaacatgggacgaaataactgtaacatggacaagtggatatggaatcagtgacgctgaaccttttgttgaatggggccctaaaggagggaaccttgtgaaatctcctgctggtacactgacttttgatcacaacaccatgtgtggtgcaccagcaaggactgttggatggcgtgacccgggatatatacacactagttttctgaaggagttgtggcccaaccaagagtacaaatacaagctgggacatagattatttaatggtaccataatttggagtcaagaataccaattcaaagcatctccttttcctggtcaaaattccttacaacgtgtagtcatatttggtgatttgggaaaggccgaagctgatggttccaatgaatataacaatttccagcctggttcactcaacactactaaacagatcgttcaagacttaaaagatatagatattgtcttccacattggtgatttatgctatgctagtggatacctttcacagtgggatcagtttactgcacaaattgagccaattgcatcaactgtaccttatatgacagcaagtggcaatcatgaacgtgactggccagatactggatcattttatgggaccttggattctggtggtgaatgtggtgtaccggctcaaaccacgttttatgttccagctgagaaccgggaaaagttctggtactcagttgactatggtatgttcagattctgcatagctaacacagaactcgattggagaaaaggatcagaacagtataaattcattgaaaattgcctagcaacggttgacagacaaaaacagccatggctgatatttcttgcacatagggtacttggttattcttctgcagggttctatgctgcagaaggctcatttgaagaaccaatgggaagggaggatcttcaatatctctggcagaagtataaggttgacatagcaatgtatggacatgtccataactatgaaaggacttgccctgtgtatcagaatatctgcaccaacaaagagaagaacaattacaagggctccttggatggtacaatacatgtagtggttggaggaggaggagcatcccttgctgaatttgcccccataaacaccacatggagtatatttaaagaccatgactttggatttgtcaagcttacagcatttgaccattcaaacttcttgtttgagtacaagaaaagcagtgatggacaagtctatgactcattcagaatatcaagggagtacagggacatcttagcttgcactgttgatagttgtccagctacaacactagcatcttga

SEQ ID NO: 43078 - DNA, 1130 bp, Glycine max
  Peptide Sequence Number=SeqID_159856
cctgcgaaggttctagggagtccgacaagttcgacgccattttcgtgacgattagggttaaacgtttacgaggtacaggtggtggttttggtggtgaaggtagtgatggcacttgggttgggttcctgataggtctagataagggcattgcctacaccaagggggaaatcgagcatccagtgcatgcagaaaacagggccacaatgaaatttgtccactcttcgacatccattgaaactatgccaaagcaggtgatggtgatggggcagggtttgttgaagacgacgatgcagctctcatcgtacaccgccgccatagtcggaagcaccgttcgcctcatcgcgaaccgctccctgcgccaccggtgctgctcgttcccggcgaaaccagagtaccgcggaattaggtctttccgttcagaattcgcgttgaccgccgctcgctgctactccgccaagaaagggcgcaagagcaaggcggagcctgaagtgccggcggtggtgatggagcaggagaaagacgctttctacgtcgttcggaaaggggacgttgttggaatctataacagtctcgctgattctcaggctcaagttggatcttccggatactcgttgtcaaaggacaccgaggaatatcttgtctcacatggactgaagaatgctttatacacaattagagctactgatttgaaagaggatttgtttggcatgcttgttccttgccctttccaggaaccttctaccaaagagggcacatcaaataaggacgtatctaaacagagatctttgggagtgcttgcacaagatgagcggacttgttttgttgagtttgatggtgcgtcaaaaggaaatcctggaaaagctggtgctggggctattctgcgagctaatgatggaagcttgatttgtagggtgcgtgaaggtgttggtatagcaacaaacaatgctgctgaatatcgtgcaatgatattgggaatgaaatatgctcttaaaaagggatttactggtatttgtatccaaggtgattccaaacttgtttgcatgcaggtaatgttcactcgtcctcctcccaccattccctattgctggttccatttcaaatgcgctattgactgtgagctactcatctga

SEQ ID NO: 43079 - DNA, 468 bp, Glycine max
  Peptide Sequence Number=SeqID_159857
atgtcctcgccgcccccaaatactacaatgccaacttcaacacctacttcatcccctcattttgttgtgcgcgtggagggagatggcggtgttccaaacgacgacatttcggtgcggcggtgggatttggaggaagagttggtgggcgaaggggagggagaggcaggtgccgtagagtcggaggaaggcagaggagacgaaggggttacgaaggaaggaggacttggcggcatgggcgtggagagaggtggcgaggagggggaggttgagggtggtgcaggactggagggtgagggagaggaggagtctatggaagcttctagggcacgaaggaggttggagtacacaaagaaactaaaggatacaaccattgattggagactaagccctttagggtccttgattgttggtttcaagagaagagcttcatcaaaaaggtggaggaggagtggaggaaaatggaggtga

SEQ ID NO: 43080 - DNA, 408 bp, Glycine max
  Peptide Sequence Number=SeqID_159858
atgtcaatccttgccctcggaagaaaattcccaatcaaacagtgggaaaaagaaaaaagaagaaaattcccaatcaaagagtgggagaaagcgaaaaagaaagaaaattcccgatcaaacatcggaagaaaacaaaagaaatacgcagaaaggatgaaacacttacccatgtcaatggtcgtcattttgcctaatgaaaatgttgtcacctggttttgttcgttgcataataggccagacaactacctcaaaggcataattaatagtgctttgaaaggacttgatgatactcaacaaagtaaatccaaacctactgctaggtggattgttgttaaatgtaatagacaaaaaggaagcactgagtatgggtattacgtcatgcacgggatgtcaactataatcttatga

SEQ ID NO: 43081 - DNA, 252 bp, Glycine max
  Peptide Sequence Number=SeqID_159859
atgtcaggatttacacgcaattctcctcaaatttcagccagcccgcatcaattagaccttgcaccttacgcttcagagccctacaatgctcaatggaatgccccggggcttctccgtgacaagcacacgttgcgttcgagtcgtattctcggagaaatggaggttgatgaaccttggctagggttatggctaccattgaattatcaaggggtcttcgtcattggaagtgcggtagacaggctttgtggttga

SEQ ID NO: 43082 - DNA, 228 bp, Glycine max
  Peptide Sequence Number=SeqID_159860
atgtgtttaggccctttgatgatgggactacggacacaaatacggttgaaagagaaattcagcactcctgggagagtacatgtagatgtagttgaatccgggcccaattgggggagcaaaagaggcaaagtgtggccagcacttatccttagggtttcgaagtggctacaaaaggtttctcaccaacaaagggatgcagacacgatgaagaaaggtgatggaagttga

SEQ ID NO: 43083 - DNA, 786 bp, Glycine max
  Peptide Sequence Number=SeqID_159861
atgataccagtctcacttgaaaagtcggatgagaatggagaactacgttcttatgcttcctggctaggaaaacatccttctgccttgggaaattttgaggaggtgatgagcattgctgaagggaaacaaattgttgtgtttttggactatgatggaacactctcaccgattgtagatgaccctgacaaggcttacatgagtgatgttatgcgtgcagctgtatgtgaagttgccaattgttttcccactgccattgttagtggaaggagcaaggataaggtatatgaatttgtgaagttagagaatgtttactatgctggaagtcatggtatggacatatcaacaccatcaggctcttcaaaatatgaagagcaggagcatcagataaaggctgttgatgaaaagggtaatcccgttgttcactgtcatccggcaatagaatttttgccaacaatccaagagatagttaaggttttgaaagaaaatacaagaagaataaagggctctatgattgaggataatacattctgtgtcactgtacactaccggtgtgtgaaaaatgaagaggaagttggtgttctcaaaaaaatggtgaagactattatgaaagcttaccccgatttttacatatcaggaggaagaaaggttatggagatacgtccaactgtaaactgggacaaaggtcgtgctcttacatatttgcttgacactcttggctttgacaacttcagcaatgttcttccaatgtaccttggggatgatagaacagatgaagatgcttttaag

SEQ ID NO: 43084 - DNA, 219 bp, Glycine max
  Peptide Sequence Number=SeqID_159862
atggcaaatgcacaatccttgggtgtgagggagagaggtggaggccgatggatcttagctgaaattttgtcggggtttggctgcactccatcaagagacacatgcagtatggcccaaataagaaatgggtggcatttcaaaggtgccttttggacaaacggccaaagaattgattatcctgatataaccgaaaaaccacctcaagatggtttaatttaa

SEQ ID NO: 43085 - DNA, 1089 bp, Glycine max
  Peptide Sequence Number=SeqID_159863
atgcctacaaagctgttctcccaactacgtcttctccatcccctcctccccatgaagccccgcactctcccccttctctcaagagccttcttcttcccttcctccaagttcctccgaaccgcaccgtttaaggttcgtgccttctcttctagggcccacagcagggaaaagcttccgctccgctcctccaagagcctcgtcgacgacgaggccgacctcagcaactgggtcgacgatttgcgctccacccggaccgacgaaatgcggcccgcccgggacagcgaattgcgttccggccgaaccaatgaatttcggtccggtcggggcaatggagtccggaccggccggggagacggatttcgatccgaccggggcagcgaagtgcggtccggccggggcaacggagtgcggaccggtaggggagaccggttcgccgattccggccggggaaacggagtgcgaactggtaggggagaccggttcgccgattccggccggggaaacggagtgcgaactggtaggggagaccggttcgccgattccggccggggaaacggagtgcgaactggtaggggagaccggttcgccgattccggccggttcggcagcaacaacgacggagagcgcgaattccggccgccgaggaataatagtgacagggcttccgcgttggggaagagaaggggtgaggatttgaggaaggggagacagagtggcaatgcgaggagaaagtttcaaccgaggagtgatgatgatgatgatgatgaggaggaggaggaggagatagtgggtggaagaaagttgaagggtagtggcgttggagcatttcttagcgaggatcaagatgacgatgaagatgaagagagtgaagggagtgaggaggaggagatattgaacaagagtagagccgctttgtttggtcaacaaaacggtttgaaccggaggaccaccgtaccaactccaagaccttcttcccctggaggaggatctgattcttatttaagtgaaaccagctctgcatgttatagcttgcaacctgcatcaggccatgtagcctgttttgccacttctcagagttgtgagccttga

SEQ ID NO: 43086 - DNA, 216 bp, Glycine max
  Peptide Sequence Number=SeqID_159864
atggtggagcaacgctgtagagattgggaagaaaaaaacagtagagagcagaagtttgaagtgttaatgccatgggggattcataagtcaagaaaagcttcatttcttggccagcatcactgcttcttcaacatccacgttactactttgatgggataccctcaacagtataaagaacaattgaaggacaataagttgaagtttggctacaaatag

SEQ ID NO: 43087 - DNA, 981 bp, Glycine max
  Peptide Sequence Number=SeqID_159865
atggattgttcagctgcaagaaaaacacaaaaggctgaccgtgaaaagttaaggagggatcgactcaatgaacaattcgtagaactgggtaacattttagacgttctgatgatatatataacaagctctcttctttgtcctccaccctttctctcccttacacttgcctgccccggagagaaccctgataggcccaaaaatgacaaagcaaccattataggtgatacaattcaattgctaaaggacctaacttctcaagttagtaaactcaaagatgaatatgctacgctaaatgaagaatctcgtgagttgactcaggagaaaaatgatctcagggaagagaaggcatctcttaaatctgatattggcaacttgaataatcagtatcagcagcagctgaggaccatgtttccatggactgcaatggatcattcagttatgatggctccaccatcatatccatatccagtgccaatggcagtacctcctggtccaattcccatgcagccataccccttctttgctaatcaacatcctgcagtcatctccaacccctgttcaacttatgttccttatttagcccccaatacgattgttgaacaacaatccacccaatacgtatcccctccactacatccttgtggtcggtccaatgtgtcaggaaaacaagagtccaagagcaagtcatccagggagagcaaggctgaaaagaatgaggattctaatgatgtcactacagacctcgagttgaagactcctgggtcttctgctgatcaggatttatcatccagacaaagaaaatccagcaagttgtcaaggagggaaagcagttgcacagaaggaagttcattagctcatcgagcagtgtggcggcaagcagaaaggataatgaatgaaaaagtagacaagttagtcaagttctcatgccttgaagccgctgaaatttttcattgtgcatctgctgctactctggaggtgtaa

SEQ ID NO: 43088 - DNA, 504 bp, Glycine max
  Peptide Sequence Number=SeqID_159866
atgccctttaaccaagatttatttgactttttatttgcaccaactcaagcattgaattctcaaggcgaggaggttcatatgccaattgttgatgatgctagctataattctttggatttgggacacaacaacttggaaaacaatgatgatgaaactttaaccgaagaggatatctctaatttgatagatttattacttgaagatgatacttatatctttgatttcattgagttagatgatgacaaccacaacacaggaaacaatggagtttcaagagtggaatttgcaaatcaagttagtattcaaaatcttgaaaggatcagaattcatgaaaatccagagcaatcttcagacttgatgtgttccatttgtcttgaggaatttttgattgggacgataacaattcgcttgccccacccttgctatcacatctttcatgaacattgtataacaaggtggcttaacatgaataatacgtgtcctttgtgtcgtaggaccatctag

SEQ ID NO: 43089 - DNA, 771 bp, Glycine max
  Peptide Sequence Number=SeqID_159867
atgcaatttcctcaaggtttcgtcccaccattgactccatatttccctggcataggaatgacctcaagtcctcaagatttacttgaaactaacaatgaaaatttcagttctgttgagatgaacatagcagaagcagataataattactggcatgaacaggaaaggggttctgctagtgaggttgaagttgataatggaaattttgaaatgcttccagaggatagacaacagtctacttcagatagttataataactctgccccattgtctcgggtaggaagctccaacagtaacagttctgccagagttcagcagaagtttactaaagaaaaccgaggttctacaagagaagagcatgttgacaattttcattatcaagatggccgaagaaatgaggtttattttgatgatagaacagcaaattctgagttgtccagtgcacctcctttgagctcctttaagagtaggacctcttctgaaagctcatgggatggatcatcagccaaatcctcaaaatcaactagggagagaagggggaggaaaaatacttcctcaatagcatctcctgtttatgcgaagggtaagaatgtttcagaaacttcatctaatcgagtagatgatgaaaatagagagtggactcctttgtcgaccatggcatctaacatatcagaaagaagcatttggcccacatctagtccttctatgcatgttccaaggaatcaaatatctggttttgaaactgcccagacaagtggatcagattctccataa

SEQ ID NO: 43090 - DNA, 462 bp, Glycine max
  Peptide Sequence Number=SeqID_159868
atggccacaaactgtaagttttgttttttccttctccttcctcctcgtcttctctcttctccttcctctcaagtattgcaacctaaaagaatcactttctttaccacagcctttttcacacccatgacatttcctctttgccaccgcattcccttccccaaccttgcctgggtttgtatcccagacggaagttctgaaccaaatgcggtttcttggtcttttttgccatctggttatgggaaaaatgggtttgtggaggagtgcaatgagtttacctcccccaatacgcttacgacatgttcaatgaagaagagggatttgaacttaggatggctgtggttagaaggttcgagtatggagaatttgttgtggcaagaagaatggagaaaaaaaaaagaaaaggagatttacgaagcaacaaaatactttgtaaaaactaaaacaattattggaagcctttaa

SEQ ID NO: 43091 - DNA, 1845 bp, Glycine max
  Peptide Sequence Number=SeqID_159869
atgggagaacatgaggggtgggcacaggcaccaagtgggctattgccaaatggcttgttgcccaatgaagctgcctctgtgatacaggttctcgactcagagcggtggttgaaagctgagcaaaggactgcagagctgattgcctgcattcagcctaatcctccctctgaggagcgccgcaatgcggttgccgactatgtccaacggctgatcatgaaatgcttcccttgccagctgaaggtcgttgtaacttgtgaccaattacgacatcattattgtatgatgaaagtacttaataacactatcatgctgttgcaagtctttaaactgagtggtgctagatcagaaatcccagtttgtagtgagaaggtgttcacctttgggtcggtacccctcaaaacttatttgcctgatggagatattgacttaactgcattcagtaagaatcaaaatctgaaggattcatgggcacatcaagttcgtgacatgctagagaatgaggagaagaatgagaatgccgagtttcatgtcaaggaggttcagtacatccaggctgaagtgaaaattataaagtgtcttgttgagaatattgtagtagacatttcatttaaccagcttggagggttgtgcaccctttgttttcttgaggaggttgataatctgattaaccaaaatcatttattcaagcgtagcattatcctgataaaagcttggtgttactatgagagccgtatacttggtgcccaccatggacttatctcaacttatgccttagaaaccttggttctttacatttttcatgttttcaacaattcttttgccggaccgctagaggtattgtatcgatttttggagttttttagtaagtttgactgggaaaatttctgtgtaagtctttggggtccagtacctattagttcactcccagatgtgacaggtttgtcttgtgtattgattgcttttcttccttccctaacattatccacagctgaacctcctagaaaagatggtggagatttactgctcagcaagttatttctcgatgcctgtagctcagtttatgccgttttccccggtggccaagaaaatcaggggcaaccctttgtttccaagcatttcaatgttattgatcctttgcgtgtcaacaataaccttggccgtagtgtcagcaaaggtaatttctttaggatacgcagtgcctttgcgtttggggcaaaaaggctggctagattacttgattgctcagaggatgaattgttttctgaggtcaatcagttcttttttaacacttgggagagacacggaagtggggaaaggcctgatgttccaagcatcgacctacggcatttgagtttatccagtcatgaccaattacagaggtttgagaatctccggaacaataaccataaaattggtagtgcctccaatcatgaatctaatgaagaggaacatgtttcacaaagtggtctgtctcagtatagtaatttatcatcggaaaagacaactagaaatgttgtttctacagtttcgcattctcagaatcaaaagagttatggaagccaaaataattcaaggacctttgatcaagtccgtagggaaactaattctaatccaggtcctcatgtcgataaagttcagagaaatgttaaagccgataacctagtgagtgatgttcagggaaggtttctatttgccaggacatgttctagccctgagctgactgactcatatggtgacgtttcaacccaaggaaggcgtacaaaagcaacagaaagtagtaaaggccagacttcctttgcaaagttggagaatagtcgtaggaagcatgttgaacctgatgtagct

SEQ ID NO: 43092 - DNA, 252 bp, Glycine max
  Peptide Sequence Number=SeqID_159870
atgttggaaatatacaatgaaacgatccgtgatctgatatctacaacaacacgcatggaaaatggtactcctagaaaacaatatacaatcaaacatgacgcaaatggaaatgcacaagtttctgatctcacagtagtggatgttcatagtgctaaagaggttgcatttcttttaaatcaacctgcaaatagcaggtgtagcaaactattgcatcttttagctatatatgaaggtgatgctatgttgtcctaa

SEQ ID NO: 43093 - DNA, 513 bp, Glycine max
  Peptide Sequence Number=SeqID_159871
tcttctcaagaggaggctataaaacagaaggatgtcctggctacagaagtttcctctcttagaggagagttgcaacaagtaagagatgagcgagaccggcaattatctcaagtacaaactttaagttctgaattagagaaagttaaagaatctaggaaacactcctccactgaattggacagcttgaccttaaaagctaatgatctggaggaaaaatgttctttgaaagataaacagataaagacattggaagagcaactagcaactgcagagaagaaactacaggcatcacaagaagaagcttttgtagaaatttcacagcttgtacaaagtgctcttgatggttacaaggtttgcttctttgcctatggtcagacagggtcaggaaaaacttatacaatgatgggaaggcctggacatttagaggagaagggcttcatacctcgttcattagagcaaatatttcaaacaaagcagtctcaacaacctcaagtctggaaatatgaaatgtag

SEQ ID NO: 43094 - DNA, 534 bp, Glycine max
  Peptide Sequence Number=SeqID_159872
atgatacgcggagataccttacggttatccgccccccctttgccattcagacacagtcgtgttcgatggcaagcagagaccaagtttggtcattctgcacacatgatacgcggagataccttacggttatccgcccccccctttgccattcagacacagtcgtgttcgatggcaagcagagaccaagtttggtcattctgcacacatgatacgcggagataccttacggttatccgcccccctttgccattcggacacagtcgtgttcaatggcaagcagagaccaagtttggtcattctgcacacatgatacgcggagataccttacggttatccgccccccctttgccattcagacacagtcgtgttcgatggcaagcagagaccaagtttggtcattctgcacacatgatacgcggagataccttacggttatccgcccccccctctgccattcagacacagtcgtgttcgatggcaagcagagaccaagtttggtcattctgcacacatgatacgcggagataccttacg

SEQ ID NO: 43095 - DNA, 330 bp, Glycine max
  Peptide Sequence Number=SeqID_159873
atgtaccctctactagaactgatccacaagagatgtaccctctcttgttctcagtcaacaacccaagtagatgtaccctctacttgtaccacaaaggatgtaccctccaatgtgttaagacaaagttctcaggcggttaaacctttgaaacttagtgaatggggatacaaaagaattctcaggcgggagaagggagacacaaaagaattcaggcggttagtccttcattcttttggaaaagagagaagaaagacacaaaaagaattcaggtggttagtccttagcgaattctttttggcaaagggagaagggaatgaaaaagatgaatag

SEQ ID NO: 43096 - DNA, 420 bp, Glycine max
  Peptide Sequence Number=SeqID_159874
atgggtcagctccagcggcaaccttttcgcaaagcttacggtaaaatctgggacctagccatggtagaagtctccgcagaggccattgcttccctcgcccagtattattatctgtcattgaggtgcttcacctttggggacttccagctatcacccatggtagaagaatttgaagagatcctaggatgtcctctagggggaaggagaccatacctcttctcagggttctatccctcattagctagaatctctaagatagtccaaatctcggcgcaggaattagaccacagaaagcaagttgaaaatggggtggttggaataccgaggaaatatttggaggcaaaagcaagaatattggcaggtaaaggcgaatgggtctcgttcatagacacaaggaaagcccgatcgtcgcactattga

SEQ ID NO: 43097 - DNA, 201 bp, Glycine max
  Peptide Sequence Number=SeqID_159875
atggcgccaagtggaagctgggctaggtccaacaatgtgtggcatatgactttatccatgatcgatttccaaactcttcaatctttccatgtcacggggaaacctggtccaactcctaaaatcaaaccagttaatacaaatggtgcaactcatgtatctcttggatacgaagctagtggtggaaatttcacggatccttaa

SEQ ID NO: 43098 - DNA, 105 bp, Glycine max
  Peptide Sequence Number=SeqID_159876
atgttggaaccccctctcaacctccctagcatgcctatttataggaaaatgagcacttggggcaatggcagcttgcccaggagaatcataagcaattgggcttag

SEQ ID NO: 43099 - DNA, 336 bp, Glycine max
  Peptide Sequence Number=SeqID_159877
atggaggcaaaccactgcattttgaaaattcacaaagttccgaatccgaaacagagccaaaaagaagaagaagaaaaatgcagaaaccgaaaccgaaaatcaaatccgaagcgtgaagaagttaaaaaaataaaaacattgcctgagactcagggaaggaaaaagatgcgcaataggcagggcactgtggcgcttcgtgagattcggcatcttcagaggagttgtgagcttcttatcccggctgctccctttatcagatgtgttaaacaaattacaaatcaattctcctcagaggtgtctcgttggacacctgaagctgtggtggcacttcaggag

SEQ ID NO: 43100 - DNA, 1353 bp, Glycine max
  Peptide Sequence Number=SeqID_159878
atggaggccctcaatgctgctggcttgacccctctatctgtgctctctgatgcaaaaacaacaagaactaaacacccttctgtttctgtatgcaaagtctcaaacttttccacctccaccaacaaaaaacaaaccttgctgcaaagttgcatatcaaaaactttgcatggggggctgattcttgcagcttccgttgtaaatggtggagctgccacagctttaacgtacgatgaagccctgggacaacctttgagcctccctggtgctggggactttgatgtgaacggttttgtggagagtgtcactggctttgcagctgaaaaccctgcaattcttgctgggggagtagctgttttggcagtgccattggttttgtctcaggttcttttcaagaagcctaaggcttggggtgttgagtctgccaagaatgcttatgcaaaacttggtgctgatgggaatgctcagttgcttgatataagggcactggtggagattaggcaagtggggtccccagatgttgggggtctgaagaagaaagcagtgtcaataccttataagggtgatgataagccagggttcttgaagaagcttgctttgaagtttaaggagccagagaataccacattgtttattctggacaatgaacttgtgatggaagccagatttgatgggaactctgaactggttgcagagttggttaccgttaatgggtttaaagcagcttatgcgattaaggatggtgcagaaggaccgcgaggatggaagagtagtggtcttccttggatagaaccacggaaaacattgagttttgacaatctgacagatgctatatctgaagcaataggagataccactgatggcgtggcagttactcttggggttgctgcagctgctgctggacttagtctattagctttttctgagatagaatcaatcctccaggttgttggatcagctgcgctcattcagtttgcaagcaagaagcttttgtttgctgaggaccgagagcaaaccgtgaaacaacttggtgagttcttgaacaccaaggttgcccccaaagaacttgttgatgaaataaaggatattggaaaggctcttctaccatcctctaccgataataaggctcttcctgctccggcagagaaaagttcagagcttgctacagctgatagcactgtacagagagcagtagctactcccgagtccaaagctgaagcagtagcaactcccgagcccaaagtggatgcagtagctcctgaagtaaactctgtgcccaaaactgaagtcaaggcagaagaatcacttcctgtgcaaccaaggccactttcaccatacccatatgtaaagtcttaa

SEQ ID NO: 43101 - DNA, 114 bp, Glycine max
  Peptide Sequence Number=SeqID_159879
atgagtctcaagggagttccaaaccgagtgacatgcctccaagtaccagcattcttcctcatgaaaaaccacagtatgaaacatgagcaccatcaatgcactgaccttgaatag

SEQ ID NO: 43102 - DNA, 267 bp, Glycine max
  Peptide Sequence Number=SeqID_159880
atgtcgtgttttggagttagtgacattgtagtgacgaggcgagtgattatagtgacaaaacaatacttgagtgttcttagaatcagggggagtctaagggttgtgctagagaataattgtaagccaagagtggaaggccttggatcttcttcatcaatggattcctttgcttcatggaagatgaatggcagcggaatggagaaggaagagagagaggagacaccacttcaaggagaagatgagtctagaagaagctcaccaccatag

SEQ ID NO: 43103 - DNA, 246 bp, Glycine max
  Peptide Sequence Number=SeqID_159881
atgaatgcatgtcccaaaaacatgtgcaaaccaaactgccccatggcttgtttccctacaaaaaatcacgcgctaatgccattgaggcatttcaccgaacacttgagcaccaaaaggagatcaaaatacaccaatgaaaagctagaaagcttagggatggaatacttacttattggtgatgaacaaaagcgcgaaacggaatcaaaaaatgcgaaaaatgatgacccaagggctgcaaactcgtaa

SEQ ID NO: 43104 - DNA, 718 bp, Glycine max
  Peptide Sequence Number=SeqID_159882
tgtatgatggtgtttttgaggtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatttctctcactaatttttgtgttgtgaaatctctcatcaaagggaagaagccatggctagctgcacttcttagacagcaggatcactcttgcaagaagagaaatgttcactttcttaaagagcaaccaaagaagattaaccctccagactccaatgccaatgaagctgaagaaaatgaagtgggggaaaggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 43105 - DNA, 281 bp, Glycine max
  Peptide Sequence Number=SeqID_159883
gtttgaagaattggctaatttggtttcttttgcacttttcactagtgctagagatccttctacttttcaagaggttatgaacaaccatgagaaagacaatatggggattgattatgatgagatttcctcctcaatcgtaagacacacttctattaaggcagtgctagcctcggtagccaatcgtgacatgcacttggagcaaatggatgtgaagataacctttcttgacaatgatgtagagcagcaaatttacatgaagcaacccgagaggtttagtaaag

SEQ ID NO: 43106 - DNA, 180 bp, Glycine max
  Peptide Sequence Number=SeqID_159884
atgggatttggagagtggaagaaagaagcttacattcttgacgaagataacgttggcggcggcgatggcgacgactacgccgccgaggatggtgaccgggccggtaaggagactccacttccgatagatcatcttcttcttcttgctctgattctctctctttcagatttttacacttaa

SEQ ID NO: 43107 - DNA, 1191 bp, Glycine max
  Peptide Sequence Number=SeqID_159885
atggaagagaatatgaagtgtgaactagttggtctcattgatgagttaatgcaagggaaggagctagcaaagcagctttgtgaccatctagtctcattatcatcatcatcttctcatgaaacaaatgaagtcctaattgagaaaatactttccacctatgagaaagcacttgccatgctgaattgcaaggctaatgtaggagaaagtaaggccaacattaatggcagcatgatggattccccttgttctttcacaaatggtagccccaaaagtgaggtcatggagcctgagattaagaacaaagatgtctttaagaaaagaaagaccatgtcaacgtgcacagaacaagtgaaggtgtgcttgggaacggcgcatgaaggatctctggatgatggctatagttggagaaaatatggacagaaggatattctcggagctaagtttccaagctttttaataaatgcacaaagtgtcattaattctgaggctccgcatgatggtcttaaagggtgtggcagaggatattacagatgcacatatagaaatgtacaaggatgtctggccacaaagcaggtgcaaaagtcagatgaagacccaatgatatgtgaaataacctacaaaggaagacacacatgcacccaagcaagtcacttaaacaaaacagtgatacccccatcaaagacaaaggtgaacttgttgggagaaaataagcaccaaacccatcaaattaagaatcaaccacggcaagagaaaatagaacaacaaccaccagagacatttttcacatttggatcatcatcaggtcttgaagttaaaatagaggacatcgaccacaaggagggcatattcccatcattttgcttttcttctccatcaatagtagggtcagaaaatggggacgacaacaacagcagcatattctcatacaccatgattgagaacaacttaatggaaagcttctctcctgccttcatatctccaacaacttcagatatagaatcaaacactttctgccactgggggagcactggactaggccaaagtgtgcaaagctcagggtctgatatcactgatatagtttcagcaccaacttcagtcaccaattcaccaataatggaccttgatttctttttcgataagatcgatttcgacacagatttccctttgagcaccatggaactttgcacttaa

SEQ ID NO: 43108 - DNA, 2679 bp, Glycine max
  Peptide Sequence Number=SeqID_159886
atggaggactcaaccaagttgcgtttggtgcggtgccccaagtgtcaaaatgttcttccagagcttgccaattacactgtttatcaatgtggtggttgtaacactgttcttcgaggaaagcctaaaggttctgaaggtggtggtaggttgtggcaagcctcagatgaggaacaaggtgggggagatcaagacgcatcaggaagtttcttgaggaaaggggtagttgatttgagtgataattcagatgttgatgttaggtctagtggtggttcctccagggagggtcaaagaagggatttgaagaaatcaaataaaggacatgagaggtttttggatgattctagagatggggatgagaaaggggttttggaggatggttttaatgtcaataaggacaaaaggggtaagtcaattggaagggagcagcaggagcagaagactcacatgggaggggaccaattctatgggagaatgtctaatttgccaattggggaaagaggtgagatggaggggttttggagaaagccacaagcagatatggaggatgtgagatttgccactctgaattatcccgacgagggatcttcaaatagctattccagtttttcttacaattatggggagcaatggaggaattacaaggacatggatggtgtcagtagggttcagcaccttgagcaagatcgagccgagattctaaggaagctggatgagttgtccaaccagttgaacaagtcttgtgaggtggttagtaacccaaaagaaaaggttcttcctgagggaaagatggttcctccagatccttttagtggccctgaaactcggtttccagatggatcatcagcgatgaacaggtcctcaagacaattctttggccctactagtaataaacatatggcaggttccccttattttaattatcaagatccatatgcttatagaagtggtcatgaaatggctatgcacaacttctacccttctatgcataatcccaattatgttcctggatatggggatccttttgtatctgagatgatgagaggttcacatcctttaccccgtcagttcccgcaacaaccaatgcacccctactttcctggacgctatactgatactggtccagattcatatgatgcatgtgcacagaatgctatgcttcacccaccttcttgcccatgttttcgttgctatgacaacaaaagaagaggtccagtgccggcacctgctgcattcggtaacagcagattccctcataccccaaatgattctatgctataccgtcatgagattccaggggcagttggtccacatgttcataatgctagaactgccattcctgctgtgagtttgcatgaaaaacaactgcatacaagatggcccagagactacaattctgagatgggtggatttgttggaagccgtcctcgaaaagtagtgcctggtagtggtggtcgtcattgccttcctatagctggtggttctcctttcatcacatgtcatatttgctatgagttactgcaactgcctaaaaagacactggtcatggtgaaaaattgtcagcaaaaaatgcgatgtggagcttgttcttcagaaataaaatttgctgtcatcgataagaagctagttttttctcctcattcacaaacagaggaaactaccacatccacgagagttgatgatgccactaatgaggttgtgaatagtcgtgtattccatgcccgtggtgatgtgaacacgggtgctgcaaacttctcgtctgatgattattctggttatgattttcattcagttgatagagaatctcctgtgctggctgcagacccaagcttgaactctaccaagtcccgggagaggcaaagtttccattcttcatctcccagtacttctaatgatgaaaatagttctgaggttatggctgctccaagtgaagctcttaagtccattcatcaaccgactaaagcctctcagtcttcacctggtggttcatttaataatgctgtaaatcgattagggaaaggaaaccaaagtagtcggtcagatcaagagacggaaaaaatagaaaagaatgcctcaaggcagaattctttgaaagagctagtgcttgcaactgagatggatgtcattgattattctaacaacgggatctcccaggatttgggtgatgcaagcggagaacatgatcatcctagatctagcaaaaggggtgaatcatttttagcaaacattatcaagaaagataatgaaaaaaataatgttactgtaaacggacagcccatatcagattgcatgattaagaaggctgaaaagctagctggaccaatccagcctgggaattactggtatgattctcgagctggattttggggtgtcatgggtggaccatgtcttggaataattctgccattcatagaagagttccggcatccaatgccagataaatgtgctggtggaaatactggtgtttatgtaaatggtagagaacttcaccaaaaagatttagatttgctttctcgtagaggacttcctcgtgatagcaatagatattatattgttgagatttctgggagagtccaggacgaagacacaggagaagatctggacagccttggcaaacttgcaccaacagtggagaaagaaaggcgtggatttggcatgaaagtacccagagcagctgcataa

SEQ ID NO: 43109 - DNA, 291 bp, Glycine max
  Peptide Sequence Number=SeqID_159887
atggaaataaaaaactcaatccagttgaggtcgacgtctaccaattctgagcacaataatagaaaggattataatgaaaagaaaaaggccacgaatgtcattctacaaagttatagatgtgaaaaagatgcaccttctattttcaaatttggatgcatcttagtgatgacttctgccgaatatatgcgaaggttcttcagcatccctgctccaaatacgtacatggggcacatcttggatgatccagtggtcttctcctgtgacaccctctacccattacatatatactaa

SEQ ID NO: 43110 - DNA, 156 bp, Glycine max
  Peptide Sequence Number=SeqID_159888
atgtcggtaatggagaaaaggaaaggtgataatgggttggatttggcaatggcgatcgatggattcgagaagagatacaaagagatcaatcagaaaggggccataccaacggtgttgcatgatcatgggacccacatatgcttacttgtcaactaa

SEQ ID NO: 43111 - DNA, 1749 bp, Glycine max
  Peptide Sequence Number=SeqID_159889
atgttggagaaagttgaagaatttaacatagagagggtgatggaggaatttgagagggtgacaaaggatgctgagaggattcaaaaggaaaccctgaagaggattttggaagataatgcttctgctgagtacttgctgaatttggggttgaatgggaggactgatcctgagagcttcaaggcctttgttccacttgttactcacaaagatttagagccttatatcaatagaatacttgatggtgatttttcttctgttctcactggcaaaccgatcacaaccatgtctttgagttctgggaccactcagggaaagccaaaatatgtaccatggaatgataaactgtttgacaccacattgcagatataccacacctcttttgccttcagaaacagggaatttcccataaacggcggcaaggccttgggctttatctacagcagcaagcagttcaaaaccaaagggggtgtgctagcaggaactgccacaaccaatgtgttccgaaacccaggtttccggcatgcgatgaagacgactcagtccccattttgcagccctgatgaagtcatatttggtcctgattttcaccaatccttgtactgccacctcttgtgtggcctaatcttcagggaagaagttcagttggtgtcttccacatttgcacacagcattgtctatgctttcaggacttttgagcaagtttgggaggagctttgtgttgatatcaaggaaggtgtccttaacagcaaggttacagtgccctccgttagggcagcaatgtctaagctcctaaaacctgaccctgaactagccaatttgatccacagcaagtgcatggggcttagcaactggtatggcctaataccagagcttttccccaatgttaagtatgttcatggcatcatgactgggtcaatggaaccttatttgaaaaaattgaggcattatggtggagagttgcctttgttgacttctgactatggatcttctgaagggtggataggaacaaatgtgaaaccaacagtgccacctgaattggccacctacactgtgcttcctcaaattggctactttgaattcatccctctgagagagctagaaggagctaagggagattctagtttcctttgtatggaagctaagcctgtggggctcactgaggtgaaaattggtgaagaatatgagattgtcgtcaccaatccagcaggcttgtacaggtaccggctaggtgatgtggtcaaggttatggggttccataattcagctccagaaataaagtttgttcggcgtagcaaccttcttctaaccatcaacatagacaagaacacagagaaagatctgcagttggctgtggaagcagcatcagaattgttggcagaggagaaattggaagttgttgactacactagccacatagatttgtcaaaggagccaggacactatgtaatcttctgggaaataagtggtgaagcaagtgaagaagtgcttggtggatgctgcaacggaatggacaagtcttttgttgatgctggttacaccagctctcgcaaagtcaactgcatcggggccctcgagctccgacttgttcgtagaggaacattccagaagatacttgagcactcccttgcactaggagctgctgtgagccagttcaagacaccaagatgtgtaggccctacaaacaccaaagtgttgcaaatattgaatgaaaatgttgtcaagagctatctcagcactgccttcaattga

SEQ ID NO: 43112 - DNA, 483 bp, Glycine max
  Peptide Sequence Number=SeqID_159890
atgttgaagtttatatataggaaactccgtcgaaaccaatctaagaagaacaagctagcatcgaagggaaatcaagccatgatcatgaattcaccaacaccgaagggaaaagcaaatgagatagaagaagatcaagaagaaaaagcaatgccaatatgggattgtggtagtcctttatatgattcatatgaattagtctctcttgatcacatcattgatcggcatctaatggcattcccttcttcacatgaatcatcaatgtccatcatcacaagattcactcatcatgatatggtgccacacaaagttgattccacagagaaatccaaagggtctttcgtggtcacaagcttgagtaaatttaaggtgaagatcatgaggaagaagaggaagaacaatgaagagagaggaaagaagaacaatgaaatgagaagaggctttgctgaatttgtagtagatttgcttttcgtgtggaggaaataa

SEQ ID NO: 43113 - DNA, 129 bp, Glycine max
  misc_feature (8)..(8): n is a, c, g, or t
  Peptide Sequence Number=SeqID_159891
atggccancccaatgagcactacttgctacttggataaagatgaagccggtcaatcagtagatatcaagaaatatagagatatcaagccaataccaaagaatctcaccttagtgccgtcaaaagaataa

SEQ ID NO: 43114 - DNA, 411 bp, Glycine max
  Peptide Sequence Number=SeqID_159892
gaaaaaaggggaggaggttgccgcacagctcgcccagtttacaaaacaaaagttgaaaggaaagatattgagctggtagaggaggaagaaccacggattggtgctaattgttctagtgcaacctctaataaatctgacatttataaggaggaagcagggaatgcagcacagaagcataaagcaaagagggtggagagtgtcgatgctgatgcagaagcctttggtgatcactgggaaagtttagattgttctatgcattctgaagctgaagcactagaacatatgaaaaaaagagatacaggccatcaaagtgtgtcattggagaataagacaggagattcaattgtgctgaagataggagattcggctaaagttgtgatgaaaacaagacatgaagggaggagagcataa

SEQ ID NO: 43115 - DNA, 462 bp, Glycine max
  Peptide Sequence Number=SeqID_159893
atgacaagccgacaacctctacaagagccagaatcaaggataaaagatatggtggaagaacccatggaacatttcattgaccagaattattggcaggttcttgcaaatggtgggaaaaagaaaagcaaaaccatgagtaatagccccatgaagaattcaaaaagtgcagcggtggttttgtctgataattgcatcgaattcctgcagcccgggggatccactagttctagagcggccgccaccgcggtggagctccaattcgccctatactggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 43116 - DNA, 162 bp, Glycine max
  Peptide Sequence Number=SeqID_159894
atgacacccttggatgacaaaaccagaatgattgagactgagatggctttcgtgggactctgttttgcacccatccattgcgggacacatacaaagatgcagcacttgcgtaataatgttctcacatgtgcacatgaatggacctacacgtgtacggtttga

SEQ ID NO: 43117 - DNA, 804 bp, Glycine max
  Peptide Sequence Number=SeqID_159895
atggatatcgcgctttttcctggtcagaacaggcgtcagtgggctgacactatgataaatctcgaagcccgtaagcttgttaataccgcaaacaccgttgcggccatgcatatcactgactcactgacgcgcctgaagtttgttgatgagattagacaagtcatcatgcagcaatttgaagctgccaggcgcgccacatctgatgaggactgtattgcctgcctgaagatactgagatcagaaaacacttctttgctcgaacagtcacgcatgctcaagaccggctacgccaggatttatgctgaagttcgatatgtcactgaccagaataaaatagttggttatttcatatcaggcattaaggtcgtcctcgctggcgtacaagccgtttttggtggcgcaatgatcatttccatgacgccggtaggtatgcttgcgggagctatcctcatcggtgacgcttttaatacgatatccagagaagcggccaggcaattgctgaatgcacctgcctcacaagggatgttcgcagatagcgcgatgtccattgctgagttcatgggatttagtcgtgatgttggtcttggcgtttacaatgccactactttagcggcaagcgtctatggtgtgttcggattgacaggcaaagccgaggcctggcggttattcagatatcttccgggagattattatcgtaaagtgcaaacaatgtctcccggcaaattaagcatgaaagttttagggtggggagtcagtgcaaaggtggtactggagctactcacccacgacgatcaaaatcgctaa

SEQ ID NO: 43118 - DNA, 1548 bp, Glycine max
  Peptide Sequence Number=SeqID_159896
atgggcgagcgatacgcccgtgacacgggctacccgattcagtaccaatggacgctgctcaagggcgtcaatgacggcgatgacgaactcgacgccatcccgcgcctgctcaagggcaaattcggcgtgctcaacgtcattcccttcaacagcctggaaggcgacgactaccagcgtcccgagaccgaacgcatccgcgagatcgtccgtaccctgcaccgccgcggcgtgctgacgaaggtgcgcaacagcgccgggcaggatgtggatggcggctgcggccagttgcgggccagggcggtgggcgcggagcgggtgcccctcccggtccaggatcgtcatcccgccatagtgggtctgcagtatgccttcccgcgccagccgggtcagggcggtgttgcagcgctggcgcgacacgccgcacaggctggcgatctcttcctgcgagatcttgaggcggccattggtgccggaatgctgctcggcgttcagctgcgcggcgacggcgcgggccacggtggtgtcgacgtccagcagcacgttgcccgtgtagctggccatcagccagttgacgcgctgcgccaggtgcatcatcagcgccttggtgaactcgatattgttgttccacaggcgttcgcaggtgtcgcgcggcaagatcgcgacctggctcggtcgcagcgccaccacttcgtattcgaacggctcgcggcggatcatggtggcctcgccgaaccagctgccggtgctgaagccagccagcgacagcgatttgccgtccgagccgcgcgacgaccatttcaccaggccgtccaccacgccgtaccagcccagggacttcgaaccctcgcggaacaggcgccgttgtaccagggtacgacggccagcatccgttcgaccgggtcttgcttgggtcgccgcttcgggccggcaggttcatggccggttccggccgctgctgcgcgcatgggttgtccccgttccgccgtggatgagggcgcccaggtaaaccctagggcgctttgtcaacatgatgactgttcgcatttggggccggtccgagaatattcggggccccagagccaaaaaaccataagaggagacaggttttcgcgcgctgtcctggccggcgccatcgccggcgccctgctgcacgcgggcgcggcccaggcgcaggtgtccgacgacgtgatccggatcggcttcatcaccgacatgtccggcgtctattcggggccggacggccctggcggggccgaagccatcaagatggccatcgaggagatgggcggcgagatcaacggcaagaagatcgaactgttgacggcggaccaccagaacaaggcggacatcgcgtcggccaaggcgcgcgagtggttcgaccagcgtggcctggacatgctgatcggcggcaccaattccagcacggcgctggcgatgtccaaggtggccgcggacaagaagaagccgatcatcgtggtgggcgcgggcgcgccggccatgaccaacgagcagtgcacgccgtacacgctgaactatgcctacgacacc

SEQ ID NO: 43119 - DNA, 618 bp, Glycine max
  Peptide Sequence Number=SeqID_159897
agtggtacctggagatatgtcgcggggatcaagagaccttggggacgtcagggtgatagggcactggtaatcgattaccagttgggtgtaatcgattacatagtgctacctgccactgagaggaaatcccttgagaaagacattttgactatgcatagccgttatgggacgcattgtaatatcgcgatggcagcgcagttgatccatgatggtgttgtgatggagtgcctagagggtgtttgggagaccctcgaaggcaatgagaggtgccgattccgtggcacaattcgactcactgctacttcattagtacatctggaggaacccgcacacacacttcagcagcctgtggagtggatactacctacagctactccatatcgactagttgagctggttcaagtgatagaggtgtcatcctctgaagaagatcttgaagaggacccagaggagttacctcctgaacctgctacgaatgcccttgacttacctgaggatgatgaagacccactccttgatgttgattccctagaagatattatgtcagcatctgagccagactctacagaggagagtggccctggagggacagcgaatagtgacaactcttcatcgtag

SEQ ID NO: 43120 - DNA, 699 bp, Glycine max
  Peptide Sequence Number=SeqID_159898
atggtgcaaaaaggcaaggacgcagaaaaatatttcaagcatggatcgcatctaaaacggcctgaaggagctgtttcaagggagagcattagtgcagtgaagaaacttggtcatcttaaggatgaagtctgcaatgccacaaaatttgatctaccaaataaggatagaaaggattcccaaggaatatgctttttgggcaaggtatgtggagtgagcagctcctttacatcatatatatttcatggtgctggatttggatctaagagaaaatatatgtttcggaaagtgaccatccagctcaagcttgtggagggtgactctgctggaactggaccatttctatctcaatgcattgagcttttctcaagtgcagacaacccgatttgcatcaatgaattgaatattaccagtttaggcatcatggagattcttatttgcttaggtggctccatttcatccactggctccactttatatgtgctcatcatgaagttcctttatagaataggtggtgatggtcctcttgttgctttcggtgcatctgatggtgtcattagagttctatcaatgatgacatggaagcttgtgcgaaggtacactggaggtcataaggggtctatctcttgcttgatgtcattcatggctgcttctggtgaggtttttcgcatgactgattatctctatatattgcttttataa

SEQ ID NO: 43121 - DNA, 837 bp, Glycine max
  Peptide Sequence Number=SeqID_159899
atggatgcattgtggaaaaaaaaattgcaattcaatggtgaagatttcctaactagacttagagggaagagtatcatgtttgtgggagactctttgggtttgaaccaatggcaatcactcacttgcatgcttcacatagctgtgccacaagccccatacagcttagcaaggaatggagatgtctccattttcacctttccgacctatgatgttaaggtaatgttctcgcgcaatgcattacttgtggacattgttggtgagagtatcggtcgagtattgaaactagattcaattcaagctggccaaacgtggaaaggaatagatgtaatgatatttgactcttggcattggtggattcacacaggaagaaaacaaccatgggatttgattcaagtagggaatcatacatatagagacatggatcgcttggttgcatatgagatagcattgaatacatgggccaaatgggttgattacaatattgatcctacccgaacaagggtgttcttccaaggagtctctccagatcatcaaaatccagcgcaatggggtgagccaagagcaaacttatgtgaagggcaaactaggccaatatttggattcaggtacccaggaggaccactcccagcagagttggtattggagaaagtgctaagagccatgcaaaagcctgtgtatttgctggacattactaccctatcccaactaaggatagatggccacccgtctgtttatggctttggagggcatttggacccggattgtagccactggtgcctagttggtgttcctgatacttggaatgagcttttgtatgctagtctcattaaaaattaa

SEQ ID NO: 43122 - DNA, 351 bp, Glycine max
  Peptide Sequence Number=SeqID_159900
atggttgatcctgccaatgtaaggtcaattgaagaaggttctgttgatgctttattagaagctgagcgagttgctgaagcaacaaaacaggccatcaaacgaaaaattgcgcaagctgcatctatcgatttacagtctcggagtctacctgcaaagcttcgtatagaggctgatgatcctgaggatgtgggtgatgacaaggagaaggctggtggcggtggtgaggatccagaggaaaggcctggtggaaagatccagaaggccacatcatcaagagcaaaattagagaaaatgcaatttcttagttcaagccctccgcaacggcatcatttcactctaggccacttttga

SEQ ID NO: 43123 - DNA, 430 bp, Glycine max
  Peptide Sequence Number=SeqID_159901
atgaacaacaacaacggagatgacaaacttgaaatggtttctctggttgttccacacgttactgatgccatccaagaatggatagagagtgtggcacaaaaccagttgatgaaaaagaaggctcaactgatgtttgtgtcagagttgggtggaaatattgtggcgcgtggggcacaccttcgagctgagctggagcacgccgctgaaaccggtgccggtcccagggaccggcatcgcggcactgagcaagagcgaggtgaggaggcagaagaaactgtgggcagaggagtcgaggaggaggaaagaattggtgtcgaccttggtggatctgagcctctcagactcagagattcggcacctgaccacactagggtttgcgacaaagaaaaagggagatacaaggcaacaatgagagagaggaaagtgaagg

SEQ ID NO: 43124 - DNA, 225 bp, Glycine max
  Peptide Sequence Number=SeqID_159902
atgatttcactaacatcagaggttccagattatggcatgacttttgtgaatggaacttcatcaaaggcctgttgccaccccttgatgctccacaccatttgcgcaaacatgaatggggtccttatcgagaagttcagcttgagatgtttgatgattgcctttggtggactgcctgggttggaagagagtattgaagaagatgataacttaaagatatggccgtag

SEQ ID NO: 43125 - DNA, 866 bp, Glycine max
  Peptide Sequence Number=SeqID_159903
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatcatagcaaacataaagagacaggaagtctcattgagaataagaaaacacacaggacgtgagattcgacaggagtcaaatctaacacaccaatacgaagaaagccccatcaggatgatgggggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 43126 - DNA, 510 bp, Glycine max
  Peptide Sequence Number=SeqID_159904
taacaacgacggctttgacaaagaagttgtgggagaagttaagaagaagatagagcctgttgcaggttattttggtatcgcaggaaatgaccccaaatgtttggcacacccacaaaagtctctatacaatggaggaattatccaaaaaccagggaactggataatggacttcaaggcttggatacaagtgagtgagggaagcgacgttcctgtaacagcagttgtgaaaagaactacaagattaaaatttgctggtgccatttttgctgagtctaattgttggtctatgcttaagggtggtctcacagtggaagaatcaggacccgctgagctctattttgagggctctgattttgtggcaaaagctgtggatttagcagctagagaattaataacaagtgcatcactaggacaagttacacaggtacagcttgaccgtgccaaggtatccacgaagtctgcagttctaatgaatttagagtcagagtatgctctttctaactctcactg

SEQ ID NO: 43127 - DNA, 1299 bp, Glycine max
  Peptide Sequence Number=SeqID_159905
caacaacagaggatgatggccatggccaatttcgtgcaacctgccattcctcgctttgatggtcattatgaccattggaacctatttatggaaaacttcttaaggtccaaggagtattggcaagttgtatctgatggaattccagtagcagaggctagcatggcaatgatagatgcacgaaaaatagaaaatagaaggattgcattccatgaagaagaaataccaaggttccgcacgagcaaagaggcagtaacttcaaacacttcattcagaacggaagacaccattgtagttgagaagattcttcgatcactgactacaaaattcaattttgttgcttgtgttatcgaagaagcccatgacattgaggaactttcacttgatgagctgcaaagttccttattggggaaaaaggatgaggcaagggtagagccaacagaggcagaggtcgaggaagcaatgattgtggaagccaacaagaacatggcaaccaatgagaacatcaacaacaccatgagaatcaattccaaagaagaggaagagtcagaatgttggactaatttgaacaaagacaatggagagagagctaactttgcagaaaaggaaaaggaacaggtggtgtctattttgatggaggtgttctctgagttagacgagacttttcacaatacagtcaagtttggcgataactccactatctttgccatgggaagaggaatggtaacactctatgccaaagagaattcaactcacactatttctaatgttttgttagttccagacttaaaaaccaacttgcttagtgtgggtcaattacaagagaagggatatgaaatttctatcaaagatggcgtatgtcaaatcagagatgaaaagttaggcttaattgctcaagttaacatgacaccaaatcacatgttcccactttatctccactacaccggtcactcatgcttctcaaccaaattgaaagatgacgcatggctttggcactttcattgtggtcacttgaactttggtggattgaagactttgtggcagaaaaatatggtgatgggtcttcctcaaatcacaacttcctctgaattctggatttgtgataaagacagtgttcaacaacacatacaagttgattttgatggaggtaatagagaagaaaggcagcaaccttcggagaatgtgcaacccataacaattgagcaacaaccagcaggtagcccacacatttcaactgttgaaacagaagatgaacgacctcaacgtgttaagcaaagacctgcttggatggctgattttatg

SEQ ID NO: 43128 - DNA, 2438 bp, Glycine max
  Peptide Sequence Number=SeqID_159906
atggatgatggaaactatgttcaacccacgattcctagattcgatgatcattatgatcattggacaattgaagaggatagcaaattgaaggacttaaaggcgaaaaactatctatttcaagctatagatagaagtattatggagacaacattaaataagaatattgccaaggagatttgggactccatgaagcagaagtaccagggttctacaaaggtgaaaagagcacaattacaagctcttatgagggaatttgaaattcttggaatgaaagaaggagaatctgtagatgaatattttgtaagaactctggccattgtgactaagatgaaatcacatggtgaaaaggtggagcaacttacaatagttgaaaagatactaaggtccatgactgccaaattcgattatgtggtgtgctcaattgaggaatctaacaatgtgactactatgactattgatgaacttcaaagtagtctcatggttcatgaacaaagaatgagatggcataaagaggaagagcaggtgctgaagatcactaatgctgggagaacaggaggtaaaggaaggggtcgtggtagaggtggaagagggtgcaacaaccatatgtgtggaattaaagattggttctttgattttgatgataaattcaaagaatcagtgaaactgggtgacaatttgaggatgaaagttaaggggaagggcaaaaaatctgttgcacttgatatctttaagaagttcaagattatggttgaaaaggactatggaaactctatttgttgcttgagaactgacagaggtggagaatttaattcttgtgagtttaacagcttctgcagcaacaatgctgtgaaatggacaattcatgtgctcaatagaagtcctactctagctgtgaaaaatgttactcctgaggaggcatggaatggcaccaagccattagtcaaacactttagagactttggctgtattgcctatgctcatgttccagatgctcaaaggaagaagttagatgacaaaagtatcaagtgtgtgcacttgggagtgagtgaagagtccaaggcttacaagctctatgatcctattactaagaaagtcattgttagtagggatgtgatatttgctgagaaagaaaaatggaagtggaacaaggaagaaataggagaaaataagaatttagaagaatgcaaagatgataatgaaacggcagattcaccaaatcctgctcaagggaggaataggagacaaccggcttggttagaagactatgtgacaactgatgacctgcacaatcttgttatattcagcactgcggaaaatccaaatacttatgaggaagcaatgcaaaacaatgtgtggaggaaagctatggatgttgagattgaagaaattgaaaggaataatacctgggaactgactaatcttccttctggagttaagacaataggagtgaaatggatctacaaaactaaatgcaatgaagatggaacggttgaaaagtataaagctaggcttgtagcaaagggttacacacaacaacatggaatcgattataatgaggtctttgctccagtagctagatgggatacaattagaactattctagctcttgccacagtcaaaggttggaatgtgttccaacttgatgcaaagagtgcatttctgcacaaggaactgagtgaaactgtgtatgttgatcaacctttggggtaccagaaaaggggatttgtcaagtgttctcatgaacacaccttatttgttaagacaggaaatgaaggcacgttgctcattgtgagtctatatgtggatgatttgatttttactaggaatgatgaagagatgtttgttgtattcaagcaatcaaggaaggaagagtttgatatgacagatcttggaaagatgaagtatttcctaggcatagaagatgaagatgggaaggcaatagatgcatctttatacaagaaaatggtaggaagtttgatgtacctcactgcaaccagactagacttgatgtttgcagtatgcttggtcagcagatatatggagatacctaaaggaatgcatctagctgcagtaaaaaggattttcaggtacttgagaggtgtaactgaatttgggatcatgtatagaagaggaaaggaggtggtgactttgtcaaccacagaagctgagtttatagcagtagcttcctgtgcttgtcaaagtgtctggctaaggagaattttggaactacttggccatcctcaactgaagcctacaactgtatattgtgataacagctcaaccattaaactgtccagaaaccctgtgtttcatggtaggagcaaacacattgatgtgagatttcattttctcagagacctcaacaaagatgaagttatcaaattggttcagtgcaattcccaagagcagatctctgatattatgataaagcctttgaa

SEQ ID NO: 43129 - DNA, 129 bp, Glycine max
  Peptide Sequence Number=SeqID_159907
atgaagaaaaatggagcccaacaggcaacagggaggtctacatggaccccagaatgggttgtacacttagcaaagcaagtgaggaatgcacatgggaattttgaaatcaaagcccaactaaaatgctaa

SEQ ID NO: 43130 - DNA, 339 bp, Glycine max
  Peptide Sequence Number=SeqID_159908
atggaagcacaaaaaataacagtgaagggctatggcttggaggaaaaaaaggttcttaaggcaatcaaacgtgcagggaaagcagcagaaccatggccatttccggggcatgctcatttttcctcattttacaagtaccctagctacattgttaaccattattatgatgcatacaaaagtgaagcaaccaatggggtccacacattcttccacacccctgcagtgtattcagttgctgtggcatctgatgaagcctttgcttctctctttagtgatgataaccctcatgcttgcactataatgtttctgtttgaagagaaggtgaagaagaaaagttga

SEQ ID NO: 43131 - DNA, 735 bp, Glycine max
  Peptide Sequence Number=SeqID_159909
atgacttcctcggttacttcctcttttcgcatcagtcattttgtgaatctgtgcttggaattcaatgaagtggctgttgcattgaggatatttgatgaaatgcttgttagtggtataacaaataaattcagagtttcaactgttcctggtgctcatgttggtttcattagaaagactgtagaatgtaaggaatcacgaattgggaagcaaccaattcctgtgccatccaatgtcacagtcaaattggaaggacaggatatacaagtgaaaggtcctttgggagaacttgcattaagttatcctcgagaagtgttggttgagagggaagagtcagggactctaagggttaaaaaggcagttgaaaccagaagggccaatcaaatgcatgggctttttaggacccttacagacaacctggtgattggagtatctaaaggttttgaaaagaaacttcaacttgttggtgttggttatcgtgctatggtagaaggaaacgaagtcgtgctgaatcttggattttctcatcctgttaagatgataatccctgatggcctcaaagtgaaggtggaggaaaacaccagaatcacagttagtgggtatgacaaatctgaggttggccagtttgctgcttcaattaggaagtggagacccccagaaccatacaaaggaaagggtgtcaaatatgctgacgaagttgtaaggagaaaggaagggaaagcagggaagaagaagtaa

SEQ ID NO: 43132 - DNA, 174 bp, Glycine max
  Peptide Sequence Number=SeqID_159910
atgtccaccattagcatcatttccactcagagatgttcaaattttattggcaacaggggtggtgcagggggggtagcaagtaagtcaatggggacagacaggggagagacagaggagaggatagaggctttcattgcttcaaacaagaagagctatttccatcttccagtctag

SEQ ID NO: 43133 - DNA, 359 bp, Glycine max
  Peptide Sequence Number=SeqID_159911
tagtgcgttcgtccgctgaagctgagtatcggtcgatggctagtaccacgtgtgaactgaagtggatcaagggagttctttccagtcttgggatcagtcattcgatgcctatacaactctactgtgacagtcaagctgcgctgcacattgcaaagaatcccgtctttcatgagcgtactaagcatattgacgtggattgtcacttcatccgtgatgagattgttcgtcacaccctgcaaccgtcttatgttcccactcatgcacaacttgcagatacatttacaaaagctttaggtcgcgctcagtttcattccttgcttggcaagttgggcatttggagtccacatgcaccaacttga

SEQ ID NO: 43134 - DNA, 240 bp, Glycine max
  Peptide Sequence Number=SeqID_159912
atgagaaagaacaacgaggttcaggaggttgttgtaatcacgccgcgtcaagaagagattcagggatcgggagggcatattcgtaattccaaggacggaatctggtggccagtgacgaagacgttgccgcgatccaccgcggttctcctcttccccgtcgtgctcatcatcgccgcgttggcttacacgcgcacgctcgacacacatagacacgttgctgaattccttagtaatcgttag

SEQ ID NO: 43135 - DNA, 3213 bp, Glycine max
  Peptide Sequence Number=SeqID_159913
atggcatcagagcaaggtcctgatggaaaaaaatctgtggtaaatgttggggtggtaaagaagacgccatctccgtatgatttgaattcgaatgacaacccaggaagcataatcacccaagtccaacttcggggaatcgtaaagaagccgaatgaagaatcaccagaaatggaggattggtggaccgtccaatcgatggtggtgtcttggatcttaaacaccattgaatcttctctgcgttctactatttcctacatggagaacgcaaaggaactttgggacgacattaaagagcgattctcagttgcgaatgggccaaggattcaacaactgaaatcggaacttgctgaatgtaaacaagaaggaatgtccatggtgaactactatggaaaactcaaggcattgtgggatgaactaggaaattaccatcagataccaacatgcacatgtgaagggtgcaaatgtaacatcaaggcaaaattagagaaacaaagggaagaagagaaagtgcaccagttcctgatgggattagatgatgtggtgtacggaacgactcgctctagccttcttgtgaccaatccactgccatcgttgaatcgagtatgtgctactttgatacaagaagaacgtgtgaaggccatatctaggaccaaggaagaaagaacagagattgttggtctagctgtgcagaccggtggaagggctagaggacgcggagacacaaaagacaaaggcatagtctgttcaaactgcaatcggacagggcatgataccatgggatgttttcaaattgtcggatatccagattggtggggggataggccacgccatgaaacaaaagcagatgctcgaatgaaagggcaacaacaggaacgcagtgcaaattctggacgcggcagaggcatgggtgtacgagcaaatgctgcccaagcaactattggaagaacagttgaggcagcggcaggggtagacaacggaggattggccggattgagcacagaacagtggcaaactcttatgaatatgctggacagccagaagggaaatcctagtgaaagaatgacaggtaaagaagattggattattgatacaggggcttcaaatcacatgacaggaaatttaagattgcttcaggaattgaaggaagtacagggatgccctataggtttgccagacggacagaaacttggtgcaacgaaggaggaccgcacttcgaggatgctgattggattgggtgaacgaatagatgggctctactacttcaaagggacacgaaatgagaaagctttcaaaattgatagtggcctgtcacttgatatttggcataggcgaatggggcatccttctttgaagattacgaagttggtttcaaataatagtagtaggaataatgactatgaaaataaggcatgtgatgtttgccaaagggctaagcaaactagagatagctttcctttaagcaataataatgcagcagatgtgtttgagttagttcattgtgacatatggaggccttataaaactccatcttcatgtggtgcttattattttttaactatagtggatgattattctcgagcaatttggattttcttgttgttagataaaagggaagcacctcgtgctttgttgaatttcattgcattagtagaaaaacaatatgaaaaatatttgataaatagaacaccaacaccattgctaaatggaaaatgcccttatgaggtgttgaatgggaagccacctacctataaacatcttagagtttttggatctctttgttatgcacataatcaaggaaggaagggtgacaaatttgccagcagaagtagaaagtgtgtgtttgtagggtacccacatggaaagaaaggatggaagctatttgacttggataccaacacttattttgtatcaagagatgttgatttttttgaagctgaatttccttttgggcaagaacctgtgatctctagtggtgagtcaatgacacacatgctagatggagaggctcttgctgatgatgaaaatgttcatagggagcaatttgtaaatgttgagttgccaagagaagagagccatgatgacgtgaggggggaactcgatcgaggaaagcgtgctaaaattccttctacaaggctccaagattgtgtgaccaatacagtgaaaacatcagagagcccatctgctagttctcccatctcacagcatcaaacaaaggtacggtatcctattgctcattacactaactatgaaaaattctcattgcaccatcgcaagtttcttgcagccgtggtagtcgatagagagcctatgtcatttgcagaagcaataaaagacagcagatggcgtttagcaatgcaacaagaaatacaagctcttgaagataataatacatggaaagtgtgttccttgccaacgaataaaaaggcgttgggatgtaagtgggtatataaaatcaagtatcattccgatgggaccatagaacggtttaaagctcgactagttatccttgaaaatcatcaagttgaaggcatcaactacaacgaaaccttcgcaccagtggcaaaaatggtcaccgtgcgaatcgttctagcagtcgctgcagcgaaaagatgggagcttcaccaaatgggcgtacataatgcgtttcttcatggtgatttaaaagaagaggtcttcatgaaatttccccccggcttccactcctctcagccaggtatggtttgtaagcttcaaaaatcattgtatggattaaagcaagccccgcgttgttggtttgcaaagttgtcttcggctctcaaagattatggctttgtgcgatcatactcagactactctttgtttacattacaagataaagacattcggctagtggtactagtgtacgttgatgatttgattatatgtgggaatgatcacgactcgatacaatgcttcaaagactacttgagaagatgctttcatatgaaagatctgggaaaattaaaatacttcttaggggtggaagttgcaagatcccctaaaggtgtgtttctttgtcagagaaaatatgctctagatattattagtgaagttggtttacttggtgcaaaatcggctagtactccccttgaacaaaatcatcatcttagcctctctaatagcgagcttcttcctgatcctgatcgctatcgcagcaaccgcaaactgagcattgggatgctgctctgcgagtag

SEQ ID NO: 43136 - DNA, 351 bp, Glycine max
  Peptide Sequence Number=SeqID_159914
atgccttatgaatcctcctgtgctcatgccaccgatgcctgggaggggcagcatgacgattccgagaagagggaacgggttgtctactacttgagcaaaaagttcaccgcttgtgagatgaattactctttgcttggaaggatgtgttgtgccttggtgtgggcagcccattgtctaaggcagtacatgctaagccacaccacttggttggcaataaagggaagcgccttggcagactatctagctcaggagcccctcaatgactaccaacccaggcatccggaattcccggatgaggacatcatggccttgtttgaggaagaagtggaggatgaagatagggataagtaa

SEQ ID NO: 43137 - DNA, 217 bp, Glycine max
  Peptide Sequence Number=SeqID_159915
atggctccgaaaaagctttccgcaaagagatctaggagggacactgcggctgaagggaccagtgctgccactgagtttgatagccaccatttcaggagcgccgagcacccgcaatgtttcgaggccatcaaaggatggtcgttccaccgagagagacgcgtcccactcagggacgatgagtacaccgattttcaggaagagatagctcaccgacatt

SEQ ID NO: 43138 - DNA, 273 bp, Glycine max
  Peptide Sequence Number=SeqID_159916
atgccgatgttggatcaatttcatctgtgcattcatgattcaattaaaaatattgtcgatgtcaaagctaatagtaacggtggatatcatgcaattgttgtcttattaagtatgagtgaagattcatgggcgttggtgtgcaatcatttgcttaaagaacttgccaaatggtctgataagtatatcaacctctttggtggcatagataaatttgaggaattaaagaggtccctacttgttgatagattatccatagttattatggataagtga

SEQ ID NO: 43139 - DNA, 366 bp, Glycine max
  Peptide Sequence Number=SeqID_159917
atgtcttcccctccttgccttttcaaagaccatcaaagtcttttgtttcaaagattatcagaatctttcgtcgagacttcaatgtctcctttactttgcaagactacgaggtcttttgttgatatacctgatggctcttatgctctctctctcttgacaggtttcactgcatgggcttccactggtggtcggtcggatgatgagatcgctcaaatgaaattaggccgaattgagctacttaacaccaattgtcgcgcaatccataaggtttttcgatgttttggaaaaaaatgtggaaagtacccaaaaggaaggtcaaaatggtcacttggtgacctggctcgcctaggccaccagaaagcttag

SEQ ID NO: 43140 - DNA, 342 bp, Glycine max
  Peptide Sequence Number=SeqID_159918
atgggggtggctcctcaatcctcactctacctacctctctctgtctctcacaaattcactgatttgggatttggagttgccaatttggagttgccactcctgtacttcgatctcctcttcgatcttgattccgccatagacaaggacaccaagaatgttgctgatttacttctgttcttctctttgtttggaaacttgcttgaactctacattttggagagcaaaatttgtggttctgtccacactttactctgcccacttgcttttctttttcaaatccatgatggcagctttattaatgtcttccatactcgttgtctccccagtgatttagcttggtga

SEQ ID NO: 43141 - DNA, 405 bp, Glycine max
  Peptide Sequence Number=SeqID_159919
atgatcattcagtgttttgatcaagaatgcaaaaaatatgaaaaagggggcaaaagggtcttttccttggttttcctggaccctagctcgcctaggctagcctctggcttgcctgggccaccaaatagcttcatggtgaagaaaccaactcacctgggcgagctgcaactgccccaaagtgaacctttgcctataaataggtgtcctaggggttccaagggtcagaagtggagagaactgagagaagagagaaagaagaagaagaaagaagaggaaatgaagccgaggcgctaccgaattgtgactgtgatcgtccctacgttgtttcttgttttgtgttcgtgcgactgtcgactaaaagaactacgtaggtctaaattcctcatcgcacctgaggatacgtag

SEQ ID NO: 43142 - DNA, 378 bp, Glycine max
  Peptide Sequence Number=SeqID_159920
atggcgttcctctcgctggtgccggccatcggctcagcgattgtctgggtaccggccgccattttcctcttcgccacgcatcagatctggcaagggctgtttattgtcggcttcttcgtgatcgtcgtcgggctggtggacaacatcctgcgcccgctgctggtggggaaagacaccaaaatgccggactacctgatcctgatctccaccctcggcggtatggagctgtacggcattaacggctttgtcattgggccgctgattgctgcgctgtttatcgcctgctggaacctcttctccgggcgcgaccacgaaggcaacgccgaagagctggacgcggatttcattgaagagggaaaaaaacctccagatttgtaa

SEQ ID NO: 43143 - DNA, 129 bp, Glycine max
  Peptide Sequence Number=SeqID_159921
atgttgggaggaatagcttggtgcattaacagcaccttgacatcacaacaaaggagagacaactccactgaggaggcacggcccctaacgccatcaggcatagggcctggcagcatgaggcctccatag

SEQ ID NO: 43144 - DNA, 1146 bp, Glycine max
  Peptide Sequence Number=SeqID_159922
atgactatgaggttcatcatgaaagaactccctactcctgcacaaaagagaggagtccttgagttaaattctcatgattcaatcttggctcaaaacaatttgctcactcaacaacttgatgcactcaccaagaaaatttcaaaaattcctcaactccaaagtgggcaagctcctcaatctggtgctcaacaagttttaagttgtgctctttgtggaggtggtcacccaagtgatcaatgcttcatgctaggtggttcccaagaagaaatgaattgcatgggaaatcaaaactgccaaggaatttatggcaatcctccttatagcaatgcctttaatcaagggtggaggaacaacaacaaccttgatgatgaggaaggtgagattgaggaagaaagtgagaaaaagtgtaagggtagtgaaaaagttgagagtgagaaaaagaagaaaaatgaagaagaaagggagaaagaggtgtggagagatttacttgaccttgaagctagcatcaatcttttgactttctcattattggcaaagaatagtgatcttgatcttaagtccacctggatgactctccaattggtgggccgttccattaagcatccatatggtgttgttgaagatgtacttgtcaaagtggataaaaccatttttcctgttgattttgtagtgatggacatggaggaagactcaaaagtgccatttattttgggaagaacctctatgcatgcggctaagatcttgcttaatgtgcataatggccaaacaaagctaagggttcttattgatacatttgaagcgcttaatgaggaagaagaaaaggtgattggagaatgtctaccaagtcttgatgctttgaaagagattcctccacatgaggtaaaaaaaaaagaggaaggaatgaaggtgaaaaagaagataaagaaagtcaaggatgagcttcatatgcttcctcttggtcttaagtatgtctctttcaaagaagatgatgaaaaacaagctatcatgagcaaactcaaatctaacttctacaagtcaattgctaggaaactcaaatccaaattgtccaaacactccacaatacaaaattctaaaccttatggagttgtggaacttgaagaacctacctctcaaaagaattgggtg

SEQ ID NO: 43145 - DNA, 282 bp, Glycine max
  Peptide Sequence Number=SeqID_159923
atggttttgaaagaggagttagttgcctgttcaaggtccaaaagaagcttgtctcagcgtttatgcgagacggagaccaacatgctagctatcatcgccaagtaccaagaagagttaggtctagccacggcccacgagcataggatcgtggacgagtatgcccaagtatacgcggaaaaagaggctagaggaaggataaatggcagcggaatggagaaggaagagagagaggagacgccacttcaaggagaagatgagtctagaagaagctcaccaccatag

SEQ ID NO: 43146 - DNA, 738 bp, Glycine max
  Peptide Sequence Number=SeqID_159924
gccgctttccgtggtggtgagcggtttgtattcacagccgatccagccgcggtaacccatgcgatccagctgcgcgaagataaactcgcagttgatttcgccggtgcccggctcgtgccgccccgggttgtcggcgacctgaacgtggtcgatcttcgccagcaggcgctcaagggtctgcgtcagctctccctccatgcgctgcatgtggtaaaggtcgtactgcagatacaggttggggctgccgatcgcttcgatcagttcgatcgcctgccgggaggtttgcaggtagaactgcggcatgtcgtagcggttgatcggttcgatcagcaggcggatattctgccgcgccagggtgtcggcggcgtagctcaggttctccttcacccgttcgtcggtggtgtggcggctgacggcgggatccggattgccgatcaggcagttgatgcgatcgcagcccagcgcctgcgcatactcgatcgcgcgcccgacgccgtcgcggaactccgcttcgcgccccggcaagcaggcgataccccgttcgcccgccgcccagtcgccggccggcaggttgaacagcacctggctcaggcgatgcgcctccagttcgctgcgcagcgcggcgatcgggtagtcatagggaaacatgtattccaccgcgctgaagccctgctccttcgcccggcggaagcgctgcatgaaatcgacttcggtgaacagcatggacaggttggctga

SEQ ID NO: 43147 - DNA, 903 bp, Glycine max
  Peptide Sequence Number=SeqID_159925
atgcggtctgataatgctaaagaattagctttgactgagtttttgcagaatgtaggagtagttcaccagttttctttcccacacagaccccaacaaaattcggtagtagagaggcgccatcaacacctattgaatgtagcacgtgctttaatgtttcaagctcagttgccaatttatttttggggagagtgtgtatccacgacagcttacatcatcaatagaacaccaagctcaaatatgcagaaccagtcaccatatgacttgctatatggtaaagtaccagcctatgatttgatgaaagcgtttgggtgcttgtgctatgcagccactatccctactcaaagacataaatccactcctcaaccaccacctgaacctgaaccacaacttgagataaaaccagaccttgcccaacctgatgttcaacctaatgcccatttctatcatcaagcagttcgatttcccgaatggcgtcaagccttgaatgaggaaattcaggcccttgaaatgaataacacttgggttgttcaacctctacctcccgatggctcccttgacaagtacaaggcccgtctcgttgcgaaagggtacacacaacaagcagggatcgattttctggacactttctcacctgttgccaagcttactacaatgagagtgctactttctgttgtagctcacagaaattggaacatgttgcagcttgatataaataacacatttctcaatggtcatttgattaaggaaatatacatggacatgtctcttggttatcctgtcaagaatgataacatgcttccagacaatggtttcacaagttctccaccacctttcttgatcaaggatttcagcaatgccatgcagatcactctttgttcactagaaggagtggagcaactctag

SEQ ID NO: 43148 - DNA, 255 bp, Glycine max
  Peptide Sequence Number=SeqID_159926
atggaagaaaagaacaccaaaagagaaaaggagaggtgttttccacccagctcacccaggcaagctgggttgcttccaccagaagcaaccttttctccagaatcttttggatgggccaaaatgggtccaattgctatttacacccccattttgttaaatacaccctcattttcgtgtttttggctaatttctttccaaaacgtcgcagaactttatggattacgcgacgatgcttgtttaagtgtcccaaagtga

SEQ ID NO: 43149 - DNA, 381 bp, Glycine max
  Peptide Sequence Number=SeqID_159927
atggacgaagattggtatatgcatgatagtataatgtctgaagaagttcatatgaatgaacaaaataaagacgacgctggtgtaaatgaagaacatattgattgttttgatgccttcaatacttcttcggtgtttgctagtcgtgatgatgttttgcattgggttcgatttgttgcttatgaaattagttttgtgacagtgattatgaggtcagacacaaatactgatattagaggaaagaccttatttgttttaattggttgtgaaaggagtggtcagtatagggcaaggaagaaagatttagtaacaacagttactaggagtagaaaatgtgggtgtccctttaagctgcgtgcgaaaccagtggttggaggcgaatga

SEQ ID NO: 43150 - DNA, 471 bp, Glycine max
  Peptide Sequence Number=SeqID_159928
atggatttttacaaggttgaaagaaatctcaaggaccgcaggtcgcttggggactggataaaaggtgctcaggagaaaccaataactaaacatcaaagatcaacaaagcatgatccctcttactgggagtatgttgatgcattacattctatgcaaaatagtaatttttcagtcaaacatagtgcatcatcatctgaccaagcaagaccaagaaggaccctgtcgatgttggatctatttcatccatgctttcatgattccattgaaaacattgttgatgtcaaagttgatggtatgggtgaagattcatggtctttggttcacaacaatttgcttaaagaacttgcaaaatggtctaatgagtatatcaccctacttggtggcataaacagatttgaggaattaaagcagtccctacttgttgatgaattatccatgtatataattttttcttatgttttgatggattaa

SEQ ID NO: 43151 - DNA, 527 bp, Glycine max
  Peptide Sequence Number=SeqID_159929
ttgtccctgttgctaaagatgttcatcacatgaatgatgtagctaacaaggtccatgaacagcctcaagaagtaattcctgatgcccagggagaggtgactatcaccctcgataatgtggcctctttgctttatccacccatcatagacgccttccatagcttcgagactcttcatgttgatgaagcggtgttgttcaaatgtgatgctgcacactggactgtagcagctcaagcttatctgttgcatttgctaggttgcactctttttgctaacaagactcacatgcatgtggtgttcttggacgcctttcgagacctcacccagagtggaagctacgcattgggagcttctgccctagtgcatatgtatgacaatttgaatgatgcgtctaagcgcaacgatttaatggttttcagatatggatgtagcaccttcaacagagtcaccacggtcgataatggcgtcgatgcagaggagataggcgtggacgtgccactaggcgaggtcaagctcgcggttctctaa

SEQ ID NO: 43152 - DNA, 300 bp, Glycine max
  Peptide Sequence Number=SeqID_159930
atgaaactaacctcgatgtcggagaagaacgaacgaaacacaggtggaaatggccgcagaagaagacgaacaagcataatggcgctgaagacgaacacgaggcaccttgcggaagagaagaggaatgccaagcaccttgaggaagaagatgaatacaaagaacttgcggaagaagaagatgaacgaaagaagttgaggaagaagaagatgaacggaagaagagtggcgcttttttatttaaagttaatgaaggacaattttgtccattcactaaaagtgctgggtgcaccaacaatgtag

SEQ ID NO: 43153 - DNA, 363 bp, Glycine max
  Peptide Sequence Number=SeqID_159931
atggaaaatgggtgcatgtatgaagaagagaacggcgcagccagtacggaagccaccacggagggtggcgtgctgcccgacgcaccactggtgcaaagtccaacggcacgaggccaccgtggggctgacggtggcacgacaacgatggcggcggaaatttcacagtggtgcaaacaaattaaaagagaaaaagaaaccaaaacgaaagtgatatggcccttaacgccaccggcgacgggcccacgggcgcgaaactaccacgggatagtggcagagggtggcggtggcatggacagaggcatcgcagcctcactggagttggcaataaaaaagagaaaaacattgataagccagaacaaataa

SEQ ID NO: 43154 - DNA, 708 bp, Glycine max
  Peptide Sequence Number=SeqID_159932
atggttacctcaaagaaaccacaaaagaaagggttaacgcgcttgagcaaattacctcctcgggttggaattgcgcttaacgtgcttgtctcgctaagagaatttccttctcgggttggaattgcgcttagcgcgcatgtctcgctaaattgtgatggaagcctggaggagccaaaatgtagagggggaggagcatatgtgtttaaagagaaattaaaaggggttaaagtttccttgagaaaatggaatttggaggagtttggtatgacacaaaggaagcaacaattaatagtgaaagaaatgaatgagctagacattttggaagaacttggaagcttggatgaggaaagttccaagaggagactccaacttcaagaagatctttggaaggtcgaaaaattcaatgaatctttgcttcttaaaaagtcaagggtgagatggatcaaggagggagattgcaattcaaagctatttcgctctataataaattggagaagaaggaagagtttgttgaaaggtatggatgttgatgaggagggggtggaagacccggggagagtaaaagaggaagtggagaatgttttttttgaaaaaagattcaaggaggacaatttatatagacccaaggttgatggagttgctttcaaacaaatcttaatagaagataattctttgttagaggcggtgtttgaggaagaagaggtgtaa

SEQ ID NO: 43155 - DNA, 340 bp, Glycine max
  Peptide Sequence Number=SeqID_159933
atgtggaaaattcttgtggaaatccaaataaggttcttgtggggaggggatgatgagagtaaaaaaatcccatggggacattgggaggatatttgtaaaagtaaggagatgggagaccctagctcgcccaggctagcctatggctcgcctgagccaccaaatagcttcatggtgaagaaaccagctcgcttgggggtccatggctcaaaagttgagagaattgagagaagagagaaagaagaagaagaaagaagaggaaacaaagccgaggcgctaccgaatcacgactgtgaccgatccctacatcgttccttgttcggtgttcttcgtgcgaccgtcg

SEQ ID NO: 43156 - DNA, 131 bp, Glycine max
  Peptide Sequence Number=SeqID_159934
tttttcatgaggaaaaatactgtagttgggggcatgtcactcagtttggatcttccttgagactcaagctgatcaccatggggaagaagttgcttgtgcacgacagggtgacctcgacacttgttgcctag

SEQ ID NO: 43157 - DNA, 2158 bp, Glycine max
  Peptide Sequence Number=SeqID_159935
gtgacaccagcggtgaccagtcgaatggcgtaactgccagcaatgccggtacgaaagtgaatctggataacagcaaggttactaccgccggagccagtgcatttggtctgtatgccagtggtgcttcaacgttggatgccagtaatgtgcaggtcactaccagtggtgataaggcctatggcgtagtgtccgaaagtgccggcactgcactgactttcacgggtggagaagtgacgactggcggacaaggtgcatatggcttatatgccagaactaattcaactcttaacgtcggcaacgtgatagtcaacaccgctggcaaaaatgcgcacggcggctacgttactggcgaaggctctgtactgaatgtggacaacagttcgtttattgtcagtggcgcagaagctaatggcctgcaggcggacggaaaatcgacgcttaatgccacaaacaccgcgattgagattacgggcgacggctcaggcacttacgcatcgggaacaggcacggtgctgaacctgtccgacagtcacattcacatggggcagaatgccggaaacgcagcactggggaagtataacagcacgaccaacctcaaaaatgttgaaatcatcactgacgccagtaatgctgctttggcagtgggttatggcgctacattaaacagcgataatgttaacgtgcaggcgcgcagcgggggttttggcattcaggtccaggatggcagcaccttcagcggtaataatattacaattcaaaaaagtggcacggactctgaagggtttaatgctgcaataaatatgacgaatttatattatcctgatgcacgaaatactcttttcctgagcgatgcagctatcaatgtatccggcgaaaatgccaccggcattctttccagacgacaggccacgctggcggacattaagctcgcgaataccaccatcaccgccaccgacggcaccgccgtcaacgtgctgaccggcaccagcatgaatattgacgccgacaactcagtgctgagcggcagcacgctgctgaaaaccggctataacacagcagaaggttcaaccgccggctcggtggtgctgaacggcagcaaccgctcgctgttcatcggtgacgtggacattgaccgcagccagaccaccgacagccagatcaacctgagcggcagctcggtgtggaccggtgcgtcatccggcctcaatacgctgacgctgaacgacaacagccagtggaatatcatggacaacagcagcgtcgatgcgctgaccgcgaacaacagcgtgatcaacgtggcgcacaacaccgcgaacttcacggtgctgactgttaacggcaactacacggcggacaacgccacgctggtgatgaatgcggcgctgggcggcgacacctcggccaccgaccggctgcacgtgctgggtgacgtcaacggcaacaccgacgtggtggtgaacaacgccggcggcagcggcgcgcagaccattcagggcctgcaacttattcaggtggacggtgccaccaacggcgaattccgccagaaagggcgtattgtcgccggtgcctatgactacaacctggtaaagggcgcggatcagcacggctggtatctggtgagcgataaaaacagcagcgaacccgatccggtggtgacgccgggcgagggcgaaggcggccagatcgtcgagccgccggtaaatcagcacaacatgatcgtgcgtccggaagcggcgagctacagcgccaacctcgcggcggccaacacgctgtttaccaccagcatggatgaccgtccggcggaaaccttctacaccgacgcgaacggccagcagcagagcacgcgcctgtggctgcacaacagcgccggccacagccgggtgaaagacagcagcggccagctgaagtcagacaccaaccgctacgccatccagctgggcggcgacctggccagcggcacgctgaccggcagcgacagcttgcgcctcggcgtgatggccggctacggcaacgcgcagagcaagtcgcgctcggcggtgagcggctaccagtcgcgtggtcaggtgaacggctacagcctgggcgtgtacggcagctggctgcagaacgcggcagagcagagcggtgcatttgttgacagcgcgctgagctacggctg

SEQ ID NO: 43158 - DNA, 555 bp, Glycine max
  Peptide Sequence Number=SeqID_159936
gtcttgttcaaactacgacctcgacgtcagtcaacggccactggaagtcaatattccaaattggctaaaaggttttacggtccctttcaaattgtgcaaaggataggacccgtggcttataagctagacttgtcggagtcttcacgcattcaccctatatttcattgctctctactcaagccatatcgacaatccactactcagccggaggcacctctaagtctgccacccttattggaagagcaccaacccctcattacccctttgttcatcctggacaccaagtggactcaatcaggggaggataaggacctacttgtcctcgtgcaatgggatggcttactgtcggaagatacatcatgggaaccttgggcacaattaaagtcagactataaccttgaggacaaggttattttggaagcgcaaggggatgttaagagcagaaacacacaagcagaagaggcagacacagaacaacaagcagcaaggaagcaacatgggaaagcaaagaaaggagaaggacaaaggctaaagagggaaattcacaaaccttag

SEQ ID NO: 43159 - DNA, 273 bp, Glycine max
  Peptide Sequence Number=SeqID_159937
atgagaaccattgttgagcatctcgaaacggtacaagatttgaagtactcttgtaggttcccactgcaagagccagcaaaagaaatgtcaagatcaccaagtcttaatggtatcatatgtcacgcaccacctaggttgagtttctctccctcagcagcatcagtagtagcaagaccatctgtttcatctcctagatggtctgccaggtctggtggtgtgcccacactgcatcttcctcttcatgcttgttcctccagttcatctcctaggtag

SEQ ID NO: 43160 - DNA, 678 bp, Glycine max
  Peptide Sequence Number=SeqID_159938
atggagcagcgtttatctagtcctcaacctttacctcttccatcacatcagggtggtggtgcattgaaagctattgacagctttaagtcggggatagctagtgtatctctgtatgcttctggaccagctcctgatgtagcagaacaagatgctttttcctcagttgagtatgaggaactagaagggttgaaacaccgagttggattgatgaaggagcaatgttcatctattccgcaacctttgcatcttccgcctacagggttgattagaaactttacatatgaagaaattgctgctgcttgccacaacttttcttcagatcgatgcatgtcagaacgtctttcttctaccatatatagtgcttcatttggtgatgatgcttcaagtgcgaagaagtttgaagccactgtcacccgccttcattcatcaactcatggattgaaggaattcataaatgaagttaatacccttgcatctttgcaacatccacacctctgtaaattgctaggatttcatgcatgtgatggttcggaaccaaggatgttggtttatgagaggctatgccatggaagcttggaccgccagttgtttgggagatctgatggttcttcaattgattggaactcgcgaatgaaaattgtcatatgtgctgcacaaaggtcttactttcttgcatga

SEQ ID NO: 43161 - DNA, 2304 bp, Glycine max
  Peptide Sequence Number=SeqID_159939
attgcaagcaatgaaaagcctaatggatctgggacatcaaaagtacaaaatgtcagtacacagcagcagtgcacatctctggctaaccaattaactgtgaggggtatgcaagtagggcattatgcagagaatgatgagcttcagtgctggttcaaaactcacaacgttgaaacagatgggccttttgcagaaatgaaaccagaaattttaccctcagttggagaacttggaaacacattgatatcacaatttcattgtgagtctaatggatcgtctaaggcttccaaagcagagaactgtaagccagagacagaaatgcgagatatatatgaatcattggcacagacaaatttgagtatgacccttgctgctcctttaggaaattcaaatccctttcatagtgctgttgttgatgaaagggaacaaagtaaaacatctccacttttattggggtcaaggtctcaccatcttttacctaagcctgctaggtcaactattgggacaagcttagaagcaaatgctggcatggtatcgcagattcgtgtagcaagaccacctgctgaaggacggggaaggaatcaattgcttccacgttattggcctaggattactgatcaagagttgcaacaaatatcaggagagtatccaacattttcaaattctacaatcgtgccactctttgaaaagatgcttagtgcaagtgatgctggtcgaattggtcgcttggttttaccaaaagcatgtgctgaatctggtaatttgttaaaactgaaagaggagaccattgtgcaggcatatttccctccaatctctcaaccagagggccttcctttacgaatccaagatgtgaaaggaaaagaatggatgtttcaatttagattttggccaaataataacagcaggatgtatgttttagaaggtgtaaccccctgcattcagtctatgcaattgcaagctggagatactgtaacatttagccgtatggaccctgaggggaaacttataatggggtttagaaaggcaacaaattctactgcagtacaggaaacactaccatctaatatgcccaatggttctcattcaagtgaaacttcctattctggtgtttatgtgaatctacctatattaagtggttactctggccttcttcagttacaaaagggatgttcagaaacccacctaaatgcgctgtctaaaaaatggaactcagctggtggtgacatgagttggcataacattgacatgcctgaaagcagaaaaagagatgagttgccgttgccacctgtgatggttcctgagaagaaaagaactcggaatattgggtcaaaaagtaagaggttgcttattgatagccaggatgcactggagctgaaacttacttgggaagaggctcaagatatgctccgtccacctcctactgttaagccaagcattgtcatgatcgaggatcatgtatttgaagaatatgaagaacctcctgtctttggaaagaggagtatattcgtagttcgatcaactggggtaaacgagcagtggacgcagtgtgatagttgctcaaaatggcggaagttgcctgttgatgtacttactcccccaaagtggacatgtgtggagaacttatgggatcagagcaggtgttcatgtgctgctcccaatgaattgaacccaagggaactggataatcttctgaggctgaataaagactggcagcaagccagagactggccctggaacatgaatcttcaggactggatgctttggcaaatgcagcaatactgggtgatgatgcaagtgactctggcaggacatcagttgttagcaccacaaaacatcctcggcatagacctgggtgctcttgcattgtctgtatccagccaccaaaagcggcaatccgaacgtgaagcagagattgctcagagaaatcagttatcatggcggaccaaagatgaatcagaagtagatagcaccttacgacatttaactccagttgacagattggagaatgaggtacgggtgcaaaatgaattggattcaaggagtcaaaaccatgcggtggctgaagctgccaagggacaattagatttgaattgtcaacctgatcgagaagatgtgcaagcttggccgaacaatttgagcatgacgagtcttcttgaagaagcaaatctcccgctggaaacctacctaaagcgaaatggccttagtagcttgatatcagagcagcaaacaaattcagcttcaaatgtgcaagcacagacaaccaatgatagtgagggaaaacacaatgaggattgtggaaccgctttg

SEQ ID NO: 43162 - DNA, 801 bp, Glycine max
  Peptide Sequence Number=SeqID_159940
atgaccccgaggataaatcacctaagcagatttgcactcctgaggcctgatcctcaggagttggctgctaagctatatatcccagggaggggattcgagcttaatgttgatgggcagccattgaagatattgaggaagaacatgaccaccttagctcagacatggagtgttctttccttctcgaacctgattcctacctcccatacatttgatgtgaccttggacagagccaagttgatttatggtattattatgaagatggatatgaacttggggtacctcatctcccaccagatctctctgattgcgcaacatgacacatccagacttggattccctaccatgatcacatctttatgcatagccagaagcgtccagtcagattctagatccctggagaacttgagccctgccattaacatggcatatattaagaagaattgttggaatcttgatgatccaatagtgacatttggagggctaaggaaggccaggggtaagagatcagaggtccccactacttcaacaccaccagagacaccaattccttcttcttccacagctccagtacctctcattcagactccagctatttcacctacatttacacagctaccacttccagctcctttatctgcaggaccttcaaactttatatttacaccacaaatgttgcacttcatgctccaaagcatccacagggggcaatccattatcatacagagccttcagggcttaagcttgccatccatcatgagcatggatgagtttgatttgcaggtggcctggctaggagcctag

SEQ ID NO: 43163 - DNA, 456 bp, Glycine max
  Peptide Sequence Number=SeqID_159941
atgtttctaatccactgttgtgttccgtacatccacgtatctaactcacgcgtcaatttcaactcacgctcatcgattcggaatctagagcatcattacccgcacttatcgcagagatcggcgaattcgccggatcgcagggcccagcctttgcgccaccgaatcgtcgtcgaggtggcgcacgccacgttcatgcagctccttgactccatttacaactccaattccacacagactctgcaaaaaaaatcagaaaaatcagaacgaaaaaccctaactgtcacctcaccagctcgctcgacgccggatgtaaaatccagcagcggagaagcgaccgtaccgaaattaagccggagaggaagctcgagtggttcctccggtcgccggaagttcgcgaggggaagttccggtcgccggaagttaatttttaagcggaggaggggcggcgagtggtga

SEQ ID NO: 43164 - DNA, 288 bp, Glycine max
  Peptide Sequence Number=SeqID_159942
atgcgggtgagtcgcatagttggtgagtcgagacgtgggttagttaacgacgtcgctcgaacagtggtgttctcgaagcgtgggtgggttgacgatgatgttgggtcgatgacatcactaggtagcaacacatggacaacacttggagctgtgtggacgctttggatacaccgtaatgcagtaatttttaaagaagaaaattcagaactagaaaaaatggtggagttggttaaagtaagatcatggatgtggctatcttcaaaggctaaaggatttttggcaaaatag

SEQ ID NO: 43165 - DNA, 243 bp, Glycine max
  Peptide Sequence Number=SeqID_159943
atggactcaagcggtgcacttagcgggatgatccctcgctcagcgaacatgcacagctcatccttcttccagattcttcctcgtgctcagccaaaggagtgcttcttcctcacactcagcctcaagaatggtgtgctcagcggatggctcgctaagccgacagattggcttagcgagcatatcaaaatcagcacttcacaaacttgcctaattaacctgaaattgaaaggaaatgattattaa

SEQ ID NO: 43166 - DNA, 525 bp, Glycine max
  Peptide Sequence Number=SeqID_159944
atgcagaaaggtctttggaccagacaatatctgaacagtacagaattgtcaccaagtaaccaagaaaaaggaaaccacgacctaaagtggtcctctccctttgattgccaaccaaaatcctgtgcgctagagactttctcaccacgcactaaacaaacacaaaaggaaaaggcagaaacactcaaagccaaatttcccaccaagaaaaaacaaaccattcccaagaaaaatgtttcctctaaatggtcatttagaaatgaaatgctaaacatccaaaatctcatttacggttatgagaaaatttcatcagcatactctccttccccgatagacacattgtttttcatccaaaaagcatatgttgctctgatcagctggaagttttgtctctttactaaagcatgttcgcattttgataaagaaaacaccgagactatttttagtctcacagttgtcaagaactacgtaggtctgagttcctcatcacaaattgaaagaaagaccgcaaaggtcaacatgttatag

SEQ ID NO: 43167 - DNA, 477 bp, Glycine max
  Peptide Sequence Number=SeqID_159945
atgactacacaatcatccaacgcgtcgaatgctattgtcattaagttttttgtccttccatgcttgctcttttcgttcttagtatatgttcgatattgtgcatacttatcttctcctttcaacggggcccatcaaattcactgctgtctacaattgtgcaccgatttgaggccgcattccatgttgacaagaatgtcattgaggttcctttattcttaccatagacaatggtacccgaattatccaacttatgtgctcttcaaatacaaaggagaagagcactttataaagcttcataaatatggtaaccgatacttttttggtgatgaactcaagggacttagaagaacccacgacatttacaaaagtgtcatcatgcattttgttgcatgggacaaaaatactactttccatgtggaggtcatgggacctctctatagacgaacacgtgaaaggttctactaccagaggctttaa

SEQ ID NO: 43168 - DNA, 336 bp, Glycine max
  Peptide Sequence Number=SeqID_159946
atggaaaatgggtgcatgttttgcaaaagtgagctaggcccaaaacgtaaggaagagtcttttcttattctgccattttccttcttcctctccttcttccgcgctttcccgcaagctgcctcttcttcttctgtgagctgtgcctgtgtcttccgtgagcctccctgcttcatccgcgaggtggttgttcttattccgcaagttgcctcttcgtccctacttcgagtgcctcttcttcttccgttcttccgcgagcttccgttcgtccgttcttcatcgagtgcagtttgtaggtatgtagttgatccgcttaaggatttaggtcatccgctatag

SEQ ID NO: 43169 - DNA, 327 bp, Glycine max
  Peptide Sequence Number=SeqID_159947
atgaagtggaagaaggcccgcacaaagaaaactgatcaaatgacttctgaggctgcaaaggaaattacagacacgattacctcacagggaagctttgtcgcccatgaacgtcaggatgtacagactgttgccattgggcgaccagagcaccctggtcgttatctaaaaattgacgtaaacttaattgatcaaagagttatggaattttgtggaaaaaaaatccaaggcattggagacacatataccaatctaggaatccttaaattagattctaagcaagtggactggtttacaacagaaaagggtaaagaagtcaagaaatcataa

SEQ ID NO: 43170 - DNA, 533 bp, Glycine max
  Peptide Sequence Number=SeqID_159948
atgccgacaaccattcgtcttcctcttgacaccctcagcctctacttctttgaaattgatcacctaattggcgaggaatttgtggtgaggtggtggcaatttgtggaggttcatgtggatgtggtttttcatggaggtggtttatggagacaaaacgaagtagtgaagaaaatgaaatcatgtcaaacccaagtaaatgtaccctctacttgtaccacaaaggatgtaccctccaatgtgttaagacaaagatctcaggctgttaaacctttgatactttgtgaatggggatacaaaagaattctcaggcgggagaagggagacacaaaagaattcaggcggttagtcctttgttcttttggaaaagggagaaaagagacacaaaaagaattcaggcggttagtccttggtgaattctttttggcaaagggagaagagaatgaaaagatgaatagcacaagttttcaaggtttggaaaaccagaaagcttttggtacaaagaagaagaagaagttcaaagagattcaaggctt

SEQ ID NO: 43171 - DNA, 511 bp, Glycine max
  Peptide Sequence Number=SeqID_159949
gttttgcaaaagtaggctaggcccaaaacgtaaagaagaggttttgcaaaaatggattaggcccaaaacagaaaaagggtgctcggttaggttgaaaccgggtcagagcgactcgacccaatccgcgattacgcaacagggttggaaaaccctagttgccacacgtagagaatggcgcgaccattatggaagccaccacgaagggaggcgcgctgcccgtggcaccactggtgcaaagtccagtggcacgaggccgccatggggcacgacagtgatggcggcggaaatttcattgtggggtaagaagaaaattaacaaaataggccgcataagcctcgccggaggccacggtagggtcaccatggaaggtgacgcaatgcggtgttatgaaagaaaaaaaaagaaaagaaaagaagaagaagaagaagaagaagaagaagaagaagaagaagaagaagaagaagaagaagaaacattagaaagaaagagagaagagagtcagaatgcgtga

SEQ ID NO: 43172 - DNA, 954 bp, Glycine max
  Peptide Sequence Number=SeqID_159950
atgcagcctgctccatctttagtcatggatatttggagatgcaacatttatggtggagcccatgagtcaggtatgtccatggctcaagatgatacatctaaagagggaggaaatttctttcaaggccaaggttggagatcccaccctaagaataacttcaataaagatcagggaggcccatctaattggcctcttaatcaaggccttaatttgtatgacaaaaccaccaagctggaagacactttgactcagtttatgcaggtttctttgtcaaatcacaagagcacagagtctgccattaagaatttggaggtacaggtgggcgaattagctgaaaagtccataggcaattttgtggccaacactgagaagaatcccaagaaggagtgcaagatagttctcactaaaagccagacgaaggaaaatgttgagaaggagaagagagttgagggagcattagaggatgtcaatgatgaggaaggagaggatacactacaaaaagaagcatttttcccacaaaatttttcccacggattaattccgtcagaaatatttgaattttggacagaattttttccatggaattcatttcgtcggaagtataacttacccacagatggttacccacagagatccgttcgtcaaaaatttgatagctttccggaagattatttcaatggaatatgcatccgtcggaatttaaaaattttcccaaacataaagaccccaaccctaattgcctctcattcacttttcaatcttatatcatttcttcctcccacagcgtcgtcgctcactcccatcttgtcaccgatgttgccacaccgccactgtaagcccacgctaggattgtcgccccccactgtctttcttcattggggctgcaacgtcatcaattatgggtctctacgccctccacaagggattgtcacacctgccaatattacattgtaa

SEQ ID NO: 43173 - DNA, 192 bp, Glycine max
  Peptide Sequence Number=SeqID_159951
atggagaaggaggaaaaatgctttgagaggtgtatatgtagaagggagatgaaaggggccaatcctaggaaagcagacacatggaagcctattgtgaaccaagttgctaaaagattgtcttcatggaaacacaaaactctatcacttgtggagagggtagttgggaaaatggagtgtggagatggtgtctaa

SEQ ID NO: 43174 - DNA, 684 bp, Glycine max
  Peptide Sequence Number=SeqID_159952
atggatgcagctttgggggctttgtttggggaattgctgaaagccattttgctcgcaaaagacaaagcgattatgttcaaggaaaccatggaccacctcgaatccactctgaaatcaatagaaccggtgataagaaagatagaaaagcacaacaagaagttggggcgtccgaaggaggaactcgaatcgctgaaaacaaagatggaaaatggcgcgaagcttgtttccaagtgttccgaaatccacaagctagattttgtgaccaagattcgttaccagagtaaactagaggcacttgaagactctctcacgaagtttttcgtcattgacctggcagctcagacggcgagagatcagaaggagaccttgcgtaaggttagaagaatggtaaacgccgctaagaagttgcccttcaactcagttgatgaatctaaccctaagcctgcaggggaggtgattgaatctgagatcgaagctgaatcagattatgatgatgcagtgagtgtcgattctgcacccatctgtgagaatgagtcagatactatttctcattctgatgagcaacaaattgttgaggaggcagagccatttgacagcaacgagaatggtgtagatagtgaggaggatggggtggtcgagttctgtgtctctgaccttggcggcgaacatgacgaaaagggataa

SEQ ID NO: 43175 - DNA, 813 bp, Glycine max
  Peptide Sequence Number=SeqID_159953
atgacagcacataatcgttggcaagtttttaggggtaaaagtgaccaagcagatgatttgatctttaacatacaggagcaccacatgatccagctaaagaccaaattggacgtgttcttagctaaaaataccgaagaaaatgattgtgacttcagggtaaaaggaacttggtccggcatatcttatgttgtttacgccgttccgtctaacaacattatagctcagaaccacaaccactcaaatatcccaaacccaccatcccacaccattgacaacaacaacaacatagatttaacaacacattcaacaacaaagcctaaaaaaaatccaaaaacaagaaatagatttcgtggggggcaaggggaaaagccagaaacagatggaggcaaggggaaagagcgtgcggtggttgggcggtggatcttgatgcactgtgacacagttctagtggggttgatatctagcttcaaaacccgcagcggtggtggactccttagtcgtgaatggtttcaaaacccaagactctctctttgtctttctgggatttggactccttggttatgcatggccagaaacactagggtgacgacgacgacgactgcaagggcgacaacaaccttggtggatgatagtggattgtttaagggtgagaaaatgaaaatggagagtcggtggagagtagttgaaacagagagagagaaaggggaagggggaaaggttgtgagaagaattttggaattgggaaaggctttggggatgaagtatgatgggaatgaagagatattgttaaggctttggtgtccatggaattaa

SEQ ID NO: 43176 - DNA, 192 bp, Glycine max
  Peptide Sequence Number=SeqID_159954
atgaggaacaatggagttgatgtgtctgtgctagaaccatctacagctgacaactttcctgaatatgctcacaagctcatcaaaagaaaggttaagagggaaactatggaggattcaaggtttgtggttggacagatggaaaaagctcaggagcagccaatagatctagagtctagagtagtgactcactag

SEQ ID NO: 43177 - DNA, 594 bp, Glycine max
  Peptide Sequence Number=SeqID_159955
atggtaggttcctctcaacgcaaaagccccacaaaccaagatgaatttgctaacattgggaagagcacaccattaccaacacctatggtgtctagaaatcaaaccaagtccttgagtccatactaccctaagttagattatgaagccattaactcttggttccccacttatgaagacgagtaccctatagttcataaggagaccattaggagtgatttcttgaaagagaaaagtgggatttttaaggcctctcctccaaaggataggaagaccatttttagttggcttgctggggtagaagccaaaaaatcccaacactggaagaacatagacatttacgatttgatccaattaagcaaatatgatattgtaagtctagacatgcctatgttaatggcctcattcctattctggaatcgcagtttgcatgcattgaaactcccttatggtccaattagtttaactttgtcagccatagctgcaaatactagccttaaacccttagaagacatttgccttggtaaattcctactagcctcagtttacaaagtgaaggaaaaagctatcaagattatggataccccagaaaaatga

SEQ ID NO: 43178 - DNA, 375 bp, Glycine max
  Peptide Sequence Number=SeqID_159956
atgcatgcaagcagcacccaaaccgccagtaccactggcgagtttggtcattctgaaggaatcgctccttgcaacagcgatatggccatgcatagggaactgccagtagtaggcgcgcaggcaggaggcaggagggcagggtgcagcagtgcagcagtggtgcaggacggaggtgcagcagcgtaccagaatcgccagtacgattggcgaattcatttgcaaaggaaccgccagcctggctggcggtttgcattgtttaaaaaattttcccccttcccttataaaaagaagaagctcccgagtgcacaggcaagccttcttgcacttcgttattcttccaagttctcccaggacagtaactctctcttctcctaa

SEQ ID NO: 43179 - DNA, 282 bp, Glycine max
  Peptide Sequence Number=SeqID_159957
atggcccccaataagagtgaccatgttaaggttcctattatcaacaacattgaaagtgccaagaaggtatttccaaaagactggttcatcattgggaaatgggtgaactttcagagtctaatggaagaaggctctattgtcaatagcatttttgatcatgctaatcagacaccatttttggggacttcaaaacaagatagagtcaacattcaaggagtcttcaatggaaagaaggggataatctcgcctaagacccttattactgtgattgggtctccataa

SEQ ID NO: 43180 - DNA, 255 bp, Glycine max
  Peptide Sequence Number=SeqID_159958
atggctcgtcaattgttagaacaccagtcccacaactgcttctgccataattctcaagacttcaggagactttgttttacagaattgtcctgtattttcaagaataccaaggggggtgtcatggcccctgtgaggagacacatggagaattggagatggacctttagacgccaacggagccgaatcttcaaggcccattcgcatcaagagctccacgctggttggataattacaagaggaagtgaagacgagtga

SEQ ID NO: 43181 - DNA, 2826 bp, Glycine max
  Peptide Sequence Number=SeqID_159959
atgaagcaagtgcaactcatcctactcctatcagtgtctcttgttcttttgggtccaatcctagtgatctcaatagacctttcttctttcaacgatgatgtgttggggttgattgtgttcaaggctggcctagaagacccaaaaggaaaactctctacgtggaatgaagatgattatagtccttgcaattgggttggtgtcaaatgtgaccttgcaaacaatagggtatcttctcttgttcttgatggattttctctttctggccacattgataggggccttttgagactgcagtttcttcagattctgtctctctcaaggaacaacttcacagggaccatagctcctgatcttctcagcattggtgatttacaagttgttgatttgagtgagaacaacctctatggaccaatccctgatgggattttccagcaatgttggtctctaagagtagtttcatttgccaacaacaacctcacagttgtgaacttttcctctaaccagctacatggggaattgccatctggaatgtggtttttgagggggctacagtcaattgatctttcaaacaactttctggagggagagattcctgaaggaattcagaatctgattgatttgagggagttgaggctagggagtaaccacttcactggtagggttcctgagcatattggagactgcttgctcttgaagttggttgatttcagtgataattctatttctgggagacttcctgagtcaatgcaaaaactcacctcatgcacattccttagcttgcaaggaaattcattcactggtggcattccacactggattggagaaatgaaaagtctagaggtattggatctttctgcaaacagattttctggttggattccaaagtcaattggaaatcttgacttgctgagtaggttgaatctgtcaaggaatcagatcacaggaaacctgccagagttaatggtaaactgcattaagcttttgactcttgacatcagccacaatcacttggcaggccatcttccttcatggatattcaggatgggcttacaaagtgtctctctttcaggaaataggtttagtgagagcaattatccctcacttacttccattcctgtatcttttcatggcctccaggttttggatttgtcatcaaatgcattttttggccaacttccatctggaattggaggtcttagtagcttgcaagtcttgaatttgtccaccaataatatctcagggtctattcctatgagtattggagaacttaaatcattgtacattcttgatttgagtgacaacaagcttaatggaagcattccttctgaagtagaaggggcaatttcactcagtgaaatgaggctacaaaagaactttttaggagggagaattccagcccaaattgagaagtgttcagagctaacatttctgaatctttctcacaacaagcttattggttcaatcccttcggccattgcaaacctaaccaatcttcagtatgcagatttctcatggaatgaactctctggaagcttaccaaaggagctgacaaatctttccaaccttttctcatttaatgtttcatacaaccgccttcaaggtgagctaccagtgggtggtttcttcaatacaatctctcctttatctgtctctggtaatccattgttatgtggttcagttgttaatcactcttgcccttctgttcatccaaagcctattgtcctaaaccccaactcttcttactccaactctggctcttccttacaaaacaatcatcataagatgatgctcagcatctctgtcattattgccattggtgctgctatttttattgtcattggtgtggtggttgttactgtcctaaatatccatgcaaggtcttcaatgttatcttctgctgctccatttgtgttctctggtggtgaggactatagcggttcacccgcgaatgatccaaactatggcaagcttgtgatgttttccggcgatgctgaatttgttgatggtgctcataatattcttaacaaagacagtgaaataggccgtggaggatttggagttgtttattgcactgtccttagagatggtcattgtgttgcaatcaagaagcttacagtgtccactttgaccaagtctcaagaagactttgagagggaagttaaaatgcttgggaagatcaagcatcaaaatcttgtggcacttgaaggttattattggactccatccttgcagctcctaatttatgagtacctagccagagggagtttgcaaaagcttctacacgatgatgatagcagcaaaaatttgctttcttggagacaaaggttcaagatcattcttggaatggcaaaagggttggcctatttgcaccaaatggagttaattcactataatctaaaatcaaccaatgttttcatagattgttctgatgaaccaaagataggagactttggcttggtaaggctattgccaatgctagaccattgtgttttgagtagcaaaattcaaagtgcacttggatacatggctcctgagttcgcttgccgcacggtcaagataaccgagaagtgtgacatttatagttttggaattttgattttggaggtggtgacaggaaaaagacctgtggaatacatggaggatgatgtggttgttctttgtgacaaggtgaggagtgcattggatgatggcaaagtggagcaatgtgttgatgagaagcttaagggtaattttgctgcagaggaagcaattcctgtgataaaattggggttggtttgtgcatcacaagtgccctcaaaccgtcctgatatggctgagttgttgtga

SEQ ID NO: 43182 - DNA, 554 bp, Glycine max
  Peptide Sequence Number=SeqID_159960
atggtgtgtggaacggggttggggatatccgatacccgatgggtacccgacgagtacggggatgagacaataaactcaaacccgtcggatatcgggtacgggtatgaggatatgtttaggagtcgagcctccaatgccacatttccatgtataaagaaaatgatattgcagcaacaatttcagaagcagcaagcaatggatgaagtggcaaagattcggaagaggtttggtgacgagcagagcactctcttggaccagtttgagagactctcctttgagactcacctcaacaaggccatgctacaaaggagcctatcagagccagggttcccaagacgagtgtcacagccaaggcacgttaatgtgaccccaacaacaatacccctcttgaataatcaagggaagcaaaggcgttgtcgtgtgtcagggttcaataaggttctgaagaaattgcttagaccaattcttggaaggaagagtagtggtggagagaggaagcatgccccggatcctaggaatccactctcttggaaaaacttcagcagatcactaag

SEQ ID NO: 43183 - DNA, 411 bp, Glycine max
  Peptide Sequence Number=SeqID_159961
atgtcaggtttctccaaagacatgcctgcagttgatgaggaccaacaagaagacgatgtgcatgcaaatcgtactgatcatgacgaaggtttatgggagaacattcctatgctcatggcatcacccccaccgtcgcccaatgctacagataatcctctgaaggatgatcttaagaagttagtctgggaagatattttgcgtaaacttgacatccctgaaggtgaaaatgccaaaaaaaaggtcatgtcgacagtcgcaagtaaatggaggcaatttaagtctcatttgacttcaaaatttgtgtttgctgacaatgagggccaagcaagtagtgagccgacagtgaagcatggtattgatctagctacttgggcggaatttgcaaaaagccgccaaaccccaaattggcag

SEQ ID NO: 43184 - DNA, 267 bp, Glycine max
  Peptide Sequence Number=SeqID_159962
atgacgaaggaagtgatccacggtcacaactctgcaacgcctcggctccacttttcctcttcttcttcttcttcttcttcttcttcttcttctacaattttctctagttttcaggctgctgaaaaagccatccagtgcaggggaaactcgcccaagcgagctgcttgcttagggctgaaggtatcagctcgcccaggcgagctagagcttgccccggtgaatgacttgcttaggattgaagttttctctttagcccaggcaagctag

SEQ ID NO: 43185 - DNA, 1293 bp, Glycine max
  Peptide Sequence Number=SeqID_159963
agggctacccgccttcaccttcatagggctgcacgccctcgccttcagaggactacacgtcctccccttcagaggactacacgtctcgccttcagagggctacatgccctcgccttcagaggactacatgtcctcgccatcagagggctgcacgctctcaccttcggaggagtacaagacctcaccttcagaggcctacacgtcctcatctacagagggctagacgccctcacctttagaggactagacgtcctcgccttcagagggttgcacgccctcaccatcagaggactacatgtcctcgccttcagaggactacacatcatctcctttagagggttactcgccctcgctttcagaggactacacgtcctcagctttagaggtctgcacaacctcaccttcagaggactacacgtcctcgccgtcagagggttgcacgccctcaccatcagaggactacatgtcctcgccttcagaggactagacgtcctcgccttcagagggttgcacgccctcaccatcagaggactacacgtcctcgccttcagaggactacacgtcctctccttcagagggctactcgtcctcgctttcagaggactacacgtcctcagctttagagggctgcacaccctcaccttcagaggactacaagtcctcgccctcatagggctgcacgtcctcgccttcagaggactacacgtcctcaccttcagaagactacacgtcctcgccttcagaggactacacgtcctccccttcaaaggactagaagtcctccctttcagaggactacacgtccacgccttcagagttctacacatcttcgcgttcagagggctgcacgccctcatcttcagaggactacacgtcctggccttcagagggctacacgcgctctccttcagaggactgcacgccctcacctttagaggactacacgtcctagcgttcagagggttaaacgccctcacctttaaaggactaaacgtcctcgcttttagagggcaacacgccctcgcctttagagtgaagcacgccctcaccttcagagggctacatgccctcgcctttagaggactacacgtcctcacctttagaggactacacgtccacgcgttcagagggttgcatgccttcaccttcagagaactacacgtcctcgccttcagaagactacacgtcctcgccttcagagggctacacgccctcgcctttgaggactacatgccctcgcctttagagggctgcacgtcctcgccttcagagggctacacgccctcgtcttaa

SEQ ID NO: 43186 - DNA, 704 bp, Glycine max
  Peptide Sequence Number=SeqID_159964
tgcttgtgaatggtagcccagccgaggagtttaggatgcatagaggcttatggctaggttatccattagcacctttcattttcctttgtatggctgagggactagcgggattgatgagggaagtggtagataaaaacctgttcttgagtatgaagataaggagaaatcacatggaggttgatctacttcaatttgtggacgacactctattttttgccaagccttctatggagcacgttatgaccctaaagactatccttagatgttttgagcttgtattgggcctaaagataaacttcttcaagagcaaactggcaggagtagctgttgagagtgccaccaatgagatttatgcttctcttttgaattgcaagggagggaaaatagcttgggtgaaatggaataggatttgttggcctaaggaggaagaagggttgggtgtaaaagatatccatctcttcaatttagctcttctttctaaatggaaatggagattattttctaatgaggaggctcttcgagaaaggataatcatgtctaagtatggtgagggtgtggaaagggcatgcggtaatcggaaaaatgggaaatcgtttgatgagaacactacaatgccttatagcttaaatgaagttgtggatggaaaatgtggtgttgggagtggaaatggaggaaaaggtgttttgaataggaatatgagttaa

SEQ ID NO: 43187 - DNA, 336 bp, Glycine max
  Peptide Sequence Number=SeqID_159965
atggatgaaagaagaggaagacttaagatagaggtaggaggaactgaaatgaatgagtttaataacttcattcaaaatatggaaccagaggatgcaccactagtgaggaggaggttcacatgggtgctaagttgttggctacaagatgggaagtttaaagagttggttgaggattcatggaaaggaatgaatatgagaggctgggcgggctatgtgtcaaaggaaaggctcacattacttaagggggagttgaaaaggtggaataaagatcaacttggaaaatttcaacaaaagaaaagggaattggtggaaaaaattcatgagattgatttataa

SEQ ID NO: 43188 - DNA, 272 bp, Glycine max
  Peptide Sequence Number=SeqID_159966
ggcgcccgttccccccagcaagttcatgtcgtcctgacataggtaaggattgtgcccgtaagacacctagtggacccaaagaaggccaacagggtcttggagttgcctgctctaaatacggatctctgtcagttatagggagtgcctgtcgcccccagcaaggtcatcaggcccccctactaatcgagctttcatcaagaagtactgcgcccccaggcaggcccagggcaaaacaccacaacagcattgggatggccggtagcaggcaatag

SEQ ID NO: 43189 - DNA, 282 bp, Glycine max
  Peptide Sequence Number=SeqID_159967
atggaggcaatcaaagtgaaaagcctgggagacaatttggcattgttgtctataaagggagatataaaaatagagatggctttgaagaacaatgctgaatggtggaaaaagatatttggacacatgatttctagtgaatcagaatgctcaagctttgatgaagaaataaaagatgaaagggttctagggaggtgtcgcaaaaggaagcggagccaaaggcgcaccacaatcgttggccagggagaaagtactggtggagaaaaattcaaatgggcaaagtag

SEQ ID NO: 43190 - DNA, 198 bp, Glycine max
  Peptide Sequence Number=SeqID_159968
atgttgctttgtgcaccagcagaatttctgatttgttctcgtgagaggtcttccatgagaggtgctcattcgttgttgtgtcattttggtggagatgtattgtttatggtggttcatcgacaagtgatggttgtgttggtgattgatttggccattaacgacggaggtatggtcttcgatttggtttatttcgagtaa

SEQ ID NO: 43191 - DNA, 519 bp, Glycine max
  Peptide Sequence Number=SeqID_159969
atggacgaagatcaatggatgcatgacagtataatatctgaagaagttgatatgaatgaacaaaatgaacacgaagctggtgtgaatgaagaacatgtgtttgctacccatgatgatgttctagattggactcgatctgttgcttatgaaattggttttatggcggtgattatgagatcaaacacaaatattggtattagaggaaggacctcatttgttttaattgattgtgaaaggagtggtcagtataggaccaagaagaaagatttggatgagaagatcattgtttctgatatgacaaagtcaatggtaacaagaaatattcttctaacgttgaaggagcacaatgccaatagttatacaacaatcaagcaaatatacaatgcaagaaatgtgtatcattcttccataagaggtagtaatactaaaatgcaacaaccaatgaagcttcttgaatgggatcaatatattcattggcatagattgaaggatgaagatgttgcacatgatatattttga

SEQ ID NO: 43192 - DNA, 2111 bp, Glycine max
  Peptide Sequence Number=SeqID_159970
tgcccccaggttgtcgatttccggtggacaaatgccctgagatattgctctatcacatgattcatcacctctgtctggccgtctgtctgaggatgataggttgtgctcattttgagcttagtgccactaagcttgaaaagttcttgccaaaatcgactcatgaacaggggatcgcgatcggagacgaggctgcggggcatgccgtgaatctttccggtggtctccatgaatatcttagccactgtagtagcagtgtagtgcaccggaagtatccccatatgcacccctttggagaaacggtccaccacgaccaggaccgccaagggcggcaagccaactataaagttgagggagaggtcctcccaaggtctcatgaacaactggacatcctgcttcatagatggccagacgaaatttgcactgatgcgagccaaggtctttgtaattctcatgtggccgccagtgggagtgttgtggaattctgcgaggatggtggagatggcctgaagacctttgggaagccatatacaacccttttgaaggatgaagtcatgacgatcgtcttgaatgtggcggcgaaagtccacgaaggaggaattgctgagaagctcttgtttaagttcctgcaaaagaaaggaagtttggaacagttagcagaaaaaattggagaggggtggcttttcgtcgctgtgagagggcatcggctgctgcattggatctcctggcacgatagtgaattgtgtagtcattgcctagtaatcgtgtcgggtagcattgctgttcaggttggtaatggcggcgagctcccttacgtacgtggaggcacaaaagagcttagaacagaagggtttgctgaagaagacgattgggtggactggggcaccacacagagcttccttcagactgaggaaggctgcgctagcatcagcgttctagtggaaggagtccttagcgaggagagtcggttcgaggggattgaggagttggccaattctggacaacttcgatctttgtcggcaccggtgccactccttggcacgacacgatatgcccgagatattcctcctgagaagttgcaaaggagcacttcgaaagcttcagaaaaaattggtgtaagctcaggacttcgaaggccttgcggaggtagtgccaccaagctcgtcgaggagctcatcaattgttgggatcgggaatcgatccttgatcatgacggcgttcagggccctgtagtctacaccaaacctccaggagctgtccttcttcttaaccaggagcacagggtagcggtatggtcggacggtgattggagatgtgtggggttgaaggaggatggagtgattagtaggccgaggagggggaagggtgtttggttgttggaacaagggtgcgaattgggtgagcagggcggagatattagggtgggtggttgtgggggtagtgggggaaggagagacccgtatgtgaaagaattcactggcaccattggtctggatcagtcgtcggagttgcggtgtggagatggcttccaggtcctgggtagtatcacccttgagttgaatgatcgtgccgccatggacaaatttcatggtcaaggagttatagtctgtcaatactggaccaagggacttcagccaatgcacaccgaggaccacatcggctccgctaattgtggtggtgaggttcaggtggctgaccagtcgggcctgcacaaagttgtgcgtgctcctgccgtcgatgaggatcatgacagactggttggagatgcggcccaacaggcggagcgtttctggagcggactgacccgacaacgcttcttcttgctactcttcatctgcgatgaggagaaagaaatgagaggcgcagcggtgcccgcgggtaaacctctcattgcagttgaagcaaaggctgcgctcctgccggtatgccatcttggcgggggtcaggcacttcaaaggggggaagagggtgatggggttgagagggcggagccatgggtgttgcgacctgcctggacttcgtggcggatgtcggggaccaagcccgagatgaagcagcttaagaggagcgacgggggaaggccgacaatcctattcgccagagcttcaaactga

SEQ ID NO: 43193 - DNA, 357 bp, Glycine max
  Peptide Sequence Number=SeqID_159971
atggcggactcccctcgagctaagtctccattggaacacattaaggaagcaatctcccagcttgcctcgagccaaattttcgttactgaaaagttggaggatctcctccttcgagtcgctaatctcgaaaacccgagccactccacagcttcgccttcatcttcctcacctaaccctgtacccaaaacaaccattatcaatacccccaaaatgaaacttgatgttcctaaatttgatggcactgacccttcggggtgggtgttcaaaatcactcagttttttgcgtatcactccactcttgaactcgaatgcttaaccattacttccttcaccatggaaggaaccgccctggcttag

SEQ ID NO: 43194 - DNA, 1368 bp, Glycine max
  Peptide Sequence Number=SeqID_159972
atggaaatcaattctctatcactcccctcttgccgtatgcctattctgctaaaggactctcacagcggttcccctcagcaacaaaacaagttaatctggtggcagaatgaaaaaggagtaattggtggtaaggacaacagtgtagattgctcttcattggctcaaaactctagtaggaaaagaatgattcatcaatctgatgggagtcttcatgatataaaagttgaaggttatatgccaaaacagacctcattgtgtgtttcgatgctatattacacggagaatggcttctttcctcaagcacagactttatgggagcagctcgtaaatagctcttttgttccttctgttcagttcatttcaagattatttgatgcttatgcaaagcataggaaattcgatgtggtgatcgatattctacgttatgtggatatgaggaatttcagtattttaccagatgtctactggttggctatatcttgttttggaagagaaggacagcttgaattgatggaggatatggctaatgaaatggcttcaagtggtgtccatatctattctagaactgccaatgctttccttttgtattatagtctttttggtactttggaagagatggagaacacgtatggccgccttaagaaatctagatttctaatagagaaggaagtgattcgggccgtggcctctgcgtatataaaggagagaaaattctatgaattgggtgagttcctaagagatgtgggtctacgtagaaaaaatgtgggaaaccttttatggaaccttatgttactttcttatgctgccaatttcaagatgaaaagcttgcaacgagaatttattggaatggttgaatccgggttccgtcctgatattacgacctttaatatccgtgctctggccttctcaaggatggctttgttctgggacctccaccttagcattgaacatatggaacatacgaagatcattcctgatctagtgacttttgggtgtgtagttgatgcatacttggatagaaggcttggaagaaacctggactttgctctaaacaaaatgaatttggatgattctccgcgattattaacagatccttttgtgtatgaggccttagacattcactctgtagttaacttgaaacagacttctacttatggagttatggtggatgcacttgaggtgaagagtttcggagacgacaaggaagaggaggccatagccgaggaaggcggcgggggagccgacgacgaggaggagccaaggggggaacttgttgcaggcgaggccggggaggaggtcgaggtttttgccgatgtcaacggcgacgccgaggagcgtgacgtggcgctggtcgaagccgagaactga

SEQ ID NO: 43195 - DNA, 158 bp, Glycine max
  Peptide Sequence Number=SeqID_159973
ttgaccaggcacagcttaatcgagccaaacaggctaccaaatctgcaattttgatgaatttggaatcaagaatggttgtttcagaagatataggaagacaaattttgacatatggtgagaggtatggctcaatgatgacattctataacttcagttaa

SEQ ID NO: 43196 - DNA, 462 bp, Glycine max
  Peptide Sequence Number=SeqID_159974
cctcacaaaggcattggcatattgtcatgagaagcatgttatccacagggatatcaagcctgaaaatttgttgcttgaccatgagggtcgtcttaagattgcagactttggttggtctgtacagtctcgaagcaaaaggcatactatgtgtggaaccttggattatttagcacccgaaatggttgaaaacaaagctcatgattacgcagttgataactggactctgggtatcctttgctatgagttcctttatggtgctcctccatttgaggctgagagtcaagttgataccttcaaaaggataatgaaagttgacctaagtttcccttctactcctaatgtttctttagaagccaaaaatcttattagtcgagtaactgctggtaaaagactcttcacgaaggctctcacttcagaggataatggagcatccttggataaccaagaatgcagatcccaagg

SEQ ID NO: 43197 - DNA, 1278 bp, Glycine max
  Peptide Sequence Number=SeqID_159975
atggattttttgcacaccctgttgagtttgatagccttttcttttctgggtatcttcctagtcttttgtttcatcatgttaaccataattataggaaaatcaataggggaccctgattatgctccagtaaaaggcacagtgtttaaccagctattatacttcaacacactccatgactaccatgctcaagtggccaaaactaatccaacttttcggctactggctccggatcaaagcgagttgtacaccgcagacccgcgaaatatcgaacacatactgaaaaccaactttgataagtactcaaaaggcaagtataaccaggatattgtgactgatctttttggtgagggaatttttgctgttgatggtgacaagtggaggcagcaaaggaagcttgcaagttttgaattctccacaagggttcttagagatttcagttgttctgtctttagaaggaatgctgctaagttggtcagggttatctcagaattttcccatcagggtcaggtttttgatatgcaagacatactaatgagatgcactctggactccatattcaaagttgggtttggaacagaattgaattgcttggatggatcgagcaaagagggaagtgagttcatgaaggcctttgatgagtcaaatgctttgatttattggcgctatgttgatcctttctggaagctcaagaggtttcttaacattggttgtgaagctacccttaagagaaacaatgtcaaagaggacatactatcaaggtttttgattgagagcaagaaggaccaaaaaactatgactgatcagtacttgagggatataattctcaactttatgatagctggcaaagacacaagtgcaaacactctttcatggttcttctacatgctctgcaagaaccctcttatagaggaaaagattgtgcaagaagtgagagatgtcagttgtagttgtagccatgaaagtgaaccaaacatagaagagtttgtggccaaaataacagatgacacccttgatagaatgcattatcttcatgcagcattgacagagaccttgagactttaccctgcagtccccgcggatgggaggactgcagaggcacatgatattcttcctgatggccacaaactgaaaaagggggatggagtgtactatttggcctatggtatgggccgaatgtgttccatttggggtgaagatgctgaggaatttcgtcctgaaagatggctcaacaatggaattttccaacctgaatcgccattcaaattcgtagctttccat

SEQ ID NO: 43198 - DNA, 282 bp, Glycine max
  Peptide Sequence Number=SeqID_159976
atggcttggtttcagggtcgtcttaagattgcagactttggttggtctctacagtctagaagcaaaaggcatactatgtgtggaaccttggattatttagcacccgaaatggttgaaaataaagctcacgatcagtggcggatccaagaccttaagataatgaaagttgacctatgtttcccttctactcctaatgtttctttagaagccaaaaatcttattagtcgagttacagagatttggatgacgccacttccagtgaaggaagataagtcagggtag

SEQ ID NO: 43199 - DNA, 372 bp, Glycine max
  Peptide Sequence Number=SeqID_159977
atgaccatattggtctctgcttgtcaatcggacttggtgtctccgaatgatgaggtgtggataatcgtaaggtgtctccacatgctaccggactctcgagtcgctggatatcaaagggtgtgtgcgggttaccatcaggtgtctccgcatgctaccagactcttgggtcacgataacaaaaggagcgcatcacttgatacaggctacggagaattggatgacgccacttccattgtcgcaacgtgcccttcgcgggcgagcgagggcgaggctcacgggtgcgctttccaaaggaggaaagatgcgcggagtcgccaccaacgtttatttgtggaaaacgtcgggaaaaccgaaggaaactggtcaaggtga

SEQ ID NO: 43200 - DNA, 699 bp, Glycine max
  Peptide Sequence Number=SeqID_159978
atgatcggtctgagcgtggcgattcagatccccggctttatcgggctcggacatcatctgaaacccgatctggtgctgctggtcaataatgcgattgcttcaatggccggcgtgctgtttgcggtgatcctgaccgcgctgatgcgcaacaagcggccatcgtggaccgcgcgccgtgccgtgcgtcacggcctgcgtgaactgctgcgctttatcaaggagattgagcgcaacggctcatcgctgctgggacgccagcgttttattggcctgatgctggataaggtcaacgtggtgctaccgcgcctgcaccttgatccgcagtccgatatggcgccggcgggaatgctgctgaccgaggtgtggctgggggttaatagctttgactactacgcgcgccatcaggcgctgctgagccgttatcagctggacagcgggcagatgtttcacgagctgggactgtttcttaagcgcaggctgaagtcgctgcagacgccaccgcatgaggatttgcaggaggagctcgatgtgctgctgatgcagctggaacagctggcgcagcgtgacgaggcgctgttgctgccgctgtttcatctgttcagcatccggctatacctgtttccgcaacttagctggccggtggcgacgccgcgtcaggccgaacgcctgcagcagcatcgttaccgcctgcaggcttag

SEQ ID NO: 43201 - DNA, 234 bp, Glycine max
  Peptide Sequence Number=SeqID_159979
atggaggaatcatcaggaacaaggcaaatgaggagaaaattgtgtgttggccgattaaagatccaagttaagtacaacacctattgcacttaccaaaatttggagctaggacacgtcaaggtggacgtggccaaagtgaacttctggacttcacatgtcgactttaagagcagcctttgtcaagagcacaagaggggagacctgcaaaacaaagggactctgatgtttaagtaa

SEQ ID NO: 43202 - DNA, 246 bp, Glycine max
  misc_feature (187)..(187): n is a, c, g, or t
  Peptide Sequence Number=SeqID_159980
atgaagatgctcttgataccacatgatgtagctccatgtggagcttgtaggccttggatcttcttcatcaatggattcctttgcttcttgaggtctgattgtagcagaatggagaaggagaaagatgaatggagacgccacttcaagataatgaggcaagctttgaaaagtgttgtttttcaccttntcgctaagccaatcttctggcttagcgagcatccgctaagcgcaacactcatgggctaa

SEQ ID NO: 43203 - DNA, 138 bp, Glycine max
  Peptide Sequence Number=SeqID_159981
atgcatcgacgtgatcaaggtggccttgttcgtgctcatgcgcttagcgcaattatggaccgcttagcgcacattagtgaattttggcttagcgcgtgtctttctcgcttagcggatggactgaagcggtgcgcttag

SEQ ID NO: 43204 - DNA, 201 bp, Glycine max
  Peptide Sequence Number=SeqID_159982
atggttataggaaagatcaagataatgggagagagggatcatattcatcactctcatatcaaaaggcataaaattcaaaggtgctctagagaaagggatgaaaaaacccctgaacagctgagaagtgtcattaacactattgccaaaggattcctcgaaggaggagcaacaacgtcaactgggaaaggacacctacaccaa

SEQ ID NO: 43205 - DNA, 962 bp, Glycine max
  Peptide Sequence Number=SeqID_159983
ttggcccagggcttccccggtatcaacagggacaccaggatttatttattctgcgaagtgatcttccgtcacagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatctatcgcgtcttggctgtcaccatcgccatgaggcgtcggcgcaagtggaggtgcgacacctggtgcagattcctaccgctcctccggtgcagttggacgagaagcaacaacaagatgctcccatccaactattgtcgctgtggaaaagtaagacttttctcaatctccgtttcggcattcccaaaagttttcacggacagcataccatcggatgggatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaaa

SEQ ID NO: 43206 - DNA, 563 bp, Glycine max
  Peptide Sequence Number=SeqID_159984
agaacgaccgtagattcgaagcgccacagctagtcatcgcccacgacctcccgccatcggaccgtgagccgcacgggcacccgtccggtggctgccgcggtgtcgatcaggcgggtcacctcgtcgcgcgtctcctatgcggacctggccgggagcccggcgccgcgcacgaccgagacgggcagcgtgtgcacggccgcgatggccgctcccatggactccgccgccccgcgaccggccggcacgagggccgcgtcgatctggaacccggggaggagctcggtcaccagtgccggtgcatctcccagccgtgtctcgccgatgtagccgggggcgtggaagggcagcatcgcccgggcgccggccgtcagcgcgcgcagtgcgatggcctcggcggccagctcccgcgccgactcatcgtcgtcggcgacgcggatggcgagttcgcgaccgtcggccagcgtggcgacagcggagtcgaagcggccgtccccgtcggaggacagggcgcgggcgcccgtgacctcagcaccgggaagtgcggccgtcaccgccgcggctag

SEQ ID NO: 43207 - DNA, 507 bp, Glycine max
  Peptide Sequence Number=SeqID_159985
atggcggcgaagttgtctgtggggtattctttggatcaaataccaaacgatataacgaagaagacaccggctagttttgagccctctattgattatgtggttactaagattccacggtttgcttttgagaagtttcctggttctcagccaatattgacgacacagatgaaatctgttggtgagtcaatggctgtagggcgaaacttccaagagtcgtttcaaaaagctgttcgctctctagagtgtggatactctggatgggggtgttcacaagtgaaggagatgaactatgacttggagcaattgaagtatagcctccgagttcctaaccctgagcgcattcatgccatctatgctgcaatgaaaagagggatgcatattgatgaaatctttgagctgagttacattgacaaatggtttctcatgcagctcaaggagctggttgatgtggaaagtttcttgctgtctcacaatttgtctgatttgacaaatattgatttctatgag

SEQ ID NO: 43208 - DNA, 983 bp, Glycine max
  Peptide Sequence Number=SeqID_159986
acatttgtgtggaaaactttatcatctactatacgctctactggtggcattgttttaacagtggcttcaagtgggattgcctcaatactattgcctgggggtagaacaacacattctaagtttgctattccagtccctgcaacacaaaattctacatgtaatatccatcaagggagtgatttggctgaattgttgcagatcacaaaactcatcatatgggatgaagctccaatgtgtcacagatacagtattgaggcccttgacaaaagtttacgggatatcatgcacaatggaaatccttttggaggaaaggtcattgttttcggtggtgattttcgtcaaatactacctgttgtgccaagaagtaatcgctctaacattgtctatgcaactctaaatgcatcttacatttggaaccattgtcaaattctaaagctgacaaaaaatatgcgattgcaatcaaatcctactgaccattccaactttgatgaactaaaacaattttctaagtggctcctagacataggcgatggtaaacttgtagaaccaaatgatggctatggtgaaatcaccatcccagatgagtttcttatcaaggagtttcaagatcctatccaggaaattgttgaagcaacatatctagacttattacacaactacaacaatggagatttcttgcaaaaaagagctgtcctggtctctacaaaaggtgttgttgacaaaataaacaactatgtcttgtctttgattcctggtgaggagaaagagtattgtagtgttgattgtgttgacaaatcagatgaactactcagtcctgcttttggagtactaacaactgaatttctaaactcattgaagacatcaggaatacccaatcacaagctcagaatcaaggttggtactcccatcatcctactgcgaaatctagaccagactgatgggttatgcaacggaactaggcttattgttacacgactgttcaa

SEQ ID NO: 43209 - DNA, 453 bp, Glycine max
  Peptide Sequence Number=SeqID_159987
atggatacctcagagccctacactggggcaatgaaaggtaccatgcataaacctcaagcgaacctaggggcagatcagaaattctcacccaataggttccctgctacaagatttactacatctaatgtccaatcttttgaatttgggatgaccggccctctcgatgagtcaatctattgctttctcataagggtggacccttgggtactagtacctattgcatatagaagactacacatcctcaactttagagggctacatgtcctctccttcaaagggctacacgtcctcgccttcaaaggactacaggtcctcgccttcagaggactaaaaatccttgactttagagggctattcatcctcgccttcagagggctgcacaccctcgctattagaggactgcacgtcctcgccttcagagggcttcacatcctcgccgtcagaggactgcac

SEQ ID NO: 43210 - DNA, 252 bp, Glycine max
  Peptide Sequence Number=SeqID_159988
atggagatacacaaatcaagagataacaaattcacaacatacattggcggaacatttcaggtgatgaaaatggaattgcgtggagaattacagagagaggtggttaccgaaattgaggaggaggaacaacagctgaatccgattaaggcagtgatcggaaacaacttttttatggttttcgatcacaaaaacagaggcggagttgggtcttttacctctcgattcgaggccgaagatcacgagaatcgctga

SEQ ID NO: 43211 - DNA, 586 bp, Glycine max
  Peptide Sequence Number=SeqID_159989
ctcacgtgttttccacgtggataaattcggttccagaagcttcacttctcgaaccccttcttacccacgctccaattcactctctttttctcgttccccttctctgaatttcagccccccaagtgttaaatcattgccaccgaacaacaaccctgcttccccttctttctcttcatcctcttcttctccgagggaagaatggcatgttccatctcaggggaaaaattctccagcggccaccgatttacctactcctccgccgccacctcctccgccaccgccgcagttttgggaggctccggttgataaaagtgttacttttaggaacgagagtgaggagactccgaagccaaagttgaaagctttacattgggacaaagttaaggccagctcggacagggtcatggtttgggatcgcttgggaccaagttcttttcagttgaacgaggacatgattgaaacacttttcatggtaaataataataataataattccaaggagggtttcggtgttgcgattagagataatcataatcctcggcgtcaagtagttcattctgcgtctcccaatgcccttggagaatag

SEQ ID NO: 43212 - DNA, 627 bp, Glycine max
  Peptide Sequence Number=SeqID_159990
atggaggcaccagctgatgcagaggacattgtgcccgacattcctgcggacacaggcgcagaggctcttgaggatgagcatcagggatttccgggtggtccgagcgacccatccgatcgtcctgaattgaagctatcctctcatgggaggaaggtccacagtttaggtaggcctatccctgccattgagggacttattgctggtacaggactaagtcctcttatcgcgtgtttggtagacaccggcgatcggggacttttttccgcgtttgtggagtggtggcaccaggagacgtctagttttcatctcccggtgggagagctcaccatcatgctggatgacgtctcctcgcttctccatctgcccgtgattggagacttacacgcctttcagcccttgcacgtggacgatgcaagtctgccagggctgagacaacccagtgtcgtggaccgtacgtacgcctgcaatgggtacgtgatatatatgagcgctgatgccatacaggtcattggacagctacagctcacgcatatcttctccatcttttgggttgcactctatttgctaacaagagtgcaaccaatgtgcatgttgtctacatggaggcccttcgtgacctcagtatga

SEQ ID NO: 43213 - DNA, 375 bp, Glycine max
  Peptide Sequence Number=SeqID_159991
atggtggtggtgatgatggtggtaatgatggtggtgacaatagtagtaatggtgatggttaggatggtgacaatgatgacgacaatgatagtgatgagtggtgagacactggtggtgactatgatggaaatgatggtggagacaattgtaggagtgacaatgatagtgatggtggttattatggtagcaatggtgattgcggtgacgatggtggaatgtggttgttatgataaagatggtggtggcgacaatgacgatagtaacaggggtggtggtggcattgacagtgttggaggtagcggcgatggtgatagggttggtgacgatgacaatggtgacaactacaatgatgatggtgataatatgaggtggtga

SEQ ID NO: 43214 - DNA, 807 bp, Glycine max
  Peptide Sequence Number=SeqID_159992
atgggaggagtgacatcatccatggctgcgaagttggcgttcttcccgcctcacccagcatcgtacaaggtggtgaaggacgagttgacggggcttctgctcctgagtccttttcctcatcgcgagaacgtggaaattctgaagcttccgacgcgccgcggcaccgagatagtgagcatgtacgttcgccaccccatggcagcttccactgttctctactctcacggcaacgccaccgatcttggccagatgtacgagctcttcatccagctcagcatccacttgcgtgttaatctcatcggtttggttctttttgaggatggaaatcgtgggcacttgagttttggttgcttggaggaagggatcgtggatgatttggaatgttgggaaatgggtgtttatcagaatgcggttgtcttagtttcttgtgtttttgaaggaaaagaaaaaatggaggcctttgttggagggtatgactactccgggtatggccaatcatcagggaagccaagtgagcagaatacatatgcagatattgaggctgtgtataagtgtctagaagaaagctatggtaccaagcaagaggatataatcttgtatggccaatctgttggaagtggccctactttggatcttgcagctaaattacctcaattgagagctgttgttcttcacagtcccatactttcaggcttaagggtcatgtatccagtaaaacgtagttactggtttgacatatataagaatatcgacaaaattccactcgttaattgccctattctcataattcatactttcagttgttga

SEQ ID NO: 43215 - DNA, 729 bp, Glycine max
  Peptide Sequence Number=SeqID_159993
ttcagaggactacaggtcctgaccttcagagcgcaacacgccctcaccttaaaaggcctacacgccctcgccttcagaggactacccgtccctgccttcaaaggactacacgtcctctccttcagaggactacacttcctcgccttacgagggctacacgtcctcgccttcagagggctacacgtcctctcctacagaggactacatgtcctcccctccagaggactacacgtcctcacctccagaggactacacgtcctcacctccagaggactacacgtcctcacctccagaggactacacgtcctcacctccagaggactacatgtcctcacctctagaggactacacaacctcacctctagaggactacatgccctccccttcagaggactacacgccctcgccttcagaggactacatgtcctccccttcagaggagtacatgtcctgaccttcagagtactacacgccctcgcctttaaaggcctgcacgccctcaccttcagaggactacacgacctcaccttcagaggactacacaccctcaccttcaaaggactacacgtcctcgccttcagaggactacactccctcgccttcagagggctacacgtccttgccttcagagggctacatgtccttgcctttagagggctactcgccctcaccttcagaggactacacgtgctcgccttcagaggactacacgacctttcctctagaggg

SEQ ID NO: 43216 - DNA, 415 bp, Glycine max
  Peptide Sequence Number=SeqID_159994
atgtcgttggggaccgcgctggatacatcagttgcgggaaactcaaattcggagcgtttcataacgaaaacaacaattaatcaccgaactaagaagaaaagaagagtgtttgaaagagttgagaataatggaacgttgttggtgatgacagacagtggtgacgatggtgataatgatagcgacgacgttggtggtggtgatggtggtagtaatgtcaatggtgtcgttgatgatgatggtggtaatgacaatggtaacagtgttggtgatgacgatgatggagatggtagtggtagtggtatcgatcgtgatggtgatggtagtggtgacaatgaaagtaacagtggcggtgacattggtagtagtggtggtaacaatgccggtggtggtgatagtgatgtgaacaacaatagtg

SEQ ID NO: 43217 - DNA, 372 bp, Glycine max
  Peptide Sequence Number=SeqID_159995
atggaactgagtgacattaagaagaggcaggaccggagggagccgcttcctccgccgccgctgccgaggattccggcgaaggacgacggcgacggcggagagagttgctgggaactggaaccgcttcttcttcctcttttgtccggtgcttcttcttcctctcttctccggtgtcagtggttgttgttcctcttttctccgacagtggttcttgttcctgttttcgtggtggttcgtggttgttactgtggtgctttcgtcttcttcggtcgttgttcctttggtcttcttgatcgccttcgagttctccttgcttcttcgttttcgtttccatgcccctgtttcttcgttttcgttctcccctgtccatga

SEQ ID NO: 43218 - DNA, 1430 bp, Glycine max
  Peptide Sequence Number=SeqID_159996
atgggtaaggaaaaggttcacatcaacattgtcgtcattggacatgtcgactctgggaagtcaactaccactggtcacttgatctacaagcttggaggtattgacaagcgtgtgattgagaggttcgagaaggaggctgccgagatgaacaagaggtcattcaagtatgcctgggtgctcgacaagctcaaagctgagcgtgaaagaggaattaccattgatattgctttgtggaagtttgaaaccaccaagtactactgcacggtcattgatgctcctggacatcgtgactttatcaagaacatgattactggtacctcccaggccgactgtgctgtccttattattgactccaccactggtggttttgaagctggtatttctaaggatggacagacccgtgagcatgctcttcttgctttcaccctaggtgtgaagcagatgatctgttgctgtaacaagatggatgccactacccccaagtactctaaggctaggtatgatgaaatcgtgaaggaagtctcttcttacttgaagaaggttggttacaacccagacaagattccctttgttcccatctctggttttgagggtgacaacatgattgagaggtccaccaaccttgactggtacaagggaccaactctccttgaggctcttgaccaaatcaatgagcccaagaggccctccgacaagcctctaaggcttccattgcaggatgtctacaagattggtggtattggtactgtgccagtgggacgtgtagagactggggttgtgaagcctggtatggtggtgacttttggtcccactgggctgacaactgaggttaagtctgttgagatgcaccatgaggctctcacagaggctcttccaggtgacaatgttggatttaatgtgaagaatgttgcagtcaaggatctcaagcgtggttttgttgcatccaactccaaggacgaccctgccaaggaagctgccaacttcacatcccaagtcattatcatgaaccatcctggccagattggtaatggatacgcaccagtccttgactgccacacttctcacattgctgtgaagttttctgaaatcttgaccaagattgacaggcgatctggtaaggagcttgagaaggagcccaaatttttgaagaatggtgatgctggtatggttaagatggttccaaccaagcccatggtggttgaaactttctctgagtatcctccccttggtcgttttgctgtgagggacatgcgtcagaccgtagctgttggagtcatcaagagtgttgagaagaaagaccccaccggagccaaggtcacaaaggctgccgccaagaagaaagtcttaggtgtttgttttaccagttatattttgaagtgtccgccgatttcatgtagccgtagccttcaaaactgggttcttgatcggcg

SEQ ID NO: 43219 - DNA, 351 bp, Glycine max
  Peptide Sequence Number=SeqID_159997
atgaagcccgatatgtccttaaaaatcaaagaagaggtgaaaaagcagttcaacactggctttttggtcgtggctcgataccccgaatgggtagccaacatcatgtcggtccctaagaaagatgggaagataaagatggcgccggaggacatggagaagactacgttcgttaccctttgggaaacattctgtttcaaggtgatgtccgttgggctcaaaaatgctggggcaacctatcaacgggcgatggtagcattattccatgatatgatgcacaaagagattgaagtatacgtgaatgacatgattgcgaaatctaaaaccgaggaggaacatctcgtcaacctgtag

SEQ ID NO: 43220 - DNA, 423 bp, Glycine max
  Peptide Sequence Number=SeqID_159998
ccaaagatccacaagggatgtacccctcccttgttctctttgaacaaccaagtggatgtacctccacttgaacggatccacaagagatgtaccctctcttgttctcagtacaacaacccaagtagatgtaccctctacttgtaccacaaaggatgtatcctccaatgtgttaagacaaaggattctcaggcggttagtccttcgaatctttgtaaggggaaacaaaagatatctcaggcggttagtcctttgaaatcttttgttaaaggggaagggaagaatcaaaagaattctcaggcggttagtcctttgaatcttttggaaagagagaagggagacacaaaagaattcaggcggttagtccttctattcttttggcaaagggagaatagaatgaaaaaaaagagtagcacaagtttttga

SEQ ID NO: 43221 - DNA, 348 bp, Glycine max
  Peptide Sequence Number=SeqID_159999
atgccaggcttaagtcccgacattgtacaacatcaattacctctgaatcccaggtgctccccggtaaagcaaaaattgcggaggatgaagttcgagatgtccttgaagataaaagaagaggtgaaaaggcaatttgaagccggcttcttggctattgcttggtacccggaatgggttgccaacattgtatcagtccctaagaaggatgggaagttgggaaagttgctcggctttatcgtaagccagaaggggatagaggtggaccctaacaaggtgaaagccatccttgaaatgcctgagccactcactgagaagcaggtccaaggcttcctaggacgtctgaactaa

SEQ ID NO: 43222 - DNA, 237 bp, Glycine max
  Peptide Sequence Number=SeqID_160000
atgttgtggaactttacggattgtgagacaatgttccctttcgacttccggatgccgcgacacttcacggattacctaacaatgggtgttaagtacctcgaagcggtcaagcaaaggttgcaagccatcaaacaatggtccccagacaaaattagggtttgtcatcatcagaaagggggagattgtggaagcaaagcttccaagcttattttgatgatgccaaaaactcaagtctag

SEQ ID NO: 43223 - DNA, 445 bp, Glycine max
  Peptide Sequence Number=SeqID_160001
atggacatcccactgagaagcactaggaagtaccttttcaaaaaaacagacctgttgagattaagggagctagcatctttagtaagtgatccagttgattttcaagctcatcatgggaagttgctcagaattcttagagtagatgttgaggaaggatgcctagagaccctggttcagttctatgacccgctctaccattgcttcacatttcccgattaccagcttgtccccacacttgaagagtactcctacctagtaggtttacctgtgccagacaagatacctttccatggttttgagcctacccctaaaccctccgacatcgcagccgccctccatcttaaaacctccatcatccaagcaaaccttacctctaaaggaggcctccaaggtctccccacccacttcctctaccaacaagcctccatatttgctgaagcagcta

SEQ ID NO: 43224 - DNA, 219 bp, Glycine max
  Peptide Sequence Number=SeqID_160002
atgctaggtagaactgcagctggagatttagctcttatcaactgggaaattgaaaccacttgcaggcgtaacaacgctgtaagaaaaagaagggaacaagaagcacaaggaagaagtcaaacctcacctcctccctctccacaaagctacattcaaatggaagaggaacatgcacgacgaatgacgctagaggactactctagtacaacaactccataa

SEQ ID NO: 43225 - DNA, 542 bp, Glycine max
  Peptide Sequence Number=SeqID_160003
ctcacgttccctattggtgggtgaacaatccaacacttggtgaattctgcttcacaatgataggaagagccgacatcgaaggatcaaaaagcaacgtcgctatgaacgcttggctgccacaagccagttatccctgtggtaacttttctgacacctctagcttcaaattccgaaggactaaaggatcgataggccacgctttcacggttcgtattcgtactggaaatcagaatcaaacgagcttttacccttttgttccacacgagatttctgttctcgttgagctcatcttaggacacctgcgttatcttttaacagatgtgccgccccagccaaactccccacctgacaatgtcttccgcccggatcgaccggccgaagccgaccttggctcccacttatcctacacctctcaagtcatttcacaaagtcggactagagtcaagctcaacaggggtcttctttccccgccggattccgccaagcccgttcccttggctgtggtttcgctggatagtagacaggggacagtggggaatctc

SEQ ID NO: 43226 - DNA, 693 bp, Glycine max
  Peptide Sequence Number=SeqID_160004
atgcagcagcgcggtaagaaaaccggcgttaaagctgtcgccggcaccgatggtgtcgaccaccgcgaccgcgcgaccaggctgttgcaggctgtgctgacgttgccagcagcccgcgccctgcgcaccgcatttcaccacgcagccgccgcgcccgctgagccgttgcgccagcaggtgcgcgccggtgtgcagatcatctgtgccactcagcccgagcgtttcgacttcattgagcagcagccagtcgcactgcggcagccagcgggcgatctgcgcgcgtacctcatcgctccagccctgcggcggccagccggtatcgacggcggtgataaacccgcgctgctgcagttcggccagcaactgcgggtagtcgtcatacagttgcaggcagagaaacgtgccgcacaacagcacgatatcgccgctgctggcttgcgccgggagctggctcagcacgtcctgcgcgctgagccgcacaatgtgaccgagattgctgaggaacgatcgctcgtgatcggagtgcgtaacgccaacggtgagcgaggtttcgcaggcgtagcgcgtccagtgcgccgcgctgtgcggaaaatggctcgccagccatgcgctgaggccatcatcgccctgattagcgacggcgcgatggcgcacctgcatcgcttccagcgccagcgcgcagttgcccgctga

SEQ ID NO: 43227 - DNA, 1221 bp, Glycine max
  Peptide Sequence Number=SeqID_160005
atggccggtgttgaactcgttaaagtggccaagcgctacggtaaacagtcggtgctgcatccgctcgacctgaccattcccgacggcagctttaccgtgctggttggcccgtccggctgcggcaagtcgacgctgctgcgcctgctcgccggactggagagtctctccgacggcgcgattctgatggataaagtgcagattaacgatcgcgatcccgccgatcgcgacattgcgatggtgtttcagagttatgcgctttatccgcatctgacggtggccgaaaacctggcgtttcatatgcaggtgaaaaaggtacgtcgcgatgagcaacagcagaaaatcgcgcgcatcgccgcgattcttggcatagataagctgctgcaacgctacccgcgcgcgctctcgggtgggcagcgtcagcgcgtggcgatgggccgcgccatggtgcgtaatccgcaggtgtttctgtttgacgaaccgctctctaaccttgatgcccagctgcgcatggagctgcgcgccgagatcaagtcgctgcatcagcgtttcaaaaccaccatggtgtatgtcacgcacgatcaggtagaagcgatgacgctggccgaccagattgtggtgatgaaagagggacgcatcgtgcaacagggcgcaccgctggcgatctacgatcgtccggcagatacctttgtggcgcgttttattggttcgccgcccatgaacctgttaccggcacaattgctgacgcatgacggcgtgccgggcgtgcagtgtcaggactggtggcagccgctgcccgcgcagtggcaggcggtggcgcgggaacgtgaaggcgctgccgtgacgctgggggtgcgcccgcacgatctgtgcgaagtgcaggacggcgcgcctgcgagggtgaacgtggtggagattaccggggaatcaactctgctgcaccttgactggcacggtcatgcgctgcatatgcagatggccggacggcatgcggccagcagtggcgcgacgctgcgcatcggtttcaatccgcaaaaaattcatctgttcgatgccgaaagtggtttacgcctggcggaaaaacgggctgactttttcccctccggcgtcagccttcagcccgtcaccgggctggaacggtcccgggcggttgacggctggtcagcacccaccagcaggtacccatcatcagcaaactccaccggcccagcggtacccgcttga

SEQ ID NO: 43228 - DNA, 747 bp, Glycine max
  Peptide Sequence Number=SeqID_160006
atgagcaccgcgcaaacccttacccccgctgagctgaacaaccgtaaattactcggtacctttttacgtacgcgccgtgagagcctggatcctaaccgcctcggtttaccgcgtatgcgtcagcgccgcacgccgggtttacgccgtgaagaggtagcgcagctggcggatgtcggcgtcacctggtacacctggctggaacaggggcgcgatatcaaagcctccaccaaaacgctgacggccatcgccagcgccctgcaatgcaatgatgttgagacacagcatctgttttcgctggccggacacaccctgccatcgacgcgcgtcgccgctgcctgctgcaaactcgccggacataatcagcaaatgctggatgccattcagctgccggcgatcatcgaaacgccgcgcttcgatatcctcggctataaccaggcgtggtgcgcgctgatgggcgtcgatttagcccagatcgcgccggaagatcgcaactgtatctggctggcgttcaaccatgccggctggcgtaacgtgatgaccgactgggacgaagtaatgccacagatggtggcgatgtttcgcgttccgatgagttcgcgcacacctggcagcgctacgaactgggcaaggtggaaaccgcgtaaagcgcttttaccgtgccgaagtgggcgaaatgacgctgcgccagaacaactggtggtcggcgtcacgcaacggcgatcgcctgctggtgtatgtgccggatga

SEQ ID NO: 43229 - DNA, 504 bp, Glycine max
  Peptide Sequence Number=SeqID_160007
atgacgaccgtcaccttaaagaaatggggcaacagtccctcgattcgcatcccgtccagcgtgatgcaatccgcgtcgctcagcgtggacgataaactggaactcagcgttgaagatggcaaactgatccttgtgccgctcagggaaaaggttgggcaaggaaagaatctgatggtgtcacgttttgttcccgatgcaggcgatctcatctggctggattttgatcctaccctcggccatgaacagggcggccatcgtcctgcggttgtgctgagtccctttgcctataacaacaaggttggcatgttgttgtgcgtcccgtgtaccacccaggtcaaaggctatccttttgaagtttcccttaccggtagccgtgatagtgtggcgctggccgatcaggtcacctccatcgactggcgcgccagaaaagtggtgaaaaaaagccatgtgaccgccgacgaactgagtgagattcgcgctaaagctaaagcgctgattggctga

SEQ ID NO: 43230 - DNA, 195 bp, Glycine max
  Peptide Sequence Number=SeqID_160008
agtgggcgtgaagctgttttcccaaaatgggggacccacaagagtccaaaatggaagcataggtggtggaactcggtggctcgtggtaaaggagggtcaagtgagggtttaggtttgagggaagaagggagaggcttgctcggttggaggaagagcgagttcggggtgggtgagagaggagtggggggtgagtaa

SEQ ID NO: 43231 - DNA, 246 bp, Glycine max
  Peptide Sequence Number=SeqID_160009
gggcaggatcatcttgagctaccttctggggtagagacaaaacatgaacagcagaaaccaatcaaggtacttaggaacggatgcaagtggggatggggtcacgaccgactgatcgtcgcccctttctctgcgctaaacaagcagagaacgtcgctgcaaggcagccccgtatcctttgtattcgcagttttcttttactatttgttcgttttaaaaataagtaatcaacgcctaattctaacttaa

SEQ ID NO: 43232 - DNA, 453 bp, Glycine max
  Peptide Sequence Number=SeqID_160010
atggaaatgatgacaaggaggatgaaaagagagaagaggaagaaaatgacatctctaatgaaactggccttgccaattgcaatttcgtttgaagtaacaaggaaacttatgacccccaaaacagcactggagacaaaaaatgctcccccgagaatgctattgaggccaactgccccatcattggatcttgtgaaagaaacaacactggcaaaaaaatcaggggcaccatttcccagagaaagcaaggttaccccagctatggtaggggataatcttaagattgcagccatcaacactgatgtcactgagcattctagcatggttgaagacttgatgcaatcctaccccgcaagggcattggctagaagactccaagtagattgggctagagatccaaggaaaggccctagggttctcatgagccttagggtagatttcgagcccatgggctaa

SEQ ID NO: 43233 - DNA, 240 bp, Glycine max
  Peptide Sequence Number=SeqID_160011
atgaagaagttggctttggagaatcaacaaagtaatgcacctattcagaaacatggtaggatccaaattctgaagaatcaacctcaaccaatgtatgaaaatgaagaagagatgatggttgataccttcgaatttggtttcggtgattctttggaagacatcactagaaccatttttattctccccgctaagtgtgaggaacagtatcagactagtgcaagttatcttgaatttggataa

SEQ ID NO: 43234 - DNA, 1227 bp, Glycine max
  Peptide Sequence Number=SeqID_160012
acacccgtgtccgcttcaaagctattgctcatgcgccgaaaaaggaagagtcgattgggaccaacatttggctgggatagggggcagcacgatcaattggtttcctcgttggaaggaaggcaaggaaggagttcttttctcgtgtggggactatcctaatgttccactgatagggactaggggttgtattaattataatcccgcactcgccataagacatctagggtatcccatgaggggagcgccaaccgaagaaagtctctcgcctttccttgtgaggaatctaggcacacaaagtctcaaggcgatacaaagaatccacaaggcgtggaggagtccgttgaggaaagacaaggagcttagaggcatccgaaacggcgtcatcgggggttatcatggatggctaagaattcacacgcggggcttagattggctctccaaattgaaagttatcaatgaggagaacttcgaagctccggaggaagatgaagaagttcgagctctaaaattagagctagggaaggcgagactcgccaaggagaagttcaaatcagctgctacacacatccggaaggagtgcaccgagttacaagaggaaaacgcagccactacaagagcccttgaacaagaaaccaaaagggcccgcaaggaggaatatggccgagagaaattccgaggagcattgtggggtagcaacaatgagctcaagctccgaagagaggagagagatcggttcacggccacggagcaaagcatgctagctatcataaggcaatacaaggaagaattgaaccagtccatggcccatgaacaaaagctagtggaggattttgcacaagtgtatgccgaaaaagaagcaagagggagggtgattgatgcactgcatcaagaagcgactatgtggatggataggttcgccttgaccttgaatggaagtcaagacctcccgcgtctattagccaaagcaaaagccatggctgaagaacagatgaaggccgatctatcggccttaaaagatcaaatggcttccatctcggaggtcatgttaaaactccagaaaaccatagaggataaagccactgcaaccgcctccagtacagttagggaagcggagccggtgctgcagcccgccttgaatccgggcctagacagaaacacggccgtgttcggtcgaaggtatagtccgcaagcttatccttatggcctgcctccggacttcaccacccc

SEQ ID NO: 43235 - DNA, 744 bp, Glycine max
  Peptide Sequence Number=SeqID_160013
atgccgcagtacctcgaattccttgggcgacaggctgttgatgcgctcgccgatgaacttgtggcgcgcggccagcgaaccctcgcgctggaaaccgggaggatagtatttgcggcccagctgcagcgcgtgcagcgcggtgacgatctcgcccaggtcgtcgcgcttgaacaccacggcctcgacgccggcgtcgtacagcgccgaaatgatcatgggattggacaccatggtcagcacgacgatgcgggcgccgggaaagtggcggatcaggtacttgaccaggcggatgccgtcgccgtagatctcgtcgcccggcatcgaataatcggtgatgacgacttgcggcagatcgcgcttcatgtgctccaccagcgcggtggggctggccagcgtcgccacgacgtcgaagctcaggtccttgttcagcaggtcggtcatgcccatcagcacgagcggatggtcatcggcgatgacgatgcggagtctttgcatgcgaggcgcagtcaggttggccgggacggcatacggattattctgcaccaggatccggacttgaaccaaaatgtttcgaagccagggcgtaagacggaatcgtatcgacgtttgcggattcggaccataagaagaatctcaaaaattggggacagtcattgtcgcttgatccgttcgctcgggcgtgaggcgatcgccggggccagccgtggccccgccgctcccgcggtgtgcgcgcgccgcgattga

SEQ ID NO: 43236 - DNA, 597 bp, Glycine max
  Peptide Sequence Number=SeqID_160014
atggcagtggaatggagaaggaagagagagaggagatgccacttcaaggaaaagatgggtcaagaagaagctcaccaccattggaagccatggataagagtttggaggaagaatgagatgaatgaagggagacggagagaagagcgcaaaattttggaaagatttgactactttagcccaggtgtggatgttctctcatactctaacctggtccccacatcacatacctctgatttgacagtggacagagctaggctgatctttggcctagtctctcgcatggacatgaacgtaggagctctcatttttggccagatgacttttatagcccagtataactcttctcgacttgggtttcctactctgatcaccgccctatgtagagctagaggggttgtctctgacagccttacttttgagcgccttagcccagtcattaacttggcctacatcaggaaaaactgttggagtcttgatgatctgacagtttctatccgaggggctagaagggtgagggcgaggccagctaagcttccttccacatctgtagctcctactccagcatccacttcagcagctccttcagtcccagcttag

SEQ ID NO: 43237 - DNA, 285 bp, Glycine max
  Peptide Sequence Number=SeqID_160015
atgtcaagaaaccctaatggaagtggaaatagaaatctggcagaaacggcgtcgtacgagagcaacggcggcaacgattccatagaggatggagaggaggtggaagattcaatcctgccagagcggggagcggttgatgtcccgccaccagttggaggatcccgtcaagtcaagggcggcaatagccaccgccgccatcgccggcacacctctcgccaccatggaatcgttgaatggaataatggaaggagccttcgttcgatcttcttcttcttcttttgttga

SEQ ID NO: 43238 - DNA, 525 bp, Glycine max
  Peptide Sequence Number=SeqID_160016
atgcggaccctcaaggaaatcctccattctccccctttttttccgagctccatgaattgcgttttcattcatgtgtcctccactttcgagtttggagctgtgtttcatgattgcctaagtgcggaccctcaaggcaatcctccattctcccccttttttcggagctccatgaattgccttttcgttcatgtgtcctccactttcgagtttcgagctgtgattcatgattgcctaagtgcggaccctcaaggcaatcctccattcttccctttttttcggagctccatgaattgcgttttcgttcatgtgtcctccactttcgagtttggagctgtgtttcatgattgcctaagtgcggaccctcaaggcaatcctccattctcccctttttttcggagctccatgaattgcgttttcgttcatgtgtcctccactttcgagtttggagctgtgtttcatgattgcctaagtgcggaccctcaaggcaatcctccattctccccctttttcttcggagctccatga

SEQ ID NO: 43239 - DNA, 149 bp, Glycine max
  Peptide Sequence Number=SeqID_160017
atggaggagttgattacaaaacacaactctctctcccaaaataattccaatgtcatcatgtcggctcggcggttcctcactagaatcttactccctacaccctgcttctgtcattctgctcccacaaacaaggtttgcgatcatcacag

SEQ ID NO: 43240 - DNA, 393 bp, Glycine max
  Peptide Sequence Number=SeqID_160018
atggctcacgaaatggttctccgaattgaaagtggatgctctggatctcgaaatggaagctgctctactacctttgctgctagaggatttggaactaggccttatgctgctggtggaggtagtggtggggaagctggttctagatctacttttgctgaatcgacagaatctactgctcggtcgactgactcaaccatgtctttcttcattgactgctttcatcaacagaatcgccggaatcaaccggctctactgaagcaactactcactctggatctgctactggaagatatgaatataggcataggtaaaggtatggtcaaaggcaatcgcagtggttgtttcacccagagccggagtagattcactcatagcagatacattggttattga

SEQ ID NO: 43241 - DNA, 249 bp, Glycine max
  Peptide Sequence Number=SeqID_160019
atgccttggaacgagaaaccaagaaggcccaaaaggaagaacacgtgccagcaaagttttgaggggctttatagggcagcaatagtgagctcaaactctgaagagttaagcgagactgaagggaatatgtgggccatcatcgatgagtgcaaagagaagctaaatctagcggcgactcacgagcaaaggctagaggatgagtacgccaagatatcagcagaaagcaaagcaagggaagagggtaattga

SEQ ID NO: 43242 - DNA, 569 bp, Glycine max
  Peptide Sequence Number=SeqID_160020
atgctcaccagcatgaacaccttgacccagatgtggatgacattgctgctcagcaatgtcttgcctagtgatcataactccgatctccctctgtcgaagtgtcaactggtgtatgccatcctgacacggatgagcgtccacgtggctcagttgattgctgatgccatctatttgtttgcaggtatgccacccaccaggcaccctctagacccggataagtctaacagggccctggggtttccagcattgatcacgggcctctgccaatcattcggggttcctgtcacccctagtaagggtgatgcacctcaagccgcagacgcactgctaccacctcatcacgctgatcccactgggtcacttggcatggagcgttatctacagcacttggttcgccagcaggcagctaaccatcgggggcagtgtagggctgaggtcgcatggcccgaagattggcccgaggcccaggcaggggaggcgcctgcaggagctcccggtgatgcagaggaggcccgtatggatgaggagaagatggacttgctcggtttcttaggaggaagcggagccac

SEQ ID NO: 43243 - DNA, 510 bp, Glycine max
  Peptide Sequence Number=SeqID_160021
ggatcgcacccacagagacacccagtggacctgaagaagtccaacaaggccctggggtttccagctctggttacgggcctctgtcggccctacagggcgcccgttccccccagcaagttcatgtcgtcgtggcatagggatcgtgcccgcaaaacactctgtggacccggagaagtccaacagggtcttggggttgccagctctgattacgggcctctgtcgattctacggggtgcctgtcgcccccagcaaggcgtagggcgaaacaccacagcagcattgggatggccggtatcgggcaatagacacaccgccaccacctctagagttcacctcagctcatccacaaaaaggttagagcgttgcctacaacacatggccgaccagcaggctaccaagtccaaagccaaagataagcaaaagtactatgtcagtgacaaacaagtcatcaggcgtccagctcaagacgttaaagaagcgctactaggaaggcaacctagtaccttttga

SEQ ID NO: 43244 - DNA, 774 bp, Glycine max
  Peptide Sequence Number=SeqID_160022
atggcccggaaaaaggtgaaactagcattcatagccaacaattctaaaaggaagacaacatacaacaaaaggaagcagtcactgctgaagaaaacggaggaactcagcaccctttgtggcattgaagcatgtgctatagtttatggccccaatgatcctcggccagagatttggccatctgaatcgggtgtcataaatgtgctgggaaagttcaaaagtatgcctcaatgggagcagaccaagaagatggcgaaccaagagcgtttcattgcagaaagcatcgtgaagggtaaagagaaattgaagaagcttgcggatgagaacaaggagaaggaaatgtccttgttcatggttcagtggcttaaaacagggaaagttcagcctgaacataacatgaccatggctgatttcaatgttctttcatcgatgattgatcaaaatctaaaggacattgctaaaaagatggaaatgctgaatgttaatgaggtgataccaaaccaaccccagatgcaaaccccagcgttccaacccgatataccaacctcatcattcgaaccccagatgcaaaatccatcataccaaccccagatgcaaacaccagcattccaaaccctgatgcaagcaccagcattggtagcataccaaccccagatgccaacactaacacctgaagaaatgacactgctgaataatggctatgggtccgatatgaatgctaatcccatgcaaagccagggatttatggactggcttaatggtaatggggatgactaa

SEQ ID NO: 43245 - DNA, 276 bp, Glycine max
  Peptide Sequence Number=SeqID_160023
atgggatccgggaaccgcacaaggctagcaagcggatctgggtactctcaaaatcaatcccaagggattaagctagatgtatataaggagaaggtgggtgctgagacggaagggatgactcctgcaggggtgattacgggtggtgtgttatggcatggccagagtaagggtaaaggcagccatgggaggcagccatgggcgatgaatgcccaagaagaaaggagattctggaaattgctgcattgttacgtgagagatggtaatgagagagaatga

SEQ ID NO: 43246 - DNA, 633 bp, Glycine max
  Peptide Sequence Number=SeqID_160024
atgaagaaggtgaaactggtgtatataaccaatgactcgaagaggaaggcaacatcaaagaaaaggaaaaatggtttgatcaagaaacttgatgaaattggcaccctttgtgggattgaagcatgtgctataatctataatccaaatgatcctcagtcggaggtttggccatctgaccttggaatccaaagtttgctttctaggtttaggagaatccctgaactgcaaaagagcaaaaagatgtttgatcaggaaagctttttgaggcaaagtatcatcaaagcccaagagcagccgaagaaacaaaagaatgaaaacaggaagcatgagatgacacatcttatgtttcactacctgactatcgggaagatttttaacaatcctaacttgattgatttgaattatctctcatggttgattgatcaaaacttaaacgaaatagaaaagaagattaataggatcctaacccaagaagtgacaccagtgattgaaaatggaggagagaaagcatatacaaatcatgttccagggcaagggagcaacatgaacgccatgcaaaaacattggtccatggaatttattatggtagtgccggggatgagatgctaccattcggagatgttaatgccctaa

SEQ ID NO: 43247 - DNA, 690 bp, Glycine max
  Peptide Sequence Number=SeqID_160025
atgacccggagaaagacgaaactcacattcatagccaatgatactgagaggaagacttcatacaagaaaaggaagaagtcactgctgaagaagacggaggaacttagcactctttgtggcattgaagcatgtgccatagtttatggccccgatgatcctcagccagagacttggccatccgaagcgggtgtcaaaaatgtgctgggaaagttctctaccataccagaatgggagcagggaaagaaaatggcgaaccaagagagtttcattgcagaaagcatccagaagggcagagacaaggtgaagaaaatagggaaggacaacaaagaaaaggagatgaccatgttcatgtatcagtgcttcaacacaggtactgttcatcctgataacaacatggccatagctgatttgaatgttctttcatctgtgattgaacagaagctgagggacattagtagaaggatggaaacgctgaatgttaacgagacaacaccacagcaacccgagatgcaaacaccagcgcttcccgtagcgcctgaagagacaacgacgacaccgctgaattatggccctgatgagtcggatgtgaatgctgaccccttggaaagccagtggtttatggacttgcttaatggtaatggggatgagacaccaatgactccatttggagatgttaatctcccactctaa

SEQ ID NO: 43248 - DNA, 504 bp, Glycine max
  Peptide Sequence Number=SeqID_160026
atggctagaaagaaggtcaacattagatacataagcaatcccgccaagaggaaggcaacgtttaagaaaagaaaaaatggtttgttcaaaaaggtttctgaaatctgcaccctttgtgcaattgaagcatatgctatcatttattctccagatgaacctgcaaagcctgaggtatggccatctgaccagggagtccgaagtgtgattttctgctttagggaagtctctgaactggaacaaagcaagaaaacgttgtgccaagagaacttattgttgaggaataatttaagcaaagcccaggagcagcccaagaaactgaaaaatgaaaatagaaaaaaagagatgtcccttctcatgtgtcaatacttcatagttgggaaaaaccttgagaatgccaacaccattgatctaaatgataacacattcttgactgataaaaaaattggagaaaatgagaatgaaattcgagatgcgccaagcccaggagatgacaccagctattga

SEQ ID NO: 43249 - DNA, 411 bp, Glycine max
  Peptide Sequence Number=SeqID_160027
atgcattctctgctggaggacgatgacggcggtggtggcgttgtcaacgatggagacgtcacccacgtggaagcggagctgccaggtggactgcgcggtaaggacggagcgcgggcagttgccaaagctgtcgttgttgattctggtgacgccgcggtggtggtgggagaattcctcacggatctcggcctcgaaaatgataaagtttccaccagagtttgtgacgaaggcattgccgcggtggttgacggcgacgtcactggcggtattgatctcttcggaggggagggaggagaggaagaggcggcggcgggagcgggagcggaggtcgtaggcagtgagggcgttgaacggagggatccgaggaggaagtgctgcggtggtgatggtatgtgtggtattctggtgtaa

SEQ ID NO: 43250 - DNA, 1392 bp, Glycine max
  Peptide Sequence Number=SeqID_160028
atggaggcaatggagcgagaagtacttgcagtagattcagagtttaaccaggttttacaaagtgatgcttgccgtcttcaacaacttcagtgccatactgcagctcataatcatcctttaaatagattcttttgggggaataaaaagagcttggttgatgcaatggagaagggtattaatttgcgggagcaaatattgaaattatacaaggaatattatcacggtggattgatgaagcttgttgttattggtggagtgatatcttctaatggctctagtcagggctcaagagtaggactaaaattgatatacggtgagtctctggatgtgcttgagagttgggttgtggaactgtttggcgctgtcaagaaaggtcaagcaaacccagtgttcacagtggaaggtcctatctggaaatctggtaaagtttatcggctagaagctgtcaaagatgttcatatccttgacttatcatggacacttccctgtctacaccaagagtatttaaagaagccagaggattatttagctcatctccttgggcatgagggcagaggaagcttgctctcctttctcaagagcagaggatgggctacatctctatctgcaggtgttggggaagaaggaatttatcggtcatctatagcttatgtcttcgtcatgtccatacacctcactgactctggtgtagaaaagatctttgatatcattggctttgtctatcaataccttaagttgttgagccaagattctccacaagaatggatatttaaggaacttcagaatattggaaacatggatttccgatttgcggaagagcagcctcctgatgattatgctgctgagcttgcagaaaatatgcacttttatccaccagaacatgtaatttatggtgactacgtgttcaagacatgggataaacaattgttaaaacaagttcttggtttcttcattcctgaaaacatgagggtagatgttgtttcaaagtcgttccttaagtcagaagatttccaatatgaaccttggtttggttcacgttacgttgaggaagatattggtcaaagtttcatggagttatggagaaatcctccagaaattgatgtctcactgcatcttccttccaagaatgagtttattcctagtgacttttctatacgtgctagtgacacctgtgttgatgattttgcaaattcaacatctcctagatgtataattgatgaagcattaataaaattatggtacaaaccggatagcactttcaaagttcctcgtgccaatacatattttcgaattaccatgaagggtggctatgctgacgtgaagagttgtgtattatccgaattgtttattcatcttcttaaagatgagttgaatgaaatcacatatcagtaa

SEQ ID NO: 43251 - DNA, 813 bp, Glycine max
  Peptide Sequence Number=SeqID_160029
gctcatctggtaaagacaatcatgggtttgtacatgagcccggtggttggccgcctgctggcgaaccaaatgccgcaaatactgctctgtatcaaatgatccagctggaccagcctgatgaggtggcggcgcgtctactgtcgcaacgtgcccttttgcgggcgagcgagggcaaggctcacgggtgcgctttccaaaagaggaaagatgcgcggagtcgccaccaacgtttatttgtggaaaacgtcggaaaaaccgaaggaaaccggtcgacaaaagcggggctcttgctcctacgtagttcttcctttagaggtgaatcaaacgattctttttacttggaagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagactataaagataccagcgtttccccctggcggctccctcgtgcgctctcctgttcctgcctttcggtttaccg

SEQ ID NO: 43252 - DNA, 1317 bp, Glycine max
  Peptide Sequence Number=SeqID_160030
atgagtccagaagaatgcctttataactttctagatttcacttttattcttttacaattgaacaaagttttctttttagtttttaatggaaactggcctctaatatcacttctaggaaagaactggcaaaatggcatattaaaacacttgaaggctagtattgccaagttagaaacttctgtcacttatgttggtgacatgcttgagctgaaggtctatggtttcaatgaaaagcttcctgttttgttatctaaattcttttcagtatctaaatctttcgtgccaactgatgatcggtttaaggtaataaaagaagacatgaagagagctttaaagaacaccaacatgaagcctctaagccattcaacatatttgagattgcaagttttgtgtgagagtttttatgacgctgatgagaagctgtgttatctaaatgatttgtttcttgatgatctgaaggcatttatccctgggcttctctcccagatatacgtggagggtctatgccatggaaatctgtcaaaagaagaagcaattaacatatcaaaaatatttaagatgagttttccagttaatccgctccctattgagttgagacatgctgagcgtgttatttgcctcccatccagtgccaatttagttagagatgtcaatgtgaagaataagtcagaaaaaaactcagtggttgagctttattttcaaattgatcaagattttggtctgggttcaatcaaattgaaagctttaattgatctttttgatgaaattgtggaggagccatttttcaatcaactgaggacaaaagagcagcttggttatgttgttgaatgcagcccgcgagtaacataccgtgtctttgggttttgtttctgcgtccagtcatctgagtacaacccagtttacttgcagggtagaattgaaaacttcttaaatggcctggaagaattgctggatggacttgatggtgattcctttgagaattacaaaagtgggttagtggcaaagctgctggagaaagacccttcactcacatatgaaagcaatagattgtggaaccaaattgttgaaaaaaggtacatctttgacttgtcaaagaaagaagcagaagaattgaagaacataagtaagcatgatattgttgaatggtacaagacttacttgaaaccgtcgtctccaaagtgtcggcaactacttattcggctatggggttgcaacacagacttgaaagaagctgaagcactacccaaatctgtgctggccattacagatccagcagcttttaagatgcaatccaagttttatccaagtttttgttaa

SEQ ID NO: 43253 - DNA, 186 bp, Glycine max
  Peptide Sequence Number=SeqID_160031
atgactgaagacattgtcgtcttcgaaatgcatgcaatgactgaagacatttttgtcttcaaaatgtgtgtgaattaccgtatagggcatctccgcatgtcatcggactcgccgtctctggatgacaaaggtgcagatgatgacgttagtctcggcgtgtcaatcggctcgcttgcctctggttga

SEQ ID NO: 43254 - DNA, 555 bp, Glycine max
  Peptide Sequence Number=SeqID_160032
atgtcttcacctcaaaaacttcaaatatctttttcccctgtgcttcgtaggactcgacgtcctttgtttgtacgctttaaaaaaaatgtgaaaatgaaaatgaaaaaaagaaggaatttcaatgtcttcatgccttcgcgggttttactgcttggattggcgctagtggctgatcggagggttctgggcatttccttgcttaaggtggaagcaaccgagctcgcctgggcgagctgggcggcaaccacctcccttgttttgttaaaaaatggaaagcgtttggtcgctatgagtcatgggcgtttatatcagaaacgagtgaagaacgcttttgacaagaaggtacgcacacgcaggttcagcgaaggggacttggtgctgaagaaagtctcccaagctctgaaagacaatagaggaaagtgggccccgaactacgaagggcctttcgttgtaagaagggctttctccggaggggccctggtgcttgccaacatggatggcgaggagctaccttcacccgtgaactccgatgttgtcaagcgatactacgcttaa

SEQ ID NO: 43255 - DNA, 192 bp, Glycine max
  Peptide Sequence Number=SeqID_160033
atggcaatggggcaggacggagatggatattgcctccccaatctccgacttcgactccctaacatattctcatacccatttctgaaactcgacggttggaacgtattcgaacgggtacccacgcatacgggttttattggcatgtctaatcataacctcgcttcaagctctcataagctgatattgttctag

SEQ ID NO: 43256 - DNA, 147 bp, Glycine max
  Peptide Sequence Number=SeqID_160034
atggccatacaagacattatgcctaacaaagtcagcaaagtccttgatcctgtcaagtttgatgacctggaaaatgaggccgcaattatactgtgccagttggagatgtatcttcctcctgctttctttgacatcatgattcactaa

SEQ ID NO: 43257 - DNA, 825 bp, Glycine max
  Peptide Sequence Number=SeqID_160035
aggactacatgcctcgccattagaggactacacgacttcaccttcagagggctacacgtcctcgccatcaaagggctacacgccctcaccttcagacgactacacgtcctcgccttcagaagactacacgtcctcaccttcagaggactatacgtcctcgccttcagaggactacacatcctcgacttcaataggctacacgtcctcaccttcagaatgctgcacgccttcaccttcaaaggactgcacgccctcaccttcagagcactccacgtcttcacctttagagggctgcatgccctcgctttgagaggactactcatccccgctttcagaggactacacgtccttgccttcagaggactacatttcctcgccttcagaggactacacatcctcaccttcagagggctacatgctctcgccttcatagggctacacgtcctcaccttcagagggctacgcgccctcgccttcagagggctgcaagccctcgccttcagagggctacacgtcctcgccttcagagggctacacgccctcgccttcagaggactacatgtcctcgccttcattcgactatacgtcctcacctttagagggctacacgccctctccttcagagggctacacactctctccttgagaggactacacgtctttaccttcagagggctacacgcgctcgcctttagagggctacacgccctcaccttcagaggactacacatcctcgccatcagagggttgtgtagcctcaccttcagagggctacacgccctctccttcagagggctacacgttctctccttgagaggactacac

SEQ ID NO: 43258 - DNA, 827 bp, Glycine max
  Peptide Sequence Number=SeqID_160036
ggacaccaggatttatttattctgcgaagtgatcttccgtcacagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatggacacaccattgctcacatgaaaaacttatataatgattacttcggtcaaatagtgattgtctttggaaatttcattattcacatggaagatcacacttcttataatcaccacatgtttaccatcgcaaggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 43259 - DNA, 378 bp, Glycine max
  Peptide Sequence Number=SeqID_160037
cttggctaccccatgagaggagtgccatcagacgaaagcatcacgcctttcatcgcatggggtttcagtgaccacaacgcgagggacagagagcttaggggaagcagtaatgggatcatcggcggctatcataagtggctgagagtccggacacaaggattggattggctcccaaatctaaagactgtgagagacaatgaggttaaagcttcggaagaaagtgatgaggtacaagccctaaaggcaaagcttgaaagagcccgggtagtcaaagagaagttcaaggcagcaatagtgagctcaagctccgaagaggtgaaaggaatcatcacgggtcaaaggcatgatcttgaaggacgagctaaaggcttgccttag

SEQ ID NO: 43260 - DNA, 495 bp, Glycine max
  Peptide Sequence Number=SeqID_160038
atgatcaaaaaaagcctattctgcttactgacggcattcgcatgcagtcaggcagccgcagcagaaaccggggtcgccctcaaagcggaccaattgcgggcagaaacctttagtgatgccaaggtcgttggcagcgtcaataaaaacgatgccgtggagatcctcaacaaaaaaggggcctggctacaaatcaaagcggcaggcaaaaccggttgggttcgcttgctcacggtaaaacgcaatagcagcagtggcaataatgttgcgggtgtggtgggtgtcgccactggacgcagcgggaccggtaaagttgtgtccaccaccggtatccgtggattaagcgccgaagacctcaaaaccgcacaattcaatgaggccgagaccaagaaactcgaaagcaatacagtgagcgccgaagaagccaaacaatatgcaatcagcggtggcctaagcagccaccagtatccatactttacagaaggtggtcagcaatga

SEQ ID NO: 43261 - DNA, 1343 bp, Glycine max
  Peptide Sequence Number=SeqID_160039
atggcacgtcacggtgggcacggcgttcggttatttatcggagagcggatagaacacgcctcggatcgcgatgtcttggtcacagttttcgatgctctagaaaagggcacagagtgggcctacatattcgccaacttcaacgttaacgggcgccaggttgatgccgtagtcttttccgccacaactacgctcgttattgaagcgaagggatacacattgcccatcaagggaggtgtgaacggccgttggacgcaattcggctcgtacggcagccggcagctacgcaacgggtacactcaagcgttggatgccaagaatgcgttgcgtgatgcaatagccgagctatttggcgctctttccgactatcccaatgccttgctagccattgtaccggcgattccgtcaggctcttcgttgccaccgagtgacttcaaggtgaaatctggcgggctggatgcgatcaaggttgctctcaacacgaagtcaggagccttactgagtgaagagcaatgccaagagttcgccactcatttgaaccttgaacgcgtgtcgggaagagatgcggcaatccatgaaactgtgctgttgtcagaacgagcagtgacaagttacgaatccacttttttggagtttcacgggccaatcggttcacagctggcagaggaccaataccaccttggtgacaagctgatctcggcatccaatattctaaagatggctatgtcgtcgcaatctgcgctgctgatcagaggaccgtcaggatgtggaaagtccttgctaagttcacgcatcgccacggaatgtatccagttcggaatgctgcctatccatatccaaggcaaaaacttcgagggtaagcttcagaagataattgacgtcgagcttagactactcagcacttccgtgcgcgatttactcagagcaagtcgttttcttgcaaggcatattgtcctgtttctcgacggctacaacgaatgcccagagcatttgcaagttgctttgacgcgaagtcttcaggcattttcactacgttatggtgcgggcatcgttatcacctcacaaggcgccttggccaggccagagcttttgttagtcgaagagattcaagtcaggccgccgcaacctgcactgaagtcactgcttgcaaaacttagccaggaagatgaaaacttcacaaactgccaagctctgcttgagatagcactctcaggacttgaagcggaactcattgggcaggctgccgcatcactgcccgccggggcaagtacgttcgttctattcgacacggtcgccaggatgcgcctcagcagcttcgcaactgagggaattcgggctcttgccgg

SEQ ID NO: 43262 - DNA, 543 bp, Glycine max
  Peptide Sequence Number=SeqID_160040
atggctacctcaccaaaagaaacttccgcttctggttcacccgctgtaccatcatctccgcaccaggaacaaccggaattcaacattcaacccatacaaataattcctggtcaagcttcagtccctgagaaactgattcccagaagacaacagggggtgaagattgctgaaaaggctagccttgcaacaagtcctagggaagtagacacggagatggacaagaaaatccgcggtattgtgagtagcattttgaaggatgcttctgtgcctgatgctgagaaagatgttccaacatcttccaccccagatgtttctgtgcctgatgtcaataaagatgttccaacatcctccgctccaaatgctgaagccctcccttcacccagtgaagaggaatcaacagaagaagaggatcaagcctcagaggagacccctgcaccaagggcaccagaacctgctccagacttgccttggaaagagaactgggaagagctgccatggattgcaaggagatcatggacctcatcaaggctgctggactgctga

SEQ ID NO: 43263 - DNA, 565 bp, Glycine max
  Peptide Sequence Number=SeqID_160041
tctggaaaaagtcgattcgctgcgtccggataacagccaggcggcgcggatggccaccgagtatctgatcaaacagggacatcagcgcattgcctgggtcggcggtctggggtcctcactgacgcgcgccgaacgtatcggcggctattgcgccacgctgctgcagtacggtttgccgtttcgcccggactggattatcgaatgtgacgatcgccagcagagcgtctctgcgctgacgcaggcgctgctgcatcagcatccgcgtattaccgctattctggcccacaatgccagcaccacgctcggctgctatttcggcgcgctgcgcagcggccgcaccctcggggaagacgcggtggacagttactacacccagcagctggcgctggtcggctttaatgacgatccgcaacctgagctgaacgatccggcgttgacgtttgtcagcagtgaagcgcgcatcgtcgggcggcgcgcggcagaacgcatattacagcgcctggcgcagccacaggccgatgtgcagacgttaatcgtgccgccgcagctggtgcagggccgctaa

SEQ ID NO: 43264 - DNA, 1200 bp, Glycine max
  Peptide Sequence Number=SeqID_160042
atgaaaataatcgtaaatgggaaaggttatccggaaaagagaaatatcatcgtcaacgattcacaccattatctcaatcttaaatataaaaatatctggttttatcgtaacgccgtcaggcagaaaatccgcaaagccaataagttgtttattttcgcgccgctaccgttctcggtgccggacgatgcacaaatcatccatctctttaatgaagtggcctgcacaaaaaagcgctggatggcgacatttgaaaccgaaattccgcgcgtgctgccggtgccgggcatggccaaactgcataatccacaattgcagaaacaactcaaactgatcgcggcaccgcagtgtacggcgctgctggccatttccgacgcgacgaaaaagattcaaattaagctgttacaggcgtttccacagcaggcggcagccattttgcccaaactgcacaccctgcatccgccgcaggcaattatctgtgatcgggtcaggccggtgaatcaggcgaggctgacgttcagctttgtcggcaatgagttttatcgtaaaggcggggcggaagtggtgctggcctttagcgagctgctggcagaaggcatcattcaccccgaaagcgtgcaggtgaatttaacgggcaacctgaagcatcgctataatatcgcgcacggcgcgcagcaggatgacgcgcaatttcatcagcggattgaagacctgattaatcagcaggcaatcttcaggcatgaaacatttttgcaaaatgatcggctgatgaaaatgctcgaacagaccgatgtcggattattaccgacctggcaggatacctacggcttttcagtgctggaaatgcaggcgtgcggctgtccggttattaccaccaatgtacgcgcactgccggaaataaacccggcctcggccggctggcttattgactgtccgctgaatgatatgtttgaaatcgctatcggttcagcgcaggagaaacaggcgatcagggccagaattattgcgcagctcaaacagatcatcatgcagatgatggcgcagcgcgaggcgatcagcacccgctcggcgcgggcgctgcaaagaattaaagaccagcacgatccggcgcgctttcgcgccagcctggacgctttttatcagttagctggcgaggccgatcgggcctcaggcgtgaacgcaccaaagcgagtggatatatga

SEQ ID NO: 43265 - DNA, 322 bp, Glycine max
  Peptide Sequence Number=SeqID_160043
atggcggaaccatcgaagaagcggaaaggatccacgagtcggagtcaacgacattccgggtcacaggaaacaccaattcctccctccattccctctggatcattgttctcatcagaggaacagcgtatacggtacacaaacctcttttcatctcgttccattgtagacccaaaattcatagatatggagttcttctcaaatgagaattttgaatgcttccaagcattggaaaactccaatcttattccattcatgtctctgaaattacctgtctattctgaattagtcaaagctttctattctaatttagaaatccatgaag

SEQ ID NO: 43266 - DNA, 352 bp, Glycine max
  Peptide Sequence Number=SeqID_160044
atgtgtgcgagtcaacgggcgagtaaacccgtaaggcgcaaggaagctgattggtgggatccccctgtggcggggcgaagccagaggaaactctggtggaggcccgcagcgatactgacgatagctggagcccgcgggcgagttctatcgggacggtgcggctgctctgttgagccgcgccatggaatcgagagctccaagtgggccatttttggtaagcagaactggcgatgcgggatgaaccggaagctgggttacggtgcccaactgcgcgctaacctagaccccacaaagggtgttggtcgattaagacagcaggacggtggtcatggaagtcgaaatccgctaagga

SEQ ID NO: 43267 - DNA, 914 bp, Glycine max
  Peptide Sequence Number=SeqID_160045
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatttcatggtgggcctgccgctgtcgagcatgatcggcagcccgatttccggctggatcatgcgtgcgttcgacggcgcgcacgggctcggcggctggcagtggctgttcctgctcgaagcgctgcatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 43268 - DNA, 366 bp, Glycine max
  Peptide Sequence Number=SeqID_160046
atgcctattgacattagagaaattgaggttgcactgtgcatacccggccaagggtttattctaaatgttgaaggtcaactggggaagatccttagaaaagatctaaccacccttgctcagttggacatgaatgccggagccctcatttctgggcagattacttctatggcccagtctaactcctcaagactcaagtttcctgctcttatcacagctttatgcaggaccagaggagttgcctccaatagtcttgtctttgaacgtctgagcccgatcattaatttggcctacataagtaagaattgttggaaccctgatgatccaacaattattattaggggggccaaagaccaagggcaaggctag

SEQ ID NO: 43269 - DNA, 396 bp, Glycine max
  Peptide Sequence Number=SeqID_160047
atgccttcccgccatatggcttgcctcccaactatacaccacccaatgtggcgcacacttccgatgagaatgtcgataactccactcccatactcattgagagccaacaaactcaatttgatcatgcacatatacaccactaaggggaaagcagttgatggtgtacccctgccaaatattttggagggccctcaatttcgcccgcaaccacaacccttgcatttcgcggcggggagagtccctcctgctatggtagaaagagggatatttaatcatatagaggaaaggtttagggctattgaaagaggcaaagatcatgcttttgctgacatggcagagttgtacaaatgtgccattattttctcctatttcttaaccctttttgtaccattttaa

SEQ ID NO: 43270 - DNA, 538 bp, Glycine max
  Peptide Sequence Number=SeqID_160048
gtcgactctagaggatcccaccgatcggcgtggtgttgccggaaggcaacccaaccccggtgcgcggcggccgttattacgtcggcagcctcaatgcgcggctgtatgccggcgatcaactgctgcaacctgttgcgttagccaaaagcgcctgataggttttagctgcccttttattcaaggcaacccccgggttgcctttttactttacgcacaccaacacacaggcaaagatcgtgacaacgctcgaacaatgcatcgggaataccccgctggtacaactgcaacggctggccgcccaggcgggcagcgaggatcgcgctgcgttggcgatgatccagcaggcggagctgcgcggcgagatcaagcccggcgacgtgctgatcgaggccaccagcggcaacaccggcattgcgctggcgatgatcgccgcgttcaaaggctatacgctgaagctgctgatgccggagaatatgagcctggagcggcaggcggcgatgcgcgcctacggcgccgagctgatcctggtcagccgtga

SEQ ID NO: 43271 - DNA, 693 bp, Glycine max
  Peptide Sequence Number=SeqID_160049
atgatacgcggagataccttacggttatccgcacccttttgtcatccagaggcggcgggcccgatgacaagcagagacaaaaattggccattctgcacccttgtgtcatccagaggcggcgggcccgatgatacgcggagataccttacggttatccacacccttgtgtcatccagaggcggcgggcccgatgatacgcggagataccttacggttatctgcacccttttgtcatccagaggcggcgggcccgatgatacgcggagataccttacggttatccgcacccttttgtcatccagaggcggcgggcccgatgacaagcagagacaaaatttggcggcgggcccgatgatacgcggagatacgttacggttatccgcacccttgtgtcatccagaggcggcgggcccgatgatacgcggagataccttacagttatccgcacccttttgtcatccagaggcggcgggcccgatgacaagcagagacacaatttggtcattctgcacccttgtgtcatccagaggcggcgggcccgatgatactcggagataccttacggttatccgtacccttgtgtcatccagaggcggcgggcccgatgatacgcggaaatacccgagcggttatccgtataaacattcttttgctatctgtaagacagaacgcttgatagcatgcagagactga

SEQ ID NO: 43272 - DNA, 275 bp, Glycine max
  Peptide Sequence Number=SeqID_160050
cgatgcggatgaggcgccactcgatgtttccattttgcctgcatgcctttgggtattgtggggtgtggttcgtttagtggtgtcaagtcttgcgaaacgtgaggacccattccatccaggcctctttgttggggacgctggaggatttcaaagtcccacacgtgaaccactgaacgtgggtggtctagtgcccccacattgttccttaaaatcggttgtctcggatgacgcttgccctggcgcttgctttgttcaacgcgatgctactactctta

SEQ ID NO: 43273 - DNA, 267 bp, Glycine max
  Peptide Sequence Number=SeqID_160051
atgcaccagccgcagaccctgaggagtacatacagccgcccagcccccaggttccagtggcatttgaccccccctctacatgcaatggatgattacgacggctatgaggcgattgcacagaggttggagcatgtgctcaaccttaggatggtcattgcaggcacagagttatatgatattatgcaggattgtctgacgatcgccagagggggagccagtgctgatggaagtgtcagggctcgacagagacggcgcacagagcattga

SEQ ID NO: 43274 - DNA, 1677 bp, Glycine max
  Peptide Sequence Number=SeqID_160052
aggactacaatcttcgccttaagcggactacatgtccccaccttcagagggatacacgtcttggccttccgaggactacacgccctcacgttaagagggctacacgtcctcgccttcagaggactacacgtcctcggcttcagaggactacacgtcctcaccttcagaggactacacgtcttcgccttcagatggttacaattcctcgccatcagacatctacacgtcctcgccttcagaggactacacgtcctcaccttcagagggctacaggccctcacctttagaggacaacacatcctcaccttcagaggactagacgtcctcgccttcagagggctacacatcctcgccttcagatggttacacaccctcgccatcaaaaggctacacgcccttgccttgctttcagaggactacatgtcctcgccttcagaggactacacgtccccgccttccaaatgctatacatcccccgccttcagaggactacacgtcctggccatcagagtgctacacgtcctcgccgtcaaaggactacacgtcctcgccttaaaaggactgcacggctcacgccctcgccttcaaagggctacacgccctttccatcagaaggatacccgccctcaccatgctttcagaggacaacacatcgatgccatcagaggactacacatccaaacctttagagggttacacgccctcgagtatagaggactacacatcctcgccttcaaaggactacacgtcccttccttcatagggttacacgtcctcgccttcagaggactacatgtcctcgccttccgagggatacacgtcgtcgccttcagaggactacacgtccttgccttcagaggactacacgtccttgccttcagagggctacatgtccccgccttcagaggactacacgtcctcgccttcagaagactacacgtccttgcctttagaggactacacaggactacatgtcctcgccttcagagggctacacgcagtcgccatcaaagggctacacgccctcactatcagaaggctacccgcccttgccatgcttttagaggacaacacattgtcggcatcagaggactacacgacctcggcttcagaggactacacgtcctctccttcagatggctacatgtcacgccatcagaggacaacacgtcctcgccttcagaggactacacgtcctcggcttcagaggactacacatcctcgccttcagatggctacacgtcaacgctatcagaggacaacacgtcctcgccttcagaggactacacgtcctcgccttcagatggctacacgtcaaagccaaaagaggacaacacgtcctcgcctaaagaggactacacgtcctcgccttcagagggctacatgccctcacctttagagcacaacacaggactacacgtcctcgccttcacagggctacacgccctcgcctttagaggactacacgtcctcggctttagaggactatacgtcctcgccttaaggggactgcacgccctcgccttgctttcagaggacaacaaatcctcgccatcaaaggactacacgtcatcgccttcagaggactacacgtccttgccttcagaggactacacgtccttgcctttagagggatacacgtcctggctttcagaggactacacgccctcgccttaa

SEQ ID NO: 43275 - DNA, 834 bp, Glycine max
  Peptide Sequence Number=SeqID_160053
atgtggcaggtctggggcactgccataatgcagaacagatatcgggaaactgactatttgttggcccttgtagtaacccttggctgctcagtgttcatcctgtatccggcagggaccgacataagtccatacggtagaggaagggaaaatactgtttggggtgttttgctaatgcttggttatcttgggtgtgatggctttacaagcacattccaagataagatgtttaaaggctataacatggagatacataatcagatattctatactactttgtcttcttgtattcttagcctgacaggtcttattatacaaggacatttattaccagctgtagagttcgtttatatccataaagattgcttctttgacattgcattgctttcaactgttgcaacagctagtcaattttttatttcctacacaattcgcacatttggtgctctaacatttgctactataatgacaacaagacagttggtaagcattttgctgtcatgtgtgtggtttgcccatcctcttagctggcaacaatggattggagctgtaattgtctttggtgcaatttatgcaaaaagcttcttgaggaaagcacctgaaaagacaacctctgtagaacatgtcgtggctaatgcattatatgaaggtggtttgacatacagaaagcccccaattttgtatcccagtcataacatcggagaacttgattggagcttagtccctcattttttgactggggagatctataatattgatccaaaccaaaagaatgtttataaattgaaatatgttcaatgtgtcgcctcaagcatggtgtttcttgcttatccataa

SEQ ID NO: 43276 - DNA, 706 bp, Glycine max
  Peptide Sequence Number=SeqID_160054
caatatatgcccacaaccaacttaatgagaggaaaaagctttggaaagatttggaggaaattcatgatatgcaacaggggccttggtgtgttgttggagattataacaatgtggctaaaagtcaagacagggttggaggtaaactggttactgaggcagaatatgaagatcttcaagctatgatggatgcaaccgtgggtttcaatagttttgtggaaagaagctggaaccaacctgctagaggcactccaatgcagaggttgtggtataaacttcataggcttagacctcatctcttgaaacttaataaatttactaatgatattcaaaagaataaacttgcagcaagagaaaagttggaccaggctcaacaggaccttagaaataacatcatggatgcccccagaattgaggaggtgaaaagacaaaatgctaaaagaattaaagttatccacaaagatgatggcactatcctcactactcagaaggaaattactcaggaagtgctagttttttatgggaagcttatgggtcatgatagtagaagcctccaacatgttgatattgatgctttaagaagaggagatcatctcaccatggttcaaagagaggatttagtgagacatgtcactgttaaagagattgaagatgctctaaatggaattagtgacttaaaatcgcctggagttgatggctatagctctaa

SEQ ID NO: 43277 - DNA, 273 bp, Glycine max
  Peptide Sequence Number=SeqID_160055
atgttgtcgctggatattgccgtcacacatgcgttgtatgttggtctcgtcttttgtcatgggaagccggaagatccatatcaccttctcaaactacacacatggggcactgcacccccaaatgcgcaagtaagaagagataatttttcgggccctcgtgtccgtaaatgcattcatatcatgcatcgcataagcatctcttcatggcatcataatgaacatatcgttcctgcatttgtccattatcatattccagcctcacattttgcatga

SEQ ID NO: 43278 - DNA, 315 bp, Glycine max
  Peptide Sequence Number=SeqID_160056
atgcagatattcattgaagccatagatctaaatatttgggaagcagtagaattaggaccgcacatacccactacagtagatgaacacgacatggaacttcaacgcctcaatcaaaatgaagaaaatgacaaaaagaagagaagcatagcccttaaagccgcatcttcaatacaagaagaaaacgaagaagaagattcagatgatgaagaagatttttccttctttgttaagaaatttcagaaattcatcaagaaaagaagaattgacaggcgtcagaatttcaataatggaagaaaatcacaagatgattctcaa

SEQ ID NO: 43279 - DNA, 183 bp, Glycine max
  Peptide Sequence Number=SeqID_160057
atgccgatttccccctgcggaagtttcagttggtctgtgtcattccgacatacggatagtgcccgcagacagccggtggatccggagaagaccaatagggtcctggggtttccagctctggttacgggcctctgtcagtcctacagggtgcctgttccccccagcaaggtcacgccatcataa

SEQ ID NO: 43280 - DNA, 855 bp, Glycine max
  Peptide Sequence Number=SeqID_160058
atgagtggagaacacgagttaaggcagaaacttatggatgtaagacatgaacttgagaacatgaaaaatgtcaaggcagaattgctcaatctgttgagcatggcataccaagagagggacgaagcaaggtgtcagttacagaagctgatgaatccattgcaaaacgtgtttgacacccaccaaaatcgtctcatgttcccttctgctaaatcaaactcaagcataacagaatctgacaataatagtttctcacacggttcctcacaagtggattccttttttgacacagtctcttctccagagtttacaaacatcaatgcagctgaccctattaacataatgagttatctcaaccagcatgtggttcttcaagacttcaatttctcagcacctcatgctttgatggttcctccagaaaagccaatgagtgatgacaccgcgggcgatgcagttatagattgtcttgccaaagagagaggtttgcctcaaaagggtaaattacttcaggctgtgatagatgctggtccattgctcaaatcattgctctttgcagggccacttcctacatggagaaacccccctcatttacaaaacatcaaagttccacctctagccatcaaaaaatgtgatgccacttgcattgtgcctaatacttttggagaaattggcaattcacttctgaaaccgaagcttccacccttgcattattcaaatgctccctcctcgtgttcagcttcaatgcttaactttgctggtcaaaccactggttcatggaacaacaatgcatggcagttgaattcaactcctggtgtcagcatccaagtcccttcaagcaagcggcagaggcatcaatga

SEQ ID NO: 43281 - DNA, 1170 bp, Glycine max
  Peptide Sequence Number=SeqID_160059
atggcggaaacaacctctgcttctgtttcttctcccactgcgggtgattcgaattggagagagaacaagttgtggaaaggcacatttgctgtcgcaggaatcatgctcaccctcgttacctatggtgttttgcaggaaaagatcatgagagttccttatggggtgaacaaggactacttcaaatattctctttttcttgttttctgcaatcgcatcaccacgtctgctgtttcagctggtgctttactggcaagtaaaaaggcattggatcctgtagctcctatttataagtactgccttgtgtcggtatcaaacatactcaccacaagttgtcagtatgaggccctcaaatatgttagtttccctgttcagactcttgcaaagtgtgctaaaatgataccagttatggtgataatcctatacttgtttttcggtcttcaagagaaaggtagaatgtcctatcctgctagccatatttttatctttttccatcatccatacttcttgaagcctagatctacaaaagttgtgagtgagagagacatcgagagagagagtgagaaagcaagagagagtgagagagcaaaccagtgggtgagagtcaggtctaggaatgagaggcgggaagtgaggtttagaaaggatccccggcataaccatgtcgacagcaaccaaagtaggcaacccaaacactcacgtggcaactggagagacaaagcagacatctcaaccttttacttcacgcggttcctcgatgacgtaacggagaaagatctatgggtgcagttcaaaagaggggtctcaaacgtccgggctttggaaaggcagttggataacatcataataggaagcctgaaattatacgtgaatatcccaaggtatgatagggggaggagaaattatgctcatcgaattatggagcatggtacccagacgaatgtgcgtaggcaaagaatgacagcaccccctcaaatacatgcacaacactggaaagccacgatgacgtacgcccaagctttgcgctcaaacagggcaaaatcaaggccaaagcaatactcgcatgacgtcggtgctggtagatatgggtctctgatgagaatcctgaaactggccaaatacaggctaaaggcccaagtggagaaggacgaaggcccaagtggagaaggatga

SEQ ID NO: 43282 - DNA, 540 bp, Glycine max
  Peptide Sequence Number=SeqID_160060
atgtcttctgattctgcaaatgacctttcgaaatggaaactggaagaagttatttcaattattatagtctgtgtcatctttcttacactgagtgattgcttcggcatatttaagcgtatggtgtgtggaatttgccttggtagaaaccaggttcaacggcgacttctcgacgagtccattgccgatgatccttctctgcagcagcttcagagccgtggattggagttcactgtggtgcagtctcttcccacgtttcagttcaagaaaaacgagggagaacaagaaaaggctgcaattagcgtggagtgtgccatttgcctcggagagtttgaggaaggggagtggctgaaacatctcccacactgcagccatagtttccatgtttcatgcattgacacgtggtttcagtctcattcgaattgtcctctttgtagatcagttgttcatcatcacatccttcagtgttctgtagcttctcacacattgcttcagcctttgaggagggaagactttgaaagggttcaatccattcactcttaa

SEQ ID NO: 43283 - DNA, 306 bp, Glycine max
  Peptide Sequence Number=SeqID_160061
atggaggaacaaaaattaatgcagccctcattatatttcctccatttgtcatcttccaaaattttcagagttaccaagcttcactttgattatattgtgtcctgtgagactaacacaaaggatgaggagaaaggaaatagtttgggttatgtgagactgagaaaggaagaaggtattcaaatggtagtgcaagtaggagaacaaagtagacaaacaagaagaaaggagaagaaagctaacctttcatcaccgacaatgagattgcagcaccgtgagagtgacagtgaggtgcaacgccacgagtga

SEQ ID NO: 43284 - DNA, 320 bp, Glycine max
  Peptide Sequence Number=SeqID_160062
atgtgtggtagtgtcatcggcacacttcttaacattcaaggcaagacaaaagaagatttgaatactcaccaagatctaattgagatgagtacacaagaccagttacatccaagcaaagttattgatcctctcaagttaaatgagttggaaaacaaggctgctattatcttgtgtcagttggagatatatcttcctccttcgttttttgacattatgattcacttaattgtttatctgatgtacacgattaaacgatacatgaagaacttaaaagggtatgcaaaaaatctacaccatccagaagcatctattgttgaaag

SEQ ID NO: 43285 - DNA, 816 bp, Glycine max
  Peptide Sequence Number=SeqID_160063
atggatcaaacttggatgaatgcaagtcgtatgagccctgcgtatgaggaaggcgttgaagagttcttgcaatttgcctctaaaagaagtcgaccaaatgaggatgaaaaatatttttattcttgtagtgcaagatatgcttccaaaggaaaacatgttgccaaaaaatcattatcagacgaagaagatattgtgtctaatgggttcaagcgtttgtttgttgatgcaaataatgcaaatgaccttacatggcatgcagatgagagaaattgcgatgaaatgctctgtcatccgactgattactcccagtggaagaagattgattgtttgtatccaaattttggaaaagagaaaagaaatcttaggcttggacttgtcactgaaggaatgaatccctatgacagtttaagcactcagaacagtttgtggcctattttactacgaaaatacatgatgttatctatgatgatatctggcccaagacaaccaggaaatgacattgatgtttatctcaatcccttgattgaagacttgacaaagttatgggatgagggggttgttgtgtttgatgggtatcaaaatgacacattcaagttgcgtgcaatgttattttgtaccattaataacttttcagcatacaggaatttgagtgaatacagtgttaagggccatcgtgcgtgccctatctgtgaagaagataaaagttatgttcttgagcgggctgaggacatcaatactgtattcagaaagtcccaaaagaaggggaaaaaagtaaaacttccattccatatggaagaaaaggttgatattgtttga

SEQ ID NO: 43286 - DNA, 195 bp, Glycine max
  Peptide Sequence Number=SeqID_160064
atgcgaaagttcgatccatggcccgttttcttcaagcgcgagtggaaacgcaactggcccttcctcgttggattcgcagtcaccggagctctaatcaccaaactttcccttggccttaccgaggaagaggctaagaattccaaattcgttaaggcgcacaaaagcaattcaaagtggcgaatagaaaacaaataa

SEQ ID NO: 43287 - DNA, 168 bp, Glycine max
  Peptide Sequence Number=SeqID_160065
atggaggctgatatgagcattgaacaagaccaggatgctaacatagttgatcaggtcaatagttgggtcaacaacaaactgaggaagagtctgtggatgatcgattggacaagcaataacagacatcagtcaactgcaggagggactgttggtcagatctgggattga

SEQ ID NO: 43288 - DNA, 636 bp, Glycine max
  Peptide Sequence Number=SeqID_160066
atgtctcgtatctctacactctatcttctcgcttacaactcctttcaggccattggatggacgatttccttaactaagattttgtacaatcttctcgtcactgcatccatcaaaggaacctatgcttccgccgccagcttaatctgttttctgcaatgcgctgcattcttggaagttatacacggagccattggcattgtgcccagcggggttttgcttcctcttatgcaatggggaggaaggacgcactttgtgcttgccattgttaggaaacttgatgagcttcaggaattaccttcagtttttatcacttttcttgcatggagcatgggggaggtcattagatattcacattatgctttcggttgtttgggaaattgtccttcttggatgacctatctcaggtacactgcgtttattgtgctgtatcctttgggagtgggtcctggtgaaatatgggctatgtaccaggctcttccagttataaaggagaagaatctctatgcagattccttttcaagcctcccatttagctattatgatttccttaagttgacatcaattatttatgggttttttgcttctcctattgattgggccattgatttccggaaacaagagaggaaaaacatataa

SEQ ID NO: 43289 - DNA, 786 bp, Glycine max
  Peptide Sequence Number=SeqID_160067
atggttcaacaagaaatccgaaggggtccctggacagaacaggaggactacaaattagtgtattttgttaacatgtttggagatcgtagatgggactttatagcaaaggtatcaggtaagagttgcaggttacggtgggttaattacctccaccccgatctcaaacgagggaagctcacaccccaagaagaacacctcgtcatggaccttcattccaaatggggaaatagatggtcaagaattgctcgcaggctaccagggcgaactgacaatgagattaagaattattggaggactcacatgaggaaaaagaaggctcaagagaaaaagcatgcatcagcagcatcgcctgtttcttctagttgtcaatcttcactgtcctcaaacaaccatgttgtggattcacatgcttccaaagaggttggagaagagagttgttatgacacaggtggatatgatgatggcatgatgatgggtttaattggtggtgaaaaggggtactccatggatgatatatggaaagatattatgtcagaagaagagaacaacatttataataataatcttcaacctgtctatgaagggcatagtgaagagggatgcaacttctcttgtccaccaccaccaatgattatgccttctccaccatcatgggatcagtacaacatttcttctcaacccttatgggtgatggatgaagaagaaagtaataagatgttattccctacactaagtgaccaatattttccttactatgaacaagggaacgcatttctaactggctaa

SEQ ID NO: 43290 - DNA, 581 bp, Glycine max
  Peptide Sequence Number=SeqID_160068
cacccttacaccaaagcgctgatgtcggcggtgccgatcccggatccggacaaggagaaggaaaagcagatccaactgctggaaggggagctgccttcgccgatcaacccgccgaccggctgcgtgttccgcacccgctgcccgatcgccgggccggagtgcgccaagacgcgcccgctgctggagggcagtttccgccatgcggtttcgtgcctgaaggtcgatccgctcacgcgggcgaacacgtcgttgatcggctcgccgtcgctgtccgcgagaccgatcaccacctcggcgaagaagtccgggttcagatcgtaatccacgtgctcgctccagtcttcggaggggtcgtacagttcggcgccgccgcgctcttcaaactgcaggttgaacagcagaatatccgccggatccagattgtcgccggccaattcgaggaagatgtcgtaggcctgttccagcgtttcgtcttcggtaaggcgcagcgggctgaaaaagtagaacaggcgctcgaccaggcgatgccagaacggccgcttcagccactctttggcgttcagcagcttggaacgggcgat

SEQ ID NO: 43291 - DNA, 218 bp, Glycine max
  Peptide Sequence Number=SeqID_160069
atgtcatcactggctatcccccaccaccttgcatccctcatgaaggtagatctggccttggatgcaagtcatgcggcggatctggtcttggacgttgttaaaggattgaatcgtgggtctttgatgaagaaatcaaagaagttaatgggggtggaaaagaatgcaatgacgaggttgaggcatagttggccaagcacgttgtttccaaaggcaccaag

SEQ ID NO: 43292 - DNA, 633 bp, Glycine max
  Peptide Sequence Number=SeqID_160070
atggataatgaagagggcgtgcaggaacagatgaaggccgatctatcggctttaaaagatcaaatggcttccatctcagaggtcatgttaaaactccagaaaaccatagaggacaaagccacggcaaccgcctccaatacggttagggaagcgaagccggtgctgcaacccgctttaaatccaggccgagacagaaacacggccgtgtttggtcgaaggtatagtccgcaagcttatccttacggcttgcctccggacttcactccccgcaccgccccggaagatttaagccaagcccctacttttgaggggcaactcccgccttatgacgactatcccgggcaagacgatgaggaagtagatacccatcttggccccctgctccacctcaaagatccgtccccccatgaactaccccaaccgaacatagtccgccatatcccgacttcacccacacccgtaaaagaatctgttcccttcgcggaagataagggaaagattgaggcacttgaagagaggttaagagcagtcgagggccttggcaattacccattctcggatttagcggatttatgtcccgtgcccaatatcgtcataggagattgggagagtgggactgtttcttatatgtag

SEQ ID NO: 43293 - DNA, 248 bp, Glycine max
  Peptide Sequence Number=SeqID_160071
atgagtactttggccataacgtgtttcatgcatttgactgacatatgtaaagccctgttatgtcctctcggtggggatttcctcttcagcgaagtgtcgcaacctaccctttcggcgggagggcgacgcgagactcgcgggatgcgtgttccacgaaaggaatacgcgcggagtcgccaccaacgtttatttgaggaaaacgtcggaaaaaccggaaaagacgcgatctacgaacttctaagtgaaag

SEQ ID NO: 43294 - DNA, 759 bp, Glycine max
  Peptide Sequence Number=SeqID_160072
atgattgaacgcctcatgcgggaaatccattttgctgttgatccacacagcacctccaagaagcaggctctggagttaattcaagagcttcagaagcacttccctataaaacggtgtccgttgagaatacgtgctactgctcctgatgaccaggtgcctgaacttttaggaaagctgaatgaatggaatgccactgttatttctaaagaaggatcttctgctgtttcttgccataccatgtctaaagtgaaacaaaggatgactatggttggtagttttaaagaggtccttagtatgtcttctgtgggtgtttggatttttgaattggaacctggtctatataaggattgtcatgactttgttatgaataagatgcatggaagatttgaagttcttgcacactctctttatgtggagggggatacccaagtggagcaatacaatgattatgaggatatacctgaagccttgcccaaagaaacttatgattctgtgcttaaactgaatgagaaacttcaaaagcaaacaatttcatctactagtaggcctaccgagggacaacaaaagcaaaacaagtgcagcacatgtaatgtttcttttgatgacactaagctgtacagggaacatcacaagagtgaatggcacaagcacaatatcaagcgtaagacaaggcaactcccaccgcttactgaggaagagtgcatggctgacatggaattgggtgattcaaaatctgatttgaaggattattcattttaa

SEQ ID NO: 43295 - DNA, 663 bp, Glycine max
  Peptide Sequence Number=SeqID_160073
atgtatgagaattcgaatgatgcatcaaagagcagcgctaagcaacttggggatatatcacacttttatagtgttgaatctacgagcattttccttttgttgcttcttctattgctgctaaagattatcatgagaggagaccacatgcttgctattggaagtctggaaaggcattatcagtgtcgacatatctttcctgaataccttgcaccggttggtcagatatgtgttgcgcctggacagtttgcagcagactacatgaagtggttctacatgatatcttatcccttcatgagtctgacacagcctggggtcacaacagttatggatgaagcactttcagatgtacctagtgatgtaaagcaacctcaacatgcactggtatgtgttgcgcctggacagtttgcaacagactacatgaagtggttctacatgatatcttatcccttcatgagtccgacacagcctggggtcacaacagttatggatgaagcactttcagatgtacctagtgatgtaaagcaacctcaacatgcactggagacatgccaaacaataacagaaaggttggaacggttgatcaacctaagggttgtcactgaaggaacacattatcaccgaagagtgcctaaggatcataagaggtgtgactgcggaacataa

SEQ ID NO: 43296 - DNA, 174 bp, Glycine max
  Peptide Sequence Number=SeqID_160074
atgatgtcaacggaggatgttgacgatggggcacaacgtggcagcacgtcacaggcagaggaggctcggacgctcggaattgcagaaacgacacagaggaggaggaagaagatgagtgagcaagcaaaacctgcaatggcggtggaagaacccgtggtacccacaataagctaa

SEQ ID NO: 43297 - DNA, 552 bp, Glycine max
  Peptide Sequence Number=SeqID_160075
atggaggagactttgactcattttatgcagaatcccaaggaggaatggaaagctgtgatgacaaggagtaagaggtttgtggaggcggaggatgaggatagtgtcgtgtccaagaagaaagctgctgaaaagaaagagaggagtagaagtggacaagctagagagaagaaaagagaaaaagctgtgattgaaggtccagaagtaccatatcctgtggtaccttccaagaagaagaaggaccaccatttggcgagattcttagatattttcaggaaactggaaataaccatgccctttggacagatgccactctactccaagttcttaaaggatatgttgaaaaggaaacataagtatattcaccaagaaaacattgttgtggaaggaaattgtagtgttgtgattcaaaagatccttccacctaagcataaagaccctgggagtgtaaccattccttgttcaattggagaagtcactgtgggaaagactcttattgacctgggagccagtattaatttaatgccactctccatgtgcagaaggttgggatag

SEQ ID NO: 43298 - DNA, 1185 bp, Glycine max
  Peptide Sequence Number=SeqID_160076
atgtcggtgagttcgagttccaggggaagaataacgacggagcttcaagtcccgaagaaatggacagacagagaaacaagtcctgagagaaccaaggtttgggccgagccaaagaccaaaacggcaaaaaaagtctccgtcgtttactacctctcccgaaacggccaactcgagcatcctcacttcatggaagttcctctctcttcgcctcacggtctctacctcaaagacgttatcaaccgcttgaacgccctccggggcaaagccatggccaccttgtactcttggtccgccaaacggggctacaaaaacggcttcgtttggcatgatttgtcggagaacgacttcatccacccgacgcaaggacaagactacattctcaaaggatcggagattgttgagcacggtgtagccgccgtcgccgctagggttaacaaatcggaggaagagtccaattcgccggtggcgatcacgagacggcgaaaccagtcgtggagctctattgatatgaatgagtaccgagtttataagtccgaatctttcggtggctcggctgagagaatcggcgccgacgcggcgactcagacggaggagaagctgaggcggaggagggcggcgagggaggaagaagtggtggagattcaagagaagaatgatagaagaattgaagcgggaatggagggagagagggtcccgcacgtgacttgtgatgataatgatagtaataaccacactacggagctgagtagggacgagatctctcctccaccgtcggattcgagccccgagacgctggagacgctgatgaacgcggatggacggctcggactgcggtcttcggaatcccagaaggacaatctgacggtggagagctgccctagtgggaggatgagagcttcgtctgttttgttgcaattattatcgtgcggtgcggtgtcgtttaaggagtgtggagccaacgcggtgaaggatcgagggttctcattggttgggcattacaagtccaggatgccccgcggagcagggaatcattcgggaaaggaaacggggacatcgatggaaattccagatttgagcagggtgaggttggaagataaagaatattttagtgggagcttgatcgagaccaagaaagtggaaacccctgctttgaagagattattggcaatggataatcgtggttaa

SEQ ID NO: 43299 - DNA, 249 bp, Glycine max
  Peptide Sequence Number=SeqID_160077
atgctgatacttgacagtggcgtgtctgtcctgttccatcttgttgtgcccatttgggtttgtctattgtctcttactccgtgcagtggttcccggttgcaaatagtggagcatgaagaagatgtagtgcgggcaaagtgcataccacggaagtcgaagacactaccaaccaaaaaagaagaaggtgcttccatgcatattgttagcagtagcagacatgggagcaaaagatttgacccacaacaataa

SEQ ID NO: 43300 - DNA, 987 bp, Glycine max
  Peptide Sequence Number=SeqID_160078
atggccgggccgccgatgtcgatgttctcgaccgcgtcggcgaaggtgcaatccggcttggccacggtttcgcggaacggatacaggttgaccaccagcatgtcgatgcgatcgataccggccgccttgatggtgtccatgtgctcggcgctgtcgcgacgggccagcaggccgccgtggatcttggggtgcagcgtcttgacgcggccgtccaggatctcgggcgagccggtgtgggcggccacttcggtgacggtcaggccggattcggccagcagcttggcggtgccgccggtcgacagcaggcgcacgccgcgcgcggccagggcgcgggcaaattcaacgatgccggtcttgtcggacaccgaaagcagggcggtttcgattttcatggtgagggacgggagtggggcgcgtgcgcctgtctcgcttcaggtcgggatgggaaatctgtcatgcggggcgcgccagccggcccgcccgcgcggcaatgcgctatacctggatgttgtgggccagcagcttcttgcgcagggtgttgcgcgtgatgcccagcatttcggacgcccgcgactggttgccgccggaccgttccaacgccacttcgaggaccgggcgctccacgcagcgcatcaccatgtcccacatgtcgtggggctcggattcgcccaagtcttcgaaatagcgctccaggctggcgcgcacgcattcttccaggacatctttcttgctcatcggagtacagatatttttatgttggtgttgaggcggtcatgccgccagcagggctttcgcgacaggcgccgggttggggttgccgtcgcgggaaagattgaggaaccaatccgacaccgcccgccactggtcgcgggtgttgtcgatcaggttcatgcggtcgcggaacgagtccgcgtccggcaggccgtccagataccaccctatgtgcttgcgcgccgtgcgtacgccggtgtgttcgccatagaagcg

SEQ ID NO: 43301 - DNA, 105 bp, Glycine max
  Peptide Sequence Number=SeqID_160079
atggtgttaaaatggtttttcaaaggaagcataagacatgcaatggcggttccagagttagaaaagatgcaaagacaagatggaactaacaagaaacaagcgtag

SEQ ID NO: 43302 - DNA, 348 bp, Glycine max
  Peptide Sequence Number=SeqID_160080
atgattatgagggaccaagacatttataatagccaagatgaggctactacttcacctttcgctagtgaaagtgaagaagcaaaatgggaagaatctagtgaagaaatctacacccaagaagaaggacaacttttaatggttaagaaggagtgtaaggaggtaagtgtctcctccaagaggttagctaagaaggaaattcattttgcaataaagacaaacattaaagaaactttccatcttagacaacctccgcatcttctcctttgtaaaaagacatttgttagcactaccacacctctggggcttgaggttattcctcatgtaaaggagttattggataagggtttg

SEQ ID NO: 43303 - DNA, 548 bp, Glycine max
  Peptide Sequence Number=SeqID_160081
tgtagtttacaaaagcaaaggtgaaacggaagatattgagctggtagaggaggaacaggcacggattggtgctgattcttctagtgagacctccaataaatctgagaattataaggaggatgcacggaatgcaacacataagcataaaccaaagagggtagagagtgtcaatgctgatgcagaagcctttgaggaggaacaggcacggattggtgctgattcttctagtgagacctccaataaatctgagaattataaggaggatgcacagaatgcaacacataagcataaaccaaagagggtagagagtgtcaatgctgatgcagaagcctttggccatcaaagtgtgtcattggagaataagacaagagattcaactgtgctgaagataggaaattcggctaaagttgtgataaaacaagacatgaagggaagaaggcataaatatgggtttaacaacaacaaacgtgagaaggcagagaagaaaagggtggtggatgatgaaactggcgacaaacatcagctggatgaagtcctaaggatgccat

SEQ ID NO: 43304 - DNA, 630 bp, Glycine max
  Peptide Sequence Number=SeqID_160082
tttttaaagttcttagatgattatgaaggtgatggcccaattacagttctattgacccatggtagaataaaggaagctcagggatcttgtctcccatcggtcaacaattcttttaaggcttcaaagttaattattaacaaaccggtgatggagattcaagaattcaatgaacggcttgcagagttgggcattgaggctcggtcaggttttaaatcccatagtgaagggtgtacacagctttcaggttctatccaattatcatcaaaggaatcattctttggaaaggctgaggcaaagactattgctgacattaacaccatctctaaagaaattgtttgtgtaacggttggcacaattactaggattgttctggacaatgattcatggtgttatacaacttgcattcagtgtcataaaaaaagtgatgcagagatggcgcccttcacatgtgcatgcggcaaatacaataaagaagctatgcttaggtataggcttgaggtgatgatcaaccagggagatgaaaacacaaaattcctgctttgggaccgtgaatgcagtgaattaattggtcaatcagctgatgcagttaataagcttaaaattgaagtgtgtttttggattcaagagtaa

SEQ ID NO: 43305 - DNA, 835 bp, Glycine max
  Peptide Sequence Number=SeqID_160083
ttggaacctcttacgtgccgatcaacgtctcattttcgccaaaagttggcccagggcttcccgctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatccccaacgatctcaatttcttcaacaattggatcgttggggagcagtatgggctaatgaggcatggggatcatattggaattgggatcgtggcgtcggcgaagaagaaagcaaacagaattaaaatgctaaggagggaggatgggacagaagtgaaggaaggagaggggatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 43306 - DNA, 207 bp, Glycine max
  Peptide Sequence Number=SeqID_160084
atgtcaggatttacacgcgattctcctcaaatttcagccagcccgcatcaattagaccttgcaccttacgcttcaggcccctacaatgctcaatggaatgccccggggcttctccatgacaagcacacgttgcgttcgagtcgtattctcggagaaatggaggtggtgtttgtcattggaagtgcggtaggtaggctttgtggttga

SEQ ID NO: 43307 - DNA, 402 bp, Glycine max
  Peptide Sequence Number=SeqID_160085
atgccatcgcgacatagggatcacgcccgcaagacacccagtggacccagagaagtccaacagggtcttagggtttccagctctgattacgggcctctgtcagttctacagctcgtcgcccccaacaaggccatcaggcccctattaacagggctttcatcgagaagtactgcgcccccaggtaggcgcagggcaaggcatcacggcagcgggcaacagacgcaccgccaccacctctggagttcacctcagctcatccacaaaaaggttagagcgttgcctgcgacacatggccgaccaataggcgaccaagtccaaagccaaaggcgtccagctcaagacgttaaagaagcgctactaggagacaacctagtaccttttaaatctctgcttgttatttga

SEQ ID NO: 43308 - DNA, 534 bp, Glycine max
  Peptide Sequence Number=SeqID_160086
atgcattacacctcttcgtcttcaccttatcaaccacccaaccatcgcaatgactctcaccacccacctcagcctatcaaaatgcctaagtctctctttaaaaggaaacctaaacctaaccacaaatcactccaacaccacttctcagaatctgctaccagctcctctgaacccaaacctcctattctctctaaacctctaccttctctttggaaatggctagtaacacatcaagagcttagaaaaaggaaaagtcttccaaaaggaagcaaggtgaatgctcccaagtttccatcaattgtgtggacacatggttcacagatgaaggaaagaagattgactacaataagagttcaactttcccaatctgctagaatttcaagcgttaacaaacctagtggtgcaatcctctcaaggaggggacccatcaccagagtcatggctaggagactccaagaagattgggccagagatgcaggagaaggccctagggttctcacgagccttaagatagattttgggcccatgggctaa

SEQ ID NO: 43309 - DNA, 359 bp, Glycine max
  Peptide Sequence Number=SeqID_160087
ctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatctttccggaatgttgcgaaaccttatggattatgcaacaatgcttgttttcgagggttccgaaagaagcaaacaaggttcaaggaccaaccgtaagcactcccggatga

SEQ ID NO: 43310 - DNA, 330 bp, Glycine max
  Peptide Sequence Number=SeqID_160088
atgggaaaaaaagataaagaacttaagggaagaagcaatagtgtcataggcggctatcataaatggttgaaatctaggacgaaaaggataacttggctccaaaagctaaaggggctgaatggggaagaggaagaagtgcctgaggaaagtgaagaggtgcaagccttgaaagctgagcttgaaaagacaaaagtgaacctagctgctagtcacgggaaaatgctggaagacaaacaggcgaagatgtcagccttgtgggttgaaagggaagcaagagaagaggtgatagagctattgcataaagaaggcataggtttgctctcactttga

SEQ ID NO: 43311 - DNA, 696 bp, Glycine max
  Peptide Sequence Number=SeqID_160089
atggaggaggacagaacaagtattgctaggttccttagtggacttaatatggaagtgagggacaaggttgagctccttccatatagggacctagatgacctagtccaactttgcataatggtaaagcaacaacttaaaagaaagcctactttaaaatcttatggctctcactcttattcaaagaaagatcaaggtcatggcatcttaggagctgcaccttctaagcgcaaagatgataagagggatgaggaagaaaaactggaaaaacaaaagaaaaagaaggatagtaaggccttgtcttcaaaggccaaggagaaggaaaaagaggaaaaggattcctccaagaagattgttaagaaggaaaatcattttgcaacaaaagttactcttcaagtaaaggagttattggatgagggtttggttggtaagagcttaaatccttgtgctttgttggtgcccaaaatagcaccactcattgagttggtgaggaaccatgttccctcatgggaagatgcccaggaaaagggtgtcaagagaacgagcccaaagtatcaagaacatcgagatttgaggtcaaatcctttccaaggggaggggatgatgcaatcctaccccccaatggtattggataaaagactacaagaggattgggctagagctgctaaagaaggccctaggattctcatgaatctcagg

SEQ ID NO: 43312 - DNA, 321 bp, Glycine max
  Peptide Sequence Number=SeqID_160090
atggcttatggttttcatgttctgaagctgtgtaattcgagtttggcctctggtaatcgattaccaaggttgtgtaatcgattaccagagatgaaaagccttgaggcacaccttttaattgcatgtagtggttatgggacgctttgtgttgctatcgtaatcgcgatggcagcgcaactaatccatgatcgagtggagatggagtgcctagagggagattgggagaccctcgaaggcaatgcgaggtgccgattccggggcacgattcgattcacggctacttcattggttcatccagaggaaccagcacgcacgctttag

SEQ ID NO: 43313 - DNA, 315 bp, Glycine max
  Peptide Sequence Number=SeqID_160091
atggaagataccttaaagatggaagatcttttaaagaggtggattgagtatcttgataccacacgatcagaggtcagtcacccaccaccggtaaattttaatttttgtggaggagagcatttcaataacaactgtcatctctactccatgaaaaattcttggtggggacaagagttacacccttaccatcaatatgaagaaaaaagactttctaatctggataatgtgtttatgcaattcatggcataccatgctagctctaaagccaatcaaaactcaattcaaaatctggagattcaggttgacaagagctaa

SEQ ID NO: 43314 - DNA, 244 bp, Glycine max
  Peptide Sequence Number=SeqID_160092
atggcaaatcaagaagagtgggtcccgtttatggatgtgttagcattgctaatctttggggtcgtcctctttccaaacgtggatggttttgtgaacctagccgcaatcgacgctttccttgcataccaccatagcaaggagagcccggtggtagctgtcttggcagatttatttgatacatttgaccgaagtgcgagaagagtagcgcacggatcatctgttgcttgcccgctctctgtgtttg

SEQ ID NO: 43315 - DNA, 879 bp, Glycine max
  Peptide Sequence Number=SeqID_160093
atggagaggcataactttcacaagcgcttcaccaacttagctgatagtagcattgacctcacattggtgaaggagttctacgccaacctctacagtcccgaggggcctttacctaaacaagtcataatctgggtccacttaataaggattgatgcagacaacctcaatgcctttttagaaacacttatggtgcttgctgagggtgaatctttgcccgcctactcaagatactgcaggatgcctactgacattagagaaattgaggctgcactgtgcatacccgatcgagggtttattttaaatgctgaaggtcacccagggaagatcctcagaaaagatctaaccacccttgctcaggtctggagtgttctatcctactccaacctggctctgacctcccacacatcggatctgactgtggatcaagctaggttaatctttggcctagttactcaactggacatgaatgtcggagtcctcatttctgggcagattacttctatggcccagtctaactcctcaagactcgggtttcctgctcttatcacagctttatgcaggaccagaggagttgcctctgacagtcttttctttgaacatttgagccagatcattaatttggcctacataaggaagaattgttggaaccctgatgatccaataattattattaggggggccagaagaccaagggcaaggccaactgaggctccttctacatcagtagctcctcatctagctgctacatcagcagctcctcctctagctcatattgcagcagctccttctaccctacctcttgtagattttcaaagtttcgaagccatgcttcaaagcatacatcaggggcagattattttgctgcaaagtctccacctg

SEQ ID NO: 43316 - DNA, 255 bp, Glycine max
  Peptide Sequence Number=SeqID_160094
aggaaaacgcaaggatcatgcatgagcaaacatgaaaacaaaggtatgcagtttgtagaacaaaattgccccatttgtctccacgtgccatcggacacaatcgtatctggatggcaaaaggtgtgcggaatgatcataatttgtctctgcatgtcatcgggctcaccgcctctggatgagaaaagggcgcagaatgaccataatttgtctctgcgtggcatcagacacaattgtctccgaatggcgaaatggtga

SEQ ID NO: 43317 - DNA, 712 bp, Glycine max
  Peptide Sequence Number=SeqID_160095
tgacggtgtaccatttgaaggtacactgaatgacgattggaagtttgatttttctgcacatgatgcccgccagttggtttgcaccaacaatgcagatatgaccggatgccttcttgccggctcattggcttttgaaagctgcatccttcattatctgattatgcggattttgcttccacgatcttccaatcttgcccaggtttctgaggaagatcttgttatcatgtgggcctttcatacagggcgtcaacttgactgggcacatcttgtaagatatcgcatgcataaggcattgcgattaaatgcacctttgccatatccacatcttgtcactctctttttccgccattttcaaattcctcttgatcctaaaccttatgttccaatcaagagatcttttttaattggtgctgctgtgattgcttcttttggttaccgcaaagagcatgatggctcttgggtcaaaaagggcgttcaacccgctgatgaagaaggcaacctaccagttgaagataattccactcttcttcgaaggcttatggacaagtttgatggacttcagacttctgtaggtgacaagtttgatgccatggaattgcaagtcgacatgcggttcgatgccatggaatcaaggatcaccaaagttgaagaagatgtctccttcatccatacttgctttgatccaccaccaccgcccccatcatcatcttag

SEQ ID NO: 43318 - DNA, 861 bp, Glycine max
  Peptide Sequence Number=SeqID_160096
atggggcttcaccacccatcaatgcatggtgttcttagacttattgttactctagacgatgaggatgttattgattgtgaacctatattgggttatttacacataggaatggaaaaaatagcggaaaatcgaacaattatccaatatatgtcttatgtaccccgttgggactatttagctactatgttcacagaagcaataattgtaaatggaccagaactgttgggaaatattcaagtacctaaaagagccagttatttccaagatctccatgaagtggataattatgaatgttacgaagaatttgattgggaagttcaatggcaaaaagaacgagatttgttagctcgttatttagttcgaaaggaatccataaaaattattcaacaggctttggaaggaattcccgacggaccatatgaaaatttagaaattcgctgctttgatagagaaaaagagccagaatggaatgagtttgagtatcgatttattagtaaaaaaccgtcttcggctttgaattgccaaaacaagaactttatagatacaagatatccattttttttcagattggaatcttttaaagagatatatggaattatatgggtatttgcccttattttgattcttatattgggaattacgataagtgtactagcaattgtatggttagaaagggaaatatccgcagggatacaacaacgtattggacctgaatacacaggtccttttggagttcttcaagctctcctagacgaaacaaaattacttttcaaagagaatcttattccatctagaggagatatttgtttattcagtataggactatctatatcagtcatatcgattataataagctattaa

SEQ ID NO: 43319 - DNA, 467 bp, Glycine max
  Peptide Sequence Number=SeqID_160097
atacgtctaacagggccctggggtttccagtgttgatcacgggtctctgccagtcattcggggttcccgtcacacctagtaaggtgattcgaccgccgatcacccgggcctttattgagaagtattgcacgcctagacaggcgcagggtgatgcaccacaggccgcagacgcagcgccaccacctcatcaggctgatccggctgggtcatttggcacggagcggtatttacagcacttggttcgccagcaggcggccaaccacagggggcaggtgcagatacatgagtgtctctaccagctcagcctcaatcagcagagccagggtttcactccttttgcgtgccctactctagatcagttcagggctgaggtcgcatggtccggagattggcctgaggcccaggcagggaggcgcatgcagaggctcccggcgatgcagaggaggcccgcatggatgaggagatga

SEQ ID NO: 43320 - DNA, 360 bp, Glycine max
  Peptide Sequence Number=SeqID_160098
atgacgttgctacttagcaacattctgcccagcgaccgcagtgccgatctccccctgcggaagtatgagttgttacgagtctctgtcagtcctacagggtgcccgttccccccagcaaggccatgccatcatgacatagggatcacgcccgcaagacatctagtggacccgaagaagtctaatagggtcctagggtttccagctctaattacgggcccctgtcagttctacggagtgcccgtcgaccccaacaagttcatcaggctcctattaatcgggctttcattaagaagtactgtgcccccaggcaagcgcagggcgagacaccacagcagcctagggatggccggcagcgggtaa

SEQ ID NO: 43321 - DNA, 747 bp, Glycine max
  Peptide Sequence Number=SeqID_160099
atggttagacatcgtttcatgatcgacaactattatcattggacaatagtcggggataaggacatcaaggtgcagatcaacaagtaccacaacctggtagaagacctaaaggctgaaaacataaccctacctgatgaatttgtttccaagcttctgatcgacaaacttcttgaatcctgcattaattacaaacaacaactaaagcatagacacaaacaaatgtctctgtcaaaccttgtcactcacatcatcactaaggataacaacaaaaaggaatatgttgatgcaagggccaaagctttatctgccaaggcaaatatggtgccagacaaacccatccaaaaaaggaatcgacaaaagataaatgacaatccttataagcctgaggctaacctagctgaagcagatggcataattgttgtggtcatttctcaggaatgtgagcaaatgggtggaaaaggaaaggttcttctcaagctcacatcttggaaaatgttggctttcagtgatgtgctacatgttcccaccatcaaagtcaacttggtatctatagcactattagagaaggttggggtgaaagtgtcttttgaatcaaacaaaatttttatgactaagaataatgtgtttgtgggaaagggatattgtgatcaaggactttttgtactgaatgtttctaaagtgattaatggaaatgtgtctacttctacttatatgattgattcctatgatatacgacatgctagataa

SEQ ID NO: 43322 - DNA, 1074 bp, Glycine max
  Peptide Sequence Number=SeqID_160100
atggttacaacctcccctttcagtgtagggaatttcattgtcagatggggcatggagactatggctctaagctcgttgagtgtcttcttgccgattaaggcaaagtatgatgtgtttgcatcaactagtggtcatcaagttcacgtagcctctggtctcgactctctcgtccacaaaaccaagggtggaattgccctcgtcgatgaggaccctggacaccatgaagttagctataacgatggagacaaccacagggtcgtcttggttgacgaggttgatgcccttgaagtgtcgctttcgggattggctggactgtcctccataggaaaagatgctagtgatggttatcgctcatgccgttgttgtcttgtctactttggtcttccgctcgccttctgtccgcttcctagttcctattttgctcctctagatgtccttcggggtccaacagtcttcgatgttgttgccaatactgcagttaaatgcttccttgagaatcatgacacgattggccattatgggtgtgtaatgctcgtacctaggccctttggagagaggttggcgcttgtctggcttgtgcctcttgtccgacttgtacgcgtcaggtttggtgtgtgctttgcacttgtcacgcttctatttggcttggtggacttcattttagaatccggacctggatgtagcccttggctcattcgcacagttcgttcatgctatcaagtggttttttgcacagactatctacgaactttccagggcggactcatcgtgttcttgttgcagactggccaaggcggtcgaggtcatgcaatgagacgaaggcgtcaaagctgtctatggacctgggttcccctatgtcaggaaggcacccagatgctcgtctggatttgttgtcccatcgtaccgctcgaggttgagtggcttccaccccaaaggtatgtctacctccataatgcggaaaggtgtgggtggattgctcgtcgccctagggacgtctggcatgagcctctagttggtcatggtcagcctttggctttgtcaactcttcctcgtggtgttgctctatctttgtaa

SEQ ID NO: 43323 - DNA, 156 bp, Glycine max
  Peptide Sequence Number=SeqID_160101
atggagattacaatttacaagcttagggttcaagtcaatcaatcaaattctcagctcaacatgggtgcaagggataaatcattcatgcacaaggcttatcttgaggtgaggatggagtatcctgggctggttgaggtgtctcctatgcagttgtag

SEQ ID NO: 43324 - DNA, 585 bp, Glycine max
  Peptide Sequence Number=SeqID_160102
atggtcaaggttacaccagcaacccagttgcatgaccctgccacagaaaagtctcaaaatcaccacccacattctacaaatggtgaaaaaaatgattgtgagagtgtcatgattgatgcattcaggtggtctcgttgtaagaagcctctaccacagaaactgatgcatacaattggcatccctttgcctattgaacatatagaggttgtttgtcttctgttggtggctaagcaagtcagtctcgctaagccacccagcctctgtaggattaataagcctgggctaagcgaatggcctatagaaagaggaaagctactgcttccaggccctgggagccttatgacaccaccagagtatgacgagctccgtagagaactcaagaggcactgttggcacaaggccttgaccagggtgaggggtaaacttataaagttcgatgctgagtccctcaacaccttcttggagaccccaatgattctagagccaggggagcaccttactacatattccaggagtgccctaaaagctcctgaggaaggacctcaccactttggcgcatacctggagcgtcctatcttattctaa

SEQ ID NO: 43325 - DNA, 228 bp, Glycine max
  Peptide Sequence Number=SeqID_160103
atggggacaatgtggcatgcgccatcacttcagaatacacctaggccaaggccatcccttacaacccctcaatccaacaaaaacaagcaacaatctgaggataaatccctcacgtttcttagcaaacacatgcaatttagggcaccaaaatacatcaatggaaagctagaaagcccaagaatgagaggtggctcgcccaggcgagcccagctcgcccaggcgagctaa

SEQ ID NO: 43326 - DNA, 960 bp, Glycine max
  Peptide Sequence Number=SeqID_160104
atggcaagccaagagaagtgggtcccgtttgcggatatactagctttgctgatctttggggttgccctctttccgaacgtggacggtttggtggaccttgccacaattgatgctttccttgcatatcaccatagcaaggagagtcaagtggtggctatcttggcgaacttatttgatacctttgaccgaaggtgtgagaagaacagcgcacggattgtctgttgcttacccgctctctctagggtaccccgtgaggggagcgccaacggaagagagcctctcgcctttccttgtgagagatttggcgcacaaagtctcaaggttgtacaaaaagtccacaaggcgtggagaagtccgttgaggaaagataaagaacttaggggcatccgtaatggcatcatcggtggttatcatgaatggctaagggttcatacgcgagggttagattggctctccaagttgaaagttatcaatgaggagaactttgaagctccggaagaggatgaagaagtccaagctctaaaattagagctaggaaaggcaagactcgccaaagaaaaattcaagtcagccgctacaaacatccggaaagagtgcaccgagttacgagaggaaaacgcggccactgcaagagcccttgaacaagaaaccaaaagggcccgcaacgaggaacatggccgggataaataccgaggagctttgtggggcagcaataatgagctcaagctccggagagaggaaagggaccagtcacgggtgcatggcatgatcttaaaggaagagttaactgcttgctctagatctaagaggagtttggctcaacacttggaagcaaatcatgctagctatcatagggcaattaaaggaagagttaaaccagtcgttgacccacgaacaaaaactagtagaggacttcgcacaagcgtacgccgagaaggaagcaagagggagggtgattga

SEQ ID NO: 43327 - DNA, 312 bp, Glycine max
  Peptide Sequence Number=SeqID_160105
atgaaacaaaaaggaaaaagaaagaaagatcgcgaaggtcgacatgttatagttaagaagtataaatcattcgtaaagagcaaacgtatcttctgggaacaagggactgacgctaagagtttagtttttggaataaccgagataagaatggatgaattcattgaactgatgaaagaacataacttggaaacgttggccatgactaattttgcacgttgttttcaaatcatcattgtcacgcgtgccttatggagtgatatgggagttcggcccgagaccgacaccttgacacccaaatgtgggatcctctag

SEQ ID NO: 43328 - DNA, 150 bp, Glycine max
  Peptide Sequence Number=SeqID_160106
atggtgctcaaatttcatgacgatccaacggtgaacgagtccgagattgtcgtttttctgagacaggttaggtggcctacgggaaaaagaaagggttttggaagaagagaaaagaaacgaaattgtgaggcagaggaggctgagaactag

SEQ ID NO: 43329 - DNA, 300 bp, Glycine max
  Peptide Sequence Number=SeqID_160107
atgcagctcaacatattcatagatggtttgagaccacaatctaagcagctcttggatgcttcagctgggggatgtacaattcatggtggagctcatgaatctggatgttgtatccctaatgaagagaaaattgcacatgacgttaattatatggggaatcagcccagaggcaatctcaatacaagtggatttccagcatttcaaaacaaccagcagtatcaacaacagagacagtggcaaaatcaccctggtaaccaattcaacagagaccagggtggttcatctacaaggccacaatag

SEQ ID NO: 43330 - DNA, 448 bp, Glycine max
  Peptide Sequence Number=SeqID_160108
atggccacaatgattgaggtcgtgatgagcatgaagaagatagtggaggtcaatgcggctgcagttgttgctaccagtgtcgttgctgaggtggacccgacacccccatctggcctcaatcaaataaatcatccaatctcagatatggtaggtcagggaggcaaagagttgggaagtaagggtggcccccattttgtgcaagttcagaacaagcatgccttcccaccatatagcttgcctcccaactatacaccacccaatgttgcgcacactctcaatgagaatgtcaataactccacccccatactcattaagagccaacaacctcaatttgatcatgcacgtgtctctcaacccatggaagagacacatgaagcaccccgagaccacaatctagcagacttggaaccttacctcggatatgccactgaggggcaagcagttggtg

SEQ ID NO: 43331 - DNA, 276 bp, Glycine max
  Peptide Sequence Number=SeqID_160109
atgtctcctccacctctagaacctcacaatcactcacagactcatctcatgctctcgggatggcttcctcttcttgctcagttctcttccagtggccttgttggtgcttgcacgcttagcgcaactctggctcgcttagtgcgcattagtgaatttcagcttagcgctcgtcttttcgctcaatggatggactcaagcggtgcgcttagtgggattagccctcactcagcgaatatgcattgctcatccttcttccagattcttcctcgcacttag

SEQ ID NO: 43332 - DNA, 438 bp, Glycine max
  Peptide Sequence Number=SeqID_160110
atggctatcttcgcttcttccacgtccactatggaccgcatcgaagccaccatcacagaactcacctctgatcaatttcacttcaacgctactcaaaactccatgtccaccaaaatggatgaaattcttcagaggctgacccttcttgaaatccactatcagttttccaattcccttgaaatgtcaagaggaacttgtcttttatgcatgacaaagctgcttgtaggtaccctagccaagcctcaagttgtacctaacccaccaaacactttccttgataccaaccacattagtgcctttgttctcaccaagataaaagaaattgcaaaagcatatctagggaaggttgctgaaccaaatgagcttagctggaacaacccttgggatcctagaggacctaggcagaaatggggttcgataggatttttccgccctcgg

SEQ ID NO: 43333 - DNA, 453 bp, Glycine max
  Peptide Sequence Number=SeqID_160111
atgcagcgtttacccgccaaaatgatagccaaaatcgctcgtccagcatgcgatgtcttcataaaccaccgtgggatagacacaaaaaggaacgtttcggggttgttgtacgataatcttacgaggatgggagtgaggtccttcttggacagcatgaacatgaaacctggggataggcttttcgaccacattgatagggctatcctaggttgcaaggttggtgttgcggtcttctctcctcgttattgtgactcctatttctgcctccacgagctagctcttctcatggagtccaacaaaagggttgttccgattttctatgatgtgaaaccgtcgcagcttgtggtcaaggacaacggaacacgttctccaaaggagcttcagaggttcagtttagcacttgaggaagctaaaaacaccgtgggtttgacgtttgattctttgaatgggtaa

SEQ ID NO: 43334 - DNA, 663 bp, Glycine max
  Peptide Sequence Number=SeqID_160112
atgggatcaaatcaaacacctctactcaagaaaaggttctatcaagtcaaaatcaagagcttagaggtcaccagtttacaagagttggggcaattgatgggtcaacttcaacagcaagccttccgcaaagcctatggtaagatttgggacttagctacgatagaagtctctgtggaagtgattgcatcccttacccagtattatgaccaacccctgaggtgcttcacatttgaggatttccaactagtgccgactatggaagagtttgaagaaatcctgggatgtccactgggaggaaggaagccatatcttttctctgggttctatccctccatcgctagagctaccaaggtagtgaaaatctcggcacaagagttggaccgagtaaagcaaaacaggaatggggtagtcaaagtaccaaggaggtgtttggaggaaaaggcaaaggccttggaaaatcaaggggaatggacttcttttattgacatcttggcgcttttgatcttcgggtttatcctctttccaaatgtggaagggttagtggacctagcactattgacgctttcctcgcctttcaccatagcaaggaaagcccggtcatcgccattttggccgacatggatgacacgtttgaccggaggtgtgaaaagagcggcgcaataa

SEQ ID NO: 43335 - DNA, 531 bp, Glycine max
  Peptide Sequence Number=SeqID_160113
atggagtcaccaactgtcgcaacctacccttcagcgggaaggcgacgcgagactcacgggtgtgtcttccaagggaggaaaatgcgcgaagtcgccaccaacgtttatttgtggaaaacgttagaaaaaccgatacgtgtgggtctacgaatttttaagtacgagaggttcgagagttgtttttacatgtggggaagttatggcttaaacgatcggtcgaagcacgttaaaaacgaagaaaagattacagaaagtaagcgagatgaagatgaaatcatacaaagtaagaatggacccttaagggtacatagaatgaattcaaagcccctcacgccattttatagcaaaaacaagggaggtggttgccacccagcttgcccagacgagctagacctcatttgcgtcacaaaatttcgtgctccttctgatgtagctctatgtggagcttgtaggccttggatcttcttcatcaatggagccctttgcttcttgaagtttaatggcaatggaatggagaaggagaagaggtga

SEQ ID NO: 43336 - DNA, 575 bp, Glycine max
  Peptide Sequence Number=SeqID_160114
gtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgtttccatgtgaggagtcaaccaaatctcaaaatgaatggtttgattataacaagtttgtcaatgtcgacttctcagttgaaaggcgcatgcttattgatgaccagatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 43337 - DNA, 252 bp, Glycine max
  Peptide Sequence Number=SeqID_160115
atgacaagaggggttgaagttgaaaatcaattgaatagaaaaatcaagaggctaagatctgataggggtagtgattacactttgtttaatgaattttgtgaaaaggaaggtataattcatgaagtaaccccaccatattcacctgagtcaaatggagtagctgaaaggaaaaatagaacccttaaggaaatgatgaatgctttacttgttagttcctctgctcctagcacctttggggagaagccttcttga

SEQ ID NO: 43338 - DNA, 897 bp, Glycine max
  Peptide Sequence Number=SeqID_160116
gacactgttggaaatggtaaagcaggaaataaagctcattgcctaagcagtgcaactggagcattgaaggatgggaagagtgtgtttattgataggtgcaatcttgacagagaacagcgttcagaatttataaagcttggtggtggaccccaaatagatgtccatgcagttggtggaaaagctgctgcagttgtgaatagaatgcttcaacataaagagcttcccaaattaagtgaaggttttagccggataacattttgtcagaatgagagtgatgtcaaaaatgctcttaatacatacagcacacttgggccattggatagtcttccacatggctgctttggccagaagaatccagattccaaaattcaacttggtataatgatgttcctaaaaaaagcagaggtcccagttgctgctgcatctagagagagtggcattgaagaccctacttcccagactctgggtaaaaataattcctgctgcaaagacaaggaaacactttcctcaattcctgataatgccaactcagagatgaaggaagtagaaagccaagcagttggctctgctggttcccatgctaatcaagtttctccggatgatattcccactctggtatttccatctatttcaacatctgatttccaattcaaccatgagaaggcagctgatatcatttttgagaaggttgcagagttctcaaataagtttaggaatgctagacttgttctcattgacttttctcataaatcaaagattttgtccttagttaaggctaaagttgcgggaaaaaacattgacacccacaagttctttacccatgttggggacattacgcatctttactccaggggaggtttgcgatgtaatgtcattgctaacgttgccaactggtaa

SEQ ID NO: 43339 - DNA, 821 bp, Glycine max
  Peptide Sequence Number=SeqID_160117
tcaacgaggttgttggtcttctgttggtggctaagcgagtcagtctcgctaagccaccatgcctctgtagcttgaataagcctgggctaagcgagctcgctaagccaagtatgttccagtggtcaatctgggctaagcgcctgctggcgctaagcctttgtcgtgctaagcgtgctctgcgcgctaagcgtgagcgttatgcacagaacgttcactcctggaacatccttctggagaggaacgccgttctttatgttacagaatatgacgagttccaaagggagctcgagaggaggtgctggcataaggccttgactaggcaaatggatggtcatattgatgtggccctagtcaatgagttctatgctaatttatatgatcttgaagacaaatcccccaggcaagtccgagtgcgggggaagttgattaaatttgatgtcgcctctcttaatgcttttctggagacaccaccaacctggagcgtcctatcatattctaacctcgccctcacctctcacacgtctgatttgaatatggacaaggcgaggttagtttatggacttgttatgaggatggacaaagactccctcagccctaccattaacttggcatatattagaaagaactgttggaacccgaatgatcacatggtcactttttcgaggacccgcaaggcatgggctcaaggatctgaggctccttcttcttccgctcctccagctccagctcctccaccagcaccaccagctccagctcctgccactccagtgccttctggcagctccgctcaaactgcagagatcctagtgttgatgctttag

SEQ ID NO: 43340 - DNA, 210 bp, Glycine max
  Peptide Sequence Number=SeqID_160118
atggtcctgtcatcactcatcttgcgctggtcgccatcctcctcctcagagacctccacaagcggtgtggcagcaggtgaaatctggggagtggcctctagtgtgacctccggcgtgggctatgcctctggctatggctcctgggctataggagcctcacctcccccagaggagaagactagactccgggccaggccacctgggccatga

SEQ ID NO: 43341 - DNA, 1113 bp, Glycine max
  Peptide Sequence Number=SeqID_160119
atgccttttagaggcttgaaaaatgcaagaaaacgagctgcgttttctacgttttttggaaaacgtgatgaactcgctaagcgagcaagctgcgcaaagcgagctcatcaatactcattgtatttggtgccgctaaatgcagccttcaaggagcttagcgcaaatccctacggcacatgccagctaagtggactatgtctcgttaagcggccaatgtctttcagaaaaagaaagtgcattggtgcaaggcccacagctcaatatgacacaagaagattccactccttcaaggcttggaccagatacacagacaatgtgctaggaagacatatactagttgagaggaaggtagaaatatactatacggagttggatgagttcaaggctgaattggagaggcgtaacttccataagcacctcaccaatttagctgacaacaacatcgacctagccttggtgaaggagttctacgccaacctctacagtcccgaggggccttccccaaaacaaggagaatccttacccgcttactccagatactttaggatgcccactaatatcagagagattgaggctgctttgtgtatacccggtcgagggtttgttttaaatgctgaaggccatcctgggaagatcctcaggaaagatctgacaactcttgctcaggtttggagtgttctctcatactccaacctggcttcgacttctcacacctcagatttgactttagataaagctaggttaatttttggcctagtctctcaactagacatgaatgtaggagctcttatctcaggccagatcacatctatggcccagtctaactcctttagacttgggttccctgctcttatcatagctctatgtaggtccagaggggttgcttctcatagcctagtcttcgaacgcttgagcccggtcattaacttggcctatattaggaagaattgttggaaccctgctgatctgataattactattagaggggctaggagagtgagggcaatgccagctgaggctccttccacatctgcagctcctccttctaccccatcttctgcagactttcaatgtcttgaagccatgcttcaaagcatacatcaagggcagatt

SEQ ID NO: 43342 - DNA, 765 bp, Glycine max
  Peptide Sequence Number=SeqID_160120
atgacaggctcaaatggaaatctcatgggcaatcttccaattcttgatggaacgaattggggagaattgcggattcagatgcaagttgtatttggatttcaagatgttcttgaggttgtggaatatgccaagaaacgtgattgcaaggctctgttttttattcatcaaagtgtggacaaggcaaatttccagaagattgctcatgcaaagacagcaaaggaggcatggtgcatcttggaaaaggcatactcaggagatgcaaagttaaagaaggtgaaattgcagaccctaaggagacagtatgagatgattcaaatggagccaactgagaaagtagttgattatttcacaagaattctcagcactaccaatttgatgaaggattgtggagagaagcttgatgatcatatggttgtggagaaaatcttgaggtcactctcacctcggtttgattacattgtgtgcgccatagaagaatccaagaatcttgaggatttgaagatagaggagcttcaaggttcattgggggtacacaagcaaaggttgaatgatagagacacagagagatccacgcaagctttacaagctcattcctcaaaaggcaaaggaagaggggagtggagcattgataaaggaaagggaagtcacaaaactcacagtaagaattctaaagaaactcaatcagaaactggagaatcttcaggacaacacaagaatggagtgaagagttggaagaaggagggaaagaaatttgataaaagaaag

SEQ ID NO: 43343 - DNA, 537 bp, Glycine max
  Peptide Sequence Number=SeqID_160121
atggaagaatgcaacctagctaagagtccaattgagtttggattaaagctaggtgctggtcttgatgaaaagccagtggatgccacattgttcaagcaaatggtaggaagcttgagatatttgtgccatagtaggctagatattgcttatgttgtgggtctgagttctaagaagcaaaaagatgttggactctcaacttgtgagtcagagtacatggttgctgcctcaacagcttgtcaatcaggctggttggagtcactctttgcagaattgaagattcggcttgattcagttgttcaatttaacatggacaacaagtctgctatatgtcttgccaacaacccaattgcacatggaagaacaaagcatattgggacaaagtaccactatctcagggatcaagtgaggaaaggaagaataagtttggcttattgcaagtcagaagaacaagaagctgacattctaaccaaagcacttcgtggagagaagttttacaagttcagagaaaaacttggcgtagtgaattgcttaaactag

SEQ ID NO: 43344 - DNA, 1854 bp, Glycine max
  Peptide Sequence Number=SeqID_160122
atggagctaattgagaaggtagctgattatttcacaagaattctcagcattactaatttgatgaagggttgtggagagaagcttgatgatcagatggttgtggagaaaatcttgaggtcactctcacctcgattagattacattgtgtgtgtcatagaagaatccaagaatcttgaggatttgaagatagaggagctacaaggttcattggaggcacatgagcaaaggttgaatgatagagacaaagaaagatccacaaaccaaactttacaagctcattcctcaaaaggcaaaggaagagggaagtggagcactgataaaggaaagggaagtcacaaaaatcatagcaagaattttgaagaaactcaatcagaaactggagaatctttaggacaacacaagaatggagtgaagagttggaagaaagagggaaagaaatttgaaaaaagaaaggtaaagtgtttcaattgtaataagtatggacactttgcctcagaatgtactcacaaacataaagaagggaggaacaaggctggtgatgaggcaaatttggcagaaggagctgctagtgactctgagcaggttttgctaatggtgattgagaaatctgacaaaagaggatcagaattttggtatttggacacgggtagaaaagtgaggtttgctgatagttcttcaatcaactgtgaaggtgtaggaaatgtggtgatcaagagaaaggatgggagcaatgttgtaattgagaatgtgatgtactgtccaacaatggatagttatctgctgagtctgggacagctacttgagaagggatataagacgagaatggaggacttgatgttgaaagtatatgataaaaaacaaaggtttatcttgaaagccaagatgtatggacatctaaacttccaaggtttgagtagattagttgctaaacacatggtcagtggtatgcctcaaatcaaagcaccagcagaagtatgtgaaggttgtgttgcaagaaaacaacctaggaattccttcaatgtgtctttgcctcctagagctaaagaaccactggaagcatatgcaaaaaagcaaagtggagcaaccttgaagatcttgaggacagataggggaggagaatacacctctaaggaattcgaagacttttgtgaaagcaaaggcataatacatgaagttacaacaccctatactcctcagcacaatggtttggctgagagaaggaacaaaattttgctgaacatgaagctagaagagatcacaccagaagaagcatggacaggaaataagctaagggttcagtcaaaaggcatgttagtgcttgatgaacttggtgaaaccagtggagaagaagcaactggcaatagcataggtggggcatctcctgcagtagctcaaagacctcaaagaactaatgatgcaatcataagtgaaggagagctagttcactatgctcttctagctgatgtagaaccaataggatatgtggaagcattgaaggaagaagtatggaagaaggctatgctggaagaacttgctgcaattgaaagaaacaacacttggaaattggccaggctgccaaaaggaaagaagcctatcagtttgaagtgggtgttcaagagggaaggtcttaattatactgaagtgtttgctctagttgctagaattgaaatagttaggattgtagtggtcttggctcattcaagaggttggaatatgtggcagttggatgtggagtatggagtgtatgtcaaggaagagaatggagacataatcatactatgcctatatgtggatgaccttttaatcatagacagtaatgaagttgtgattcaaactgtgaagaaggagttgtaa

SEQ ID NO: 43345 - DNA, 504 bp, Glycine max
  Peptide Sequence Number=SeqID_160123
atgggtacttcagagtttagtcacgacacatggaaagagaatgagagagaattggtattttacttaaagggaacaaatgtggaacagtggaagcacaaaagcatttcaatgaaatcagaaaccataaaatcaggcaagcatcaacagggaaacaacagaggcgagagagaagccaaaagcaacaaaaccaaaagtagcaagcagcaaagggggaaacggaggcgagaaaaatgcaagcaacaacatggagtagatgagaaaactcagaaaagaaagaagggcctacctgcaaagggggaaatggaggcgacgagcagcaatggaggttcgcttgcggcaaggagaagacgtgcagaaacgatttttgttttagtcgtgtccggcgacggcggcggaaacagacatcacgttgcaccggagtcgtacccatttgtgtgtccgatgcgtctccgacacgggacgcgcacttcgacggcgtgtccgtgcttcatagctctagattga

SEQ ID NO: 43346 - DNA, 258 bp, Glycine max
  Peptide Sequence Number=SeqID_160124
atgcgaggatcatggaagaagctgccaaactttgagcagcaaggaaatacaatacaaaggtttaaccatgagcctttcaacctagtgacctcgtatgacgagtccaaggagaagccagaaaagatccttgagtgggaaagcttggccccaactgggaaggcccattcagggtcacagccagtctggacaacagagtatacatactacaggaactggatggcaaagcagttccaagaatatggaacgccacccacctaa

SEQ ID NO: 43347 - DNA, 147 bp, Glycine max
  Peptide Sequence Number=SeqID_160125
atgggtttgacctggccatggactggccctgtagttcctgcaactctttttccttacttggttggtatagtggtccaattcaaatatgagcagattgcaagatattggaagtcaccatcatgggttgctattccttttatctttcat

SEQ ID NO: 43348 - DNA, 123 bp, Glycine max
  Peptide Sequence Number=SeqID_160126
atgcatattgttgtggtaaaaataggggcaggatcatctcgagctaccttctggggtagagacaaagttaaagcggcagaaaaccaatcaaggtatttaggaatggacgcaaatggaggatag

SEQ ID NO: 43349 - DNA, 468 bp, Glycine max
  Peptide Sequence Number=SeqID_160127
atgccctttatcattcaagagcagcaagctgagtggataaacacgcatagacgaatcctgcttcctttatcattcaggaacagcaagttgggtggtaaacgcgcagagacaaattctgcgccctttatcattcaggaacaacaagttgggtggaacagcaagttgagtgataaacgcgcagagacagattttgcaccctttgtcattcggggacagttccgctggcagggaggttcactggctaaatggtgtttcgctcgaacgaaattagtgtcttatcttcacttccattttatctccaataaaagacaagtaaagaggggcaactttcataccctaatttcttccgaggaccatccgttgttgggatgtgaccctcatttgaccacttcgaggtatttggcacccatcgttaggcaatttgtgaagttccgagacatgccggaagccaaaagaaaagcgtcgtag

SEQ ID NO: 43350 - DNA, 389 bp, Glycine max
  Peptide Sequence Number=SeqID_160128
atgtcgccacacgggggcgacatggatgggggtgaaaaaaggaaagagagggatggggtttctcttgcttttggcatagcgggccccggcgggaggcccgcacgacgggctattagctcagtggtagagcgcgcccctgataattgcgtcgttgtgcctggactgcacattagcatggcgtacttctcctgtttgaaccggggtttgaaaccaaacttatcctcagggaggatagatggggcgattcagaattcatacatcccttatcagtatatggacagttatctctcgagcacaggtttaggtttggcctcaatggaaaaaaacggagcacctaacaacgtatcttcacagaccaagaactacgagatcgcccctttcattctggg

SEQ ID NO: 43351 - DNA, 462 bp, Glycine max
  Peptide Sequence Number=SeqID_160129
atgccgtcgaggccgctctccaactccaaaaagtcagcgagtcttccttgttgttcttgttgtgccgttgtaccacacgcccacaccaatgtcgggttgtccttgcatgacattgttgaggtcacccttgccctcaccttcacccgcattgaatgtcaccaatcaccctcatcctctacctctccattctcgaacaaggatgcatctggttcagtgaagctgtgggagattaccaaaggtgttgttattgaagattaccaaagttgtgggagacaactggtttcatttgaggagaaaaaggaagagctatttgagatatgtgtcttttccaccgtgttaggagtgactacttctaataatggtaagaaaataatgaatactctcaacagtgatcgacatcaagaaataatgactacttcgaacaaagtattagctacttccaaaaatgctatgaaaaagtaa

SEQ ID NO: 43352 - DNA, 1870 bp, Glycine max
  Peptide Sequence Number=SeqID_160130
atggacgaatgttgtccagtgtcgtgtgtggtaacctcaacaagtgtgaaagaattccatgttgatgtggcttgtcaagcccccgatcctggacaagtgttgtccgagctacttatgttaagttgtccagaatggacatgtctttggcatgtgtgttcggcgcatgcgcagtactcttgcatatgtgtcactcgtggagtggttgtgatcaccatcacttcagctccttgccttatgcttgtgatcccctttcttcttccttcactttcttcaattcttcaaggtattatgtcttccacaatgtcttcattcttgtctgattctgccatcggcataggtggcagtgattctgggggctcgattgagcaacctatgatggatcaggatgtcatctctattggtggttcctcacccgagaatacttgttggggtgcctctgacaacgagtcctcctcttcggagagggtgagggcttcgtgtcatattggtgagagcacttctcgccatcgcgggaaggagcggccttccactgctttcggggagagatgtgaggtgggtaatggacaacttttgaaatacaagtcctctctcacctcggcggcgagtgtcaatgcttttcaacgccaggtgaaactggtcttgggtcttattctcctcttgactgctttccaatgtgctctacttgagcacttgaatctgattggcaagattggttgggtctccttgaatagcatgtccaagaagttgtttgagtttgactcaaacatatttcaccgtttctttaagattttgtctactgatgttgtggctgatgatttgccactaatgttcaatagggatggggagccctgcttcccattctgctggcagtttgaccctaccaggttcaagtcgtttgacaaggatctgctaacccttgtggagagggttgacaaagctattttggagcagctgtcggtctcgctaaacattcaggccattctgtctcttccttcgatgactgatcccttcactaccttggatggtgactttgcctgcaggccactcatgaagcaggttagacctgcgggtcagactatgccgccgtctactactgttgttgctgttggagaagggggtcaacctgttggtgaggttgaccttatttctattgttgtcgaagttgccctcaacgctccttcctctgttttgacaaagaggaagcaggatgatggtgttgggtcgtttggccgtaagatgttgaaggcccatatgagcctacatgccttgaggcaggctgtagggttgacgcttggtgtcggtcgccctttgatcgtgcagaatgtgccttcgactccaccggaggccacttctgttgctgttgaagttagtgtgccagctactttggttggttctgttgtggcaccattgtccaccattgctgcacctattctgagtgctggtgtggcaaccactaatactcctgtgatgttgtcttcttcctcttttcctgcaatggtctttctttctactattttggcggtggcatcgccttctttgtcttctcgctctcgcatctccttggatcatttgtacacctttagtgattttgattcactatggggtgcaacctacaagttgaagcagaagaccccaattggctttgtgtcagccttggataagaaacttattagtttggcgattctggaggagaatggacaacgacaccaagaggctttgcacaaggtggtgtccttagaggcggaggtcgccaaatggagggttactgcttgcattgtttggagagcggagcgccctaaggtggctaacgccacgatcgcctttgttgaggccgtaaggttaaaccgccaattgtcttctaaagttggtg

SEQ ID NO: 43353 - DNA, 390 bp, Glycine max
  Peptide Sequence Number=SeqID_160131
atggtacctgtgcttccaaccgttggattaggggaccactgtcccgtacgcgggacgggaaaaatccgaccgtcaggaactgagatggggtgtaaatatacacccgtcagttttggggcgggaagggaagggaagggaagagaaatggggagtgggagtgggataaacaaaacccggttccaatccgtcctcttaccatacctaaagcttgcagtgatttctttatcgtttgtgaagcacaatatctcaattctgaagcatatcgggtgcatgcatggggcctatatcatggggtgtgaagaggaagaagagtcaaaatatataaaagttgtgcccactaatgaatgtgtatgtagccctttcgaggtggatcagtcagtaccttgctag

SEQ ID NO: 43354 - DNA, 802 bp, Glycine max
  Peptide Sequence Number=SeqID_160132
gatagctggagcccgcgggcgagttctatcgggacggtgcggctgctctgttgagccgcgccatggaatcgagagctccaagtgggccatttttggtaagcagaactggcgatgcgggatgaaccggaagctgggttacggtgcccaactgcgcgctaacctagaccccacaaagggtgttggtcgattaagacagcaggacggtggtcatggaagtcgaaatccgctaaggaggcgcggcggtcgctgcaaaacccagggcgcgagcccgggcggagcggtcgtcggtgcagatcttggtgggacgggggaagcccgtctgatagcgctctgtgcgcgtactccgaaagggaatcggcctgcccaccctggaaacggctcagccggaggtagggtccagcggctggaagagcaccgcacgtcgcgtgcctctggtcgatggaacaatgtaggcaagggaagtcggcaaaatggatccgtaacctcgggaaaaggattggctctgagggctgggcacgggggtcccagtcccgaacccgtcggctgtcggtggactgctcgagctgcttccgcggcgagagcgggtcgtcgcgtgccggtcgggggacggattgggaacgggcccttcggggcctcttccccgggcgtcgaacagtcaactcagaactgtgctctgaatgtcaaagtgaagaaattcaaccaagcgcgggtaaacggcgggagtaactatgactctcttaagcgaaaccacagccaagggaacgggcttggcggaatcagcggggaaagaagaccctgttga

SEQ ID NO: 43355 - DNA, 353 bp, Glycine max
  Peptide Sequence Number=SeqID_160133
agacactcgacggtaaccagcacacaccctttgctatccagcgacccgagagtccggtagcatgcggagacaccttacagttatctgctcctcgtcatttggagaccccaagtcggattgacaagcagagaccaatgtggtcatctgcaccctttccggagatgtcggcatcttccgatagagactattttagtctcacagaggcaagaactacgcggaaatacctaagtggttatttgtacaaaacgatttctgttaatcctaacccaagaagtcaggtggcaggcggagatacccaactgattatccgtataaacactcttttgctatccataagactcagagttcggtag

SEQ ID NO: 43356 - DNA, 210 bp, Glycine max
  Peptide Sequence Number=SeqID_160134
gattcctttgaggagcaggcgacacagggattcttcggccttcatggacgtcaggatgttgtcaccactactattggacgtccaaagcaccctggacgtgtccatgctgctggagatggtgtcaccatcaagcaatacttcggatcggctccacggacgtcccgcagctcttcctccctacctcctgaagaattgcagcagctgacctag

SEQ ID NO: 43357 - DNA, 476 bp, Glycine max
  Peptide Sequence Number=SeqID_160135
atgatctgtggaggttgcaagcaattaaggcaaaatttgaagctgctctagatgcatataaacctagtagcattatagcacaggaagatattggtctttctatgggcatccaaggaatagaagttgcaaaagaaagttcagatattataatcttggatgataactttgcatcaatagtaaaggttcttgctggcctacgacttattagagtaagtcaatgtatgtttacaatcatgaatcatcaatatgtcatttggtgtttttggccaatcacaggggcatcaatgaatccagcaagaagcttagggcctgctattgtgcacaatgagtacaaaggaatatggatatatttggtgtcaccaactcttggagttgtggctggtacttgggcctataatttcatcaggtacacaaataagccagtgcatgaaatcaccaagagtgcctctttcctcaaaggtggtgaagctaagtga

SEQ ID NO: 43358 - DNA, 252 bp, Glycine max
  Peptide Sequence Number=SeqID_160136
atgttggctatagtcagggatgaagatggtgtggatgcaagtattggggacggttcacgtgcattaacatcagatgaagatggtctagcttcagtcggaggtggagataatgtaggtgcaacatcgagaggtctaactggcatagagacagaagacggagatggggtagatgatggtagactatctcaaggcggtaatagtccaaccacatatcgtcttttcttcccagttgtccctttcccattggagtaa

SEQ ID NO: 43359 - DNA, 363 bp, Glycine max
  Peptide Sequence Number=SeqID_160137
atggtgagcgtgaacgtgagggcgagggcgagggcaaaggaacacgacgacgaaaatgatgatgataccatgcgacagagatgcaaactaaacattgatactaaacttttggcctcttgcattgtgattgccaatggtgcaaagaaaatagatgaacctatgtgcagaaacaatagaataatttaccatcgtcctcccataatcaaatatgagagtgcctctgttggtcatcatgtttgtgctggtcttttgcctgtctgtcatctgcatggtcttgctactggtgctggtggtgcaactgctgctagtgctggtgttgctggtcctgatgttgttggtgaggttgttgttgttggtgaataa

SEQ ID NO: 43360 - DNA, 375 bp, Glycine max
  Peptide Sequence Number=SeqID_160138
atgcgcctaccagggaaggagagtctgctgatgggatcccccataaccataaatgagatcttggatgttagcatttcgtttctaaatgaccatttagaggaaacactgggttcgacaaaaatagaagaaatccactcaaagtgtatcaatctcgcacagggtaaggattatggtgagtcaggattttggctcaaggtttgtagaatggctagacatgatacatgtcggggtttggtttggctcaaggataaaagggatgcctcacattatttccatgacacaaatgcaaaaatgatgatttggaaactttatgcaaaactggtcatgcatgcacctatgcggacactcaagtgtcaaatttttatggtcatgtga

SEQ ID NO: 43361 - DNA, 159 bp, Glycine max
  Peptide Sequence Number=SeqID_160139
atgttgggtgataaacgcgcagagacaaattctgcgccctttgtcattctgcacacctttttgccacctaggctcgatcgtgttcagcaaaacgcagagacaaattatggttccgctggcaggaaggttcactggccgaaaggtgttttgcttgaatga

SEQ ID NO: 43362 - DNA, 573 bp, Glycine max
  Peptide Sequence Number=SeqID_160140
atggtgagcaaactggcgcgcaacctggcgggtgtggcggggctgcgcctgcgtcgtttcgacagcatcgccgcggcggtcgcgggcgcggatatcgtgaccaccgtcacggccgacaaggcctacgccaccatcctgacggccgatatgatcgagccgggcatgcacatcaatgcggtgggtggcgactgccccggcaagaccgagctgcacgccgacgtgctgcgcgccgggccggtgttcgtcgagtacgagccgcagacccgcatcgaaggcgatctgcagcagatgccggctgacttcgccgtgaccgaattgtggcgcgtgctgacgggccagtgcgccgggcgcggccacgcccgcgacgtcaccattttcgactcggtcggctttgcgctggaggatttttcggcgctgcgctggctgcgcgacagcgcggtcaggcacggcatcggcacgcgcgtcgaagtggcgccgcaactggccgatccgaaggatctgttcggattggtgcttgcccgccagaccgccgcccgggcggcccgcgacacgcaggcgttgctcaggaactga

SEQ ID NO: 43363 - DNA, 226 bp, Glycine max
  Peptide Sequence Number=SeqID_160141
catccttccaagcttcttatccaaggctcatcttggtggtgaagctccttcttccatggcttatttccctagtggatggcgcctcctctcacctcttctcctttgtcttccgctgcatttccatggtggaaaatcaccattaaaggacctcattgaagctcaaagatccagcctccatagaagccccacaagcaagcttccatcaattccttacggccataattga

SEQ ID NO: 43364 - DNA, 282 bp, Glycine max
  Peptide Sequence Number=SeqID_160142
atggatgcctggaccaagctatatagatacaacaaaactgaaagtaacgaacaacttccatctttgcaaagacatgcctttgtcaagtggtggaaccaatttgatgcaacaaaagcagaaccagataaggttaaaatgtggttcaaagctcatccagagtttcttaagacagttgatccagagacttcattgtttcttaatcagaaatccaagctagcagctttcctaacgggatccaagttgaaggaacatctaaccaagaacttaaaagaggttctttaa

SEQ ID NO: 43365 - DNA, 355 bp, Glycine max
  Peptide Sequence Number=SeqID_160143
aatgaccaaacttggtctctgcgtgccatcggacacgactgtgtctgaatggcaaaggggtgcggataaccgtaaggtatctccgcgtatcataatgaccaaacttggtctctgcgtgccatcggacacgactgtgtctgaatggcaaaggggtgcggataaccgtaaggtatctccgcgtatcataatgaccaaacttggtctctgcgtgccatcggacacgactgtgtctgaatggcaaaggggtgcggataaccgtaaggtatctccgcgtatcataatgaccaaacttggtctctgcgtgccatcggacacgactgtgtctgaatggcaaaggggtgcggataaccgtaag

SEQ ID NO: 43366 - DNA, 261 bp, Glycine max
  Peptide Sequence Number=SeqID_160144
atgacaacaacatatacctccaaaccctacactagggtaatgacaggcaccatgcatgagcttcaacctaatctaggggcagacaagaagtcctcacccgataggttgaaaacccaaaaggatggcctaggcaaaaagttaaacattggtcagccactgaggataaaaacaatatgtaaagaagaacatagtggtcatcaagtaacaaatgaaaggttcttaaatcccatgatcacaattcaagtaaaaagaattgcttga

SEQ ID NO: 43367 - DNA, 576 bp, Glycine max
  Peptide Sequence Number=SeqID_160145
gccatttttcatcatgaggtgatcaacacagacaaagacaatgattctaccaagttaatattatttggtcagaaagttggcaaggggaaagcgattcagaccacccatcaaaacatggaagtgtgtgaggatgtgataggtaaatctagatggacttatggtcatagttctagttctgagagctcaaatgatgaagaagatgatgacaattgctttgattttttttcaaaagattatatgacatctcagtcttcattgtcactagagcctactattaaggaccctcctggagtacaatactctcaaactcccctgagtaagaagaaatcaaatggctcacaacaaaggaggcggaagttaaagttgccatgggaaatggggtcatctaaatcttttgagagtgagaagaagcctaacatttgttattcttctaaccataaatttgtaaacaattttgaggccaagaaactgccgcttgcaggtggaacaccacattggggactgccacctgcagatggggcactggattggggattgttgtttgttggtggggcactagaatgggaattttcacat

SEQ ID NO: 43368 - DNA, 174 bp, Glycine max
  Peptide Sequence Number=SeqID_160146
atgcacgataactggccttctgtcagccgctcccagattgagttagatgagctggaaagtgtttccattctgtccatgacccttgcatgggatgaattttccttctctacttttcaagaagcccattattcacttcaagattctctagaccaggtgcctgacatgcctttttga

SEQ ID NO: 43369 - DNA, 327 bp, Glycine max
  Peptide Sequence Number=SeqID_160147
atggcatgcaacatgtttgctccgtgccccaattttagggacctacacgggaggaaactaaaagggcctttagtgataattcccaaggtggtcatatctctcttgatggtctctagagtccccagcatagtcgccaactgttgcaacctacccttcagcgtgaaggcgacgcgagactcacgggtgcgtcttccaagggaagaagatgcgcggagtcgccaccaatgtttattcgaggaaaacgtcagaaaaaccggaaaggtgtggtctacgaactttaagtgtgaaaggttcgggagttgtatttacgcacagggaaggtgttag

SEQ ID NO: 43370 - DNA, 342 bp, Glycine max
  Peptide Sequence Number=SeqID_160148
atgtgcgggtggaggtcattggcatccaagtgtttggaacacttaagggcaattgttgacgttagagtaaatggaaaagtatgccatgaggtggtggcgacctacacatggttgcgtgagggggtgcctatgtgcaaggatggcattgcgatatatggtggctatggaggttcacacagggtttcaaaattaggtgcaaatagaaaagtgaagcacaagggtcaaattggtgtgttcaaaatgacacactacaccggttacaatttgaacctttgtaaaatgtcatattttacattggttgttattcaaactaatttaacatgtagcatattagtgatgtaa

SEQ ID NO: 43371 - DNA, 180 bp, Glycine max
  Peptide Sequence Number=SeqID_160149
atggaagaattgagaaaaaagatgaccttgtcattgttgaaggcagcgataaattgcatgatcagtggtggtcgcatgatggcatttttcctctgtaatcacagggatataaaaccaaatgtcaaaagaaacttgtcaagcaaaggaaattatgaaatgacagggatgcacaatataaag

SEQ ID NO: 43372 - DNA, 207 bp, Glycine max
  Peptide Sequence Number=SeqID_160150
atgcatcaccaaaagaggaaaactctagatgagactttactgttatcaagcgagtcggagacccagcatgaccacagatcgacctccactccttatggcttacatagacccggaatcaaccatcaaggttgtttcaacaaacattcaaaggttaagcattgctttaagattaatacaaggttgcttcaacaaacattcaaaggttaa

SEQ ID NO: 43373 - DNA, 1021 bp, Glycine max
  Peptide Sequence Number=SeqID_160151
ccgccggatcctgccgagcagcgacggcgccggctcggccgctggcgtcgctgccgtctcgggcgcggcgccgcccaccgccgcccgcacgatctcggcaaagcgcttgatgcgcgccaggccgggctcgaagcggctgctgatggcgtacagccgggtgcgccgatgcggctcgtcgtcttccaggccgtcggcgatcaaggacgcgcacaactgcggatcgcccgacatcagcaagcggtaggagaacgggacggcatacggccattcggacaggccgcagatcgtttcgggccggtcggcatagctggcggggcggttgctcaggctgctgccacggtttgccaccaggtgtttcggtggagtctcgggcgtctaaccgcccgcggcccgcgcgagttcccggccttccaaaggtcggcttatccgctgcgcgagatgcgtcacggatcggaagcggcggtcatcataattccgggatcaattcccattctcatgaaagaccctgaccgaggatccgatgaccgtacgcttttcgccccgcacccgtgccttgcgcctgcccctgatcgtgctcgggctgggcctgaaaccgccaccggcccggtgcgcggcttcttcgccgagcgtgcggtcacggccaccaaaaccgatgcgccagtaatggagacgccacagtcgatcagcgtcatcacccgggaccgcatggaattgcagggcgcgcaatcagtgcagcaggctactggctacagcgccggcgtcaccgccaacaatcgcatcgaccatcgccgcgatggcgtcaagatccggggggcggactcgacccattatctggacggactgctcaacagcgcctggtactacaacaatacccggccggacccctacacgctcgaacgtatcgagatcctgcgcgggccgtcgggcatgctttacagacaaggctccatcggcggcattctgaatctggtcagcaaacggccgcaagccgaggcaatgcgcgaacttggcgtcagctatg

SEQ ID NO: 43374 - DNA, 267 bp, Glycine max
  Peptide Sequence Number=SeqID_160152
atgagttgtgtcatcctctttcttctgctccttcttctgctcttactattgagcaccaccccatgtcacgcagcagcaagaaaagccagatttgacacactcaaaggtggttcttcttctgatgatgaattcaaattcaaaccctctaataacttccatggtactggccttcaaggaaacaccaatgcacaaaaagatggagaccaagtttttggtgcagacaaaaggaaagtgtacacaggacctaatcctctacacaacagataa

SEQ ID NO: 43375 - DNA, 279 bp, Glycine max
  Peptide Sequence Number=SeqID_160153
atggcgaagcgtttgattccactgttcaatcgggttttggtggagaaaatcgtgcctccatcaaagaccaacgctggcattttgttacccgagaaatcctccaagctaaattctggaaaagttattgctgttggccctggctttcacagtaaggatgggaagctaattcctgtggctgttaaggaaggtgatactgttcttttgcctgaatatgggggaactgaggtgaagcttgataacaaagaatatagagcttctagactgaagctgttattttag

SEQ ID NO: 43376 - DNA, 306 bp, Glycine max
  Peptide Sequence Number=SeqID_160154
atggatgttaagacaactttcttgaatggtgatttagaggaagagatatatatgactcaacctgaggggtgtgtggtggatggtcaagagaacaaagtgtgcaaacttttgaaatctgttaactcgttgcgttaccctctcccgagtggcctaactcttaaaaccgattcacgcattcattccttatccctaattaggctttaccctctctcgagtggcctaaagactaacaggaaacaaagtccgagatgcagaataagcaagaaagaaaagcagataaaagaaactggaagaaaaaccctctga

SEQ ID NO: 43377 - DNA, 216 bp, Glycine max
  Peptide Sequence Number=SeqID_160155
atggattggcaattcgtatggcttatacaaattaccaatcccccccaacaatggttgcacaataaatccgacatagaggaagaaagacttacggtgaggaaggagaagacgaggacgactacggtggcgatgataggaggcatgaacagcggcggcagtgcgaagaagaagaaacaaacaatgaaggagaagaaggcgcagggtgtacgaacgtga

SEQ ID NO: 43378 - DNA, 390 bp, Glycine max
  Peptide Sequence Number=SeqID_160156
atgatgaggggtgaggtggtcgatgtggaacagatagatggtggtgatgcttggaactctacaaagtgggtgtgcgtgcggtctagagggtgtagaagcaagcttcatgatgatgaaccaagcaattttgatgatgccaaaagcccaaggtacatcctttgtggtacaagtagagggtacatctacttgggttattatactgagaacaagagagggtacatatcttgtggatcagttcaagtggagggtacatccacttggttgttcaaagagaacaagggagggtacatcccttgtggatctttgcttgtaaaggattttacaaggttattggaaatctcaagaaccgttggttcttggggactggacgtaggcacgggttgtggctga

SEQ ID NO: 43379 - DNA, 1371 bp, Glycine max
  Peptide Sequence Number=SeqID_160157
gctggcacgcatctggtggtcgcattccggcgcttcccagtgcccgcgcagggcctggcgcagcggagcaggcagcacggctgccgagggacggttcaacaaggcatccaggccggggacggaagcgcggttcacagcatcgagcaggcaagacagaggcctctacactagcgccggcgccgttcagggacaatcaccgcggccaccatcacccggcatgaagacatgccgctacactcgcgggcaaacccaggagagtcccgtcatgtccccgatcgtcccgcgtttccgcctacggctgctggcttgtgccgcactgttgctgtccctgtcggcgcctgcgctggcccagcgcgtggtagagggtgacctgcagcagcagatgtcaccggccgaattcaaggctgctggcctggaaaagctcagtgcgcaggaactggccacgctgaaccgctggctgcagggcaaggtcgaggcggccacgacccaggcagttgcagcggtacgggaatcggcgcgcgaggaaggccgccaggaagtgatcgtgaagaatcgcggcttcttcgatttcggcagcagtgagccgatcgtcggcgtgctgcagggtgagttccgcgggttcggcaagggccgcgtctacgtgctggacaacggccaggaatgggagcagaccgacacatccacgaccccaggggtacgcaagcagtcgccaaacgtcagtatcaagcccggaatgctcggtgtctggtgcgccgtaccaagtaacggcttacccgtcccgtggagcctggccgatgctccgctgctttccgatggaccgccatcgtccatcgccagcagtcgagcgccggctcggctctacaggaccggattcacgcctggcgcaatgcggtcacccgctgcgccagcttcttcgccgagatgccggtgcgtgcccccagctcctgcgcgaacagtgacacccgcagctcttccagatcccagcgcagcgcctgccattgcgggcgctcgcgcagtccctgctgctcccccacttccagcgcttccaggaacgggtgcagttccagcatgcgcgcctggtcacgtggcggatcacgcttggcacgctcggtacgcaggatcatcgctttcagatagcgcggatactgcgccaatgcgtcggccggtgtatcgcgcaggaagccaggatggatcagcccggccagctgcgcctccatgtcgtccaggttgccgcgcgcccagcccatcagcggcgcttccagcatcggcttcagttcggccaccagcgccaggatggtctcggccagcttcagccgcgacatcgcctcaccgaacagggccttggccgcatgctcgcgtcgctgctcgaag

SEQ ID NO: 43380 - DNA, 216 bp, Glycine max
  Peptide Sequence Number=SeqID_160158
atgaacccaaaagcggttagtcttttgagtccagtgataacaaccaagaagttgtacccacttcttgcaatgaacccaaaagaggttagtcttttggatccagtgatcaaccaagaagcaaatccgcttcttgcaatgaacccaaaagcggttagtctttttagtccagtgtttaaccaagaagaccttctcttgaaaaacaatcaccaagagtag

SEQ ID NO: 43381 - DNA, 888 bp, Glycine max
  Peptide Sequence Number=SeqID_160159
atggcgaactcccggcacggatacacagccgccaatttcaccctgcagcgccacgcagcgcggagcacgatcgttggtgccgcgcatgttgcgcatcagcaggctcaggggttctgtcagttcaaccggcaccgcgccaccgccgtcgtcggcttcggcccagtaaaaagaaacgcgaaaatgggcgcagcaggcgccacaggtcatacaggggatttttatgtccgcttgggtaaatcttgtgccgcgattaacctcaataccctgttttccggcaaaggagtgattatgaaactggctaaatgcgcgctgctgctggcgctggcgatcccgcaactggcactggctcaccaggccggtgatttttttgtgcgcgccggtagcgcgaccgttcgtccgaccgaaggctctgataatgtgctgggtatgggcggcttcagcgtcagtaatgatacccagctgggtctgacgtttacctggatggcgaccgacaatatcggcgttgagctgctggcggccacgccgttccgccacaaagtgggacttggcccgaccggcaacctcgctaccgtgcgtcagctgccgcccaccctgatggcgcagtactactttttcgacagccaaagcgcgctgcgcccttacgttggcgtcgggatcaactacaccaccttctacgatgcgaagttcaaccagaccgggcaggatgcgcagctgagcgatttaagcgtgaaagattcgtggggcgtggcgggtcaggtcgggctggattatcagatcaaccgcgactggatgctcaacgcgtcattgtggtacatggacatcgataccgaagtgaaattcaaagcggcgggcgaacagcagaatatcaatacccgcatcgatccgtgg

SEQ ID NO: 43382 - DNA, 192 bp, Glycine max
  Peptide Sequence Number=SeqID_160160
atgacagaaagttatgggattccgggtgccagcctgtctgcagaacatgtacaatcgccggctggtcaccatcgtgctgatggcgttgctgacctcgtttattaccgtgattgttggccacgccctgacgccgggcgaggatcagttatccctgctcagccagaccgacagcagcgcctcatcgctgtttga

SEQ ID NO: 43383 - DNA, 291 bp, Glycine max
  Peptide Sequence Number=SeqID_160161
atgagggttattatggagatggacgggagtggtatcgatggcgcctcacatattgggaggcgaaatgagttcctcgaaggtttgtgtggcttcgaggaggtggcgactgccaatgcggatcttgatcaattcagggtagagcttggtgttcaggaggtgcgtgaccatgttggtgatcttggagacgagataagggtcgagggagtagtgggaggtgagggttttggcggagaggggcttcgctggaacagatgtgttctactgagggtgtggaaggcggagacagagtag

SEQ ID NO: 43384 - DNA, 295 bp, Glycine max
  Peptide Sequence Number=SeqID_160162
atggcccttgcaaaagaacttatgggtttttcctcatttgtttctgcttcctacaaagtgtttctgcacaacaagcatggcaccttctggttcaatactatcttgcttccttcggataacacaagagttgtgaggttgaggaagggagcaaagtttccgatggcagctattagtgaggatttgataaagaccacactgacagtgcatgcagagaaaccacatttggatgccatcaatgataggataggaacaagaaacattgtgctggagcttatgagcaccgagattgatccaa

SEQ ID NO: 43385 - DNA, 273 bp, Glycine max
  Peptide Sequence Number=SeqID_160163
atgagccaaaagagtgacgatgtgaaactgtttggtcattgccatgtcatctgccatctacggtccatgatcccacgaccttttccatcccgagaaatggttttgaaaaaccgcaaaataatcattatgtcgccctcgaaaacaagcgaagtattaaatatgtgtgaatggataagagatggaattgatgctcacgacttggccacaggaagagaatctggttccgagcacgtcaataatcaagaattctttcgttactcaaaccaacattaa

SEQ ID NO: 43386 - DNA, 189 bp, Glycine max
  Peptide Sequence Number=SeqID_160164
atggatacctcagagccctacactggggcaatgagagacaccgtgcatgagcctcaagcgaacctaagggcagatcagaagttctcactcagggaaactgtcaggaagccacattataaacgaaacctcaaagagagttgggctttgtcctcaaaaggaaacaacgccagaaaatctagccttccatag

SEQ ID NO: 43387 - DNA, 1699 bp, Glycine max
  Peptide Sequence Number=SeqID_160165
atgcagcaggcgctgcgtgacaccggcgtgcgcgtcacctccggcatgaccggcccgtatggccgcctcaaccattttggtcatccggatgcggcggtacgtcgctactacattgactggtttaaaacctttgccgacatcaccgcggaactgggcggcgtcgcggtgggctcgcagtttgccatcttcacccagcgggattttaacgatgtggcgcggcgtgaagcgctgattgccatcgccattgactgctgggcggaagtggcggaacacgccaaagcggccggtctgcgttacctgttctgggaaccgatgagcgtcgggcgcgaatttggcgaaaccattcccgcctgtatggcactgcagcagcggctgagcgcggcacagtttgccctgccgatgtggatgatggcggatatcgatcatggcgatgtcacctctgccgatccgcgtgactacgacccttacgcctgggctgaagcggtgccgcgcttttcgcaaatcatccatataaagcagagcatgatggataaaggcgggcacaggccctttacattgcagtacaatgccggcggtcgcattcagccgcagccgctgcttgaggcgctggcgcgcggcggcgcgcaggataacgagatttgcctcgaactaagcttcaaagagcgcgaacccaccgacagcaatgtggtggcggagattgccgaaagcgtggcgttctgggccgaccatattgataccggggtgcaggatttgcatctcgccacccctcaaccagacagggacaacccgatgaaatccgcaccgacttccgctgaacgcgatgactctctggccctgcgggcggcctggctgcactatgttggcggcctgacgcaggctgaagtagccaaacggctcggcctgccgtcggtgaaaacccatcggctgattgcgcgcatggtggccgaaggcgcggtgaaagtcaccatcgacggcgcgattgtcgcctgcgtgacgctggaagagcagttgcgcagccgctacggcctgaacttttgtcaggtggcacccgatctcggtgaagaaggcctgccggtgcgcgcgctgggcatggccggtgccgactatttgcgtaatctgctggcctccacgccggcaatcacgctgggtctcggccatggccggacgctgtcggcagcgattcaccagctggcacgtatcgacgcgccgcacctgcgctttgtctccctgctcggctgtctgacgcgcaactacgcgctcaatccgcatgacgtgatgcatcgcatcgccgaaaaaaccggtgcgcaggcctacatgatgccggtaccgttttttgccaacaccgaagaggatcgcgatgtgctgctggcgcagcgtggtgtcagcgaagtatttagcatggccgcgcacagtgaagtgaagctggtgggcattggcaccgtggaaccagccgcccagctggtggaagccgggatgatcgatgcagccgagatccgcgccctgtcggaagccggtgcggtgggcgaactgctggggcactttttcgctgccgacgggcagatgattcacaactcgctgacggcacgcacgctgtcggtgccgctggatctggcgcagcgcgcagagatcgtggcgctgaccggcggaccgagcaaagtggcggcgatccgcgcggtgctggccagcggactcgtcaccg

SEQ ID NO: 43388 - DNA, 360 bp, Glycine max
  Peptide Sequence Number=SeqID_160166
atggccatgcatcgtaacacggattatgtgttacacctaccatactcgagtccacttagtgctagcagacaaaccggatgtagtacctattactatagaccacatgttaacttgctatatcccatgtgggtttacatccgcgcagagctcagttattttgaggactttcacgtgtatcttgaactggaaaagcctcaccatgatttggaattcctaagaactgcattggagtatgatggatggggcaatgttcatagatataacatggagttagtatgcccaattaaagttatagaggatcaaggagaccatttggacatgtcgtctgaggagatcgaggactaccgagaacttctgtag

SEQ ID NO: 43389 - DNA, 234 bp, Glycine max
  Peptide Sequence Number=SeqID_160167
atgtcggatacaatgtccaggacatcctgcccgaaaatactggagttgctgcacaatgcacaatgcaggatccacgatgtcggatacaatgtccaggacatcctgcccgaaaatactggagttgctgcacaatgcacaatgcaggatccacgatgtcggatacaatgtccaggacatcctgcccgaaaatactggacacataaatctgttatatctttaacagattattatgca

SEQ ID NO: 43390 - DNA, 309 bp, Glycine max
  Peptide Sequence Number=SeqID_160168
atgccagatgaaagtgaacccaccaacgagaacctgatgaagaactctcatagggatcctcctacactcaaagatgctaacccacaagcgaagattcatcctgatgctgaccatccaaacctgaaaatgttggtgaaacgatatgtacatttatctcatgcattatcacatcttgggcctacatcgccattaagcccaactgacgataatggtctaacgcaaatattgccactaagcctcccaggccttaatggtgttacacaacatatggatgataattgggaggacatgtctcatgccagcacatga

SEQ ID NO: 43391 - DNA, 375 bp, Glycine max
  Peptide Sequence Number=SeqID_160169
atggcaaggattcctgacaagattaattctattgatgggtcaaaagaggcgcttaaacttgttgtgagaatcacggatctttggttcgttgggactcccaacaagtctaagcaagcgaaaatggttattgttgattttgagggtgatcaaattcatgttgtttgtaaagcagaccagctaaagtgttggaaagctaatttgaaggaaaattccacttatgttatgcataatttcaaagtggtgaagaatgatggtcaatttagagtgtgtgaacacgagtacaagttagtttttattggagtgactgttgttaaagaagctgatttgcatcagctgccttttaaggaatttagatttgttgaatttggaaatgtc

SEQ ID NO: 43392 - DNA, 333 bp, Glycine max
  Peptide Sequence Number=SeqID_160170
atgcaatcacagggactgggactacctcctcagcctgaggttggtccttttgctgctcgtgtcagcacaaaggaaagttatgtagatcccttggagcaagacccagacactggtgactcagagaaatgtgggttgcatgctgatgagaatcatccccgactgattgcctttgaaagagtttataatgggttgacgaccgtccacaacgttcctttgagcaatgataaagtgaaggttagtgttaaggaagttcgagatgttgaagctcgcgttcctgtacccagtcaagaggtttggataattagggagttgagggatcctcgaaacctgtag

SEQ ID NO: 43393 - DNA, 186 bp, Glycine max
  Peptide Sequence Number=SeqID_160171
atggaattcggcatgcacgaaagggagcgtgaagctatacgatattgcttccaaatcgagtccaaatacatggccaccaagaacttatacccagcaccatgcaaccgtcagcataggaagaacgcggtttcaagaatcgctatggttgtgttgtcatgccttagcttgtacaaactggttctttaa

SEQ ID NO: 43394 - DNA, 276 bp, Glycine max
  Peptide Sequence Number=SeqID_160172
atgaagatggaagccctcagcagctctaaaactcaaccgaaagcaaaaggaaaaagtggaattgaagaagacaccaaaatgaagaagaaagaatggaaacagaggaaacaaattgaaacgctggagaagaagccacgtgcatcaccaacagaatggccaaagctaaacactcaacgtgacataaaacgttacacaaaaccaagcataaaggatcctgacctcattatcccacaatatacatcattatcaattggcgaaagtgccaaacatgcatga

SEQ ID NO: 43395 - DNA, 528 bp, Glycine max
  Peptide Sequence Number=SeqID_160173
atgatccaaaagctcttcaaactattggagattctctgtaacttcaattcaagcaagttgacgttgtccaatagatcaaagatttctataagatctccagaatcaagtgacaaggagattcatgcatgcgaaacaaatccaaaaagaaacgcaaacaagatacatagagagtcgaaagatccccgaaacccaaattcacgcagtgtgccttgcatgcccatcaaggctaatttgaagtggccgaaagaggcatggattctgggtcaagatgtttcttccgggttcactcctagcatcaggaagaagcccaggttttttgttcaacaggaagaagcacaggcatggagcaaacttaatttgctgcaggatcatcaaccattaggcgccaaaaaaggacagtctttgagggtggcactcctttcacttttgaaatacaggttgcacagttcaaccagtttaaggcacgcatcggaaagttcttcaggcaagaagggagaaactccttcagataacactttcataggctag

SEQ ID NO: 43396 - DNA, 801 bp, Glycine max
  Peptide Sequence Number=SeqID_160174
atggttgcctttgcttcttccacgtccactacggaccacatcaaggccgccatcgcagaactcaccttcgatcaaaccatgtccaccaaactggacgaatttcttcagaggttgacccttcttgaaatctactatcagttttcctatgtgtttcactcccagcctccttcaaccccttcatttgagaaaaccgtcgtcggcatagttcctcagtcgagtaccgaagacggagccacagagttcgaaccgagctttgtttgcttagacaaaaaggtaccaagcttcatggaagagttgctgaacttgatttctagtcaagggacggttgtggaaaatcaaaccatggagtcggaagttcatggtgaagatggttccaaatttgcactgggaagcaatgagaaatcagtgtttggacgaggttgcgaattcagcaactacaatggcacattgtctcgtcaccaagtgtcccatgtgccatcctccatcttcaaccagttcgggcacgcttgtgccgttgtttcccttgacaacctcttaagtgttgttgttcattatggttatgcagcggctttgcatgacatgcttttggaccatagagatatgacactgtttgagaggggagttgagtcttatgggtctgccatggtcgcaagcaagcgccgactagctgtttttgtgctatggactgctgctaaaccaagtgagttgcgccgggacaaaccttgggatcctggaggatctgggcgaactcgtaacaccttgaggacaaggtgtttttggaagatccaaggaatgttatga

SEQ ID NO: 43397 - DNA, 1536 bp, Glycine max
  Peptide Sequence Number=SeqID_160175
atggcaaacagcaaatatgagtatgtcaagtgttttgaagttgaggatgaggccatgtttcccaatatcatccttgtttggatcaaggctagtaaactccataaacctcatgattcaaataccttgaaattgatgaactcttgtgctgttgaagttcttgaagagtatgcagatgtagtctttgcatatgggttcagtgatgagtatacttttgttttcaagaagacctccaagttccacgaaaggcgtgcaagcaaagtgctatccatcattacttcttttttctcatctgtctttgtgagaaaatgggatgaattctttccacacaaggaactacaatgtcatccttccctacatgggcgggtcatagcttgtgcgtccataaaagctctccaagcttatcttttgtggcggcagactatttgtcatttgagtaatcaacatgagcaatgcctttggcgtcttgttgaacgtggaatgaatgagaaggaagcatgggatttcatcaagggttttgaaaaaagtgatctaaacaatcttttatttgacgagttcaacgtcaattacaatacactagagccgatactccgccaagggtcttgtgttctgaagacaacgggtgaggatactgtgaagtacacagataatggtgctccaattaaaaggcacagaaggaagatagtcacggtgcattccaagaaaatagctagcaagagattttggaatgagcatactgttcttttgaaggaccttggtggttttgttgaagaaattaacaatgtgactccagagtatgtgaggtcctttgaatttgatagcaaattgatgccatgtacatggattgtagttcgaatagatgggtgccacttccacagattttctgagatacatgaatttgtgaagccaaatgatgatagagctcttaacttgatgaatttgtgtgcagtcgctgtcttagaaaagttttgggaggatatagtctttgcctatggggttagtgacgagtatagctttattcttaagaaaaccactaatctttatcaaaggagagctaatacaataatttcagctattgtgtctttcttcacatccacttatgtgatgagatggaaagatttcttcccacaaagtgagttaaagtaccctccttcctttgatggacgagctgtgtgctatccatctaccgagattctacgggactacctttcatggagacaagtggattgtcacatcaacaatcaatataactcttgtttctggaagttagttgcatctggaaaaagcaaaagggaagcccagaacagtttaaaaggtggtcagttgcaaaagaaaattgaggaattggctattgactacaataaattaccagtcatgtaccgacaaggatcctcaatttatagggacaaggtagacaatgttctaattcatcaggagaatggagagtctcctgaaaattatggaaaggttattgtaggacattttgacatcattggaccaaccttttggttggaacacccaaacatccttgatgaatag

SEQ ID NO: 43398 - DNA, 960 bp, Glycine max
  Peptide Sequence Number=SeqID_160176
atggagctttctgagacagacgaggaaaacattacagctgctgcaaagtttggctggtacaacctgcttattgatcgcatgattcaaggatcggagtcttcaagaatgtcaatggcaaaagctatagttaatttagagttgaaggatttgaacttgaaactccttggcgagcagggaattacccttcctttgctagaaatgctatctggcagcatcgaatctaaagaactgtcattgtcagccctggttaaactagcaagattacatgccaataaggggattattcattattgcaacatctggaggatgaagtcattcattaccattaaatgttgtgaaatccttgagaagcttgctacagatgatgatagaattgatttttttgttgatggagaagggaaacaacttgagttagataacatcataaccaatttgctagctgtaatgcagagtccgaactcagctcactaccgaaagcctgcattacgtggtcttcttggcctttgcaagtttgagactggtttagttaagaaggcagttctagcagccaatggggtatctctaatcctggcccttcttgacgattctgacccagaaatcaaggaaactgccataaatcttctctttcttttctcccaacatgaaccagaaggagtagttgagtacctcttcaggccaagaagactagaagctttagttgggtttcttcagaatgaagacaatgatgatgcaagagcagcagcattcattggtgatctttctatgagtactccaaagctcacagttgtttccaaatcaacgggttgcactcgttggtggtgttttagaccattaaaagttcctttatgttcagcacatgagagtgtatgcactgtgagttccacattgtctgttggaagcaaatgctttgcccggcttgataaggctgttacatggggaggttcatgcaagtgctcatga

SEQ ID NO: 43399 - DNA, 915 bp, Glycine max
  Peptide Sequence Number=SeqID_160177
gttgtgaaaacagctaatgcagcaatcgatgttgttattgataaagaaagcttcaaggtcctttcaaaacaactgcttgatattgcaccagtcctaaaggaattgcagcttcaggacttgaatgagtctgaagctgaaagggaaccgtggccgcttctacctgctggtgaggtgcagatacatagtcaagttgaacaggtcacaagggacataggaaggtctctggctgtgctatctgtcgcaaacactgaagtcctatcaagaatttctgatcaggttaacaggttacagaatgaaatgcaaacggtagagtttgaggcttcacaatctcagcttcaaattattgacaagttgaaccatggaattagggagaaaaaactcgatcaggcttttgcaaatgacatgcttgaggaaatagcaagggcagttgggatgccgagcagatcattgagctactatcttgagctgatgctgcaagggattatgaagaagttaagaaacaatactttaaaagggttcagcctttgcaccggtactaaatgtgagagatccgccattgaagcttggtttgatgatggaaacgggactgacccagaaacaaaagaggttcttgaagatactaccttgagatcaaatgttcaattaggagagtccatagaagagtggagagaagttaattactgctttggaataaggtctatcagagaaagcctattatccaattctgaattactagtgcaagaatctcagagccaaattcaggatctcttaagagagaattccattaacaaggattggatttctataggagagcttaccgatattattatctctatccttggggaatctaattccagagatgtaaagatgaagatcttgatcacgtttaaggatgctgtagaggggcatgcatga

SEQ ID NO: 43400 - DNA, 1378 bp, Glycine max
  Peptide Sequence Number=SeqID_160178
atggctgtaggctcaagaagaagcccaactaagaccctgggacaaatcaaaatcgcatcgcaaactcgaaaatccctacagacagagagaaagatgcagaagagagagcagggcaagtccggcggatccgccggaggaggggcgacgccacctgcgaagagaggccgtcccttcggcagcggtaacaacagttcctctgccgctgcttcagccgcggattcggcggctccgtcaaccctccttggtccttcccttcacgttcacaactccttcgccgatcagaacaacaaaagaattgtcttggctcttcaaagtggtctgaagaatgagctaacatgggctttgaatacacttacgctgctctcctttaaagaaaaggatgacatgcgcaaggatgcgactccccttgcgaaaattcccggcttgcttgatgcgctcctacaagttatagatgattggcgtgatatagcactcccgaaggaatttgccaagacaacgaggatcaggactttaggtgcaaattctgttgtaagtggatttgggagtgaatatcaggcgctgggctcaactggtactccccaccgccctggtgtaggatctggctctgctggtatagaatcaacgcaacagaatggcatggcaaaatctcgtttttctgagttgtggcttgatgaagatagtttatttaatttagatgatgaagggcgagcagaaaagcagcaatgtgctgttgctgcttcaaatatcatcaggaacttctctttcatgccagataatgaagttataatggcccaacatcgccattgtttggaaacagccttccaatgcatagaagatcatcttgtagttggtgttacttacagagaaaaacgtgcagttcaggccatcatggggatgttggaatctgcagtcaaagcatggcattgtgctgctgctgaattacttgggcgtttgatcattaatcctgacaatgaacctttcttgcttccattttttccacagatacacaaacgcttaattgatctcatcagcatgccagctctagatgctcaggcagctgctataggtgcactctataaccttgctgaagttaatatggactgcagattgaagattgctaacgagagatgggctattgatcggttgcttaaagtgataaagatgccacatccagttccagaagtttgccggaaatctgccatgatattggagagtcttgtgtctgagccgcaaaacagaagtttgctgctagcatatgagaatgcttttgcagagatagttttcactgatggaagatattccgatacatttgcgaggatattgtatgaactaacatctagaccaagtaacaaagtggcagcggctcgtggcatatggg

SEQ ID NO: 43401 - DNA, 759 bp, Glycine max
  Peptide Sequence Number=SeqID_160179
atgactccaccaatcggtgtgatcaacgtgtttttggttcccgatgacttcaaagttgattcctccactggggatgatgatcatggaatgtgggaggtgatcaacaacctcaacggaagaggacccaagcagaaaatgaggaatggacgggggaggtttgccatagactgtttgataagcacagagatattgttcgaatattcgattaaggacttccgtttgcccgtcaattttaggatgataagcagtgctcatgcaaagctaggtgcccttgagtttgaaaagttcacaccaaaatttgctaatgaaaaatggggtcacaataaaaaactaagctataggcattccgtgatgtttgcaaaccagctcaaggaaagtttaagcaaccttaaaagtggtaaaatggaatggaagaccatcaacatggccggccttataaaagtgtctggtaatgaagtcgagaaagagaacctcccacacagcaactggaactgtgcattgatgcacaaaatccctgacattgttagaaacaaaccaaggtttggcaacacccatgtgtcccgcgataggtctttgatggaattcctacaacaaagtggtcctgaaatgtggtgtatgatcaatccatatgcggcccttgaagatgacaagcctttgatgaactcggtaatcccgataatcggtgggttagggattgatattttgaagtggaattcctcactagagcacaagcttcattgtagttcatccaaaaagtga

SEQ ID NO: 43402 - DNA, 399 bp, Glycine max
  Peptide Sequence Number=SeqID_160180
atggggggggatgagattagaaagaagttgaacatcgaagaagatggatgcggcatagtatctaaccatgcacttcacttgttggcccgatacgtccaatggaggtttgggagggtggtggttgatggtaccctatatgcagagagcctcataaatggggtgatcagacagggcttaaagttgatttgtggtgtcaagggttttgggtcgggatcatccgtggatactttctccagagtaaagggctcatcatcgatgattaataggaagaagcaggtgatgcaatcctacccttcaagggcattggatagaagattccaagtagattggaccagagatgcaagagaagaccctaggattctcatgagccttagggcagatttcgggctcatgggctaa

SEQ ID NO: 43403 - DNA, 249 bp, Glycine max
  Peptide Sequence Number=SeqID_160181
atggccctcatgaatgaggttcttgagacacagatcaatgtcttcaatgacaaaactaactttttggcacataataccaacaacagaccagttattgaaccacaaagaggtctcccccgagcctatatgatgcaatcctaccctgcaagggcattggataaaagactccaagtagattgggccagagatccaagggaaagccctagggttctcatgagccttagggtagattttgagcccatgagttaa

SEQ ID NO: 43404 - DNA, 612 bp, Glycine max
  Peptide Sequence Number=SeqID_160182
atgacctggactgggcataaaagcgtatttgataatgttgatgttggtgatatttacaggggtctgagatgggttagattctttggcacaggaaccaaggcctctaaagcggccgctatagtggcggggcagagcggagcagcacccattcgcgacggacacgtgtgtagcggcgcgattttgggtcgcggctggagcagccgttatcgcggcggagcgtggcagagcggtgcgggttgcggagctgtttttcgccccgctacttcgaagcactggagggaggatgagggatttcattctgatagtggttttcgcaagatggtgactgaaggaggaggaggaggccatacacatggtcgaaaggagaggggcgaagagaccttggtggaggccgggaagacatacctgtcggtgacaatggaagctgtgtgggtgccgtttataggtgtgaataatggagggggtggtgtaggcaaggaatgtgtcaaaagaaaagttatgcaagccttgtctcaaaatcccaattgctctggtttggctgccaaggatgctatggaagctgtatgggatgtttgttacaatgatacacagccctttgacagagctccttag

SEQ ID NO: 43405 - DNA, 177 bp, Glycine max
  Peptide Sequence Number=SeqID_160183
atgaggatttatcttttatcttgttctagagtcagagaatatggattgggtcaacaaaaggtcttaggggatcacaaaggttggaaggtaacatctcctgatgatcatgggaggattttctctcaaggaaatgttgacaatattggtgaagaaaggtctaaagttaaggaggggtaa

SEQ ID NO: 43406 - DNA, 429 bp, Glycine max
  Peptide Sequence Number=SeqID_160184
atggagagggaaatgatcacattgatagtagacactttacttgtgttctactatgagaagatggtgggatacatgccttcgagttttgcagatctggtgtttgcaggcgagaggatcgaggtaggcctaagaaggggcaagtttgattacgctgcttcaacaagttccagcaataggaggcctggggcaggtggagcaaagaaaaaggaaggagacgcctacaccgtgaccacaggtacatctacttgggttgttgtgactgagaacaagagagggtacatctcttgtggatcagttcaagtggagggtacatctacttggttgttcacagagaacaaggaagggtacatcccttgtggatctttgcttgtaaaggattttacaaggttgaaaagaaatctcaaggactgtaggtcgctaggggactag

SEQ ID NO: 43407 - DNA, 486 bp, Glycine max
  Peptide Sequence Number=SeqID_160185
atgtcgtacgccgacctgctaccatccttactcaataaccaaatggtcgtagtgagcccgggaaaggtctatcaacctctatttccccgatggtacaatcctaatgccacatgcgccaatcatggtgacgtcctagggcactccgtcgagcaatttatagcttttaagcacaaagtacaaagtttgattgatgcgggatggcttacatttcaagaggatagtcccaatgtaaggactaatccacttgcaaatcatggaagctcgtcggtgaacatggtgggagaaggaaaatctcaggagttgaaacagataagggatgtgttaactccaaaacgattcatattggaggtgttgcgtgaggtcggtgtgattgaatgtgatgataataaaggagatccgtgcttgatgcattcatgggtgttgcacgatgcaaaaaggtgcccaatagctgaggagttgctgcagggactgataagtaggggttaa

SEQ ID NO: 43408 - DNA, 471 bp, Glycine max
  Peptide Sequence Number=SeqID_160186
atgggcactagatcagtgctcatgtggcgcatctttatctcagataccatccaccagtttgtaggtattgcacctctgagacacccagagaagtccaacagggcattaggatttttggcattgatcacaggcatagcagtcggggcaagaccagtagcaatcggtcgtaggcgcaccaccatctctagagtccatctcagctcacatgtagtcaatcataggggccagatgcaattgaatgacagcttctatcagtatacactgcaccaacattgtcaggaccttaacccttacctatggcctactcccgagcagttcagagccacttttgcatggcctggggataagcccaattttcaggtggaggcaggtcctacggaagctcaaggagctgcccaagtggacgaaggtggagcagaggatgatggggacatggcagatttgcttgatttcttcattggaggagactga

SEQ ID NO: 43409 - DNA, 168 bp, Glycine max
  Peptide Sequence Number=SeqID_160187
atgcatgcggcagtattttatcatctaagtgtttttgcaaagggaaaaatgaatgaagaggcattttgggttatggtcaatgtcacaccaacttgggcattagatgacatggcgaagtctcggctacaaccgcacgtccgactaaagacgttaaagaagcgctcctag

SEQ ID NO: 43410 - DNA, 303 bp, Glycine max
  Peptide Sequence Number=SeqID_160188
aataatggcaacgatggtgacaatgacgatggaggcaccaaaatgatggtagtagaagcggctaaatggtggcgcgacggtgctgatagtgatagtgacgataacaatattgggattatagtagtggtgacgacgatagtgatagggtggattggtggaatagtggtagcgacacacaacaatgatgatggtggtagcggcgacaacaatgtggtggtggtggtggagacgacaaccgtaagatgtggtggtggtggtgattgtgataaaatagtggaggtggaggcaatagcaatagtgtag

SEQ ID NO: 43411 - DNA, 231 bp, Glycine max
  Peptide Sequence Number=SeqID_160189
atggctgaaacagggcagtacaggtcacggattggcttaaacaaagacgagtttgctggaaaatggccggaaagcaccggccctggtgccatcatggcagaacggcatggcagattttttgccaactgccacagtcaatttgtgaagcgaggcctaccatggcagcgccctaaggtgcaatggaatttttatatggtggaatttcagccttccaccatgttccgctattga

SEQ ID NO: 43412 - DNA, 318 bp, Glycine max
  Peptide Sequence Number=SeqID_160190
atggggtcgttttcaaacaatttatccaagggggctcttttggacgtaaaatgcatgcatgcagcacccaaattgccagtaccattggcaagtttggtctccgtgaaggaatcgctcctagcaatggcgatatgcacttgcaagttgaacaaatcgccagtgagactagcgatatacgtgccagtggaaccgccagtcaaactggcgagttctaggtgctgtttcgtaggcttgctttttcaggctttttcaggtggcaggttgcttttttctgataataggccaaaaggcaagttgcaactgccattgacgagttaa

SEQ ID NO: 43413 - DNA, 492 bp, Glycine max
  Peptide Sequence Number=SeqID_160191
atggtgataggtcctttaataatgagtattatctcctctaataatgaggtcatcacattgtttttcggccatctcagatggggtcccttgacagtcattcaccgaccggagagggttgtacgacagtttagatacatccagactattccaccacatcctgttgcgccttcgatttcttttgaagaaatgaatgatagatggatgcaattacatggattgttctacatgatttggcacccattcatgagttcggcacagtcaggggattctcctagagttctgtcggttcagcaatatgacacatttgttgaaccaaatgtgcatcagcaaccggtggcggcagcgacacctgatgaggcagacattgatgtgcatcatcttggacatgcaatggatgcttttgaggtaattgctgataagttggagaggctactgaacctgaggatcttgaccaaaggaatttgttggatcaagtggcctcgaaataattaa

SEQ ID NO: 43414 - DNA, 576 bp, Glycine max
  Peptide Sequence Number=SeqID_160192
atgcctcattcttgccttgaacaaacatattcccaagtgtatatggatggaacatgtctttggttgagtattagtgaaaatcaaacatgggaagaatgtttggtgtcatttgacttgagcaatgaggtatttcatatatcaattctgggggaacttggtgttaaagcatcatggactaaatttttcattgttgggcctttaccttgtgttgaccttcctatcggagtggaatctaagattgatatacatcctatcagggtggggatgaagggcaatatattcttcaaaagaaaagatgatgaactaatcttatttgataaatctcctgtggcaaagattgtcaagattgattcaaagtgttttgatgataacaaagatgatgacaaaaaacctaagaaaatgacttcaagattgagtcaagaacaattcaagaatcaagtttcaagtttcaagtttcaagaatcaagaatcaagaataatcaagatcaagattcaagactcaagattcaagaatcaagaaaagactcaatcaagataagtactaaaaagtttgtcaaaacattgagtagcacatga

SEQ ID NO: 43415 - DNA, 480 bp, Glycine max
  Peptide Sequence Number=SeqID_160193
atgtcttgggtaaagttcttgcatacgtgtgggttgccacatacacacttgcttttatttttacatccatcaagcaaatacacaactctcgatgatatagacaaaatcatcttaactgaaataccatgtgaacaacatcataaagagttgcacaatttagtagagtctcatacgattcatggccattggggtttagcaaatagatcatcaccctttatgaaagatggaagatgctctaggagaagagacactggcaacactattataaagaatggtgcaactgatgacaattggagtgttgccccttacaatgtgatgttgctattgaagtaccaagcgcacatcaacatagaatggtgtaatcaaattacttccatcaaatacttattcaaatgcatcaacaaaggatatgaccgtattacaattgtaattgttgcaaatgaagatcaaggaggcgtagttgatgagattaaactataa

SEQ ID NO: 43416 - DNA, 264 bp, Glycine max
  Peptide Sequence Number=SeqID_160194
atggggctcgaacccgcagggtccgcccagattttgacgaggaaaacccgagttgattggggtcggggtcgggttcggattttcctcgataaccaaagtcagaattttataagtgtgtcaaggacggggcggggtggggaaaacccgaccccgtcgggggtggggatggggggtaaatctacacccctgttgggtttcgggggtggggtaagcaaaactcgaccccgacccgccctgttgctatgcctaattggctacaagtaa

SEQ ID NO: 43417 - DNA, 453 bp, Glycine max
  Peptide Sequence Number=SeqID_160195
atgtgtcacctccttggttttggttgggattcaaacaaaccgcattcgcactgtgcatccctttcttccttcctcgtcttattctccaaccctctccaaaacctccttctcactcttcttctttctgctactctccctctaaacaacgtcgtttctcgtcgtacagccatgtcatacgactacctcttcaagtacatcatcatcggcgacacaggtgtagggaaatcgtgcctgctcctgcaattcaccgataagaggttccaaccggttcatgatctcaccattggtgtcgagttcggcgctcgcatggtctccatcgattctcgacccattaagcttcagatatgggataccctaacggaggttggtcgggtttgtaaggatataactcatatctcacaaggacatgagtttgaattccgacatcgatgtgaggagttcgatggtggataa

SEQ ID NO: 43418 - DNA, 969 bp, Glycine max
  Peptide Sequence Number=SeqID_160196
atggaggaagaagatgcacgcatgcaaagaagaagaagcaccgacacgaagaagaagacctatgaagcacgaacaagaagtaggaagccgaagaggaagtggaagattaaaacagcacagggtgaagggcattttagccctttcatccgagttgtgggtgtcccagcaaaaactctgggtgcccacagcaactcccaaaacctaaaaacaaagcccgttaataaggcccaaaagcccagaacgatgatcgtggctgcaacaatagaagctgtttctctcttttcttctctctatccttattcttcgaccttcgttagatcctcagtttccaatcgaccttcaatttccttgatgaatgcttcagactcagagaaagaagacacagaaattgaagtaatagcaattacacccaatgaagaaaactcgaaattgatgaagaaagagaagaaaaagaagaagaaagtttcgttgaaagatgcagagaagaagggcggcgtgtgttatatgagtcgaatcccccctcatatggaccacgtcaagcttcgccacattctctctcagttcggcgatattcaaagaatttttctcgctcctcaagattcttctgtccaagtgcctgctaagaggtcacgtggatcccgagaccaagcatattcagaaggatgggtcgaattcggtaataaaagtgttgctaagagggttgccaatatgttaaatggtgaacaaatagggggtaagaagaggtcatcattctactatgacctttggaatattaagtacttaagtaagttcaagtgggatgatctgactgaagaactagccttaaagaaagctattcgggagcaaaagctggctgtagaactttctgctgccaagagagagagggatttctatctttccaaagttgatcaatcacgtgctttgagtgctatagaggagcgactaaagaagagctgttctgagtggtga

SEQ ID NO: 43419 - DNA, 519 bp, Glycine max
  Peptide Sequence Number=SeqID_160197
atgcaattgaaaaatgatgatgatgatgttaacacaatgttaatgtgtaatgatcaatactcgtgtgttggcccgattgagttattatacaccattggtagaacaccggatggtatattaagcttacttcaagtcactatgacccttactcatgatgtcctgctatattacaatgggaggtggaacatgtcacgccaacacgaatttgtgggttactcgttcataggaaaacatccaaaaagatttgacattccttcgagatgtaccatcgatggactgaaggatgtgatcaatcaagttgcacctcaagggattcccccttatgatattcatgaatcacaaacggtaacgcgattgttttttgaacaatcaggtcattctgagtatttagacaaagttatcaaatttgaaattattgagctgaaagctgacgatgacgtgctaaaggtcttagtacagtataactattggaaacaatttgggccaatagaaattttagctgtttttagtaaccagtaa

SEQ ID NO: 43420 - DNA, 318 bp, Glycine max
  Peptide Sequence Number=SeqID_160198
atggcttcaagattgattccaagatttgatcgaagtgaggcctatgggagaataaccacaatgcaaccaggtggactttccagaaggcagtactcaagaaataccaaccagaaactttgtctccaagattcagaaactgaggagaacatagaagcagagatgaaatttgagaaaaaattcaagaaccaacggagtggaaggctgatagaactgaaccagaacagaggaaaaaacatttttattcgagttaaatgctacaggacaatggttacacacactgatgaattcgaggtctcatcaccctcctactatctctag

SEQ ID NO: 43421 - DNA, 210 bp, Glycine max
  Peptide Sequence Number=SeqID_160199
atgaagacaggcaaatatgaacgtttgaaggtgaaaaacaataaccaatttggagaaaaaacaaacttaggaggagttgatgatatttggggggctgctgtggtggtgagatttggcttgattaccatgcttcaatcagttagaacaccagagggacttcatttcagcagccacaagccaattcaccttgaggacaaggtgaaactttag

SEQ ID NO: 43422 - DNA, 869 bp, Glycine max
  Peptide Sequence Number=SeqID_160200
catacgggaatttgagtggatacactgttaagagccatcatgcatgccctatctatgaagaagacacaagctatgtacaagtgaaacatggaagaaaaacaatatacactcgacatcgacgttttcggaaaccttatcacctttactggcgattgaaaaaagcttttaatggaagtcaagagcatgaaaatgcgtcaatactattaactggtcaacagattcttgagcgggttgaggatatgaatactatatttggaaagacccaaaagaagctgacaagtaaaacttgcatatggaagaagaggtcgatattgtttgatcttgcatactggttcgatctagatgttacacattgtatcgatgttacgcatatggagaaaaatgtgtgtgatagtgtcatcgacacgcttcttaacattcaagacaagacaaatgatggtttgaatacttgtcaagatctagctgagatggatatacatgaacaattacatccaatgtctcatgggttgggttggaaccgggtcaggacgacccgacccaacttgcatttaggcatcagggttgaaacaatccaagatgacctaaatcccaaaacgacacgagacttgggtaaccaccacggagggtggtgcgccttcccccagcgccactggccggtgatgctagaccgccataggggcggtggcgatgtgacgacaacagagtggatgtacccggttgagcgatacatgaagatcttaaaagggtataaaaagaatctacatcgtcctgaagcatccattgttgaaaggtacattgtagaagaagttattgaattttgttcagagtacattgaaaaggcaaaaccaattggacttcctgagtcttag

SEQ ID NO: 43423 - DNA, 492 bp, Glycine max
  Peptide Sequence Number=SeqID_160201
atgaatccagatgaagtgaggatgtgggtatatgaggagacattacgaagtggtgagcagctcacagatgtcatcaatcgaaccaatgaaaatgtcaaatatcttcctggaatcaagcttggcaaaaatgttgttgcagatccagaccttgaaagtgcagtgaaggattccaacatgttagtgtttgtgactccacatcaatttatggaaggaatatgcaaaaggcttgttgggaaaataagggaagattctgaggctatttcccttgttaaagggatggagatagctgtggagaagtttagtgaagcaactgttggatacaggctcaatagagaagttgctgagagatgggttcagttgttttatactcactatttcattgtgacagctgttcaggatgttgaaggagttgaactgtgtggaactttgaaaaatgttgtggccatagcagcaggttttgtcgatggcctggagatgggaaataatacaaaa

SEQ ID NO: 43424 - DNA, 270 bp, Glycine max
  Peptide Sequence Number=SeqID_160202
atggaaggagctaagcctgagggtgttggaggcaatgagcttagcagcaacactgccccagttgccacttccaataacagtgactttggatctgtgtgtggcatcattgacaacactgttcaagaagttgttcggtgccacagtagtttctccctcttgtggaagaacaacttgtttggcttccaaggctggagccatgaagaaacaacagaaagagaagtgagcaatgcaatgcaaagcaataatttgagcagtgaaaaagaagaatag

SEQ ID NO: 43425 - DNA, 264 bp, Glycine max
  Peptide Sequence Number=SeqID_160203
atggctcgcaccaaaaaatttggagagatgacgtttgaggcgttacgcgaaattgcagataggattccagatacagtcctagatgtagtgcctgatgcaatctctcccagggactcgtactgcctcctaaggctgaggtcggtccttctgcttcttgtgtcagcacaaagggaagttgtgttgatccctcgggacaaaaagggggctgagggaccagcgaaactggtggatatgctggaactagatgacaatcttctatactag

SEQ ID NO: 43426 - DNA, 282 bp, Glycine max
  Peptide Sequence Number=SeqID_160204
atggctgacggcggagtcttccggaagttccggaaggaccttttccggaaagtttccggaagaagtgttcttccggaagtaaccaaacgtcttccggaagaacacttcttccggaagactcccggaaaaggttcttccgggaactttccggaagaagtggttcatccggaagaatttcggaagacgccctcttccggaagaactttcaaatttccggaagaccttttcggaagaatcacttcttccggaatgtttccggaagaaccacttcttccggaagtg

SEQ ID NO: 43427 - DNA, 387 bp, Glycine max
  Peptide Sequence Number=SeqID_160205
atgcgaggtgagccaaactcagccatgatattgaatacaaaaagatgcagagaagaagacagagtcacaaaaaaagatgcaacaaaatacctgggtacagtggcgagttgtcacagtggctatagtgcaaagggagatatagtcgcgaagatgaagcttagacgaaaaagaagagagcttgagaaaaataggactcatgacatgaccaagagcaagggcaaggatccacttgaaggacttggaggacctatgacaagggctagagcaaggaaagccaaggaagctcttcaacaagtgctgtccatactgtttgaatacaagcccaagtttcaaggagaaaagtccaaggttgtgagttgtatcatggcccaaatggaggaggactaa

SEQ ID NO: 43428 - DNA, 600 bp, Glycine max
  Peptide Sequence Number=SeqID_160206
ggcgcagaagacgacattagtctctgcgtgctatcaagcttttcgtcttacagacagcaaaaagtttatacggataaccactcgggtatttccgcccgtcagcgtgactcaaaagtcagtatgacagatcttgtgagcgcggaagatgacggcgcagaagacgacattagtctttgcgtgttatcaggcttttcatcttacagacagcaaaaagtttatacggataaccacttgggtatttccgcccgtcagcgggactcaaaagtcagtatgacagatcttgtgagcgcggaagatgatgtcgcagaagacgaagttagtctctacgtgctatcaggcttttcgtcttacagacagcaaaaagtttatacggataaccactcgggtatttccgcccgtcagcgtgactcaaaagtcagtatgacagatcttgtgagcgcggaagatgacggcgcagaagaggacattagtctttgcgtgttatcaggcttttcgtcttacagacagcaaaaagtttatacggataaccactcgggtatttccgcccgtcagcgtgactcaaaagtcagtatgacagatcttgtgagcgcggaagatgac

SEQ ID NO: 43429 - DNA, 1287 bp, Glycine max
  Peptide Sequence Number=SeqID_160207
atgccgacattacctccttttatttcacccatttccccgacgaagctaatgaagagttgctatggaggcacttcaaaaagtggggtgacgtacatgaagtatacatcgctaaaaggctcaacaaggatggcaggagatacaggttcatgcggttcaagggagtctcggatgcaaaaggattggaggttcgacagaccagttcggaatacagagttgcagaaaaagaaccccattgggaggaagtacaccgacgaagcaagtaagccctgcggggtaactattggtgctcttcggagatcatatgtggacgtggtgactaaaggggggtgccaaggagacaaaaggacagacgaggcacaaacaccaactattctgatcaacccagatgaaggcggggaatattggtgtaacgaaacctgggtgggcatgctaaagaaggtgatggaggtggaaaccttagaggatcgtatcacttgggagttaggatataacgtccgcactaagttcctcggagacgacatggttcttctccctgggatgtccgatgacaaagctaaactcctcattcaatcagagacggaaagcgatgattctctcttttactcactggagaagtggacgccgaaatgtagacccaataacagggttgtttggctccagctgtggggattttcgatacaggtgtgggaaatgaaaaatctcaggagggctgtagctgctattggggatgtcatcgagtcagacgatgacacagaggaccgccgacgattggaccgggctcgagtattggtgcggacaccgcttccgccgttgataaggtcagaggtcatcgtccgtgtgggggagcttgagtatcgggtatggattgtggaagagacagggttcgaaggtgggtcgaaccggaaaggaagctcgtcgtccgatgggtggtcggagatgataacatcggacgacggtggggaggttggcgatgttcttgacgacactaataccaatttctccttctcgtcggagctgcccaaccagaaattgtctccgtctcgtacccaacgggcagaaggagggaccgatgtgcgctgctgtgatcttagacccctaggtaatatccaggcagacgttacacccaaagaaaagtcaaaaggcactgtagaaggtatgctaggctctagctttggtaagctcaacctagcggacaacttcgcaggaacagaagaggaagctgctaacaccaaagaggtaacctgctatataccctacaggatgatcaaaggcacaggaatcacatag

SEQ ID NO: 43430 - DNA, 888 bp, Glycine max
  Peptide Sequence Number=SeqID_160208
atgatggcaattcctagtgactatgtagtatacctacaagaatcatactataacattggagccaaaaatgatcctgaaacattttcacatgccataagttctaaggaattgaatttgtgggacaatgccatgaaagatgaaatggattctatggcatgtaacaaagtttgggatatcattgagttgcatgatgctataaaatccattagatgtagatgggtctttaaaacaaagaaaaactcacaaggcaaaattgagagacataaggcaagacttgttgccaaagggttcactcaaagagaaggaattgacttaaaagatgttttttctcctatgcataagaaagactctattcaagtaattatggcattaatagctcaatttgactttgagttacatcaaatggatgtgaaaacaaaattcctcaatggtgatctggaagaagaggtttacatgaaacaacctgaaggattcttctccaataatggtgaacacttagtctgcaagcttaataaatacatatatggattgaaacaagcctcctaccaatggtatttaaaatttcatgaggttatttcttcgtttggttatgaagagaatgtcatgaataattgtatataccaaaagggtatgctatatgaggtgaaacaatttctctcaaaaaactttgatatgaaggatatgggtaatccaagtggtgaccactggagagctacaaagaaggtagtgagatatcttcaaggaacaaaggactacagtttaatgtacaaccgaactgatgatttcgtggtgattggttactttgagtcagattatgctagttgtattgataccaagatatccacttctggctatgtttttttgctagttagtggagttgtatcttaa

SEQ ID NO: 43431 - DNA, 636 bp, Glycine max
  Peptide Sequence Number=SeqID_160209
atggacatgaacctggggtacctcatctcccaccagatctctctaattgcacagcatgacacatctagacttggattccctgccttgatcacagctctatgcaaggcaagaggagtccagtcagactctagatccctggagaacttaagtcctactattaacttggcttatattaagaagaactgttggaatcttgatgatccaacagtggcatttagaggaccaaggaaggccaggggtaagagatcaaaggcccctactactttagcaccagagacaccagctccttcttcttccacaactccattacctctcactcagactccagtggcctggccaggagcccagtcttctccttctggagggggtggggcctccgcagcccaggagcctgcttttgaggagccagcagtagcagcagcagagggggaggatgagctcaccccttctgagcccttttatttcgatgtagatgcacacatggctcaggaggagggtacctccacagatcagatacctgagccatcctctgcacctcctcctgaggagacccagccatctacaccagtcacggagccaaagcaacctatccaggattcattagtagctccagcactggatcttaatgaagactag

SEQ ID NO: 43432 - DNA, 288 bp, Glycine max
  Peptide Sequence Number=SeqID_160210
atgccttttaaaggcttgaagagtgcgagaaaacgggctgtgttttctggaaaacgcgatgaacttgctaagcgagcatgttgcactaagcgagttcatcaatactcattccgcgcgctatgccaagcattcctgagccaagcgcatttggttgcggcatccgctgagctaagcgagcttcactcgctaagctcccaacacttagtgaaatttttgctcattttggtgccgctaagtgcaaacttcaaggagcttagcgcaaatccttgcggcacatgttcagcttag

SEQ ID NO: 43433 - DNA, 2023 bp, Glycine max
  Peptide Sequence Number=SeqID_160211
catgctgaccggcagcggctatcgtcacatcagctatctgttcttcaattcgtggaaatacaccacgctgccgggcggtatcgtcaacggcatcaccggcgcgtcgaatcaggtggcggacggtatcgcttttgacgaaggttatgcggtcacacggaaggatgacgactggcgctgggcggaaggctggctgccgcactcggcctggcgcaaaacgggcgcggcggtcggtggaccggttaatgaaaaaggtcagaatcagatgcggatacggctcagcaacgatgatggaattcagactcccggcattggcgtgttccctggcgtgaagacattacgacaggttgatcctggcgccggcgtggcgcggaagagggcaggcgacgggctgtaccaggctgagggtattcacgatgagcatttgctgaaagccatcgctgatgtcccgcgtgaacgctttatcgacgaggcttttgaacataaagcctgggagaacgtggcgctgccgattggcaacggccagaccatttctcagccttatatggtggcgcgcatgacggcgctgctggagctgaacccgacttcgcgcgtgctggaaattggcaccggctcgggttatcagaccgccattctcgcgcatctggttaaccacgtttactcggttgaacgcatcaaagggctgcagtggcaggcgaaacgccgcctgaagcagctcgatctgcataacatttccacacgccacggcgacggctggcagggctgggccgcgcgggggccgtttgatgccattattgtgactgccgcaccgccagaaattccgactgcgctgatagcgcaactgggagaaggcggcaaaatggtgctgccggtgggtgaggaccagcaggtacttaagcgcctgcgtcgtcagggtggtgaaatcattgaagaaacgattgagccggtgcgctttgtgccgctgacagtgaatcatgcggtcaacgtcgacacacagttttatccaggattgccatcacgggggatcaatgagcacgggaagcacagctgtagctctggcgacaacacacaagcccccatcagccagattggcagcaacagcggcgacagcggtatggctgctgctcccaccactggcggcggcatgatcgccgcgcagaacagcaccgtgccggcgatgccgcgtggtggaatgttaagcggtggtacaccatcagccgcgtctgcgggtggaatggttagtggcaataataatgtgaccaccgaaaatggtcgtattgtgtacaatcgcaattatgggaatattcctaaaggcagctacggcggtgaaacctacaccgttaagcgaggcgatacgctgttctatattgcctggattaccggcaatgatttccgcgatctggcacagcgcaataatatcgcggcgccctatagcctgagcgccgggcagacgttgcaggtgggtaacggtaacggtcagaccatcaccggtggtaacgcgataaccgcagcggatgccacgcagggcggcgttccggtggcatcgaatcaaacgcaaattaaatccacccctgttgcacagcaacctgttattacgtattctgatgattcgggttcgacaggcgggaaaatgctgccgtcgaaaggggcaaataatgtggcaacgaccacagctccggttaccgcaccgcccacagttagcagcacaactaatagcacaacaccagtgggaagctggcgttggccaactgatgggaagatcatcgataacttctccgctgcggaaggcggaaacaaagggatcgatatcgccgggtcgcgtggacaacctgtcgtcgccactgcatcaggaagagtggtatacgcaggcaacgcgctacgcgggtacggtaatttaatcatcatcaaacacaacgatgattacctgagtgcctacgcccacaacgataccatgctggtccgggaacaacaggaagttaaggcggggcaaaaaatcgctaccatgggtagcaccggaaccagttca

SEQ ID NO: 43434 - DNA, 318 bp, Glycine max
  Peptide Sequence Number=SeqID_160212
gcggttgataccctgtggcagcaggcagagcgaccgcaggcgctggtggcgatcaacgatcgcgtggcgatgggcgcgatccgcgcgctacgcgatcgcggcattgacgtgcctgagcaggtagcggtcatcagctgcgagcgcttccccggcagcgagtattttatcccgcgcctgaccagtgtcgatcaccagaatccgctgctggggcaaaacattatcagcatgatgatggcgcagctggacggcagcttaagcccgcacgcgcgctgcagcgcaccgctaaagccggtattgatccccggcgaatccgcctga

SEQ ID NO: 43435 - DNA, 481 bp, Glycine max
  Peptide Sequence Number=SeqID_160213
atgatgacctacatccaccagcaacccgaggtgctgagccatctgctggcgtgctatccgcagggattaccggtgctgggcaaggcaaaaacagtgctgattctggccaccggctccagcatcaacgccgcgcttagcgccaaatattacgttgagcaactgaccggcgtacgcatcagcgtgcaggagccgttccattttcagcactacgagcagtgggatccggcgaccgatctggtgatcgcgatttcacaaagcggcgagagcacttcgacgctggcagcgatcgacgcgctgaaaaaacagcacggcgtggcaacctggggcatcaccagcaaaatcaccagtccgctggcgcaggcggtggatcacgccgtagacatcatgaacggcgaggagcgcgtcggttatgtcaccaaaggctatgtcgccacgatcctgacgctgatgctgattggcgtgcacagcgcgcgccacagcg

SEQ ID NO: 43436 - DNA, 492 bp, Glycine max
  Peptide Sequence Number=SeqID_160214
atgccgatctccccctgcggaagtatcagttggtctgtgccgtcccgacatagggatcgcacccacaagacacccagtggacccagaaaagtccagcagggccctggggtttccagctctggttacgggcctctatcagtcctacagggtgcccgtaccccccccccgggcaagggatcgcgcctgcaagacacccagtggacccgaagaagttcaacagggtcttggagttgtcaagctctaattacgggtctctgtcagttctacggagtacttgccacctccagcaagggcatcaggccccctactaatcgagctttcatcaagaagtactgcgtctccaggcaggcgcagggcgaaacaccacagcagcctggggatggccggcagcgggcaacagacgcaccgccatcacctctagagttcacctctgctcatccacaaaaaggtttgagtattgcctacaccacatggccggctgtcataccctaa

SEQ ID NO: 43437 - DNA, 273 bp, Glycine max
  Peptide Sequence Number=SeqID_160215
atgccgcaacacaatgcgtctcataaccactacatgcaagtaaaaggggtatctttaggcttttcatctctggtaatcgattacacagccttggtaatcgattaccagaggccaaactcgaatcacacagcttcaggacatgaaaacctgaaaaaggcactactggtaatcgattaccagaggcctccacaatctgctgccttcatttctaagcctggtaatcgattacacccccttggtaatcgattaccagaagccctcatagcttcctga

SEQ ID NO: 43438 - DNA, 303 bp, Glycine max
  Peptide Sequence Number=SeqID_160216
atggccaacaatataatcagcaccagggatagtggagaactcaccctggcaatcagttcaataaagaccagggtggaccatctaccagaccgactgttaagcagctttggagccaacatagagaggaatcctaaggaggagtgcaaggctgttatgactagaagcaaaatggtgaacatgaataaaggtgagaagaggataggtgaagaaaaacaacagctggtgactaaaccaaaaattgacccagtgttggaacctttgagtgagactaaggaagaagtggaagtaaaagatgatcagtag

SEQ ID NO: 43439 - DNA, 402 bp, Glycine max
  Peptide Sequence Number=SeqID_160217
atgagaacaaaaacgacgaagctaatggacggagccactggtggcaccgccgcgattcttggaggtcgtcatcatcgtcttgaactcctcgaagttgacgcagccatcagtgtcggaagaatgagtcaatctacacagcagtgcctctatgatttcgccaaaatggctctcatcaacatcttcgctcacccctacgccatggtctgtcgtagctttttcccatttaattcacttattcctttccccattcttattctcactctcattcattcaaggtgtgcggcttgtactgtggagatgtcgacgctgataaatgggtcgacgctcaaattggccactacattggaattggtactcccttcttcttcttcttcttcttcttctacctttcattctcattag

SEQ ID NO: 43440 - DNA, 765 bp, Glycine max
  Peptide Sequence Number=SeqID_160218
atggccctgaggaaacttgcctcaaagagatccaggaaggataaggcggctgaaggaactagttccgctcccgagtatgacagtcaccgctttaggagcattgaacaccaacaacgcttcgaggccatcaagggatggtcatttctccgggagcgacgcgtccagctcagggacgatgagtataccgatttccaggaggagatagtttgccggcggtgggcatcactggttaccccccatggccaagttcgatccagacatagtcctcgaattttatgccaatgcttggcctacagaggagggcgtgcgagatatgaggtcttggatgctatcggccagctcctgggatatcctttagtgctggaagagggtcaggagtgcgagtatggccagaggaggaaccggtccgatgggttcgacgaggaggccatcgcccagttgctatgtataccagggcaggattttgcccggactgctgccgggagacgggtgcggatcatgcgcaccaacatgaccaccctgactcagatctggatgactttgctgctcagcaacatccagcccagcgaccataattccgacctcctcctgccgaagtgtcagctggtgtacgccatcctgacgcggatgagcattcacgtggctcagctaatcgctgatgccatctatatatttgcaggtatggcgcctaccaggcaccctctggacccggataagtccaacagggccctgggatttcccaccttgatcacaggactctgctag

SEQ ID NO: 43441 - DNA, 614 bp, Glycine max
  Peptide Sequence Number=SeqID_160219
tcgttgtcgcaagtaccgccactgaggtggacccgactcacccatttggctcaatcaacaagaattccttcccaccatatggcttgcctcccaactatataccacccaatgttgcacacgttcccgaggagaaagtcgatatcttagctcccatacccattgagagccaacaaccccaatctgttggtggtgtacccttgccaaacactttggggggggctcagtttcacccacaaccacaacccttgcattttgcagtgggaagagtccctcctattatggtggaaaggggaaaatttgaacatataaaagaaaggctaagggccattaaaggaggcggagattatgctttcgctgacatggcagagttgtgcctagtacctgatgtcgttatccctttgaagtacaaggggactacttgtcccaagaatcacttgaagatctcaagtagcacccctaatgatggagagggagatgatagcaatgatagtggacatgttaccggtgttctactatgcatagatggtgggattgaagtgggtctgagaagaggaaaatttgattatcctacttcgatgaacaggaagcctcgggcaaatggagagaataagtag

SEQ ID NO: 43442 - DNA, 213 bp, Glycine max
  Peptide Sequence Number=SeqID_160220
atggagaattgccgaacaacactacgcaataactttgcggggctccagacacgttggtcgaggatgcatgaacagcgccaggcaatgacattcaaggggctccgtaaaaaggtggagaatggagaattggcgaacagcgcgctaggcaatgatattcatggggctccgaaaaaagcggagaatggagaattggcgaacagcgctacgcaataa

SEQ ID NO: 43443 - DNA, 441 bp, Glycine max
  Peptide Sequence Number=SeqID_160221
atgaaggctgatatggaggccatgaaggaacagatgacgacaatgatggaagcaatgatgaacatgaggaagatgatggaggataacactgctatagttgttgatgcgagtacttctattgagatggacctgattcacccgactggttttaatcaagtgaatcatccagtctcagatgtagtaggtcaaggagatgaggtaacaaaaaatgcatacgggcctcatcatgttcaggttcagagcaagcattccttcccaccatataggttgcctcctaattatacatcgcccactgtgttccccaagaccgatcacaccctggctgggttcggggtttatccaggatataccactgaagggcaggcattttctggcattcctgtgctgaacgctcccggaatatctcaatatcgcccttatcacaacccttgcattttgtaa

SEQ ID NO: 43444 - DNA, 322 bp, Glycine max
  Peptide Sequence Number=SeqID_160222
atgcttgaaagttttcaacaacaagatcaaatgtcagttctggaattgcacatagaaaaggatgtggccggtggttttatgtttcgttcggcaaattctcttacatcatgtgaaaataatttatctaagaatgaggcgcaaccgccaagaaatgtgagcaatttacatgatgatgaagatgatgatgatgatgattatcttgtgtctaactcatacgtggaagagtctttagaagaagatgatagtattgacggtatatctgatacagacgatgaagtcaccgacatgattcaaccagtaagaattgttcacccaacacaag

SEQ ID NO: 43445 - DNA, 255 bp, Glycine max
  Peptide Sequence Number=SeqID_160223
atgagaacttttgatctgcccctatgttcacttgaggctcatgcacgatgcccctcattgccccagtgtaaggctttgaggtaccaattgttatctttcgtcatgaccttgtacctgggaacctattgggtgaaaacttctaatctgcccctaggttcgcttgaggttcgtttgaggtttatgcatggtgcctttcattgccccagtgtagggcttagaggtaccaattgttgtcttgttttcataacctcgtag

SEQ ID NO: 43446 - DNA, 534 bp, Glycine max
  Peptide Sequence Number=SeqID_160224
atggtaggtcaggggggcaaagagtttggaagtacgggcaacccccattttgtgcaagttcaaaacgagcattccttcccaccatacggcctgcctcccaactatgcaccacccaatgctatacatgtgttcgaagagaacgtcgaccactctagtcccataccccttgagagccaacaacctcagtctgggcatgcacatgtcactcaacccatgggggagatgcatgagtattgcccacaaccacaaccctttcattttgcggtgggaagagtccctcctgctatagtggaaagggagaaattggatcatatagaggaaatgctaagggtcattgaaggaggtggaaattatgcctttgccgacatggcgaaactattcctagtgcccgatgtcatcattcctcccaatttcaaggtgtcagactttgacaaatacaaggggactacttgccccaagaatcacctgaagatgtacaacaggaaaatgggggcatactcaaaaaatgaaaaattgttgatgcatttcttctag

SEQ ID NO: 43447 - DNA, 156 bp, Glycine max
  Peptide Sequence Number=SeqID_160225
atagaggaagtaaaagaacatcacatagatgaagaggctctgataccacataatgtggctccatgtagagcttgtagaccttggatcttcttcatcaatggaatcctttgcttctcgaagatcaatggtagtggaataaagaaggaggaaaggtga

SEQ ID NO: 43448 - DNA, 153 bp, Glycine max
  Peptide Sequence Number=SeqID_160226
atggaaggatattcagctgacaaggatagtgttgatgacactgtatacgaaaaatacggcattaacaaggagaaatgggcccaattttgtcaaagccttagagacccttcatgggaggatgtacggaaaaaggcacaggccatccagaagtag

SEQ ID NO: 43449 - DNA, 360 bp, Glycine max
  Peptide Sequence Number=SeqID_160227
atggcatcaagaaaatgggctagagcagatgacatccctccatcatccattccaactcctccattagcaaccataggaccgaatctccaaagctctcaaaccttagtccctatgctacaaagcttattccgaggacagattattatcatgcacagtctgcgagaattggctcaccataggccaattataaccatagagcatttccttgagcgagtagccaggcccggaggtcaacctccattggagggacccaaagaggctgctcctcctaagcccacacctgcacgggttgaactagtgccaggtgatccacaatctccagtggtgaatccaccttcttctcctcatgtcataccctaa

SEQ ID NO: 43450 - DNA, 384 bp, Glycine max
  Peptide Sequence Number=SeqID_160228
atggagttggcatgggacggggcgaaatttgggttaccgaatgtctcaaatggttttttcatcacacatgcagatgtgactgaaaataattttaggtttatgaatgattggagtacaagcattggtttttctccagtgtacagtttccttgagccccagtctatacgctgcacaaaggacacgcgtgaagaatgtcaaaaggcacattggcaacttcttgtgttgtgttcacgagagaacattatagtatggttctgttctgtacgaagaaagcctgatgttcacattaagtttgcagtgaacaatgcaatgaagaaaatatgcagtaatctccaaggcaaggacaatgcacctccacctccacctcaatggattgaggctaag

SEQ ID NO: 43451 - DNA, 564 bp, Glycine max
  Peptide Sequence Number=SeqID_160229
atgcagaggggatcccaaattgaaccagttgatctagaaataggagatcgattagatgatatgattcgtgatcttggacaagagtcttttcagcaagcacatgcccttatgtatgatacattgaaaagtgattcaaagaagcctttgtatcctgggtgcaagaagtcattgacactattgtcaacggtgttaagtctggttaatgtgaaggaaaacacgttgcgaaaatgttactatgaggcgaagaagattctatgtccgatgggtatggagtatcagaaaatttatacatgccctaatgattgcatattgtacagacttgagtatgaagaaatgcataaatgccccaggtttaagcgtctgtttgctaatgtagatgccgcaaaagaccttacatgtcatgcagatgggaaaaacttcgatggaatgcttcgccatctagctgattcctcccaatggaagaatattaatcgtttgtatccggatttcgacaaaaaggcaagaaatcttcaacatggacttgccactaatggaatgaatccctatggtagtttcagcacttag

SEQ ID NO: 43452 - DNA, 611 bp, Glycine max
  Peptide Sequence Number=SeqID_160230
acttccaattagtaccaaccattgaagaatttgaggaaattctaggatgtcctctcggggaaagaaagccatatctttcctccgggtgtctcccctctttgagcagaattgcaactgtggtcatggattcagcaagaggtttggaccgcataaaacagactcggaacggcatagcgggcctaccacagaagtacctagaagacaaggcaaggggtatggccaatcaaggaaactgggtcccgtttatggatgtgttagctttgctaatttttggggtcgtcctctttccaaacgtggatggtttggtagacctagcagcaatcgacgctttccttgcctaccaccatagcaaggaaagtccggtggtagctgtcttggcagatctatttgacacatttgaccgaagaatagattgggaccagcttttggccgggataggaggtagaacaatcagttggttcccccgatggaaggaaggaaaagaaggagtccttttctcatgtggaagatacccaaacattccgctggtaggaacgagggggatccttggtgcaccaaagttcccaagactatacaaagaatcccataaggcatgggaaaacccccgttaa

SEQ ID NO: 43453 - DNA, 5538 bp, Glycine max
  Peptide Sequence Number=SeqID_160231
atggcgtctccgtttcgcaacgacggcgcgtttccttcttctcatctctcacaccttatctccgtcaagcttgatgataaaaatttcaagcagtggaaacaacaaattgacggtgttgttcgtggccacaagcttcaacgcttcgtcacggtttcggtgattcctcatcgttccccttctacttccgatcttaatctcagtgaggtgaacgatgcatatctggattgggaacaacaagatgctctcatctgtacgtggcttctctccacgatctctgattcgctactcccgaagcttgttgactgcacgcacgcgtggcaggtttggactgaagtgcatcgttacttcgccacgctcctcacgacgaaagcacgtcagcttcgctcagaattgcgtcgtctctccaaaggtcctctcacgattgagtcgttcatggagcgtgttcgcgaaatcaatgaatccttgatctcaattggagatcccgttcctcttcgtaacctaattgagatcgtccttgatgcacttcccgaggaatatgatcctatcgttgctactgttaatagtaaggaagatcttagctctttggacgaacttgaatcctatctccttgcacacgaatcgagattggagaagcatcggaaaatgattctcacagaaccagtgtcagtcaatttaacgcaggctcagccgtctgattcgtcttctccgatggaaccgtcgtctcctgctacagagtcgtttcccactggcactagtcatgttactgctcatgctgaaaacaataattataacttcagaggcggtcgttctggccgtggaggtggccgttttggccgtggaggtggccgttttggtaagtctcaatgtcagatctgtcacaaaagtggtcatgacgcctctatttgttattacagatattcgcaatccgcttctatgccgttttcacctcaacgtgctcctttcaatccatttctgatgaatgctcgaccggtgtatgcaccttcttttggctatgcttcacctagaccagctgcacccagaccttctccaccacaagcatttatggccagttctgatccaaccttcagcaaccaatggtggtatccagattcaggtgcgtcgcatcatgttacacctgattcttctaatgtgtctgatgctcactctgtgactggttctgagcaagtgttcatggggaatggccaaggtttgtctatcaactctataggttccatgaattttacttcccctaactttcctcacaaaccactcactctacacagtttactccttgtacctcacatcaccaagaacctcattagtgttagtaaatttgcccaagacaatcaggattcttctgaggtgcttcttcgtggagttgtaggagctgatggtctttacaagtttcagagtccctcgtctcaagtgtccaagttcaagtctctctctagtctcaattctagtgtagccttaggttcaaacaattgtaatcctagtacatcatgtaatactttacttcattctaatgctcaaagtgattgtattactgattgtactccttctgtttcaatgaatacaagcaatgtttcctgtgttaattcacctcttgttcatgctactacatttactaattctcaatctccacaacactctattgttcctaatattatacctaccagcaaatatgctttgtggcatacaaggttaggccatcctcattaccaagctcttgcagaagtgctgaaaacttgcaatattcctataccccccaagtctctagctgaattttgtactgcctgttgtttaggcaaatctcacagactgcctacctctttatccactactgtgtatgctcaaccttttgagttagtagtttgtgacttatggggaccagctcctatccagtctttaggaggttatacctacttcttgacttgtatagatgcctattccagatttgtttgggtcttccctttgagacttaaatctgacacacttactcaatttgtccaattcaaaacaatggttgaacttcaattcaactgtaaaattaaagttgttcaaagtgatggaggaggtgaatttaggcctttcaccaagtatctcaataaccttggcattactcataggtttacatgtccccacacccaccaccaaaatggcatagttgaacgaaagcatcgtcatattgttgaaacaggcctagctttattagctcactctaatttacctctcaaaatgtgggatcatgcttttgtcacagctgcttacctaattaataggatgcctagtatgtctcttgccaaccagtccccttatttcaagctacttcacaaagtacctgactattctcatcttagagtctttggctgcgcttgttttcccttccttcgtccctataatgctcataaattggactttagatcccaagagtgcatattccttggttattctaccattcataagggttataaatgccttgcagctactggccgtatttacatctctagggatgttctttttaatgaaaccagatttccctactccatcttatttccctcttcttcttctgctacatccacatcatctcctcatacttcttctgcctggtctatatcagcagttcctgtatctgctattcctcttactcaagtcagttctgttcctactacacccactacctctgtttctcttagcagccctatgtctgcccctattaacactaatgaggttcctactacacccactgccaattctcctattataacaccttccaatgatgcttcccctgcttctgaaaattcctctttacactctcccatcactccctcttctcccacccctatcacatctgatattgcagaggccaacaccatttctccatcctctattcccgccaccagttctcctctcagccctgtaccaaccccccaacaaccctctatccatcctcataacactcattccatgcaaactcgagccaagagtggcattaccaagcctaaaattcatcccactcttttactcactcatatggagcctacttcagttggtcaggccttgtcttctccccattggtttcaggccatgaaagatgagtatcatgcattgttaaagaatcagacttggaccttagtgtcgccatctgtttctaggaagccaattggctgcaagtgggtttttagggtgaaggagaaccccgatggctccattaacaaatataaggccaagctggtagctaaaggcttccatcagcaagctggcactgattttatagagacattttctcctgtggtgaagcctgttactgtcagaattgtccttactcttgctgttactcacaagtggcctatacagcagattgatgtgaacaatgccttcttaaatggcacccttgaggaggaagtttttatgctgcagcctcctgggtttgaagctgctgacaagacacttgtatgtaagttgaacaaagcaatttatggactaaagcaggcccctagagcctggtttgataaacttaaaggatcccttctgcatcatggttttcttgctagcaaatgtgaccctagtctatttctccttcacactgcaagcttaactataatggtgctcgtatatgttgatgatattatcataactggcaattctgcatcctttattactgctttaatcaagaatctgaatactgatttttccctcaaacagttgggtaagttggattattttcttggcatagaggtaacacacttgcctaatggctccctccttctctctcaaaccaaatatctgacagatttacttgctaaaattaacatgctcaatgctaatggcatgcctactcctatggtgtccacaagcaaattgtctaaaattggttcgccagttgtttcagatcccactcagttcagatctgttgtgggggctcttcaatatgccactctcaccagacctgaaatctcattttctgtcaataagcctgcctcacctcaccagcctttgtctttgcttgggttctgtgatgctgattgggcatcagaccctgatgacagaagtgctgaggctgagtacagaagtatggctcaacttgctgcagaaattctatgggtgcagtctctccttcaagaacttaaatgcagacttctcactcccacaattctctgtgacaaccttagtaccgttacccttgctcataaccctgtgctgcacaataggaccaagcacatggaattggatatattctttgtgagggacaaagtgctctccaagaatctcatagtgaagcatgttccagcccaagatcaatgggcagacttactaactaagcctctctcagcagtgaaatttctccctctgcgtgacaaactgcgtgtgatcaacaaactcagtctgcttgatgcatcctcaggcttccctgacgacaagcttgacgttcacggctcctggatattctgtccttggcaccgctggtatctctatttctatgagaaaatcttggggaagatgatcgatgaccccactttcgctcttccgttttggaactgggaccatcccgccggcatgagaatccctcccattttcacagacaaaagttcgcttctctacgacgaacacaggaataacgatcatgtatatgctttaatcgacctaaactacgataaggactctgataaggactctgtgcaacctcttcaaaacactagatggccgccagtggagaaaaagaagagcttgatcctaaccaacttgaacagagtttatagggcagttgcaagcgaagagtgctctctcccatataccttcctcgggccagcattcgaagttggttgtgcacctcagaaaaactatggaactctggaatctttgcacaatacagtccacagctggaccggtgaattagaaaaacctaaccacgacatggggttgttggctacggctgcaagagatcccattttctttgctcaccaaacgtcgataggatgtggaacatatggaagacagaattgctggatggaagaagatttgatcacaaaagtgacgactggttggaatccagtttcttcttctacgacgagaacaggaactatgggggatctcatcaaaccaaagaaggagagtagtctccttcgttcaaaacgagaagcttcaacattcaagaaattacagctccctcacactctggaatccattgagcgtacaaccgtgaagaggccgaagccgcgatccaggaacgagaatgaagaagaagaagaagaaggcgtaaaagaggtgttagtgatagatgttgaatacgatagcactgatggtgtgaggtttgatgtgttcatcaacgaccaaggcgacaatgagattagacccctggattcagagtttgcgggaagctttgtgactttgcctcactcgccgcatttgaaagacttgggagtaacaaaagacgatgacagtatttctgtcacactggctcccatatatggggacaagcctgttgcaattaagggtgtaaggataaagcgtgtttatcctgaggtggacgatgaataa

SEQ ID NO: 43454 - DNA, 243 bp, Glycine max
  Peptide Sequence Number=SeqID_160232
atgacggttctccttcctccaaccatcgttgtgctcacacccaccacaaaccagggtcgatatctcctcatagcaaatcgttggagccaacaccgtggtttcaaatctggtgcttgtcaacgactctgtggaactcttcatcaccaccaccaacattcatcatcttcgtcagagcaacaacacctccccgcatggctcctggttcaggatggtggcagcgtgaaaaggtcgccaacaccatag

SEQ ID NO: 43455 - DNA, 528 bp, Glycine max
  Peptide Sequence Number=SeqID_160233
atggccaagctatcctccaggtctacacatccgatgcacaatttccatcaagttcatgcctgcaagaatagctccaagatttacacctttggacctacaaaagaagaaaggaaaagtccctccccacagtactctacaaaggatgcggttccaaaatttgttgcattaaagccaagcatagagtttgatcaaaatgatgccatgctctttaactataaatacatgtatgaaatctccaatcacatgtgcatcatgcagattttgcgtccagccaagatatatcgcttcaacaactggtactctaaagatgcaatgagaaaatccattgccatagtctgggcaaggtttccaacacttaaggagcatctattgatgcaagctccattggagcttgtaggcctacgatcttcttcatcaatggattcctttgcttcttggaagataaatggcaacggaatggagaaggaagagagagaggagacgccacttcaaggagaagatgagtctagaagaagctcaccaccatag

SEQ ID NO: 43456 - DNA, 755 bp, Glycine max
  Peptide Sequence Number=SeqID_160234
gggactacacgtcctcgccttcaggggactacacgtcctcccctccaggggactacaggtcctgaccttcagaggactacacgtcctcgcctttagagggctacacgccctgacctttagaggactacacgtcctcgcctttagaggactatacgtcctcaccttcagaggactacacgtcctccccttcaggggactacacgtcctgtccttcaaagggctacatgtcctcgcctttaaagggctacatttcctcacctttagaggactacacgtcctcgcctttaaaggactacacgtcctcaccttcaaaggactacacgacctcgccttcagaggactacaagtcctcacctttagagggctacacgccctcacctttagaggactacatgtcctcgccttcagagaactacacgtccttgccttcaggggactacacgtcctaacctttagaggactacacgtcctcgccttcaaagggctacacaccctgactttcagaggactacacgtccttgccttcaggggactacacgtcctcaccttcaggggactacacgtcctccccttcaggggactacacgtcctgaccttcaaaggactacacgtcctcgcctttaaagggctacacgtcctcgcctttagaggactacacgtcctcgcctttagaggactatacgtcctcaccttcaaaggactacacgtcctccccttcaggggactacacgtcctgtctttcagagggactacat

SEQ ID NO: 43457 - DNA, 192 bp, Glycine max
  Peptide Sequence Number=SeqID_160235
gagaagcgcaatgcagctgctaagaatgatgaacctaaaaaggaaggtgcttcaatgctttggaaagctttccaatttgtattcagggtctacacattcgctggtggcattgatgatcgtgcagacaagctaacaagagaattggctcaggagatagaaagtgacccgaatccgaacctgaaccaactatga

SEQ ID NO: 43458 - DNA, 642 bp, Glycine max
  Peptide Sequence Number=SeqID_160236
atgaacaaatcgctagcaaactttctacaatgtataggattgttgtctcaagtgggcaactcccaaggctcttccttggaagcccttatcgtgctggagatgaacctgaaccttgctggcacttttgagaacgttccacatgctcctgttcactcttggactggtgaaagagagagcctaaccgtgagaacatgggaatcttctattctgctgcgagagaccccattttctattctcacgacgccaacatggataggatgtgaagcatatggaaaacaatatcgggtggaaaaagaagggatttcactgaccctgattgatgttgacattccatggctcaagaataagcctaaacctaaaagatctaaagctaagaaggtggcattattggcacaagattttaactttggattcaaagataacaaggtgataagaccaagcaatactgagtttgcaggaagctttgtgagtgtgtctcattcacacgtgcacaaaaacaagaagatcaaaacatgttttagagtgggattaacggatttgttagaagacttagaagctgaaaatgatgatagcattttgatgacgtcggtacctaaatatgggaaaggacttgtcacaattcagggcataattttaagatag

SEQ ID NO: 43459 - DNA, 2010 bp, Glycine max
  Peptide Sequence Number=SeqID_160237
atggcgaccgtggggttctgcggtttgaagccattgctctttcgtcgcaaagcaaatatttttgaggcaatgaaaggctctacgcctaagaagtcttcatcttcaaaggccaagaacaaagcaaatggagagtcattggagttatcatttgttggagcagaccaattgattctaatggtggagatccataagaagatcttggcattcagagacatcatggacctagctccatgtaacagctctgcttccttacgtgagatggtaatgaaaaccctgcaagatctgcaagggctttaccctgggatcataccaaaaaatgaagtgttaaagattaaggacaagcctatagaccagtctatggcctacttctgcaaggctttgaaatctcttggagagtcatggatgatgaacaatgattggacgaataagctcaatattgtattaccaacatgcaaggataacgggaatatgcgtcaattgggtgagacaatgttgatcactctagattgcttgatgaagttagcaagtgagaggtttgacatagaattgacagaagaagatgaccacaagaaagaattcagcccacgttcaagctcatttgggaaatataatataatgagatcaacctcgttttcagatagcagtttctcttgttgctcttctcctgtcacacctaaatctgttctcccagacttgatgaagtactcagcaagatcaggagacagtccaaggagttcttgtgcctcaccacttcttctttctctcagagttcaagctgttggaaagttgaaccctattgatgtgaagcgcttgtcttttcagatgtcaccaacacaaatccacaagatagaagaggaatcacccaccacagaattggatgacaatgcctcaaaccatggaaaggattcatcagaagagctagtgtttcacttggacacaactgaggagttagaaagcataatcaatgatcatagaacaaacaaacctcaagctattagggaagtgaggctatcattgtctccaggacaatttcaaccaaaatctcctcctaaaccaccacaaacacctcttgagcaaaaagaacaagaacttgtatcttcacctccaattacacaacaagcctctcctacaccatgcataccacaacctcctccacccaccaccttccccaccatccatgttccaacaccacctgagatgcagccaaatgtagcaccaccaccaccaccacctccacctcctcctccaccatcagcactaaaattggagcaaaatgctgcaccaattaggatgcctccacctcctccaccaccaccaccaccagggtctcgaagtttaggttcagcaacaactgctgctgctcctccaccacctccacctcccattcccttgataggtggatcagttccagcacctccaccacccgtaccgggtggtgtaaaaagaggtgcaccaccgccaccacctcctcttggaggagggagatccttgtgcgctagggcaactactaaactgaaaagatcgacacaattaggcaacctgtatcgaactctaaagggaaaagtggaagggtctagtctgactggaaaatcttctgctgcgaaaaaaggtggtattggagcagcaagcactggaggaaaacaaggaatggctgatgctctagcagagatgacaaaaagatcctcttacttccaacaaatagaagaagatgttcaaaagtacacaaagcaaatcttggagctgagatctaccattactaatttcaagacaaaggaaatgacagaattgagcaagttccacagagatgttgaatccgttcttgagaatctaactgatgaatcacaggtgctatcacggtttgaaggattccccacaaagaagttggaagctttaagaatggcagcagcactgtataacaagttggactcaatacttactgagcttcaaaactggaaaatagtgcctccaatgggtcagcaactggaaaagattgagcgttatttcagcaag

SEQ ID NO: 43460 - DNA, 558 bp, Glycine max
  Peptide Sequence Number=SeqID_160238
atgcaacgtttgccagcaaccttgtgccggaaaatcgctcggccggcctgcgatgtcttcataaaccaccgtggaatcgacacgaagaggaacatcgcggagctgttgtacgaccgtctgaggaggatgaaagtgaggtcttttctggacagcatgaacatgaaacctggggataggttgttcgatcatatagacaaggccattctcgggtgcaaagtgggtgtggcggtgttttcgccacgctattgtgactcgtatttttgtctccatgaactcgctttgctcatggagtcaaagaagagggttgtccccatcttctacgacgtgaagccctcgcagctcgtggtcaaggacaacggaacttgcccttctaaagagcttcagaggttcagtttggcactcgaggaagctaaatacactgtcggattaacctttgattctttgaaaggggactggtcagagctgctaagggatgcttcggatgcagtgatcatgaacttgctggaggtagaggaagagcataggcgcatgaagaggaaacttaactgtgaatactga

SEQ ID NO: 43461 - DNA, 447 bp, Glycine max
  Peptide Sequence Number=SeqID_160239
atgactatctaccagccttccagcaaacttttttacatgttccagaagattttactgttatcagatggtagaagcctgtactttgggaagggagaaaatgttatgaattacttctccagcatcggttatgctccatctgtagctacggatccaactgatttcttacttgatcttgcaaatggctttccctggtggcagtctggagctgatcaaatgcatgaccggctagtcttgccaaccctttttgtcaccattacttgttggatgggagggctaaaagtgaatgcttcaattttctttcaaactctagctgttgctcttctctatgctttggtatcacaaggctttggccttgctattggagcattgctgataaataatcaaaaagtggctgttgtaagaaaaaatagagaaaaacacattacagaagagaagagaactaattga

SEQ ID NO: 43462 - DNA, 1086 bp, Glycine max
  Peptide Sequence Number=SeqID_160240
gcctgctctttcattttcttctagacataggcaatattggggtggtgggaggatattgagctctggtgatcataatggtgatcttgtgactaatttgcctggccagcctggggtgaatttccagcactatgctggatatgtcacagtcaatgaaaccaatggaagagcactcttttactggttctatgaggctatcaccaagccagaagagaaaccattggtgctttggcttaatggaggccctgggtgctcttctgtgggatatggagcaacacaggagattggtccatttttagtggacactgatggccaaggcctcaaatttaataacttctcttggaacagagaagccaacatgttattcttggaatctcctgttggagtgggcttttcatactcaaatacaagcagtgactatgaccaattgggagatgaattgacagatctagctctgacaaattcggttgtgctctttctgttatttgtgacagctaatgatgcttactcttttcttcacaattggttccaaaagtttccatcctatagaattaggacattttacatagcaggggagagctatgcaggaaaatatgtaccagagctggctgaactcatccatgataggaacaaggacccctccctctatattgatctcaagggtattctgttgggtaatcctgaaacatctgatgctgaggactggatgggtctggttgattatgcttggagccatgctgtgatatctgatgaaactcatcaaacaatcaaaacaagttgtgactttaacagcactgatccatggcgaaataaagattgtagccaagctgtggatgaagttctcaaacaatacaatgaaattgatatctatagtctctacacctctgtttgctttgccagtacagcaagctcagacgatcaatccatgcaaacttccatgaagcgttcatctaaaatgatgcctaggatgttgggtggctatgatccgtgccttgatggctatgctaaagccttttataataaaccagatgttcagaaggctcttcatgccagcgatggtcacaatctaaagaaatggagcatttgcaa

SEQ ID NO: 43463 - DNA, 3948 bp, Glycine max
  Peptide Sequence Number=SeqID_160241
atgtcagcacgaaggttatcttttgctgattggtataactcaatgaaggatgcgacggcatcatgtgatccttgtagccaacctcaactacagaatagtcccgaggattcttcatcaaaaaatgtttcacctagtgaatctggcattcatgacacttttcagatacaaaatgggtctcaagtgttagaagaaccatatctttctaagttgggctttgcaaattcagtcacgagctgttctccattctgctcagatgtgtcagatttcggggtcagaggttcagttggtgtatctgattctgcagctaattctatgcttgattgtgaacgtgaaaaccagggacctcaatctcgggcttgctcttccccaaatgcttttcctgaaaggacccaagtttctaaacatgagatacctgcatatagtgtagaaacaagtttccctgaggcacagtcaaacaatatatcaatttgtggagataatttgaatctgagtatgtggattggtgaaaatgagagccaattcaagcatgtgagagaggatgttgaatctgaacatgcttcactcagttctattgttgacaatgatgatgtaaatattgaaggttatgttgaagacatcattgcaggagtttctgggcaacaggaaaatgactcgtgtacatcttttgaagcatcatttatggatgctgatagatctttgcatgtcacaacttcaactgattctagtgttggtcaaggttcccatgtttccagtgatttcattgactaccatgtatctccaaactgttaccagggaacacatgatggaccctttgttgctgactcttctcttggttttgtgcctaatgctattaattctcaattgtggccatatgaagaaatgatgaataacattaaggctgaaaatgtggagttaaatgctgatattgcatatatgagtaatggcatgccttcaagcactactgggtggatgccttttcaggatagtcaacttatgttagctgataatggttatccatcatttcattctggtaattttgatgacatgtcatcactgtctctttcagcttgtgcttcatacatgtcatatggagaccattaccagaacaattttcaccgtgatgatgccgagttcaatgtaggccaagaggtgaaacaaacacctggtattttttcttctgaagggtgtcaagcttaccagtgttttcagaatgaggataattatgcagttatatctgggatatccaatcaatatcaagatagcattggcagaactgctagttttcaaggaaactttgacaatttgaatttaaaagctgcagataattcttggctccatccccaagaactaattaccagtgagaagcagtttggttgtgttaagagagaaggagggattcaacataactttattgattctcatctttcaaaaggaagaactgagaatttccatgttgaggaagaccctgatgtttgcattattgaagacatcagtcatcctgctccgacgagtcgacccgcaggcattgggaattcccttaatatatctcaatcttgtagatatgttggaagtacggtcggaagtacaaggatgaaggcatgtgatgaacgaaatatattacgagttgcattgcaggatctatctcagccaaagtctgaagttagtccaccagaaggattgttggcagttcctcttttaagacatcagagaattgctttatcatggatgattcaaaaggaaacatcaagtttaaattgctcaggaggaattcttgcagacgatcagggacttggaaaaacagtatcaactattgcattaatattaaaggaaagacctacattacttaatgggtgcaccactgcccgaaaaagtgaattggaaactctggatgtggatgatgacatgcttcctcagaatggtatagtaaaggaagaatctaatatgtgtgaggataagccaagtggatatccaatgaatttgttgaagcaagcaaagggaaggccatctgctgggacccttattgtttgcccgactagtgtcctgcgtcaatgggctgaggagttgcgtagcaaggtaaatggtcaggcaactctctctgtgctagtataccatggaagcaatcgaacaaaagatccttatgaggtggccaagcatgatgttgtcctaacaacttattccattgtcagcatggaggtccctaagcagcctccagctgacaaagatgacgaggaaaaggaaatttttgaagatcatgctacaccaagtaggaaaagaaaaagcccttctaattctagtaaaagtggcaagaagaaattggatggcacaaatcttgaagctgttgctcggccacttgcaaaggtgtcatggtttagggttgtcctggatgaggcccagagtataaagaatcacaaaactcaagttgcaagggcctgttggggtcttcgtgctaagcgaagatggtgtttgtcagggactcctatccagaatgcaattgatgatctctacagttacttcagatttctaagatatgacccttattctgaccatgcatcattttgtactagaattaagaacccaattagcagaaatccagcaaacgggtatagaaagttgcaagctgtcttgaagacaataatgttacgccgaacgaaaggtacacttcttgacggggaacctattatttccttgccgcctaagtatatagagctgaaaaaagttgatttttcaatggaggaacgtgatttctattccaaactagaggctgattcacgtgcacagtttcaggaatatgctgatgctggaactgtcaagcaaaattatgtcaacattttgctgatgcttctgcgccttagacaagcttgtgatcaccctctgcttgtcaagcgatacaattcaaactctctatggagatcttcggttgagatggcaaagaagcttcctcaggaaaaacaaatctctcttctgaaatgtttagaggtttccttggccctctgtagcatttgtaatgatcctcctgaagatgcagttgtctcagtttgtggccatgttttctgtaaccaatgcatctgtgaacatctttctggtgatgacaatcagtgccctgctgcaaattgcaaaagtcaactgagcacatctatggtattttcaaaagccacactgaacagttgtctttctgaccagggttgtgataattcacccagttgctctggtcctgaagccgaagaagctgaaccttggtccgaaagtaagccatatgattcttcaaaaataaaggctgcacttgaggttttgaagtcattgtgtaagccacagtgctacacatcaaaaagtacttctgagcatagcactttcagggaagataaaaattgccttgggaacccctccattgctaagaatgggaaatccttaaaagattctcctgagagtcaaaatttgtctgatgagaatagaagctctaatgcttcagttactgttgtaggggagaaagctatagtgttttctcagtggacgaggatgctagatttgcttgaagcgtgtctcaagaattcttcaattaattatagaaggcttgatggaacaatgtcagttgttgcaagagataaagctgttaaagattttaacaattgtcccgaggtaactgttataattatgtctttgaaagctgccagtcttggtctcaacttggtagtagcatgccatgttcttatgttagatttatggtggaatcctacaactgaagaccaagcaatagatagagcacatcgaattggccagactcgtcctgtgactgttttgcggttaactgtgagagatacagttgaagatcgtattctagctctgcagcaaaagaagagaatgatggttgcatctgcatttggggaggatggaactggtgatcgtcagactcgcctcactgtggatgatttaaaatatttgttcatgatgtga

SEQ ID NO: 43464 - DNA, 642 bp, Glycine max
  Peptide Sequence Number=SeqID_160242
atgccaaacgagagagaccaagatgtctttttcatcaatgtggatagtgaaaataggagctcccaaatgagtttgacagggcagaaaaaactgaatccaattacacaaaccggttgtctcttgactccatcaatacaaaaaccacagccacaattccacaatcacaaagccagcatcatcttcacagagcaatggaagaagagcaagaaaagctcctcctccactcatacccccactactggggcttcactccagaagaggactactacaaacaacaaggaatcacatccacaacctccttcttcaccaccccacttggcctcaaactcttcacaagatcctggctcccaaaccctagttcaactccaccccgcgccctcatcttcatgctccacggctactcctggaccatttgcgttaccgcgccaaacccaggttggggactgtggtggagcttttgaggtgttgcatgggagtagagagttgtaccgtgaggccaggagtgaggataagacgattagggtttatgaagggatgatgcatttgttgctcttcggggaaaccgatgagaatgttgagattgttcggaacgatatcttggagtggctgctcgctaggtgtacacaaaccagagttgaatag

SEQ ID NO: 43465 - DNA, 269 bp, Glycine max
  Peptide Sequence Number=SeqID_160243
agtggtacctagagatatgttgcggggtcaggagaccttggggacgtcagggtgataaggcactagtaatcgattaccagttgggtgtaatcgattacacaatgttacctgctactgagaggaaatcccttgaaaaagacattctgactatgcgtagccgttatgggacgcattgcattgttacctgtgtagttagatttcttgtgaaagagtctaccctctttcttttatctcttgtagatcacgatggcagcgcagttgatccatga

SEQ ID NO: 43466 - DNA, 1290 bp, Glycine max
  Peptide Sequence Number=SeqID_160244
gtcgactctagaggatcccacttgactggcgcgctggttaacggtaacagcgtgactgctgacatttgtcgcaacctgtctattaccagcctgcaggatagtgataactatgattcgaagcagatcagtgttggtgccggcggcagtttcacttttggctcgatgaccggttccggttatatcaacgccagccaggataaaatgcacagcaattacgacagtgtgctggagcaaagcggcatttatgccggtcagggcgggtttgatattaacgttggcagtcacacccagctcaatggtgcggtgatagccagccaggctgacgcggataaaaaccgtcttgataccggcacgctgggcttcactgacctgcataatcaggcagattataaaacccagcaccaggggattggcctcagttcggcgggcaacttcagcggccagttcaaagggaacatggccgccagtatgctggcgggcgcaggcagcagtggccacgcagagggaaccacgcagtcagccgttgcccagggatcgatagtggtgcgcgaccaggcaaatcagcagcaggatgttgctgcacttagccgcgacaccgagcacgctaatgacagcatcagcccgattttcgacaaagagaaggagcagaaacgcctgcagacggctcagctgatcggtgaaataggcagccaggttgctgatatcgcccggacgcaggggcagattgaggcgacggaagcaggtaagaaggaactggcaaaaaacaacataaaccagccggatgccgacgcgcctgcggctaaaaagaaagcgtatcaggaagcgctggaaaacagcagtgattataagaaggccatggcactctggggcaccggcagcgatatccagaaagggattcaggcggcgactgcggcgattcagggtttggcgggtggcaatctggcgcaggcagccagcggcgcagcggcaccgtatctggccgagcagatacacaaatataccgctgacaatcaggccgcaaaagcgatggctcatgcagtggtaggtgcggtaacatcgtgggcggcaggcaacagcgcggcagcaggcgcgaccggtgcggtcagcggagagctgatgggtcagttgatcatgcattcgatgtatccgggtaaacaggtcagcgacctgcaggagtcggataagcagatcatcagtgcactgagtaccctggctgcaggtctggccggcggcgtgaccggtggcagtagcgccagtgcgctggccggcgctcaggcagggaagaatgcg

SEQ ID NO: 43467 - DNA, 195 bp, Glycine max
  Peptide Sequence Number=SeqID_160245
atgaagctaaaatttactaaagactggattgcatatcttagattgcctcttccaattgatgtttacaaagagattttgaaaccagctttcacaataatagctgatcatgagatgaaatgccttttgttattgattcgtggcacacatagtaccaaggatactttaacagctgttacaggaaatcttttacaataa

SEQ ID NO: 43468 - DNA, 306 bp, Glycine max
  Peptide Sequence Number=SeqID_160246
atgattgaaaaggtctctttatgggctaaagcaatcaccaaggtagtgtggtataggagatttgatgagttcattgtctctcatgggtacattagaagtccctatgactcatgtttttatcatagaaaggtggagaatggttcccacatctatccactactatatatggataacatgctcatagattctcaaattgttttggcaattcaaaagctaaagttattacttagtagtgaatttgagatgaaggacgtgggagctattgaagagattctgggcatggagatcaaaagggattgggtctag

SEQ ID NO: 43469 - DNA, 749 bp, Glycine max
  Peptide Sequence Number=SeqID_160247
atgtatgtgctggatgaaccttctatcggcctgcatcagcgtgacaacgaccgtttgctggaaacattgaaacgcctgcgcgacctcggtaacagcgtgattgtcgtagagcatgaccaggatgcaattttactggccgattttattgtggacattggccctggtgccggtgaacatggcggccagattgtttcttatggtaccgcggccgagattcaggctgacccgaattctttgaccggtcaatatatcagcggcaaaaaacaaattcagttcaagttaccacgtacgcagccagatccggcacgcatgattaaactgaacggcacaacgggtaataacctgaaaaacgtcagtatcgagatcccagtcggtctgcttacctgcgtgacaggcgtttccggcagcggaaaatcgacattaatcaacgatacgctgtatcgtgccgtcgccacacatttgtatggtagcagcactgaagcagcaccgcatgaaagcattgaaggcttagagtttttcgacaaagtagtcgatgtcgaccagagccctatcggccgtacgccacgctctaacccggccacctataccggtttattcacgcctattcgtgacttgtttgccagcgtaccggaaagccgtgcgcgcggttatggtccagggcgttactcattcaacgtcaagggcggccgctgcgaggcttgccaaggcgatggtgtactccgtgttgaaatgcactttttgcctgacgt

SEQ ID NO: 43470 - DNA, 1797 bp, Glycine max
  Peptide Sequence Number=SeqID_160248
atgacaggaaatggaagaagaaccactcgcagcggagagagattgtcttccgaaaggttgaatcgtcacagagaaagaagcaaatacggaagcttcattccgatgttcaacaatggcaatttcaaagttgggttcggtatcgtcttgtttttgagccattattacctcgccaattcagctgcagaagatcgtattcctcgcgttgtgacgccgtttcccgcgccaaagataacggaccttcctcagtttgaaggtgagcacaaagagagtttgtattggggaacttatcgtcctcaggtctatcttggaattcgtgccaggactccaaaatctttgatagctggattaatgtggattgttgtgaaggacggcagatatcacttgcggcatgtttgcaaacatgaggataaccttagtacttatggttggactaagcacaatggacgagattttggacatcaagtgctggttgaccatggcatggccatcaccactgggttcttaaaatcaaaagtggaaggcagtggctatggaggggattgggcagttcgaattaatgtgcaaattgataagtccaagtggaatgtggaatttgggagaggtgcccagctctttttctatttggctgatgaagctggtaatgctctaaacttaagtagaaaaaacttgaacgttcatacggattctttggtggcatctggctctcgagaagacattggagattggcagctacatttaaaatcaatggatgatttggagctgcattattctggatttcacactcctcactttcacaatttgtccaatcttgttgaggaaaatcttgcatcacaaataaggaagcatgctcgattgctgctatctgactcatcagatgattctccaaatgtattagtttttcagattattggtggattttctttcacaacagatgttatatttatctctggaactgattcagaaagttcaatagtggaaaagcgtgccagcagtcttacaggaacctcactgtccaatcagctgaaatacaaagaacaagcatttgatgaaaagtttgagaaaattttcaatttagctgagaaggtggattcagaatccatatctgttggtaaggcagctgttggaaacttgttaggtggcattggctacttctatggtcagtcaaagattgctgtttcaagaatctataatcttagtgagcatgttgattatatatcatattggcctgctgagctttacacagctgtaccatgtcgaccttcctttccaagaggatttttatgggatgaaggttttcatcaactaataatctggcgttgggatatccatatttcattggatatcattggacactggttagatttgatgaatgctgatggatggataccacgtgaacaaattctcggggctgaagcactcagattcttctgcacttgcagtcgggttccagaggaatatgttcctcagcatccaacaaatggaaatcctccgactctgtttttagcattaaatggtataattaatggattgaagaataatgagtttactgcaacggataaaactgagatctctctgttcctggagcgtgcctttgttcgattagaagcatggttccaatggttcaatacaactcagtcagggaaacagatgagcagctactattggcatggacgaaacaatagaactatatatgaattaagtcccaagatagggcagcagattaacttgaccaaaacaaccattggcatgcttcaaaaagaagctaatggtaaggcaaccacaaatgagatttattga

SEQ ID NO: 43471 - DNA, 261 bp, Glycine max
  Peptide Sequence Number=SeqID_160249
atggcggcgctacgtggagtggctctaccaacacaaggagttgggactctacctagacgtgcgattaatgaaagacaaggacaaaggaaaacacgaagggttgtcaatgacatacatgggttttttactaagaagaacaaagagtaccaagagaagctaccccttgttgtgctcaaggtagtggaaattatttactctaaagccaactccgaggctgaatacatgtttcaatatcatcttacaaatatattgatttgttaa

SEQ ID NO: 43472 - DNA, 2343 bp, Glycine max
  Peptide Sequence Number=SeqID_160250
atgaggatatcatctgtggattccaaagagactgatccatccgttttagtgaatgggcattttgatagtccccttggttcccctggtgctggtgactgtggttcatgtgttgcatccatgctggaaattgcaagactagttgtcgactctggttgggctccctaccgcccagttattttcctttttaatggtgctgaggaactttttatgttgggttcacatggattcatgaagatgcacaaatggcatgacactataggagcttttataaatgtggaggcatctgggactggagggcctgatttagtttgccaatctggacccagttcttggccttctaatgtctatgcagaagcagcaatataccctatggctaatagtgcagcccaggatgtttttcctgttattcctggagatacagattaccgaatattttcccaagactatgggaatattcctgggcttgacattatctttctacttggtggttatttttaccatacctcatctgatacagtagagagactattacctggaagcattcaagcacgtggagagaatttgttcagcataatcaagacttttactaattctgctaagctacaaaacacctataaaacaaattccagtgaaattacagctagcacattcaacgatgagcgggctgtattttttgattatttctcatggtttatgatattttatcctagatgggtagctaaaattcttcacagtattcctgtcttcttctttcttgttatgcccttcacgcatggtaggacacattcttggtcagcagcattgtgtgattttataaaaggatttttgttccatgctgttgggattatatttgcagttgttgttcctgttgcattttctatgctgagattactgttctcttctcagacaatgaattggtttgctcatccatacttggctttcgcgatgtttataccttgtgcacttgttggacttttaattccaagaattatctggagacactttcctctttctcaagatatttccattgtcaagatatcaaaagaggcactatctgatgaagcaaggttctggggagcatttgggttctatgccgtattaactttggcttatcttgtagctgggttgagtggaggctttgtgactttttttgtgtgtgcttccctgcttcctgcatggatatctttctgcttgtcagtcaaatactttggacaacggtcactcaggtcaacaatgttttacatactacctctagttccatgccttgcctattctgtttattttggtggcattcttgcccagtttctgatagagaagatgggaatgatgggttctcttccactaccatatgggcactatgttcccgatgttattgtggctgcattaattggaattgtaactggttggtgcacaggccctctaatgcccatatgtgggcattggttagccaggtcatccatcttgcaatttctgctacatcttagtgtgtttgctttggcattatcatctcagttctttccttacactatgtctgcgcctaagaggattgtttttcagcatactttccatactgcaggctcaagtcagattatagaatccacctatgatttttctgtaactgactccaattctttactattccttttcaaacattcacctagtgtggcaaaggaattgaatattacttcagagttttcatttgaatccacatcattgtctaaacgcaatgattggatggcaatttttccagtttcttttctcttctcaaatagtctcaagttccctgcaaaaagggatgatattttgaaacagtatgaattctttcccaaattgtctgttcaaaatccatctttaaatcccgaaaagggacccagaagagttcacttggagctttatttaggttccttggaagaggtttgggttgcggttctcaacatcactggtcctttatcaagttggtcatttgcagataatttgcttccggtggttattggtggtcttatgagaccccctgttattgggtcattattagatcacctacaaatgttcaatcttataaatttcacgcttctaatgtctaatccttggcatgaggaggcctgcatttgcacaggaaccgaaacctatggtggtggtccacaatcatatatatgccgtctcagtggacctagcgatggaaattggaccttctggttagaggctaacagctctgaagcattaagagtggacctagcggttttagaccaaaagttggttgatccagtaaagagattgaagaatctttttccagactgggttgatgttgttgcatattctagttttatgtctagctatatcttctaa

SEQ ID NO: 43473 - DNA, 654 bp, Glycine max
  Peptide Sequence Number=SeqID_160251
atggcggacgccaaactttctcccgctggcgtggactgcctcgaagtcgccttggccaaacttaccctcagtcaactcaacctcgccactgctgtcgacaccttagccaccaccatcgacgaccttcttcagcgactgagccttcgcaatcccactccacatttttcatcttccgtccctgcacaggaattgataccagtcaccatcatatcgactccgttcatgtcgactctgcggctcatgccatctctgccacccatgccaactccattgcccatgccgcctccgccgcccatgccgactccgtcacccatgtcgactttgccgtccatgccacctttgtcgtccatgccgcctccgattcccaggccgactacgcctccatgtcctgcacccgtgcaaccattccttccaccattgtcaggtccgcttcctatgcctgttcttcatctgcccaatctcgatctcattcgtaccgccatttcattcaacaagctcatcggcattgttccgctttatgaccatgtagttgttccgaatgacaagccttggaaaaataaagacatggcgttgtttgagatggggcatgtgtcctatgggactgccatggccgcacaaccatttgcctttgcactatgcacaactgctaaatga

SEQ ID NO: 43474 - DNA, 315 bp, Glycine max
  Peptide Sequence Number=SeqID_160252
atggcaatgatggatgtgcgcgatggcacaatagtggtgcaggggagtcacacgcatgaagcctcagatgttgaggttgtaccgtggtggtgctgtgtgcatctagtgttgtggtcgctaggttcaaatctgggacagagatggtgtattagctatgggtttggtggtggcatggtgatggagatgagcgcagatttgggcaaggtaggggcgtgcaacaatgctagatctggatggagatggaggtgtgcaggagtgctagaagataggggtgggtggcttgatgaaaattttgaggggaagaggagggtgtag

SEQ ID NO: 43475 - DNA, 681 bp, Glycine max
  Peptide Sequence Number=SeqID_160253
atggatttggtgggtgatttgtctgggtggtgggaggagagtggggggttgaaaaatgaacgtgtatttctgaagcaaggaagcaacgaccggtatttggtgggtgaggggaggtggtgtagaaggaggttgtggggttgtaatggctctatgatagaaagcagaagcggactgagtttgaatgaaacgtttaacctgttgggtgagacttcctcaggaagggaaggaacacctgcacccgaggaaaatatccataccactgatgggaagaacatgttagtcgaaagtgaacggttgcttgagccattgaaagccgaggaaaatatccataccactgatgggaagaacatgttagtcgaaagtgaacgggaatttagccacgcgggtttgaatgaagttattggtactgcctccgtcgatcaatactgtgacgcgagactaattgacgtcaccatatatgcggagggattccgatgccgaagtgctggagagtgcgttgaagctaatctgagcatgatcggtgttagaggaggcaatgtcttcaaggctcacttgcttagactgggttttggggggtgtagccatgtaggtgaaatggaagaggaaggaaggggaggggataataatggaggtggggtgggtgtcggtggtggtgggtttactctagcatggaagttctga

SEQ ID NO: 43476 - DNA, 1083 bp, Glycine max
  Peptide Sequence Number=SeqID_160254
atggatagaagtgagatctctctattcctggaacgtgcgtttgttcgattggaagcatggttccattggttcaatacaactcagtcagggaaacagatgggcagctactattggcacggacgggacgataggacaatgcgtgaagtaaatcctaaggatcacataacacagttgcggtgtttatgttggtcaattttgacaaagctttccttacccctaatgatgacccttgctcctaacagacattatctctggcattttcagacactgtcctctggtttggatgattatccacgagcttcacacccaagtgaagatgaacgccacttggatcttagatgttggatgttacttgcagcagactgtatgcattccattcaagagttgttggatatggaaagcaaacctggaatggattatggttctactgtgaaattgctattggattttgagttactgaaccagatgcattttgatgatgcatatggtgcttactttgattttggaaatcatacagagaaggttcaacttaaatggaaagaactggaggatggacaaaattatgctactcgccaacttctccgggatgttatggatatgcctgtattgagattggttcctcacattggttatgttagtttattcccgttcatgggaaggatcattccatctggatcacggattctggaaaagcagcttgaactcatttcaaatcgcagcctcttatggaccaactatggattacgttctcttgccaaaacaagttccttgtacatgaaacacaacacagagcatgaccctccatactggagaggcccagtttggataaacatgaattacagaattctttcagcactccaccattactccaaagagaatgggccatatcaggagaaagctaaagccatctacgaagaattgagaagcaatttaattagaaatatagtgcgcaattatcaacagacgggatttttgtgggaacagtacgaacagacgaagggtaagggaaaaggggctcatccatttactggttggacatcgcttgtagtattaatcatggcagaagcatatggaaatatttag

SEQ ID NO: 43477 - DNA, 794 bp, Glycine max
  Peptide Sequence Number=SeqID_160255
atgaggagaggtggtttggcgggtggtgtgggttgccgtggttggagctgggcctccgtgaggaagaagaagaagaagagtaaaggaagtgtttctatatttctcattgctcttgctttatttataaggtacgaaggtttcgtaattcttcttttgggcttgtttacttcttgcacctctgtttgcacccttgcttctggcttcgtgaatatgttctctgttgttgcctttggttccttatcacttcctaacagtgttaatgggtgttcgattatgtgtttaagaccaaagggttgggagttgggacaatatgctcccttcaacccggctcacgggtgcgtcttcgaagggaggaaggtgcatggagtcgccaccaacgtttattggggaaaaatgtcagaaaaattgaaaagcgtgtgtggtctacgaactttgagtgtgaaagatttgggagttgtatttacgcacggggaaggcaccctcgacattcgaccttatttcttcccgcgcctaaagttaccctctggtgcacctgctccctgtgcacccgacccgcctcttcgggttttcatgtacgatctccctcgccgattcaacgtcggcatgattgaccgccggagcgcggcggagatgcccgtcaccgtcgaggactggccggcgtggccggtgaactgggggctgaagaagcagcacagcgtggagtactggatgatggggtcgctcctcaacgtcggcgggggcagagaagtggttagggtttcggatccggaactcgcccaagcgttcttcgtgcc

SEQ ID NO: 43478 - DNA, 630 bp, Glycine max
  Peptide Sequence Number=SeqID_160256
atggtgaagtactcaagggagcctgacaatccaaccaagtgtagaatcgacacttattctctaaacgacgacgtttataatctctctcaatctgagcatttttttaatcgtctttcatatgcagcttgcaaggctagaggcgccgaccttagggttcattttaagaacactagggaaactgcctttgcaatcaggaagttgcccttggttaaagctaaaaggtacttggaagatgttcttgcgcacaagcaggccattccgttcagacgtttctgtcgtggtgttggaaggacagctcaagcaaagaatagacactctaatggccaaggaaggtggcctgtcaagtcagcaaaattcatccttgatttgctcaaaaatgctgagagcaatgctgaagtgaaaggtttggatgttgatgcgctttacatttctcatatccaagtcaatcaagcacagaagcaaagacgccgaacataccgagcccatggaagaatcaatccttatatgtcatctccgtgccacatagagttgatattatctgaaaaagaagaacctgtgaagaaggagcccgagactaagttagcaacaagcaagaaatcccaagctcttcgaagtggcacttcatcttag

SEQ ID NO: 43479 - DNA, 408 bp, Glycine max
  Peptide Sequence Number=SeqID_160257
atggattggcaagggcaaaagctggcggagcaactgatgcagataatgctgcttgcatttgctgtgattgcatttgtaggtggatatgtcatggcttctttccaaatgatgattctcatatatgctgggggtgtggttttcaccaccttgctcactgtccccaattggccccttttcaatcgccaccctcttacgtggttggatccaagtgaggtggaaaagcatcccaagccactaccatctgccaatgtaactcaaaagaagaaacctgttaagaagaaagaaattgttgaaattgagaaaattggtgcccaaaatgcaattaagtctgttttaagatcggagggtgttcctgattgcgatctttcgcgtgaaaaaacacccattttgatctgtctcgatccttag

SEQ ID NO: 43480 - DNA, 423 bp, Glycine max
  Peptide Sequence Number=SeqID_160258
gtggattccgaagccttatctgttggtaaggctgctgttggaaacttattaggtggaatcggctacttctatggccagtcaaagattgctctttcaagaatccttaatcttagagaacatgtcagttatatgtcgtattggtctgctgagctttacacagctgtaccaagtcgatctttctttccaagaggatttttatgggatgaaggttttcatcaacttataatctggcgttgggatattcatatttcgttggatatcattgggcattggttggatttgatgaatgttgatggatggataccgcgtgaacaaattttgggggctgaagcactgagtcgggtcccagaggaatttgttcctcagcatccaactaatggaaatcctccaactctgtttttagcattgaatggtatatgctaa

SEQ ID NO: 43481 - DNA, 917 bp, Glycine max
  Peptide Sequence Number=SeqID_160259
gctatggtggtgcttcttacttgatgaggcgtgagaaatacctccaagggtcaaccctgtctgaatccttcccagagggatctggaacagctagtgttccgtcgtgtttggaatttgtgctgaggaacataaaagctggtgttgtacagtgtgtggttgtacctgttgatttaatggaattattaaagaaatccaattactggcagaggtctggaggtagagaccatgtatttcccatgacgcaccccaatgccttcaggttcctacgagatcagttgaatgaatcgattcaggttgttgtggatttcggtcgctatcctaggggcatgtctaatttgaacaaagatgtggtgtccccgtatgtgcatgttgtggactcttttacagatgatgagcctcaagatccgtacgagtctcgctccacattgcttttcttccgagggaggacttacaggaaagatgaagggattgtccgtgttaaactagcaaagatattggctggttatgatgatgttcactatgagcgaagtgttgctacagaagagaacataaaagcgtcatctaaagggatgcgttcttcaaagttctgtttgcatccagcaggagacacaccatcatcttgtcggctttttgatgccattgtgagtcattgcattcctgtcattgtgagtgatcaaattgaactcccatttgaggatgagattgactactcccagttctcggttttcttctctttcaaagaggcattacagcctggctacatgatcgatcaacttcgtaaatttccaaaggagaaatggactgaaatgtggaggcaactaaaaagcatctcccatcattatgaattccgatatcctccaaaaagagaagatgctgttgatatgctgtggagacaggtcaagcacaaacttccaggg

SEQ ID NO: 43482 - DNA, 120 bp, Glycine max
  Peptide Sequence Number=SeqID_160260
atgtcgggtgatttagcatacaagagcattctccagagttcagcacttatgaagttaggaaaagtggaaataaacactcaccaaattcatatataccttgggcatgcaacaccccaatga

SEQ ID NO: 43483 - DNA, 213 bp, Glycine max
  Peptide Sequence Number=SeqID_160261
atgacattgaggttgttaatggtggtggttggacttgttaagaacagaattagaagagggacaataataaagaaaagggggagtcctggaaactacgttggaacgatgatggtgatggttgggcttggtgacacggaggtgcagacatggcacacattgacacgacggcttggcagcatggattctgagtttgaagaagggaagggagaataa

SEQ ID NO: 43484 - DNA, 918 bp, Glycine max
  misc_feature (910)..(910): n is a, c, g, or t
  Peptide Sequence Number=SeqID_160262
ttcgcttgggtgacatggatactcaattctctcatgcgcagactcttgtgaggagaaaaagaaatgaaattcatgatttattctttgatgatgggacttggcatattgatccgaatgatcttcatcacgaggctaccaggtattttcattctattttctcgaaagatagttctccttctcattcttcctttgaggttcagaatatcccccaattgaatgaggatgagaatcttgctctttctgctcatgttacgattgatgaagtcagaatagctgtgatgggcataaaatcattcaaggctcctggccttgatgatgccttcctttatggcactgttgatccgggcctccttgaaaccttgcctgttcttattcctaaagtggaaaatccaaatcatttgaaagaatttctctcattagcctttgtaatgtggcctataagtggttcaaatttagctgtattgtggaatggttcgaagcttgataacttttccccagctcgagggagaataatactggctccctatttccctttccagagggggacgggtcctcctttgactcacttgttctttgcaaatgatgttctcctcttctgtaaagcaacgaaagaccaagccagggtagtggattctacccttgctctctttggtgctgcgtctgaccttaaagtcaagcttcaaaagtctaagatgatatgctctagaggtgtgaatgttgatcttagagggagaattgagaatattatgggatatagttgttcaaactctttgggaaaatatcttggtcaacacctcattgaagttgattcatttcaagataaaccttgggttcctgttttgagacacaagtatattgagaatatttgtttggttcgagcccttgagtaccttcgggcagggttcaccgncaagattg

SEQ ID NO: 43485 - DNA, 699 bp, Glycine max
  Peptide Sequence Number=SeqID_160263
atggggtcatggtgtggaagggatcttgtagtggaggaaactaatctacaggaggaggctgatagtggtgacctgatgtggggggttaagaaagagtgcacaagagtcgaggcgatgcaggataaagggaagtttagggataaggagaaaggaaaaggggtgattagggcagtagacctacaaagctttttcactaacatggaaagagggctaaatatgtactatcacagacttatagcaaagaacagggagaatagcaaattgggcttggggagcacatatcctaacaagactgtatggataagaattgaggttgtgaaggtagtgtgtggtgtggaggaaaagaggggcagacgtgggattcatattgaggaaaatgtggaggttagggagttcaattccttcttagattctttgaaatgcattgagctgccactggtagggaagcattttacatggtttagcccatggggagatgctgtgagtaggctagatagatgttttattgggagtgggtggaagaaagtaaaggaggaagtgaagtgcgacattgagatgaaattcaagcaagaagacaaggaggataatgccctgctactagaaacattttcagaagaggagataaacatacagtgtgggattgtgaaggcaataagtgcgtggagcctcatgggtacaatttcaactttattaagttaa

SEQ ID NO: 43486 - DNA, 516 bp, Glycine max
  Peptide Sequence Number=SeqID_160264
gtcctctgggagtgcgagaccctcccggaccaccgccacaccccggaggtcgataagatcctcgccgacaatgacgccgccttcggcggcgacgacgactccgttttcgtccgccgcgaggacgcaacggacgaggaggtgcgggagaacgcggagctcgtggagcggctccgcagcagccccgtggtgcagttcatggcgcgcgccgaggagattctggacaagatgaacgagatggagctgaaggagaacgagaggccgtaccacaaggaggattgggaggtgtggaagaatgtgcccaatgttattgggcttgacgggaggcccatgcccagaaaagcccagaaaacccgcgaggaggctgatgataagttttgggatttcgctaggcagttctttttcgggctgtggaatttcaggcagaggccctaccctcctgggaagcccattgacgcggcccagtctattgggtataagaaccttgagaggcgctactatgactgtgagttgcaatga

SEQ ID NO: 43487 - DNA, 855 bp, Glycine max
  Peptide Sequence Number=SeqID_160265
atgagaagtggtgggtggtactataaggatcggctgggtcgcactcgaggaccgttagaattgattacgcttaaaactgcatggggtgctgggattattgataagaacactttcatttggggtgaggatatggacgaatgggcgcccatccatatgatttatggaatggagcgtgcaatcgccacttgggaagttagacttgctgcttccgcaacagcattgcttcacaaactacagaaaggtataccaccgtgggttcctttgaagggatttgaaaagaagacttataagcaacttcaagaagaggctatagaaagcaagagacgtgatttagcagtattggaagctaatgatggtctttggcctggagctaaaattccaagtcatgccctatttctttgggctagtggctctgaactgaccactatattggaacaggatcacatgcccaacaaatacattcccaaatatcttagaaagaagttggctgaaattattccagggttgaggccatgggaagttctgagcatagaacaagcaatggatcgattaacatttaacggggaatggtaccgtgaaccacttggttcattcaccactggtcccccataccttgagcactggaatagagatgttatgaggttgtataagatatttgatgatcttaacaccgagttgtacgaacatatggagaattcaattgctggctttgataaaattatggagaagatcagggatgattttattgcgagaactgataaaatgttggagaagaaagacaaagagaaaagagaagctcggaagaaagctgggttgcctgagtatcaatggcccgaaaaaccatatgttccttag

SEQ ID NO: 43488 - DNA, 2451 bp, Glycine max
  Peptide Sequence Number=SeqID_160266
atgtccgcccatataggtatccacactatcagaaagccgaaattgagacccaaagcgctcaatgctctaacgatcaaggatcgtttcccgataccgacaattgacgaattgttggacgagttagggggtgcgtcctggttttcaaagctggacttattacaaggatatcaccaaatcctactgttggaggaggatataagcaaaacagcttttcgaacccaccatgggcatttcgaattcacggtgatgccttccgggctttgtaacgccccttcatcctttcaagctacaatgaacaccatctttcgccccttccttcgtcaattcattattgtattttttgatgacatccttatttatagtgctacactggaagatcacgttttccatttagaacaagcttttcaggtgttgttgcaggagcagttcgtcttgaagttagaaaaatgcacatttgcccaacctcaagtcgagtatctaggtcacgtggtgtcttctcgcggagttgagccagtgctagccaaggttcaggctattcagcactttttgggacttgcaggattctacagaagattcattcgtggttatgcaacaattgttgcgcctctaaccaagcttctcacattagaatcttttcagtggaccccagacgctactgcaacgtttactactcttaaacagatgctgacttcatcccctgttcttcgattgccggacttcaacctccctttcacggtggagacagacgcatcaggcacaggcatgggcgtagtgttatcacaacagggcctcccagttgcttacttcaacaaaaaatttcccctaaagctacttggtgcttccacatacgttcgtgaactattcgctattatggccgccgttaagaagtggcgccagtacctccttggccggcgcttcaacatcctcactgatcatcgaagtttgaaagagctgcttactcaggtgattcaaacacctgagcaacaaaagtaccttgcacgtctcatgggttacgattacaacattcaataccgctctggaaactccaatgtcgttgctaacgcgttatcgagagtgccagaaccaacctctgagatatttttgcttttatcagtcccctgtttcacatttttgcaggagctcaaggctcagttggagcaatgcccagattacactcagctccgacaaagcattatggatcaccccgaccaaaatcctgagttttcaatcaccaaggacttcgttcttcacaaaggccgtatatggcttccttctactttgccatttttgaacaccctgttacaggaataccattgtacacccacgggtggacatatgggtgtcgcgaagacattggctaggctgaccgagaatttctattggcaagggattcgcaaggatgtgaaaagattcgttgcttcgtgtctagactgtcagtacacgaaatataaagcccgaaaaccggcgggattgttgtgcccattgctagtgccttgtcagtcgtgggaggacttatccctgaatttcatcaccgggctgccggcatttcgcggcaatactgccatcttggtcattgtagatcatttttcgaaagggatccacctaggcatgctcccaacccatcatatggcatacacagtggccattctctttatggaccttgtcggaaaactccatggcatgccacagagcttagtttcagatcgcaatcctctatttctcagcaaattctggcaggagctctttttcttgagtggtaccaagctacggctaagctctgcgtatcaccctcaatcagataggcaaatagaagtcttaaatcggaagccttcttcatggggcaagctgctgggttgggtggagtggtcttacaacacctcctggaactcaagctcaggtctctctccgtatgaagtcacatttggaaagaagccttttaactttccacaatatttggcaggggactctaacattgatgctgtagatgttatgctcacgaaccgcaaggctgttttcaccgaaatcaaatggaagctggaaaaagctcaaagtcgcatgaagtactttgcagataaaaagcgttgtgaagttgaataccaagtaggtgacatggttttggtcaaacttcgtccacacaggcagatatcggtctcgggtcaacctagtgcttactcgaagcttactaaaagattctatgggcctttccgagtcgtagaacgaattggatccacagcctacaaattgcaattgctagaggaagcccgaatacatccatggcaaggacttcccccggatgataccacttgggagaactgggatcagttacaggctgattatcaccttgaggacaaggtgctttcggaagcagtgaggaatgatagcaacataggaacaagaccaaggaggaagagcagagcacccacctaccttaaggatttcactagctgttag

SEQ ID NO: 43489 - DNA, 198 bp, Glycine max
  Peptide Sequence Number=SeqID_160267
atggcggagcatttggcatcgatatttgagacagagaaggacaagatgaactggcccttctacttcaagatcggcgttagcaggcacaacgtggaaaatgtgtacattcagttcaaagggagcaacatggcgctaatatcgttaggaacctcatcgaaaggttgcgttatgttggagatattggaggttgaagattga

SEQ ID NO: 43490 - DNA, 813 bp, Glycine max
  Peptide Sequence Number=SeqID_160268
atggtggaagagcttgtgagggttggaatagagaggcaaatttggtcaataaagagtgaatttcatgaggtgatcgcaaccactgcacccctaacactatgttcgcgccacataatggtattgtccattaccaaccatgaccttgaggggggtggtgtcacaaggggaaaggcccagtctcgtaagcatggtatcttggatgaagttatgggtactaccccccatccaccaagattaaaacctgctttgaagccacgaagcctgaaaaacgtaatgtctctgcgttcatcgcatttgaagcaaaggcctcgctccctgcgagaagcaagctcgttcggcgtcagacgctttaacggtaccggcgagaggggttgcgccgaaagggctcgtggtgagggagacaccgaaatcggggtgtgcgttgagggcgcggtcgaagtcgagaaggaagggacgcgactacggaaggcgcgtcttgtctccgcgagtttctcttcctgcaagcgcgcaaggcccgccgcctggaccagcgttaatggttgcaacgcttggacctcgcggcggatgtcgggattcaaccccgatacgaaacagctaagaaggaaatgcgggggaaggcccgccacgcgattggcgacatctttgaactctgaaagggttccggtggggtcttcatattgtgaggatgcgaaccggcctaaggggtctgagccatcaatctggggacatcaagctttacacggggtggttgtgaagaagaggaaggcgatgggttatggggaaaagaggttggagaagaatcagaggatttag

SEQ ID NO: 43491 - DNA, 201 bp, Glycine max
  Peptide Sequence Number=SeqID_160269
atgatggtggcctgggtgatgttggggcacggctacgagctcggaatgggtttgggcaagaacaatggcggtagcaccggcctagtaagggtcagaggaaaccacgagaaatttgggttacgctataatcctacacatgctgacgtaaggaaaaacatctcgggaaggaagaacaaaggccaaggcccgcagtcgggatag

SEQ ID NO: 43492 - DNA, 645 bp, Glycine max
  Peptide Sequence Number=SeqID_160270
atgggaaatcaacagagacaaggatatactcaaggaggattttcaggcttccagcagggtccttataaccaacaaggacagtggagatcacaccctggcaatcaattcaacaaagaccagggtggaccttctaacaggccaatccaacaagggcctaacatctttcaaaggactactaagctagaggagactttgactcagtttatgcaggtaacaatgtcaaatcataaaagcactgagtcagcactgaaaaaccttgaggtccaggtgggacaattggccaagcagatagatgacaaatcatccaacagttttgtggcgaatatagaaaagaataccaaggaggaatgcaaagctgtgatgacaaggagtaagaggtttgtggaggcaaaggatgaggatagtgttgtatccaagaagaaagctactgaaaagaaaggtactgatgaaaagaaagatgataatgaagagaggagtagaagtgaacaagctagagaaaagaaaagagaaaaagttgtgaatgaatgtgcggaagtaccatatcctgtggtaccttccaagaaggagaaagaccgccatttggcgaaatttttatatattttcgggaaactggaaataaccatgccattcggagaagctttatag

SEQ ID NO: 43493 - DNA, 606 bp, Glycine max
  misc_feature (229)..(229): n is a, c, g, or t
  Peptide Sequence Number=SeqID_160271
atgggggatcccatcagcagactctccttccctggtaggcgcattgtttgtcactcaaatcatatgctcagttggaatatttgtctctttgctaaagcatgtttgcattttagtggagaaaacaccgagactttttcaagtctcacaagttatccagaactacgtaggtctgagttcctcattggaggatacgtaggagcaagagcctcgcttttgtcgaccacaccgncttttgttgccatgactcaagagctggtagcccgcggggataccttacggttatccgcacccctttgctatttagacacagttgttgtccgatggcacgcagaggccaagtttggtcattctgcacacatgatacgcggggataccttacggttatccgcacccctttgctattcagacacagttgttgtccgatggcacgcagaggccaagtttggtcattctgcacacatgatacgcggggataccttacggttatccgcacccctttgctatttagacacagttgttgtccgatggcacgcagaggccaagtttggtcattctgcacacatgatacgcggggataccttatggttatccgcacccctttgctag

SEQ ID NO: 43494 - DNA, 809 bp, Glycine max
  Peptide Sequence Number=SeqID_160272
atgggtgaaatagaggaggaacaagagcggatgaaggcctacatagaggccatgaaagagcaaatggccacaatgatggaggccatgatgagcatgaagaagataatggaagtcaatgcaactatagttgccgctaccagcgctgttgctgagggaggcaaagagttgggaattacaggcggcccccattgtgtgcaaattcaaaacaagcatgccttcttgccatatgacttgcctcccaactatacaccacccaatgtggtgcccactcccgatgagaatgtcaataactccactcccatacttattaagtgccaacaacctcaatttgatcatgcacatatctctcaacccatgggggagacacatgaaataccccaccacaatctagctgacttcgagcctcacctcgaatacgccactatggggcaagtagttggtggtgtacccctgccaaacactttggagggccctcagtttcgcccacaaccactacccttgcattttgcggtgggaagagtccctcctactatggtggaaagggagaaattggatcatataaaggaaaggctcagggtcattgaaggaggtggagatcatgcttttgctgacattgcagagttatacctagtgcctgatatcatcattcctctgaaattcaaggtgtccgatttcgataagttcaaggggactacttgccccaagaatcacctgaaattgtactgtcggaagatgggggcgtacgcaaaagatgaaaaactgctaatgcatttcttccaagagagccttactagggcagccgtcacctg

SEQ ID NO: 43495 - DNA, 1527 bp, Glycine max
  Peptide Sequence Number=SeqID_160273
atgaaacccacggcaacattcttctttctccttccttcaacaacactcgttgtttgtctttgccttggaattggaacaaccaccctctttataaccctcctcgcaatttcccttaactactggcttgtccctggaggctttgcatggagaaactatgactattatcaaaccaaaaaaaaacttactgggcctatgggctggcccatactcgggactctgcctctcatgggctctttagctcaccaaaaacttgcggctttagccacttcgctgaacgcaaagaggttaatggcgctgagtctgggccccactcccgttgttataagcagccaccccgagaccgctagagaaatcttgttgggttcatcgttttcggatcgtccgataaaagaatcggcacgcgctctcatgttcgagcgtgccattggtttcgctcattcaggaacctactggcggcacctacgtaggatcgcggcgtttcatatgttctctccgaggaggattcatggcttggagggtctccgacaacgcgtaggtgacgacatggtgaagagcgcgtggagggagatgggggagaagggggtggtggaggttcggagggtatttcaggaagggtcactttgtaatattttggagagtgtttttggaagtaacgataagagtgaggagttgagggatatggttagggaagggtacgagttgattgcgatgtttaacttggaggattattttcccttcaagtttttggattttcatggggtgaagagaaggtgccacaagttggcggctaaggttggtagtgtggtgggccaaattgtggaggaacgaaaaagagatggtggttttgttgggaagaatgattttcttagcactttgctatccttgcccaaagaagaaagattggctgattcagatctggtggctattctgtgggaaatggtatttcgaggaacagacacagttgcaatactccttgaatgggttatggcaaggatggttttacaccaagacttacaaaagaaagcccgcgaagaaatcgacacgtgcgtcggccaaaacagtcacgtgcgagactcggatattgcgaatctcccttacctccaggccatagtgaaagaagttctccggctgcacccaccaggcccgctactatcatgggctcgccttgcggtccatgatgtccatgcggacaaagtcctcgtgccagctggcacaacagcaatggttaacatgtgggccatttcgcatgactcgtccatctgggaagacccatgggctttcaagcccgagaggttcctcaaagaagatgtttccatcatgggatcggacttgaggcttgcacccttcggggctggacgtagggtgtgtccgggccgggccttgggcttggccacggcccatctctggctcgcgcaacttcttcgccacttcatatggcttcccgcacaaaccgtggatctttccgaatgccttaggctttccatggaaatgaagacacctctgcgatgcctagtggttcgtagataa

SEQ ID NO: 43496 - DNA, 273 bp, Glycine max
  Peptide Sequence Number=SeqID_160274
atggcttctaaaagtggagatgctactccaccatctccaaaaaccgcaaggctcaaggtggagatgactaaacttgagcgaagaagagaggtaagatcatttaattcttctcatggagaggatgaagggtatgacgatgatgagggaggaatgaggaatgagatgtataggaagagaagaaatcatagaagatatggaggtaggaaaagagaggaagggattaagggagtgaaggtgaagatccatacttttaaagggacttatgatccataa

SEQ ID NO: 43497 - DNA, 294 bp, Glycine max
  Peptide Sequence Number=SeqID_160275
atggtgaaagttgggaaggcagggagtgaagtgagaaatagtggagtggatgggtttgacaaattcttaggctgtgaacatggaaaaagaagtatctacaggcttgctaaagttagagaaaaaaagagcaaaacacatcaagagttagaaggcagaaagtgcaccagtttgagcttagagctaaaatgggaggccataccatacaagtcacatgattttaagtgtctaggatccatggtacaacgtgaagggaaaatagagggagatataaaccatagaattcaaactgtttga

SEQ ID NO: 43498 - DNA, 2523 bp, Glycine max
  Peptide Sequence Number=SeqID_160276
atgaatgaaggcgacatcgagaagaaagcctttcgaacccacaacggccactttgaatacctggtgatgcccttcgggctttgtaacgcaccctctacgtttcaatcagccatgaaccagctgctccggccgttcttacgccaatttgctacagtattttttgacaatatcttggtttatagcaattcattggccctacatctgcagcaccttgagattatcttccaaacccttcatcatgctgagtttttcctgaaacgctccaagtgtctcttcgcacaagataccatcgaatatctgggccatattgtttccggcaagggcgtatctcctgaaccatcaaaaatccaggtgatgttacaatggccaaccccaacgtccgttcgagagttacgcgcattcttggggcttacagggttctacagaaaattcatcaaacactacgcctccattgcagctcctctcacgtccctgctatgcaaggatgccttcacctggtcccaagactcacaacaagattttgatagactcaagctcgccatgaccagtgccccagtactggcccttcctgacttctccgagcccttcatgattgagacggatgctttcgaaactgccattggcgtcgtgcttctgcagaatggccatccactagcatactttagcaaatgcctgggaccacgcatgcttcatgcatccacctacattcgcgaacttcacgccgtcgtggctgccgtacggaagtggcggcaatacctcttaggccggccgttcaccattctcacggaccacaagagtctccgggagctgatgacacaagtcatacagacaccggagcaacactattatctatcaaagttgctgcgttacgaatactccattcagtataagactggcgccaccaacgtgatcgctgatgctctttcccgagctccatctcctgaagcttccttgctcgtccttagtgttccccagcttgacttccttagcgacatcaagcaatccttcgactctaactcggagttccaacgccttgctcaagccattcgtgataaccctaatgaccatcctgactacactctcggtcacgggctgatactgttcaagggtcgaatctggctcaatcaggataacccattccttcacagtctcatcactgaacatcattcaacacccttgggagggcacttgggtgtcaccaaaactacccatcgccttgagtcaagcttcttctggtctggtctcaaacaagatgttaagcaattcatcaaacaatctgggttactgcagcccttaccagcaccagagggggtgtgggaagacctttccatggacttcatcacccacctgccaaactcaaatggcttcaccgttatcctagtcgtggtcgataggttttccaaaggtgtgcatttgggagccttagcttccgggttcaccgcctttaaggttgccaacttattcctggatatggtttgtaagttgcacggttttccgaaaagcatcgtctcctaccgggatccgatcttcgtgagcagattttggaaggagttgttcagattgagcggcacgcgactccggttaagcacttcataccatccccagtctgatggccagacggaggtgatgaatcgtgtcgttgaacaatacctccgatgcttcatccacgttcaaccttcaacatggcatcagtacctagctctcgcggaatggagttataacacgtccctccattccagctccggcctcacgccgtttgaaatcgtttatggcaaaccacctcccacagtcctcgactatgttcccagcgccactagcaacgaagctgctcagtctttactagaaacccgtcacaccttgcacttaaagcttaagcgcaagctgcagaaagcccgggaaaggatgaagaaatatgctgactccaagcgagacgacgtcacgttcgtcgtgggccagtgggtgtatgtcaagttacggccaggtcggcagacgtcgatcactggttccatccacccaaagctctctaaacggttcttcggcccattccagattctcgaacgcgtcgaagcagtggcctatcgtcttcttcttccacctaggtcgcagatacacccagtatttcattgctctctcctccgcccccatcacggtccaccacccaccaccacttacgaatggtccttacaggtccacgataaccagccccttcgacggccactatgcttccttgcttcttggctcgaccattccactaatccaccatcccgtatggttcttacgcagtggaagggtgaaccactggaagatacctcatgggaagcatggtctgaattgtgcaaaacttaccaccttgaggacaaggtggtttttggggcggacggtagtgttagcatctccgatgacgactgcaacatctctggtgactgcagcaccgacgaccgtcacacacccaacccgagaccagcgcgcatcaagggagctcctactcatctgaaagattactacgtaaacctgcacacatga

SEQ ID NO: 43499 - DNA, 801 bp, Glycine max
  Peptide Sequence Number=SeqID_160277
atgtcgacggccgaaacatttcgcttatacgaccatattcgtcttcatcatagtcgtgttgctaagttcttgaacctccctacatcatcgacaacaaccctgcatattatagtgggaaatagaaatcggctaaccagcaacaccacatgcccccaggttaccatcgtcgttgagggccaccaattcaccctagaccttttccagcttcccctctatggtgctgatatagtccttaaggtccaatggctccaaaacctgggccctataatgactgattacacctccctaactatgtccttcacccacctgggccggcccataaccttacaagcggatgtaccactttgccctgattccgcatcagcccatcaactgaaacgctatgtgcacatacaaagcctctcaaccttgtttcatttggtccaaatccctgacccagagcctcaacacccacttggtcctcttgcacccttaaaccttctcaattactccctcccgttcaatctcctaccacatccacctcacacccaactccaaaccagtggacgtaaagccttattgatacccatattgccaaaagtcggaactcaaaaggtagatagcttctatgctcgcggctggcctcatataacccaatcacatccctttctcttcatcggtgctcctggtaaagaagaaggagtacgcggaacctggcattgctatgtcgactactgggctctaaacaccatcacaatcaaagctagatttcccgtgcctatgatagatgagctcctcgacgagttaggcaaggcttcctag

SEQ ID NO: 43500 - DNA, 1614 bp, Glycine max
  Peptide Sequence Number=SeqID_160278
atggctaaccacaaaaccaggaagactacgacagatcgccttgaagaagctatcgctcgtctcaccaacagccaagtttccattaacgatcgttataacgacctcgccggaaaggttgattcgatcttggaacatctccatctccacgcttctgataacaataccaacaccactactttgagtcacccaaatcatcaacgtagcgctgttaagatcgacataccacgattcgatggacgcgatccgttagggtggatcttcaagataactcagctcttccaataccagaacacaccggaggacgaaagaatcacggtggcatccctataccttgatggtgcagccttaagctggtaccaatggatgtacatcaatgggcttatcaccacatggaatgggttcctccaagcattagaatcgcgattcacgccgacgttctacgaggatccaaaaagggccttgtttaaacttacacaaacaagctcaaacccgatgtacgacgggaggttcttgctctccagccgatatcgtttttgcaggcttctgcattggccaagctttaggaagagaagctgcgtgatcgaacattcctaccagctcgaaactctatccctccaagaccgaccatcaatagcacgcctcaggtttcggccaaaactaaaccaccattcgttcaacgcacacctgcagagatggctttccgaagagaaaaagaccttggccttcgagaacgatcctgctccctcctcggacatagactcacacatcagtctccatgcgctcgccggagtaccctcatcagaaactttccgaatctatggcatgattaagaacacccgcctcacgatcctggttgacaacggaagcactcataacttcctccaacaacgaatcgcgcaatttctcaagctctcaacccagaacactcatcctctccaagtaatggttgggaacggatccatgctagcatgtgatcaaatttgcccaagcactaacctcactattcaaggacatcctttcgtggtgtcatttcacctcctgcagataagcggagccgacgcgatgctcagaatagattggctacgccgtttagggccagtcacgatgaattacgcggattccatcatgagtttcaatcacttgggtcacgacatcactctgagagcagatgtttccattggacccgaacccacctctgcggcccaacttaaacgcctcctcccgacgggttctacatcagccctctaccaactacacgttttacccgtaaccgaacccgaacaacccgcatcgccacacccgattccagctatggaacaccttcttctccgctataataatcttttccagaaaccttccactcttcctcccccacgacaagtggtccaccgcatcaccctcaagccggccactcccccaatcaccgttcgtccctatcgatacccccacttccaaaagaacaagatcgaaaaccaggtctccgagctcctcgccgctggtctgatcagaccaagcaccagtccctattcttccctagtgctcctcgtgaagaagaaggacgacacttggagactttgtatcgattatagagctctcaactcagctacaatttga

SEQ ID NO: 43501 - DNA, 240 bp, Glycine max
  Peptide Sequence Number=SeqID_160279
atgggttgtttgttaggagtgaagctattaaaaagaatctctgaagttgtaaagagagagatgttaagtggggtcccttttttgttgggaggtttctggacaggtaagttgttccctctcattgatgcacggctcttgtcgaaacatgccacgcggatgcattttcaggcacatccttacggtgctgtcactagcctcacatgccacgcaagacaaattttgaagacgagtacatgctaa

SEQ ID NO: 43502 - DNA, 531 bp, Glycine max
  Peptide Sequence Number=SeqID_160280
atgatgaggaagcagcagcaacagaggcaaatggtccctcccaacagaggaaggaacaacaacagcagcaacaacgttgttagggtagggaacgttgttaatgggataggtttgtctgcttctgcatggcctcctaatgggtctggcatgagggccgtttttctttctggcaagagagaaagaagcaccggaaccggcgtgttcttgcctcgctgtgttgacactcgcaataataatgaatctcgcaagaagccagtgtgcaatactgtgttggtgtctgatagagtggcgcaggcgttgaatctggagggtgtggtgggtggtggccgtggccacaagcagcaacacaagcctcgtttcaatggggaaaatggatcgccggtttcaagggttaggagtaacaataataataataatcattatggttatggttattcccatcatcagaagcgtaacaacttgaagccgcagcagcagccacaagttgtggtgaaccatgagatccagttgcctctggaatggacttattga

SEQ ID NO: 43503 - DNA, 399 bp, Glycine max
  Peptide Sequence Number=SeqID_160281
atgattgttgcagatgaacaagatacatacaatgataattttgatgttgattatgatcatataaatgaagagatttcaaatgttgacatatcttgtggtgctcctcctaactttgctacatacttaattcaagaatcaagagaaagattcaagagaagtttcaagtttcaatttttcaagaatcaagaatcaagaatcaagaataatcaagaacaagattcaagactcaagattcaagaatcaagagaagacttaatcaagataagtatgaaaaagttttttcaaaaactgagtagcacatggatttttctcaaaaacatgtttaccaaagagtttttactctctggtaatcgattaccagattgttgtaatcgattaccagtagcaaaatggatttga

SEQ ID NO: 43504 - DNA, 501 bp, Glycine max
  Peptide Sequence Number=SeqID_160282
aacattcgtggtggacgagtggtgctgcacccaatcacaagtcctccctcggaatttgagcattcggaaaaaggggatgccttgtatgccatggaactagctttgtctttggagaagttgacgaatgagaaacttctgcacgttcacagtgtggcagaacgtaacaatgatcctcaattggcagacttcattgagagcgagttcttgtatgagcaggttaaatcgattaaaaagattgcagagtatgtggctcaactgagattagttggaaagggtcatggtgtgtggcactttgatcaaaagcttcttcacgatgaagatcatgaaaatgtcctaaaaggatgtgttggaacaatagtttatggtaaatcgaaaaaattactggttgagttgcggacaatgtcgctttctttaagacgtttcatgacactgcctaatattgtgcaaacagattatcaaccacgaagttttcaggataaaacaatccagatcactatataa

SEQ ID NO: 43505 - DNA, 309 bp, Glycine max
  Peptide Sequence Number=SeqID_160283
atgggtatgcagaaaaaagagaaatggaagaagaattcaatggcggatattgagggtgagattgtgtgtgaagctaaagggaaggggcaaggggaggggatttgttctgggccgttggatggagagacacgtggagggctgagctttgtttcgggtactggcgtgtggcgagctcgtggcctatccagtgtgaaagtggaatctgtggaaatatccgtcccacgtcatgatcgagaaatgtgctcactcgctcgaatgtgtaaacctgaggtactcgcgctcagaacgtttcaatcaattaatatttaa

SEQ ID NO: 43506 - DNA, 381 bp, Glycine max
  Peptide Sequence Number=SeqID_160284
atggtgaagcctgatcaaattttgtttacaatcaaagatcaagatgaaaaaaatgtaaccaccattaagactgtatacaatgagcgacaaagatatcggcatgaacaaaaaggtttaagaaaagaggtacaacatctactgaagttgatagaacacaatccggttaaaggtgcacatgcaagactaaagaggttgctttgtgataacatgagagatttgtgtacttgtaaggataaaatcatcaacgtgattgaccattggtttaatacaccattttacaagagactacgaggttttgtttcaacacaagcacaaagttttatcttaaatgagttgaagcgctctgcaattgttggtattgacaattctgcttatgattag

SEQ ID NO: 43507 - DNA, 153 bp, Glycine max
  Peptide Sequence Number=SeqID_160285
atggatcagatattcaacaaggtcggatcctattggttcaaccagaaagcctccagccagctcaattccgttggtgatgacatcaatcaaaaatatgttaagggggatatagagtttggatgtctagtaagggaaggtggagaagctccgtaa

SEQ ID NO: 43508 - DNA, 945 bp, Glycine max
  Peptide Sequence Number=SeqID_160286
atgagaattgtggttttctcagcacttatggtgatgccattctattggttgtgcctctttaaccacgtctttgtggtttcaggcctttgtcttgatgatcagaggtctttgctgctccaactcaagaacaacatcacattcataccctgggcatatagaagtagcagcaggctgaagtcgtggaatgcaagtgatgattgttgcaggtggatgggagtaacctgcgacaccgagggtcatgttactgctcttgacctcagtggagaatcaatctccggtggatttgatgattcaagtgttattttcagtcttcaacatctccaggaattgaatttggcttctaataatttcaattctatcatcccatctggatttaacaagttggacaagttgacttatctgaatttgtcatatgcgggctttgtggggcagattccaatagagatttctcagctgacaaggttggttactcttgatatttcttgtctttcctacttaactgggcaagagctgaaactagagaacccaaatctacaaaagcttgtccaaaatctcaccagtattaggcaactgtatctggatggagtaagtataaaagttccaggacatgaatggtgcagtgccttcttgttgctgcgtgacctgcaagaacttagcatgtcacattgcaatctctcaggacctttggatccttccctggcaactcttaagaatttatcagtcattgttcttgatcaaaacaatttatcatcccccgtgcctgacacattttcccatttgaaaaatctgaccatcttaagtcttgtttattgtgggttgcatggaacatttccacaggggatattcagcattggatcattgtcagtcattgacatatcgttcaactataatctccaaggtgtctttccagacttcccacggaatggatctcttcagattttaaga

SEQ ID NO: 43509 - DNA, 315 bp, Glycine max
  Peptide Sequence Number=SeqID_160287
ctcagacataatatcgaaatccccaacggtgaaaattctcggaaatgggttgcgaacgcggtcctcaaatttcacgacgatccaacggtgaatgagtccgagatcgtcatttttctgagacagaaagatgcatcacatgtaagaccacagaatggaggcttcaatcccttctccttctctctaacgtttgagaaccctaacagagcaaccggaggaggagttctagagagcaccaaaaatgccacaattgataacgaagaacgcttgagtgactacatcgaggtgagggatgaattattcacaattggggattag

SEQ ID NO: 43510 - DNA, 1728 bp, Glycine max
  Peptide Sequence Number=SeqID_160288
atgcatctagataacattttggttctcagaaatttaactacactagacctttcatacaacaacttatcagtcaaagtgaatgttacaaatgttggctcatcttcctttcccagcattagcaatctaatattggcatcctgcaacttgaaaactttccctggtttcttgagaaatcagtccagattaaccagtctagatctctcagataaccatatccaagggacagtgcccaactggatttggaaactacagattcttgaaagccttaatatttctcataatttgttgactcatttggaaggacctttccagaatctttcttcccatttgttgtaccttgaccttcatcagaataaacttcaggggccaataccgtttttttctagaaatatgttgtatttcgatctttcaagcaacaattttagctctattatcccacgagactttggtaattacttgtctttcacattttttctctctctctcaaacaatactttgagtggcagcatccctgattccctctgcaatgctttttatcttaaagtgcttgatctttccaataataacatttctggaacaattccctcatgtttaatgacagtgagtgagaaccttggggtgttaaatctgaagaacaacaatctctcaagccctattcctaatacagtcaaagtttcttgtggtctgtggactttaaatcttcgtggaaatcaattagatgggccaattccaaagtctcttgcttattgctcaaagttagaggtattggaccttggatcaaatcaaatcacaggtggctttccatgcttcttaaaagaaatacccacgcttcgtgtcttggttttgaggaacaacaaatttcaaggttccccaaaatgtttgaaagtcaatatgacttgggagatgcttcaaattgtagacattgcttttaacaattttagtggcgaactgccaagagaatattttacaacctggaaaagaaatataaagggtaacaaagaagaagctgggttaaagttcatagagaaacaaattttggactttggtttatattatcgagatagtatcacagttatcagtaaaggttacaaaatggagttggttaaaattttgacaattttcacatccattgatttctcgtctaaccattttgatggacctataccagaggagttaatggattggaaagaactccatgtccttaatttgtcaaacaatgctttgtctggtaaaatcccatcatccataggtaacatgagccaactagagtccttggacctttcacaaaactctctgagtggagaaattccagtgcagcttgcaagtttgtcattcctttcatatttaaatctctccttcaatcatttgatggggaagatcccaacaagtacccaacttcaatcatttccagcttcttcttttgaaggcaatgatggactatacggtcctccattgactaaaaatccagatcataaagagcaagaggtgctgccacaacaagaatgtggaaggttagcgtgtactattgattggaattttattagtgttgaattgggattgattttcggccacggagttatttttggtccactcttaatttggaagcaatggaggctatggtattggcaacttgtgcacaaaattctttgtcagatcttccctcaggtgtatcttgaatatgtaacttggagaggacaaacatacgaagctttaaggtggaggcattag

SEQ ID NO: 43511 - DNA, 189 bp, Glycine max
  Peptide Sequence Number=SeqID_160289
atgatggaacgaatcaagagggagaaaatggtttctagagacagggaaagaggccaagtgaaagatgaaatcggaagaaggagaatgagggttaccactgtaacttcccttgcagtaaggaagaagacaagggagatagaaactaaaaaaggaaagggagaaggggatgaagaaaatcagagaaaatga

SEQ ID NO: 43512 - DNA, 417 bp, Glycine max
  Peptide Sequence Number=SeqID_160290
atgcaggttgtaggtgttcttcacatattccagtttgaaacaaagcagggagaagaaatttgtgtagctcttcagacacacataaatgacgtaatgttgcgatgctattctaaagctcgatatgttatggatggatctttgaatgaagacacttctaatgattttaagccttcttctaatttggaactatctaaaaaacgtcttcaagaattatcaaaacttgttgaagaatctcaaatgaatgctgatcaaatagatgggttaaaggtcaacgacaatgagattgaggttgcagaagctgtcaccgatgacggtgaaggtcacaaggccttgtcaagcaatggcgaaggtcatagaaccttgttcgtcgagaatgcaaacagagtagtgattgcaaaatccatggagacaacataa

SEQ ID NO: 43513 - DNA, 819 bp, Glycine max
  Peptide Sequence Number=SeqID_160291
atgtattcgagtgcaagccagtttgacggcaatgcagccttctccggtggtggattcatgccttctcagaccacccagggccctgactcttcattcgttccctccaagaatcgtgacgctcagtccttgcttcctctgacggtgaagcagatatacgatgcgtctcagtcaagtgatgataaaatcaatttgatcattgacggtgtggacgttaccaatgtcactcttgtaggaagggtgtccaacaaagctggacgaattactgatgttacttttgtgcttgatgatggtacgggaaggattgagtgtaataaatggcttcatgaagctgttgatacaaatgaagcagaggctatcttggaaggaatgtatgcgaggctccatggacaattgaaacattttcagggtaaaaggaccttaaatgttttctcatttaggcctgtgactgactttaatgagattgctagtcatttcaccgactgcatatatgtgcatctctacaattccaaattaaggactagtgtccctaatcagcagcattcctcaccaattcctcccacaataggttatcaagctcaagttgttccgccaacaaatcagttctctgatcagcatgtcaatggtcagaagggtgttactgttgaagccatggtcttagattttttgcatcatcccgcaaacagttttaccctaacccctcacacttctcccatcactgtcatctctatcttgtaccctcactctcctaccatcttctcacctgcttgtgggtggaacctgtgcctgtggcttcaccatctctgttctgcttgtggctga

SEQ ID NO: 43514 - DNA, 1370 bp, Glycine max
  Peptide Sequence Number=SeqID_160292
atggccactctttcctcctacgaccacttcatcttcactgccttagctttcttcatatctggcctaattttcttcctcaaacagaaatccaaatccaaaaagttcaacctccctccaggaccccccgggtggcctattgttgggaacctcttccaagttgctcgttctgggaaacctttctttgagtatgtgaacgatgtgagactcaaatatggctcaatcttcaccctcaagatgggaacaaggaccatgatcatcctcaccgacgcaaaactggtccacgaggccatgatccaaaagggtgcaacctacgccaccaggccccccgagaaccccaccagaaccatcttcagtgaaaacaagttcaccgtgaatgcagcgacctatggccccgtgtggaagtcgctgaggaggaacatggtgcagaacatgctcagctcaacaagacttaaggagtttcgcagtgttcgggacaatgcgatggacaagctcatcaacagactcaaggacgaggccgagaagaataacggcgtggtttgggtgctcaaggatgccaggtttgctgttttttgcatacttgtggctatgtgttttggtcttgagatggatgaggagacagtggagagaatagatcaggttatgaagagtgttctcatcactttggacccgagaattgatgactatcttccaattctaagcccctttttctcaaagcaaagaaagaaaagccttggaggttcgcagagaacagttcttaacggtggcacagacacaacagcaacagcggttgagtggggcatagcacagctcatagcgaaccctaacgttcagacaaagctgtacgaggaaataaagagaacggtgggagagaagaaggtggatgaaaaggacgttgagaaaatgccatacctacacgctgtggtgaaggagcttctaagaaagcaccctccaacacactttgtgctaacacatgctgtgactgagcccaccactttgggagggtatgacataccaattgatgcaaatgttgaggtgtacacaccagccattgctgaggaccccaaaaattggttaaaccctgagaagtttgaccctgagagattcatctctgggggtgaggaagcagacataactggggtcacaggggtgaagatgatgccatttggggttgggagaaggatttgccctggcttggctatggccacagtgcatattcacctcatgatggcaaggatggtgcaggagtttgagtggggtgcataccctccagagaagaagatggatttcactggcaagtgggagttcactgtggtcatgaaggagtctctaagagcaaccatcaaaccaagaggaggagaaaaagtgaagtt

SEQ ID NO: 43515 - DNA, 812 bp, Glycine max
  Peptide Sequence Number=SeqID_160293
gggtaacgagagaatgaagagccgatggctagtgtggctattggcgatactgggcgtcatcggagccacactcttcatagcaagcatgatccaaacctgggagaacaacttcctatgttccataagcagaaccatgcagcagcaacagttcacccacggtcccacatcgatgcaactcaaggccatcctccactacgccacctcgcaggttgtccctcaacaatctctctcggagatcaccataaccttcgacgtgctccaggccctccaccggcccgccaacttcctcgtcttcgggctgggccgagactcgctcatgtgggccagcctcaacccgcacggcaccacgctgttcctcgaggaggaccctaagtggttcgggatcgtcaccaaggacgcgccgaacctcctggcccacacggtccgttaccggacccagctccgagacgccgacagcctcctctcctcgtacagctccgaacccgcgtgttttccggcgaccgccacgctccgcggcaacgagcgttgcaaggtcgccctacacaacctccctgacgaggtgtatgctaaagagtgggatttgattatgatcgacgcgccgaaggggtacttcgcggaggcgccggggcgcatggcggcgatattctcggcggcggtgatggcgagggacagaaaaggatccggtgtgacacacgtgtttttgcacgatgtggatcggaaggtggagaaggtttacgcggaggagtttctgtgtaggaagcacttggtcaaaagtgttgggaggctctggcacttccagattcctcccatgg

SEQ ID NO: 43516 - DNA, 522 bp, Glycine max
  Peptide Sequence Number=SeqID_160294
atgtcacttgatgccttgaagcaagttattcaaagcaagattagcctaccatatgttggatatggaatgctcaagtttacaacattgaaaattgttgaagacgaaaatgtcaaagcctcacaatcatttggtcttactgaggatcaacctcatgcatactggagtactcttaaagcaaagcctatcccatcaactcaaccaaatgagcctgaatttgctgagtttggcttacctaacaaagaactcggtccctttagtggtgatgaagacaaaattttatgcaaccaaccccatcaagaacatgatgaagaggctgatcctacacccccatcaacaaccatactagcatactacatggcagtacacatgcaaaatgttgaccttgaatctaattttcaagattttgaattggtcatgcgttggatcgcaaagaagtccaacattcgatgggaaccctctttgaaagaatttgttttgaaaccaaagaagaagtacaacatgctttgcagtagtatcatgtga

SEQ ID NO: 43517 - DNA, 381 bp, Glycine max
  Peptide Sequence Number=SeqID_160295
atggcgatggatgtgcttggaggtgcagagcagtatacatccttgcaaattgttgcaagctatgtagacatatcttccaagtatggttgtagagaaggaaacattgttaatgctaatcaaacaaggttaatggaacttggttgtatggaaagtacaaaagaaaatctcattgtggcagttgcacaagatgagaacaaaaaaatattgttaatagccttcatcgttgtcgaggcatatgcaaggacgaagcctgctttcaactattgctacaacaatttgaggcaggagcagatagtgaacaagccattaattgacttaaccagatttcgcaagaaaaatgaactcttgtttgggatgaaggctaatgaaggggagacatga

SEQ ID NO: 43518 - DNA, 627 bp, Glycine max
  Peptide Sequence Number=SeqID_160296
atggattttgagtatcagaacatgtcaatgagcaaaattctctcaaggagatcctctatggggagctcctctcgcatttcttattataggagtagtggggaaggggttccattcaaatgggaaatgcaaccagggattgcaaaggaacaacaaccaagagaagatcttcctccactgagtcctccaccagcacttctcagcctggggctacccaagccatgcattccagacaccaaaccttcaacaaggtcaaggctaaggttttggaagaaaagggtaaaacggggaaaaagcaaaaagtcatcctcttcatcccatgattgttttcatgaagatgatgatgttattggtttggacatattagattgcaactctgattctgagtctaactcaatggcatcacctcgtggttctagtttctcttcttggtcgtctatgtcattcatgaaaagtcctactactactatcagaaagcgggcgtcttccctgttgcgtcgtggggtggtgttcgcacaacggtgcggtggtgctatgacacgtaaatctgttggtgtgaggtcttggtggtgtttgatgatggttatggttgacgatgacgatgtgcagtgtgcagaggctaacatatag

SEQ ID NO: 43519 - DNA, 237 bp, Glycine max
  Peptide Sequence Number=SeqID_160297
atggctctccactttctggtctatgatgcacttaaaactgaactacagtggcagagatcttcgtggtctgcaacaagatgctatgccatgggttcccacgtgattcaagctacttacaccaacaaatttgtggacttaattctatctctggcccatttaagcatatcacagtttgatgctttcgagtccaactcaggggtctacctgttgttgctctcggaccaattaggagtctag

SEQ ID NO: 43520 - DNA, 576 bp, Glycine max
  Peptide Sequence Number=SeqID_160298
atggcccatccctctgctgtcgtctccgtcagaaggccaatcacccacgtcgtttttgacatggacggtctcttgctcgacactgagaggttctatactcaagtccaggaaatcatactcgctaggtacaacaaaacctttgattggtccctaaaggcaaagatgatgggaaaaaaagcaatagaatctgctaggatctttgttgaagagactggaattagtgattctcttagtgccgagcaattcctggtagaaagagaggatatgctggagaagttgtttcctactagtgagcctatgccagaagttaaacaaggcaaaccttctccggatggatttcttgcagcagccaagagatttgagggtggaccggtagatccttctaacattcttgtttttgaagatgcacccgcaggagttcttgcagctaagaatgctggaatgtctgttgttatggtccctgatccaaggctggataagtcttttcttgatacagcagatcaagttttgaactcactgttggatttcaaccctagtgagtggggtttacctccttttgatgataatagagactga

SEQ ID NO: 43521 - DNA, 945 bp, Glycine max
  Peptide Sequence Number=SeqID_160299
atggcagaacaatggcactgcattcagtaccctgaattctatgtcatgtttggcattttgtaccaaacttcatgtgttgccactccacataaaaattcagttgccgaaagaaagcatcgccacattttaaatgtggctaggagtcttttatttcaggcaaatttgcctaaagcattctggtcctatgccgtaactcatgttgctcattttattaataggattccttctaccacattaggatacaggtctccttttgaattgttgcaccatgattcacctacgctcttggacctcaaagtttttggctctttatgctctgtgttcactttagatcagggtagatccaagtttgatcctgtagagcttgaggtgtatctttcttggattgaagtttgtatgaacacatctttccacattccactttcattagaaccaacttctacatccttttcaccagaacctcaatgttttgactttcttcttgatcctgtctcacaaactgtccccccatcattaattttcgcttctcagccgcatactgtaccgctgtcttctaataatcatattccttcaccatattctccactacccattctttgcagatcctctagatatcgcaagccccctgagtacttaaaagattttcaccaccacctatgcaactcagccacacccaatgcatcctcatctacagctgctcaaggatggattttagttttacagcaactggacgtggacaatgctttcccccatggagatcttcatgaggaagtctacatggagttgccacctggtttgtttcctcagttttctaatcaagtgtgccacctcaccaagtccctttatggactcaaacaggatagcaggcagtggttagaaaaattatcttcttctttggtctcttttgacttcatacaatctcaatatgatcactctccaggttga

SEQ ID NO: 43522 - DNA, 261 bp, Glycine max
  Peptide Sequence Number=SeqID_160300
atggacgcagcagcaacagtaggtagggtttccaatggcggcggcgtagttcgcttcccgttatctgcatcgagcgctttattcatgcagaaaggagacatcaccaaatggtccatcgatggttccaccgacgcaattgtaaatcctgctaacgagagaatgcttggtggtggtggtgctgatggaggtaactcatttcttgtacttgttgataataatgctttgttacggtttagggaagaatgggtaaagttgcattga

SEQ ID NO: 43523 - DNA, 165 bp, Glycine max
  Peptide Sequence Number=SeqID_160301
atggggagaagtaataagtggaaaacaaaacaagtggtgaagacccatattgtgtgttcggaaaaggaaggctatcaggatgtcaagctaagagtagtgctgtgcactttaagaaaaagggatgaaccaaaaacaaaagactatagagaagggcttggctcaagg

SEQ ID NO: 43524 - DNA, 303 bp, Glycine max
  Peptide Sequence Number=SeqID_160302
gaagaagaggaagagcaagagaagagggctttggacagtgagagtcctaagcaggagtcagagattgaggacaattgcaaggaggaggaggaagaaaagaagatcaagactttacaccctgacatgctttgggagccagctgggatgttggtgaacacttgggtgcacatggcatgggaaagggtaggactattacctaatgccaatttgaatcatacaatgaagatgagggctgtttgggttgtgccttcagattatccttgttctaagcgatttgtgacgctgcctatttttaaattctaa

SEQ ID NO: 43525 - DNA, 1225 bp, Glycine max
  Peptide Sequence Number=SeqID_160303
atgaatgaatactggacctcgttggcgtcacttctgggtgtgtttgccttctgccaaaccatcctccaagcagtgttcccaccggagctccgcttcgcttccgtgaagctcttctaccgtatcttccactgcttctcctcctactgctacttcgacataacggagatcgacggcgtcaacaccaacgagctctacaacgccgtccagctctacctgagctcctccgtctccatcaccggtaaccgcctcagcctcacacgcgccgtcaactcctcgggcttcaccttcgggctggccaacaatgacagcatcgtcgacaccttcaatggcgtgaacgtgctgtgggagcacgtggtgacgcagcggcaggcccagaccttctcgtggcgcccactccccgacgagaagcgtggcttcacgctccggatcaagaagaaggacaagtccttcatcctaaactcctacctggattacattatggagagagccagcgacattcggaggaacaatcaggatcggctcctctacacgaattccaggggtggctccctggactcccggggccacccttgggaatctgtgcccttcaagcaccccagcacctttgacacattggctatggaccctcacaagaagaaagaaatcatggaggatcttctggacttcgccaatggacaatctttttaccataaaaccggtagggcttggaagagaggctaccttctatatggccctccaggtactggcaagtcaagcatgatcgccgccatggccaattttctcggttatgatatttacgatcttgagctcactgaggtgcataacaactctgaactcaggaagcttctcatgaaaaccagctccaagtcgataatagtcattgaagatattgattgctccatcaacctcaccggtagaaagaacaataacggttctgtttctgtttctgcttcgaggagttactatgattccgagatacgagcaggtggtggttgtggtgaggagggtgggaataatattactctgtctgggttgctgaattttactgatggcttgtggtcttgttgtggaagtgagaggatttttgtgtttaccaccaaccacattgagaagcttgacccggctctgctgcggagtgggagaatggatatgcatattttcatgagttactgttcgttcccggcgctgaagattctgctgaagaattacttggggtgtgaagcgt

SEQ ID NO: 43526 - DNA, 174 bp, Glycine max
  Peptide Sequence Number=SeqID_160304
atggggcctaatccattgggtttggtgctggacttgagagccagccagccaatggatggatggctgaccatgattctgaaatgctatcagaatgccccgtttccatatctttttgcaattggacaatcaacaactaagttggaaagggaaggttttacagctggtttgcagtga

SEQ ID NO: 43527 - DNA, 423 bp, Glycine max
  Peptide Sequence Number=SeqID_160305
atgttacgggactcaatcagacatccgagtaaaaagctattgtcgtttgaatttgctcagagattcaacattcaatttcgagcgtctcgatatattaccggactcaatcagacatccgaaggttcagcattcaatttcgagcgtcccgatatgttacgggactcaatcagacatccgaagcttcaacattcaatttcgagcgtctcgatatataaagggactcaatcagacatccgagtaaaaagttattgtcgtttgaattggcttagaggttcaacattcaatttcgagcgtctcgatatgttacgggactcaatcagacatccgagtaaaaagttattgtcgtttgaattagctgagagcttcaacattgaatttcgagcgtctcgttatattacgggactcaatcagacatccgagtaa

SEQ ID NO: 43528 - DNA, 378 bp, Glycine max
  Peptide Sequence Number=SeqID_160306
atgtttaggcatgaatatcaagagaatgggggcaatgtggcatgccccattacttcagaatgcaccctaggcctaaggccatcccttacaacccctcaattcaacaaaaacaagcaacaattcaaggataaatccctcacgtttttgagcaaatacatgcaacttagagcaccaaaatacatcaatggaaagctagagagcccaagaatgaggtgcaggggtgctcacccaggcgagctaacctacacttttttttttcgggagacgatactaggctgccttgcagaggcgctttccatttgtccaaagctaggcaagggacgacgacccatcggtcatgaccctagcctctacttgcgtccatccctaagtacctga

SEQ ID NO: 43529 - DNA, 552 bp, Glycine max
  Peptide Sequence Number=SeqID_160307
atggctatgatgcagtttctgaatagtataccaaagtttgtaaagatagtagaagttggtccaagggatggattacaaaatgagaagaacattgtgcctacatctgtgaagattgaattgattcatagactagcttccactgggttatctgttattgaggctacaagctttgtatctcccaaatgggtcccacagttggctgatgcaaatgatgtaatgcaagcagtacataacttgagaggcatcagattaccagttctgacccctaatttaaagggttttgaagctgcaatggcttctggtgccagagaagttgctatttttgcatcagcttcagaatcattttcaaaatcaaacattaactgtagcatcgaagagagccttattcgtttccgagctgttactcgtgctgctaaacaactctcaattcctgttcgagggtacgccttttattttctttttaattattttaagattacatcaaataactgtgcttcaatatctgtattgggaaagcaatacctttcacaaagtgcccaggtcaaggtctag

SEQ ID NO: 43530 - DNA, 474 bp, Glycine max
  Peptide Sequence Number=SeqID_160308
atgtccaaatcttttgaatttgggatgatcagcactattgatgagtcaatctcttgctttctcataggggtggacccttgggtactagaacctatttcctttagaggactacacgtccttgccttcagaggactacacgtccttgccttcaaagggctacatgccttcacctttagaggactacacgtcctcgccttcagagggctacacgccctcaccttcagaggactacacatccttgccttcagagggctgcacaccctcgccttcaaagggttgcacgccctcgccttcagaggactacaagtccttgccttcagaggactacacgtcctcaccttcagaaggctacatgccctcaccttcagaggactacacgtcctcgccttcagagggctgcacgcccttgcctttagagggctacatgccctcgcctttagagggttgcacgccctcgccataagaggactgtag

SEQ ID NO: 43531 - DNA, 864 bp, Glycine max
  Peptide Sequence Number=SeqID_160309
atggatgactggaacattccagaaatccctcaggatcaactatacgttcctgaaacaattaaggacaaacacaactttgattacataatcaaaatagtagaaaacaatattcctctaggacaagatataggggaagaatttcatttactttcaaaaaattcaatttatgaacatagtcgtaagtataaatatctacacatcggctgtgtacaagtagccatcaagcccttaattgacataggcatagatgcagcagttttaatgtgtctaagagatattaggcataataaatttgaagactccctaattggaacagtcgaaactagcctaggacaagccttaatttataggatccagtacaaggtcatgaatacttgtgcatctagagtcctgctaaaacctcaaaaaagagaaacaactttgtttatcactgatatgacaaaggctaacgtttctctcccaagaaaaataaaatgggatgaagtaactcttctcgaaagatgggttatggataaggccacaccgtctgttccacgacccgctccaaccatagagcatattaagcaagataactccagtaaggtagaaataaccttcaataggagaaattctttttcatcaagaatagaagcctctagatctgaatatgagtcagccagaaggtctttttcggttagaacccgttcaattccagtaggactaaccagatctgagtcacataaccagttccctactataaacctccaaggattagacactacttctagcatacctagaacaacttacagccaagaacaagaggacgaccaaaagtcgatccaatccccaacatactcttctatggaaccttatgatgttatctga

SEQ ID NO: 43532 - DNA, 246 bp, Glycine max
  Peptide Sequence Number=SeqID_160310
atgtcatcaagtcaatcaatatcgatcaatacacaagtgttatgcaacatatacactaagactcaatcctatatgcaatgtggtaccatgtcagtgaaaaaccacgtcgggcgcctaggagtacatgacaagacaaaccacacactagcaagtcaggtcactctcactaggcttaaaggagcacttaaaccgggtgacccccaagacctacactccaaaaagtccatcaagacctctccctcctga

SEQ ID NO: 43533 - DNA, 345 bp, Glycine max
  Peptide Sequence Number=SeqID_160311
atgctttggctcagagggggctgccctttcgagttttcaacccattgggtgagaacttctaatatgcccctaggttcgcttgaggctcatgcatggtgcctctcattactccagtgtaaggctctgagcttgcttgtggggtcctttaatggtgattttccaccatggagatgcagcggaagacaaaggaaaagaggtgagaggaggcgccatccattaaggaataagccatggaagaaggagcttcaccaccaagatgagccttggataagaagcttggagatgatgcttcaatggaggaaaagaaagagagaaggggggagcaagaaattgaatgatgactag

SEQ ID NO: 43534 - DNA, 339 bp, Glycine max
  Peptide Sequence Number=SeqID_160312
tccgccgtcactccgtccccacctccgcctcgccccggcatcgccacctccgggttcggtcccgcccccaacacgctcaccgagcccgtctgggacaccgtgaagcgcgatctctcgagaatcgtgagcaatctgaagctcgttgtgttccccaacccttaccgtgaggaccccggtaaggccctccgggattgggatctgtggggcccattcttcttcattgtcttcctcggcctcaccctctcttggtctgcctctgtcaaaaaggttttgaccttgttagcggttagttcagctgaaatttctctggttgttaataatcctaggttagaaacttaa

SEQ ID NO: 43535 - DNA, 302 bp, Glycine max
  Peptide Sequence Number=SeqID_160313
atgcaaaacacatcacactgcagttctataccttctgttctactcacggctgcacttgctgctagtggatcagagaagagagatggtgaggccgaggaagacaatgaagaagaatgggccccacagatcccaatcccggagggccttaccggggtcctcacggtaagggttggggaacacaacgagcttcagattgctcacgattctcgagagatcgcgcttcacggtgtcccagacgggctcggtgagcgtgttgggggcgggaccgaacccggaggtggcgatgccggggcgaggcggag

SEQ ID NO: 43536 - DNA, 531 bp, Glycine max
  Peptide Sequence Number=SeqID_160314
atggtaaggttgctgcctggtgacctagagactattatgggtttgaatcccctagaaatagactcggaaataaggttgtgtacatctaccttccccaaacctcaccagtctgaggtttttgctgttgcatttgctttacttgctgctggcgctgtaattttgacattgaatgtacttcttctgggtggtggacctgaccattctcaaaagtatactttgatgaatgaggccaaatatttgactgtcttcatcatctcttcaaaatttcagggtggacacattattttctttcagagtctgagtctgttgggttattgcttgttccctctggacgttggtgcattaatttgtatgttgaaggacaatgtcattgtgaaagtggttgtggtgtgtgtgacattggcttggagctcttgggctgcatatcctttcatgagttctgcagtcagccccaggagaaaagctcttgcactatacccagtttttctcatgtatgtatctgttggttttctcatcattgccattgactaa

SEQ ID NO: 43537 - DNA, 924 bp, Glycine max
  Peptide Sequence Number=SeqID_160315
atggcggtgaagtcctcaaagcccaaccgggagcgtttcatgctctcttgtttcacattcatcgtcttcctctgcgtgttcgcttcaataaacgaggttcgattcaacggcgccctcccaaacgaatctcttcccacaaactcagaagacgacgacctccgaatcctcatctccgtcctcaccctccccgaccaataccaacggcggcacttcctgcgcctcgtgtacggcacgcaaaccaccatcgagggcgcgaaggtggacgtgaagttcgtgttctgcaacctcactaaagaggaccagaaagtcctggtggcgctggagatcatgcgctacaacgacatcatcgtcctcaactgcaccgagaacatgaacaagggcaagacatcaacgttcttcacgagcctgcccgagatcttcaacaacgaaacaacaacaagcggtatcgtcccttaccctccttaccactacgtgatgaaagcagacgatgacacttacgtgaggctgaacagtttggtgaggtcgttgaggccgttgccgagggaggatttatactatgggttcgtgataccgtgtggaagcatggacccttttaagcactacatgtctgggatggggtttgtggtgtcctgggacatagtggagtggattcatggttctgatattcctaggaaacacgtggagggccctgaggataaggtgttcggagattggatgcgatgggctcgccgtggaaacaacaggttcaatgctaagtggtctatgtacaattatcctgatccaccttccgtgtgtagtcacgacctttggaatgatactattgctgttcatttgttgaagaatcaggagaagtggattcggactctcacctactttaaccacacccatgctttgaagccatccaagctgtaccatataccttag

SEQ ID NO: 43538 - DNA, 144 bp, Glycine max
  Peptide Sequence Number=SeqID_160316
atgactaattatgattgttggctgaattttgaatgcttcaaaaatttgatagctgatgaagccggcaacaaggatcagagcagaggtggatatggtggtgctccggcctcgaagggatgcccatttgttgaacattctgactag

SEQ ID NO: 43539 - DNA, 927 bp, Glycine max
  Peptide Sequence Number=SeqID_160317
atgttggggaggttgtgtttcgctttccaggagttgagaaaacagctcttgaagggtgtgcatgctgttgtcagagagcacttgtttgagaaccccgtaaccgcaagggtgcaaagtttacaagaagatgctgcaccatatcatagggattttctcgcaaaaactattgtgcgtcaaggtcatcaagtgttggcatactctaggtcagactactctagtatagctagggaattgggtgttacttatttccatgatgctgatgatctctgtgcacaacatcccgaggtaattttactttgcacatcaatcccttccacagaggctgttcttaaatcattccccttgcagaaattggagagaagtaccttgtttgttgatgtactttctgtcaaggaatttcatagaaacttgtttcttcaacatttgccacctgattttgatgtgctttgtacccatcccatgtttgggccacaaagtgcaaaagatgggtggagtggttttctttttgtttttgataaggttagaataggaacagatgaagcaagaacatcacgatgtgattggtgtctcaacattttttctagtgaagggtgtcagcttgttgaaacgccatgtgctgaacatgatcgacaagcagctggatcgcaatttatcactcccactgtaggaagaattttagaaaagctggattttttggagccaacgaaaattgacacaataggctttgagtctttgttgaatttaatggataacactgttagagacagttttgatctctactttgatttgttcttgtttaataaaaactccaggcaacaactagaaagattccatctagcttttgagtcattgcagaatcagctttttgatcatgtgcttgataacttaaagcaagtattaaaacttgaagaagaatcccatgattag

SEQ ID NO: 43540 - DNA, 120 bp, Glycine max
  Peptide Sequence Number=SeqID_160318
atggctcgcttagcgcacccctgctcgctcaacgcaattccccctctggttggaattgcgcttagcgcacccttctcgcttagagagacatcaaaagttgttattttccaaatcccaacg

SEQ ID NO: 43541 - DNA, 276 bp, Glycine max
  Peptide Sequence Number=SeqID_160319
atggatccccctaccacactagcaagagttgctcctagtttgccttccctttctcggcgcacaagcggtgaccttgtaggggacaaacgggtctactttcatgacgaaagaggtgcgagactagccacacataaagatctgctttcaaaggtttctagagatatcatcccctttgatatcaacattgtggcggtaaggactaccagcgacaacgtatcatcaaagagaaaaactataaatgaggtttctctgtcatcaagcaagtcggagacttaa

SEQ ID NO: 43542 - DNA, 504 bp, Glycine max
  Peptide Sequence Number=SeqID_160320
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaaaacaatttatcacacagatgcagaacatggaagcaagcacggaaatttcaagaccccgtcttcaaggaagtttagcaacaagcatagggttcaagagttggagagacccccttacctcttgatgaactcacaaaatcttgaaggaaaaatgatgaatgttcagttttcaagaatggaactcatttacctaagcttgatgtataaatggctcaagaacactaggaacaag

SEQ ID NO: 43543 - DNA, 596 bp, Glycine max
  Peptide Sequence Number=SeqID_160321
atgtctggccataatacaccgatttcaacagctcactcctttctctcactgaatactccaagggtgtctgtggaagcaacaatcaattcagacttaccagggctcaagactctgcttgtcgaatacttttctggagcaaggttgtttgccaaaatccaaagaacagacaccgatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 43544 - DNA, 426 bp, Glycine max
  Peptide Sequence Number=SeqID_160322
atgacggctgctggtatcgagaatggcgacaacttcctgctgctccgcattgagcgggccggcaacctggtcggccagcagttcggtgccttcgcgcaggctggccagcggcgttttgagttcgtgcgacaaatggcgcagaaactcatgccgctgcgcttccagccagctaagacgttcgctgagccagacaatgcgctgtcccagcgagcgaatttcgcgcggcccgcgaaagctgacgctattgcccagcgttttgccctcgcccagccggttaatcatgcgttcgacgcgcttaaccgggccgataatcatgccggtgaacagcagcaccagcaccagactgatcaaaaacagtatcagcgcctgccagccaaaaaactggccgcgatcggcaatttcgcgctgcagctgcaggccgcgtga

SEQ ID NO: 43545 - DNA, 288 bp, Glycine max
  Peptide Sequence Number=SeqID_160323
atggcctttctgctggtgctgctgccgctgctggtgctggcatggcaggcgtgggaaagtctgtcagcgctgagtaatcaggcggcggacactaaccgcaacaccttcaccgacgtgcgtcgcagcgaggcgatggcgcgtacggcgctggagctggagcgtagctatcgccagtatttggagccgctacggccagatgctcagcagccatgccgccagcctgcccgatttgccaacgttcaaaatattgcagagcgcgctgccgcagctggaaaagctgcagtgtga

SEQ ID NO: 43546 - DNA, 477 bp, Glycine max
  Peptide Sequence Number=SeqID_160324
ggatatgggatgacagaagcaggaccacttgccattagcatggcatttgcaaaagaaccctcgaagattaaaccaggtgcatgcggaaccgttgtgagaaacgctgagatgaaaatcgtggatacagaaacgggtgattcacttccaagaaacaaatccggagaaatttgcataagaggggcaaaggtcatgaaagcggttcaacatggaatcttgaagcctgaaggcgttgatataaagaaattccgcaaacagtttggatatctaaatgacccagaggctacagagagaactatagacagagaaggatggttacacacaggagatattggtttcattgatgatgataatgaactcttcattgttgatcggttaaaggaattgatcaaatacaaaggattccaagtagctcctgctgagctcgaagctttgttgattgctcacccaaacatttctgatgctgccgttgtagggtaa

SEQ ID NO: 43547 - DNA, 494 bp, Glycine max
  Peptide Sequence Number=SeqID_160325
atggaagaagagcttcacgactttaccaaaaacaaaatctgcactcttgttcccaaacctaaaaacaagagcatcattggaacaagatggatatttagaaataaactagatgaacaaggaaaagtggtaagaaacaaagctatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 43548 - DNA, 471 bp, Glycine max
  Peptide Sequence Number=SeqID_160326
atgcatgaacgacaatcaattcatggggctccgaataaaagtggagaatggagaattgcactaggcaatcacttcgcgtggctccagactcattggtggaggatgcatgaacgacaatcaattcatggggctccgaataaaagtggagaatggagaattgcactaggcaatcacttcgcgtggctccagactcgttggtggaggatgcatgaacgacaatcaattcatggggctccaaataaaagtggagaatggagaattgcactaggcaatcacttcgcgtggctcaagactcattggtggaggatgcacgaacgacaatcaattcatgggactccgaataaaagtggagaatggagaattgcactaggcaatcattcccctggctccacactcattggtggaagatgcatgaacaataatcaattcatggggcttccaataaaagtggagaatggagaattgcactaa

SEQ ID NO: 43549 - DNA, 468 bp, Glycine max
  Peptide Sequence Number=SeqID_160327
atggatgttaagaaaggtgggtctatagtacaaacagaagtgaagttgcaaaagcataacgaaaaggagatgggcatgagaaaaggtccatgggcggttgacgagaacaccattctggtcaattacatcaccacacacggtgaagtatatatattaattatgagatttatcaattacaagtctaaggaggagtgggaagagttgcagattctaaactacttgtgcccagacatgcagcatggaaatatcacactccaagaacatatattaattctcgaccttcgctctcgttggggcaacatgtatgattgctcaacaactactacgaagaacaaccaacaaaataaagaactattgaaggaccgagtgataaaacaagcgaagcagctaaagtgtgatgtgaatagcaaacaattcacagacatgttgcattacgtgtggatgtcgcgcttgttggagcggctttag

SEQ ID NO: 43550 - DNA, 291 bp, Glycine max
  Peptide Sequence Number=SeqID_160328
atgggaaagttggatcatctagaggaaaggctcagggccattaaaggaggtgaagattatgcctttgctaacctagaagagttgttcctagtacccaatatcatcacccctcccaagttcgagataggggcatacgcgaaagatgaggaattgctgatacattccttccaagaaaatcttactggggtagctgttacctggtacactaacctgaaaccttctcgagtccactcttggaaggacctaatggttgccttcgttaggcagtgccagtataatggctttggatag

SEQ ID NO: 43551 - DNA, 168 bp, Glycine max
  Peptide Sequence Number=SeqID_160329
atgggacaccttaggtttgtcatactttttggtaggaataatcaacatgaaaatacagaaaaaggggttcccatgaaccctaagagaataaaggtcattcctgagtggcccgctccaccaagtgtgttaaggaaaaaagcccagcgtttcaagaacctcgggatttga

SEQ ID NO: 43552 - DNA, 561 bp, Glycine max
  Peptide Sequence Number=SeqID_160330
atgtcttgcctagcgatcacaactccgatctccctctgcctaagtgctagttggtgtatggcgcctaccaggcatcctctggacccagataagtccaacagagccctgtggtttttagcgctgatcacgggcctctgtcagtcctacggagttcccttcacccccagtaaagtaatccgatcgctgatcacccgggccttcatcgagaagtactgcacgcctaggcaggcgcagggtgatgcacatcaggccgcagacacaccgctaccacctcggcaggccgatctagctgggtcactgggcgcggctaaccaccgtaggcaggtgcagatacacaagtgtctctaccggttcagcctcagccagcaggggcagggttccgccccttttgcatgccctactccggagcagtttggggctgaggtcgcatggcctggagactggcccgatgcctgggcaggggaggagcctacaggatcccccggtgagccagatgagtcccatatggatgaaggtatgacttacttgctcgatttcttgggagggagcggagctacatga

SEQ ID NO: 43553 - DNA, 267 bp, Glycine max
  Peptide Sequence Number=SeqID_160331
atgaagtcagctgacaagcgtgagtaccatattgtcatccgaacctttcatcaaccaagggcaaacgagtccggtgacgcgcagagactaatatcgtcttctgcaccttctgtcatcctgacccatgaagtcaggtttactttagtcgtccgaagatattcaagcccaacgacgcacgagattcttctctgctgggcggggatgatcaagttcgatagcgcgtggaaacgtcgtggttatcccattttatcgctttcaagacactaa

SEQ ID NO: 43554 - DNA, 582 bp, Glycine max
  Peptide Sequence Number=SeqID_160332
atggaagacgaaatatacggcgtgtcatccacggcggagtacacggacagggcgctgatgacgccggagaacatatttccggcggagtaccacagcttcctaatgtcctccgccgcccggactccaatgttcggatccgacgagtttctctccgccgccatcgccgtcaccgccggcaacgaaaccgaaccctaccctaacgtctccgtcgcaccagaaattcagcgccaccacgacgcctcttctctcatcaaagccaaaatcgcctctcaccctcactaccctcgtctcctccaagcctacatcgaatgtcagaaggttggagcgcctccagaactcacgtgtttgttagaggaaatccgacgagaaaacgacgttcgccagagggacgttgttgtttccacgtgcgttggagccgatcccgaactcgacgagttcatggaaacctactgtgacatgctggtgaaatacaaatctgatctgacgcggccttttgacgaagccaccaccttcctcaacaagatcgaaactcagcttaccgatctctgcagccgttcttctcttccaactctttacggttag

SEQ ID NO: 43555 - DNA, 165 bp, Glycine max
  Peptide Sequence Number=SeqID_160333
atgacatgcaactatgcaagtatattcatatccatgctccaaatatttgatggtcatggttcttttccaaagcttcttgggttttggaaaaactgcaaaagcgacgacctatgggctatgggaggaggtatagagaaaatggaaagtcccgtgtggagcgggtga

SEQ ID NO: 43556 - DNA, 180 bp, Glycine max
  Peptide Sequence Number=SeqID_160334
atgccgccgccaggattcgccttcggcagcggcacatggtggtcgacggtgagaatggttggaatgactcaaatctggtgtagagaatgtcaggtcaggtcaggtaaggtaaggtcaagtgtgtacactgttctcctatgtggtggtcaaatccttgtcggattgactggctatcagtaa

SEQ ID NO: 43557 - DNA, 333 bp, Glycine max
  Peptide Sequence Number=SeqID_160335
atggctaagtttgaccctgagatagtcctagagttctatgctaatgcttggcccatagaggagggagtgcgagacatgcgttcatgggtgaggggcaaaattgattgcaataacataaatgagataagggaagagagaatgcaaacacagttttatactggttcggccacaacccgtgcctacgtccagtactcaagcaacccacttgagatttccactatctttgtaaaatccattacaaagtctgaaccacacagggacaacccatcccttgtgttcaggaatcttttacaacaagagactcacagtctcttaaccaatctcattgaataa

SEQ ID NO: 43558 - DNA, 384 bp, Glycine max
  Peptide Sequence Number=SeqID_160336
atgctaggcgcaccatatccactgcaacttccaacctctgtcacacaatgcctaatccactgtggtgatcatatgacaattctcagaagattcggacctccactgccatggaatgtagttgtgctcgacaaaggcatcggtgacaagtatgtcactctcccttggtacaaattcattcaagaaggtgattttagccatggagacaagctctcattcaattataggcgtgctgagaagatttgggaggttgttgatgtaagctccattggagcttgtaggcctaggatcttcttcatcaatggattcctttgcttcttggaagatgaatggcaacggaatggagaaggaagagagagaggagacgccacttcaaggaaaagatga

SEQ ID NO: 43559 - DNA, 396 bp, Glycine max
  Peptide Sequence Number=SeqID_160337
atggtttccttaagatacaaaattagttgggttgattggaacaaacaccaagtaccagttaaagtttacatacttgattccaccaatagaattagatcaaatggttccaaaataattcatgattgccaggcagaatataccattctagaaaatggtgatggtgattctcctcatgtccaaaaggcaaacatcccagtagaaaaaggaggttatctcatttatggcactgctcatattcattcaggcattgtaaatgtaactttatatggacaggatgggaggacattgtgtacttcaacaccaaaatatggaacaggaaatgaggcaggaaatgagaaaggttatctcattggtgttagacaagtggcctcagatatcttaagaagggggggttga

SEQ ID NO: 43560 - DNA, 159 bp, Glycine max
  Peptide Sequence Number=SeqID_160338
atgtctcctccacctctaaaaacctcacaatctctcaaaaactccttcaaagctcttcaagatgcctcctttggtctgctcaatcgcctctgggttttctatggaaatcctgtcggtggcctcttgctaagcaccaatttcacgcttagcgcgcattag

SEQ ID NO: 43561 - DNA, 222 bp, Glycine max
  Peptide Sequence Number=SeqID_160339
atgcctagcgctgttcatgtgtcctccacctacgagtttggagccatgcgtactgattgcttagtgcaattctccgtcctcgcctttttttcggagccccataaatgtcattgcctagtgctgttcatgcatcctgcaccaacgagtctggagccccgcgaaggtattgcgtacaactgttcgccaattctccattctccacttctttttggagccccatga

SEQ ID NO: 43562 - DNA, 238 bp, Glycine max
  Peptide Sequence Number=SeqID_160340
atggtagaagtctccacagaggccattgcctcccttgcccagtattattatcagccgttgaggtgcttcacctttggtgacttccagctatcacctatggtagaagaatttgaagagatcctaggatgccctctagggggaaggaaaccatacctcttctcagggcgaatgggccccgttcatagacattctcgcactgttgatctttggaggagtcctctttccgaatgtgggatgg

SEQ ID NO: 43563 - DNA, 309 bp, Glycine max
  Peptide Sequence Number=SeqID_160341
atgggtgccaagtacctcaaagtggtcaaacgaaagtttcatgccaccaaacaatggtccccggacgaaattaggaaagtcgcgggtgaccataagatatcttcgcatgcaactgactcgttgtccctggatgacaaaggcacagaattcgtctatgcgcgtttaccacccaacttgctgctcttgagtgataaaggtaaaaatgcgggaccaactggttcccgcatgtcatcggcccgctgcctctggatgacaaaaggtgcagaagacgacgttagtctctgcgtgctatcatgctttgagtcttag

SEQ ID NO: 43564 - DNA, 267 bp, Glycine max
  Peptide Sequence Number=SeqID_160342
atgggccccgacgggtgcagagaaacgcgagggactggaaccagagaaatgacacgcaaaccgagaaaaaattcagaagctcttctcatctcccacgttgcttttcttctccctttctcatccaccattgttgcccatcaaagctccaaactttgctcaccatttctactccaaattgcaaaaggaagccattttcggagtcgtgaagcgcaccactacgttgtgggacttcaaatttcaggtttgggtagatttcttctcacatga

SEQ ID NO: 43565 - DNA, 597 bp, Glycine max
  Peptide Sequence Number=SeqID_160343
atgaagctttgcttctacaggaagaccaagctcagagtagctgatgtcccctcttcctttgcaccaatagctggcatccttgcatcttctacttcagccccacctccagctttagcagacccatcttctaagagctcccaaacttcaaatgccaaattgcaaagcctatttgaaggacagattctcattatgcaaagcttgcaagaactggctcagcaaaagccaattatgagtgtagagcaattcattgagaaggcacctcaaccacatgagctagagccagaaaacgaccagtcatctgaagccatcatctctagagctgttgatttttcaaaaagaagattagaaacgagatccaatgaggttgctcagcctgagccagtgccagtattagcttatgcactagttccaggggtggatccatcttcacctcagcatgcaacagactattccactcctgtcttagagatacctgagggccagaccatactagtcctgactctagacacttctcctctagctattccagtattacatctaacagatgaagaggatgttcagacacaggacacccaggaccagtcacaggaattgtga

SEQ ID NO: 43566 - DNA, 375 bp, Glycine max
  Peptide Sequence Number=SeqID_160344
atggcttctgtggatatctctgctatggtcaaatctaagatctttccgtacgccttgcggaaggcttgcattttgagaggtgacacggaccctctgttgctttgcccaagagaggggattaagatggaacccatgcatgatgcatatgcaaaaagtggaaaaatgccacgcagcgtgtttgctctgtgcccctatttaaaggacttatacgggagagagctaaaagggtttttagtgataatccccaaggtggtcatatctctcttgatggtctctagaggtatcatcctcttcgaagaacatactgcagcagtagggactactagcaacaatatgttttcaaagagaaaaactctagatgagggttcactgtaa

SEQ ID NO: 43567 - DNA, 204 bp, Glycine max
  Peptide Sequence Number=SeqID_160345
atgactaaactccaaccaccaccaaacaacattgttgcaccatcaccgccgcgctgcactcactttcaatgtgtcaaggaatcaaggttagagcaattggatgaaattcaagtgaaagctatcaatacttctaatgggaagaatttgcctaaatgtccagctttaatctttgaattcacaggtgttgcttttggctctagttaa

SEQ ID NO: 43568 - DNA, 261 bp, Glycine max
  Peptide Sequence Number=SeqID_160346
atgtcgttagatctcctcatcgaagaaagggaactcctatacaaagatcatctgagtcacccagatatactcccttccgttgcatttgttgattttggtggtgtttggttcatgggcacccactccattgcgtgcaacgacttcgaccaccaacaacgtcattcatacatgaactaccccagatcaaccttgttccatgaggcgtcacctccaacacccaaatctacactgcttcacacgtgtagtcaccattgtcattag

SEQ ID NO: 43569 - DNA, 260 bp, Glycine max
  Peptide Sequence Number=SeqID_160347
atgacggcgaagatactagagaatgaattcattatgtctcgccttttacgtactttccctcgcatttcttttagatctaactcatcttcatcctcttcctcaatgaactcgcccaaaaataataacttgctcaatacacatgaaaaccagacccatgaggtcgccccaaaacacaatctctttgatgaggaggtccgattcagagatataaaccaaaacatggatgactggaacatttcagaaatccctcaggacactct

SEQ ID NO: 43570 - DNA, 1101 bp, Glycine max
  Peptide Sequence Number=SeqID_160348
atgctctcaacgggcgatgaagtgttacatgggcagattgtcgataccaacgccgcgtggctggccgatgtgctgtttcagcacggcctgccgatgaccagtcgcagtacggtcggcgatgcgatgagctcgctggttgaagcgctacagagccgcagtcagattgccgatgtgctgatcgtgaacggcggtctcgggccgaccagcgacgatctcagcgcgcaggcagcggccaccgccagcggcagcgaactggtgctgcagcaggcgtggctggagaagatggaagcctggtttgccagccgcgggcggctcatggcacccagtaatcgcaagcaggcggagattccggccaatgccgagttgatcgataacccggtcggcaccgcctgtgggtttgccctgcagcttaatcgctgctggatattctttacccccggcgtgccgtcagaattcaaagtgatggttgagcagcagattattccgcgtcttaaggcgcgttttacgttgccagaacccccactgtgcctgcgtctgaccacctttggtcgcggcgagagcgatatcgccgcggagcttgaaccgctgccgctgccggaaggtgtcgtgatgggctaccgttcgtcgatgcccatcattgagatcaaactgaccggcccggccagccagcgcgtggcgatggagcaggtgtggcagcaggttaagttactgctggccgagtgcaccatttttgaaggctttgaaggattgccggccgtgctggcgcgggaactgcacgatcgcggcttccgccttgctctgagcgaacaatacacggccgggttgctgcactggcagctggccgccgcacaggtgccgcttagcgccgctgagctgctgccggctcgtgaggagtcgctggaagcgcaggttactcgcacgcgtcagttggccgctcagcagggcacagtgctggcctttgtcgattgcgctgcacaccccggaagccagctggggccagcgggtgaaatttacacacgggcggcacaatctggaaacccggcagaaagtggtagcgatgatggcgatgaatatgctgcgccgctggctgcacggcagtga

SEQ ID NO: 43571 - DNA, 659 bp, Glycine max
  Peptide Sequence Number=SeqID_160349
atggccctctctgccgttagcggcatgaccgggctctcctcgctgtttgcgcagtccgcctgggccgatgatggcatcgccgacggaaccgccgtgcgcttcgatttcgatgtgctgaaaaagaaagccgcggcactggccaaacagccctggggcggcgcgcccggccccctgcccgcgaccctggccaatctgacaccgcaggcgtataacgaaattcagtacgacgctaaccactcactgtggaacaacatcgccgaccgcgagctggatgtgcagttcttccacgttggcatgggctttaagcgccgcattcgcatgttctccgtggacgccgccagccgcgaggcgcgggaaatccacttccgtccggaactgtttaattatcacaacgccaacgtggatacccagcagctggtgggtaaaaccgacctcggctttgccggtttccgcgcctttaaaaaaccggagctggcgcgacgcgacatcgtttctttcctcggtgccagctacttccgcgcggtagatgaaacctaccaatatggcctgtcagcccgtggcgtcgcggttaacaccttcagcaatggccaggaagagtttcccgacttcacggccttctggttcgaaacacccaaagctgaagacaccacctttgtggt

SEQ ID NO: 43572 - DNA, 798 bp, Glycine max
  Peptide Sequence Number=SeqID_160350
atggagatcccgacgaccggggaaacgctggataacatcgtttgcttctggcagccggccgagccggtcaaagctggcagcgaatttaatttccagtacaaactctactggagccagctgccgccggtacgcagtggtctggcccgcgttgatgccacgcgcaccggtattggtggcttcccggaaggctgggcaccgggcgaacacttcccggaccagtggtgccgccgctttgctatcgatttcattggcggcgacctgcaggcggccgcgccgaaaggcatcgaaccggtaatcaccgtgtcgtccggcaccttcaaacaggtggagattctctacgtcgaaccgctgaaagggtaccgtatcctgtttgactggtatccgaacagcgactcaaccaaaccggtggatatgcgcctgttcctgcgcaccaaagatgagacgctgagcgaaacctggctgtatcagtacttcccgccaccgcccgatcagcgcaacccaggcgaccataaaaaccttccagatgcgcctgcgcggacagatacaccgcccgctgcggccagtgctgttcgcagctgttcagcgcctgctccatcagccgataacccagtttcaggccgcgcgcctcttccgacacaatcacccgaccaatggtcaccggcgaagaagccagcgcgggcgtcaggagacgcgcataggccagcagtttgccatcaagaaagcccagcagatggcggttatcagccgtcaaatcctggccatctatatcctgatacggacaggcctgttcgacgataa

SEQ ID NO: 43573 - DNA, 1647 bp, Glycine max
  Peptide Sequence Number=SeqID_160351
atggatgtcacgccgctgctgcgcgtggatggctattcgatgttctataccgcgctggtgatgctggcgagtctggcaacctgcacctttgcttatccgtggctggccggtttcccggacaacaaagatgagttctatctgctggtgctgattgcggcgctgggcgggatcgtgctggccagcgccaatcatctggcggcgctgttcatcggtatcgaactgctgtcgctgccgctgtttggtctcatcggctacgccttccgtcagaagcgctcgctggaagcggcactgaagtacatgattctgtcggctgcggcctcctcgttcctgatcttcggtattgcgctggtctacgccgattccggcagcctgagctttgtgcagctcggcaaaagcctgaatgacagcatgattcagcagccgctgctgctggtcgggctgggcatgatgatcatcggtcttggctttaagctgtcgctggtgccgttccatctgtggacgccagacgtttatcagggcgcgccggctccggtctcgaccttcctcgccaccgccagcaaaatcgctatctttgcggtcatcatgcgtctgttcatgtacgcaccggtaaccgacagtgaagcggtgcgcaccgtgctgggtgtgattgccttcgtctcgatcctgttcggtaacctgatggcgatttcgcagagcaacatcaagcgtctgctcggctattcatctatcgcgcatcttggctatctgctggtggcgctgattgcggtgaaaacccatcagctgtcgctggaaaccgccggtgtctatctggccggttacctgttcagcagcctcggcgccttcggtgtagtcagcctgatgtcgagcccgtaccgtggtccggatgcggatacgctttactcgtatcgcggtctgttctggcatcgtccgattctctccgccgtgatgacggtgatgatgctgtcgctggccggtatcccgatgacgctgggctttatcggtaagttttacgtcatcgcgtctggtgttaacgcgcatctgtggtggctgaccgcggcggttgtcgccggtagcgccattggtctgtattactacctgcgcgttacggtgagcctgtacctcagcccgccggaactgcacactcgtgatactccagccaactgggcgttcaccgccggtggtgtggtggtgctgatctccgccatcctcgtgttgctgctcggtgtttatccgcagccgctcatcacgctggtgcagctggcccagccgctgatacaaggaagcatgatggatatgcaatggcttgattgccaccacagtgaactgaccgcgcagcagctgtataccgtgctggcgctgcgcaatcaggtgtttatcgtcgaacaggcctgtccgtatcaggatatagatggccaggatttgacggctgataaccgccatctgctgggctttcttgatggcaaactgctggcctatgcgcgtctcctgacgcccgcgctggcttcttcgccggtgaccattggcgctgaacagctgcgaacagcactggccgcagcgggcggtgtatctgtccgcgcaggcgcatctggaaggtttttatggtcgcctgggcttccgggcagtcacggacgtttatctggaagataa

SEQ ID NO: 43574 - DNA, 422 bp, Glycine max
  Peptide Sequence Number=SeqID_160352
atgaaagttagttttgaaagagttttacctaatgagaaaagctcctttcgcacattacataataactcccccatttctgaatttaaatgggaatatcactaccatcccgaaattgaattggtgtgcgtaatttccgggagtggaactcggcacgtaggctatcacaaaagcaattattcaaatggagatctggtactgataggttcgaatattccccattccggatttggtctgaattccattgatccgcatgaggaaatagtccttcagttccgtgaagagatattacaattccctgaacaggaaatagaagcacgctctgttaaaaacttactggagctttccaaatatggaattcatttcagcccggctacaaaaaatgcattactgcctaagctgaaaaaaatgctggaaactgaagg

SEQ ID NO: 43575 - DNA, 360 bp, Glycine max
  Peptide Sequence Number=SeqID_160353
atggagaggagtatgattaatgctaccagtggtggagctcttggtgatatgacccctattgaggctaggaatttgattgagaagatggcttccaacccccaacaattcagtgaaagaaatgatgttattgtccttagaggagtccatgaggtggtcacagattcatcttcatctactgaaaataaaaagcttgagggaaaaattgatgccttggtcaacctacaatctggagtcaatgagcaacctgaagcttatgctgcaaacattcataatagaccccctcagcagcaaaaccaacaaaataattatgatctttcagcaatagatacaatccaggttggaggaatcatccaaatctga

SEQ ID NO: 43576 - DNA, 657 bp, Glycine max
  Peptide Sequence Number=SeqID_160354
gatacgtaggagcaagagcctcgcttttgtcgaccacaccgccttttgttgccatgactcaagagctgatacgcggagataccttatggttattcgcacccttttgtcatccagaggcggcgggcccgatgacaagcagagaccaagtttggtcattctgcactcatgatacgcggagataccttatggttattcgcacccttttgtcatccagaggcggcgggcccgatgacaagcagagaccaaagaccaagtttggtcattctgcacccatgatacgcggagataccttatggttattcgcacccttttgtcatccagaggcggcgggcccgatgacaagcagagaccaagtttggtcattctgcacccatgatacgcggagataccttatggttattcgcacccttttgtcatccagaggcggcgggcccgatgacaagcagagaccacagaccaagtttggtcattctgcacccttgtatcatccagaggcggcgggcccgatgatacgcggagataccttacggttattcacacccttttgtcatccagaggcggcgggcccgatgacaagcagaaaccaagtttggtcattctgcacccttgtatcatccagaggcggcgggcccgatgatacgcggaaatacccgagtg

SEQ ID NO: 43577 - DNA, 1006 bp, Glycine max
  Peptide Sequence Number=SeqID_160355
cccgctgaattccgggttgaaccccgcgccgagctccagcagggccgccacgcgccccttgacctcgaccgttccagaggtggcctgcagggtgccgcagatgatctgcagcagcgtcgacttgcccgacccgttgcggccgatgatgccgaccgtgtcgccgcgcctcacttcgaaatcgacgcccttcagcgcccagaactcgtcgtaatctggaagcacttggtgacgccgctgacccggatggcgacatcgctggagggatcagaggacatcggcaaacccccggcgcattttctggaacgtcgcgaaaccgaaccacgcgacaagcgcggcgcctactgcgtacttgcccaaccctatgaagtccgggatatggccccacagcaggacctcacgtgcctgttcgatgatgaacgtgagcgggttgagatagatgtacggctgcagcgtctccggcagtgcctgcaccggatacagcaccggtgccatgaacagcatcaccgtggtgacgatgccggtgacctggccgatgtcacgcaggtagacacccagtgccgccagcaaccaggacacgcccatggtgccgaccaccagcgggaggatcaccaccggcagccacagtgcggtcagcgggatcgagccgcgcaggagcagctgggcgatcagcaggaccaccaccgaaaccatcgaatggaacagcgtggcgcccatcgcgacccacggcagggtctccagcgggaacacgacacgcttcacgtagctggcactgttgagtatcagccccggggcgcggttgatgcactcggcgaacacgccgtggacgatgatgccgacgaacaggatgacggcgaaatcaccatggctgctggtttccacgccccagcgcgccttgaacaccaccgagaaaacgaaggtgtagaccgccagcatcaacagtggattgaagaaggacaacgccagcccgaagaccgaacctcgataccggctgatgacctcacgctgg

SEQ ID NO: 43578 - DNA, 288 bp, Glycine max
  Peptide Sequence Number=SeqID_160356
atgtggcatctccaatcatctttcttccttctccattccgctgccattgatcttcaagaagcaaaggactccattgatgaagaagatccaaggcctacaagctccacatggagctacatcactaccacaaacccattgagcgagctggattccgctaagtggattataggtcgagaagatcaatatggaaattccaaatccgttgagcgagggaggaaagtgttgagtgaattggctttcttcaacatgaagtatgcctatttcgctcgacaaaatttattgcgttga

SEQ ID NO: 43579 - DNA, 387 bp, Glycine max
  Peptide Sequence Number=SeqID_160357
atgaatggacaaacaagccaattggaggaagtgctcactcaattcatggaagcatccatatctaccaacaaaaacattgaggcttccatcaagaagttggaaatgcaagtggaacaattggataggcaattagaagaaaaatccaacaatgaagattgtaaggatgttgttacaagaggtgttttcaaggagacattgccaaaagagataccttatcctttaaatccttccaaagtagataagcaatggcaatatgctcacttcgtggataccttaagtcggttgcaacttaatcttccattccttgaagcattggagcaattttcatcttatgccaaatttatgaaagagtttgatgcaatcctaccccgcaagggcattggatag

SEQ ID NO: 43580 - DNA, 417 bp, Glycine max
  Peptide Sequence Number=SeqID_160358
atgtcgccacacgggggcgacatggatgggggtgaaaaaaggaaagagagggatggggtttctcttgcttttggcatagcgggccccggcgggaggcccgcacgacgggctattagctcagtggtagagcgcgcccctgataattgcgtcgttgtgcctggactgaggatagatggggcgattcaggtgagatccaatgtagatccaactttctcttcactcgtgggatccgggcgatccgggggggaccaccacggctcctctcttctcgagaattcatacatcccttatcagtatatggacagttatctctcgagcacaggtttaggtttggcctcaatggaaaaaagcggagcacctaacaacgtatcttcacagaccaagaactacgagatcgcccctttcattctggagtga

SEQ ID NO: 43581 - DNA, 429 bp, Glycine max
  Peptide Sequence Number=SeqID_160359
atgcacacacaaagtttcacaattccacaatttcctaaaataggcctaactcacaaaaacattccccagtggagtcgccaactgtcgcaacatgcccttttgcgggcacgcgaggcgaggctctcgggtgcgctttccaaaggaggaaatatgcgcggagtcgccacccacgtttatttgtggaaaacgtcggaaaaaccgaaggaaaccggtcgaaaagaaaaattccaagttcggaagttgtatttacgcttgaggaaggtcaacaaaagcggcgctcttgctcctacgtaccctccatcgaagaggaaatcagacctacgtagttcttttttaggggtgaatcaagcgattctttttacttggaaggtgatcattttaaggcgttggaccttaaaaatgatccatttacttggtaagaaaaactga

SEQ ID NO: 43582 - DNA, 173 bp, Glycine max
  Peptide Sequence Number=SeqID_160360
atggcgaagaaaccagtagagaacatgccatttgatataacaagtgatgaacctatgaaaagcatgtcattgtcatcatcaagcaatgcctacaacgtgccatgggtagaaaagtatcgtcccatcaaggtcgccgacattgtcgtcaacgaggacgccatctccaggaaact

SEQ ID NO: 43583 - DNA, 213 bp, Glycine max
  Peptide Sequence Number=SeqID_160361
atggcatgttctctactggtttcttcgccattggcgaaaatgcatattcctatgggtcctcgggtttctactctctgttcttcgacaatgacaaaattctccatcttctttatgatggtcctgaagtttctgcctttactggccacagccatggctggcatctgggaaagctcattaggacgtcagagcatgcttgacggagtagtgaagtga

SEQ ID NO: 43584 - DNA, 231 bp, Glycine max
  Peptide Sequence Number=SeqID_160362
atgttccctcctgggaagatgcctaggaaaggggttttcagaccttactgctggatttgccctgcagttactatttggtccaatttttcttcatacaaatatgttcaaggaaaatccgatttgccgaaaagcgcaccggattgtcagatccctcatttaagactaagtttcaatcctgcttcattcaagttcaaaggcaacagtacatttcccaatgctaaagtcacctaa

SEQ ID NO: 43585 - DNA, 801 bp, Glycine max
  Peptide Sequence Number=SeqID_160363
atgcctatcctttgcaaaccagtgtacattgttgtgacttcattttatgtttatgttcttcaattcagtgactgtttggcctatgaggaggaacatcactctagtagtcacaaaagcactaataacaaagtttacaaggtaaatcagcagaagacatctgatattgcagtacatggattgctcctttgggcttcaacagggtttttgatgcctcttggaatacttatcatcaaagggtccattaaagcagaacctggatctagaaggagtaaagtcctcttctatctccatgttggttttcagatgctttcagtgcttcttgccacagttggagctgcaatgtccctgaagaagtttgagaattcatttgataacagccatcaaaaactaggcctagcactttatggtgctatattggtgcaaggcttgattggatttttcagaccacacagaggaaagaaggagaggagttattggtacttactacattggatactagggactatagtttctcttgtggggatcatcaatatttacactggattaaaagcctaccataagagaaccttaaaaagcacagccctttggactatccttttcactgtggaagtctctttcattggattagtttacctcttccaagacaaattggaatatatgaaaaagcaaggagtgattataggaagtgagtcgtcaattgtgtcgtctaaccaagatattcctcaaagccaaactcaaaaggagttgttgccagttgcatgtggaagaaagagaaatgcacttgagaatttgtttgactaa

SEQ ID NO: 43586 - DNA, 291 bp, Glycine max
  Peptide Sequence Number=SeqID_160364
atggagaacaattttactcacatcgatgacgaggttgttgtcaaagccaaaacaatcagacttgcacctgcaggtctaacctttagattccttattgtgatgttgtggatccaccaccattgtcactatcataatgtcgacaaactcatcatctcagttgcaatgactttgacatcgtccattgcgccaaaacaatcaaatgatgtgtggcggcaacgatggttgaagcacagcgattcaacagtgataaggagacatgggcatgactactactttcatttgcatcattaa

SEQ ID NO: 43587 - DNA, 444 bp, Glycine max
  Peptide Sequence Number=SeqID_160365
atggcttcaaagagagagagaatcttgaaagcgacgtggttgaagaaggaaacagggaaagaagaaaggctcttccacttgaatattgcagcgcccaggagtgtgaaattgtgggagtggaatcaaaaattcagaactgctcctccgcgtttggattattgggtcacgtacatcatggtggggcccgcgttgagtccagcgtgggttctggcttgggggtgtcaaatgaaacgtaacatttttgtaaatctccatattggtgcgacgctcccagaatcggcggatttcagaacttcagagttcaaatgcgaggaattcggaaggaggcgaagcttgttgaagacgaagcgagagttctcagggttttgggatttggggaagaagatggcgacaacgaacagtgaccgcaaagattgttgggggaaagttgcggatccagtgtaa

SEQ ID NO: 43588 - DNA, 366 bp, Glycine max
  Peptide Sequence Number=SeqID_160366
atgtttatatgtagcactgccgctgaaccttgcgtagtggccatatttaacaaccaactgcttctttcttatatggaaagtcttatcttcaaaattgttatgtttaccggaagttctttttcattcttaagggaggattttcgtaaagaatttcaagagcagaatccagatgtaaagtcaatgcgtgatattggcaaggcatgtggagagaagtggaaaacaatgacttatgaggagaaggtacaatactatgatatagcaacaaaaaaacgtgaagaatttgatagcgcaatggcagaatttaacaagaaaatggaaaatggcgagtttgacgaaactgatgatgaatcagagtttgatgagtaa

SEQ ID NO: 43589 - DNA, 165 bp, Glycine max
  Peptide Sequence Number=SeqID_160367
atggcgaaaaaggcaaaagggtctcactctgcttcttctgcctctgcatcttcttcgtccgagtacccgtttctcttcactttctctttctttctcaatctccattccttactctgttctgtttcattttctctgtgctcccctatggaacccagaaaaggaatg

SEQ ID NO: 43590 - DNA, 391 bp, Glycine max
  Peptide Sequence Number=SeqID_160368
ctaagcgagtgcttagtgctaagcccaaagacctctctgcattttaattctttggaattgggcttagcgcgaatgctcgttgtcgcaacctacccttcggcgggagggcgacgcgtgactcgcgggatgcgtgttccacgaaaggaatacgcgcggagtcgccaccaacgtttatttgaggaaaacgtcggaaaaaccggaaaagacgcgatctacgaactttttagtgaaaaggttcgggagttgtatttacgcacggggaaggagagaaacgttaaggcatttggaccattaacgatctcttggggtggtcgacaaaagcggggcttttgctcctacgtatcctcaattgcgatgaggaaatcagacctacgtagttcttgcaaaagcg

SEQ ID NO: 43591 - DNA, 129 bp, Glycine max
  Peptide Sequence Number=SeqID_160369
atgaagcaggattcggttcagaacaattcttgtaggcaccaaattgcgacgatttccgacatgtatcttcaaccgccaagttcaaacgccaaggtcacaaaggctatagtggacaagcttcataagtga

SEQ ID NO: 43592 - DNA, 546 bp, Glycine max
  Peptide Sequence Number=SeqID_160370
atgatctcggaggagggccaactgtgtgagcacaaccagagaaggaggctatcgtgcagctactatgcataccgggacaagattttgctcaaaccgctacagggagacgagcgcggatcatgcacaccgctacaactcttatctccccttgctgaagtgtcagttggtctgtgccgtcataacgtagggatcatgcccacaagacaccaagtggacccggagaagtccaacaggaccttagggttttccatctctggttataggcctctatcaatcctacagggcgcccgtcccccaacaaggtcatgccatcgtgacataggtaagatcgcgcccgcaagacacccagtggacccgaagaagtccaacaggatcctagggtttccaactctgattacgggcctgtgtcaattctacggagtacccgttgccccaacaaggtcatcagactccttattaactgagcttttatcaagaagtattgtgtccccagacaggcacagggtgaggcaccatagcagtcaggggatggccgacagcggataa

SEQ ID NO: 43593 - DNA, 420 bp, Glycine max
  Peptide Sequence Number=SeqID_160371
atggggaaaatggatattgaatccgccacacatgcctcagcaaatggaagaaacgttgcccctacggttaagttttccaacgacactgagaggcttcagcatattaatagcatttgcaaggcccttgtgggtgctcagatgaagcgtgttattgatcttcttctagagtcaaagtatggtattaaggacaaaacagagcttcttcaactggtacgaaagtatcccgagggccttgctgttattgacctcaaggatgcttaccccactgtgatggaagatttgcagacccttgctgcttgtttaggtgcatttgaggagccaaacattattcatgttgatgatattgttgacccagtcagggatttagaggtcattactaaagaattgcggctgaagtttgcaaagcatgtgctcttttaa

SEQ ID NO: 43594 - DNA, 2733 bp, Glycine max
  Peptide Sequence Number=SeqID_160372
atgggctttgatgttgaaattcaagctttgaaagctttcaagaactccatcacagctgacccaaatggggctcttgcagattgggttgacagccaccaccactgcaactggtctggcattgcatgtgatccatcttcaaatcatgtcttttcagtttccctggttagtcttcagctccaaggggagatttctccttttcttggaaacatttctggccttcaagttcttgatttaacttcaaactcattcactggctacattcctgctcagctcagtctttgcactcacctttctcaactatctctttttggaaattctctctcaggtcctattcctcctgaattaggacaccttaaaagcctgcagtatttggatttaggttacaacttcttgaatggaagcctccctgacagcatattcaactacacttatttgttgggaattgcttttactttcaacaaccttactggcagaatcccatcaaacattgggaatctagttaatgctacacagattttaggttatggaaataacttggtagggtctatacctctttccataggtcaattaggagctttgcgagctcttaattttagccaaaacaagttatccggtgtaatacctagagagattggaaatctgacaaatttagaataccttctattgttccaaaattccttgagtgggaaaatcccctccgaggttgctaagtgtagcaagcttttaaaccttgagttatatgaaaatcagtttattggaagtattcctcctgagctaggaaatatagttcagttggagactctgaggttatatcgcaataacttgaattccaccattccatcttccattttccagatgaaatcttctaaccctgcattcaaatgcatttactgggaagatcccttcatcaataacaaacttgacatatctgttaatgagccagaatcttctttcggtgaacttccttcaaacttgggtgatcttcataatttgaagtctcttattttgggcgacaacttctttcatggatccattccccctagcattgccaattgtactagtctagtaaatgttaccatgtctgttaatgctttaagtggaaaaattcctgagggtttttcaagtctaagtttggcaatgaacaacttcagtggattgataaaatcaggtatccagaacctgtctaaactcatacgcctgcagctgaatgtaaattctttcattggatcaattccaccaaagattggaaacttgaatgaactcgtcactttatccctttctgaaaataagttttcaggtcaaattcctccagaactgtccaaactttctcgccttcaggggcttagtctacatgagaatctattagaagcttttagttttggactctctcacaaccagatcacaggatcaattcccagatatgtcattgcatgcttccaagacatgcagatctatcttaacctttcttataaccagttggttggcaatgttccaactgagttgggcatgttggaaatgatacaagctattgacatttcagacaataatcttgcaggtcctattcctgcaaaagcttttagtcatatggacttgcttgaaagcttgaacctctcaagatatcatttagaaggtaaaatccttggaacattggcagaacttgatcgtcttagttccctagatctttctcagaatgacttgaagggaattcctgaaggctttgccaacctttccggcttggtgcatctcaacctttccttcaatcaacttgaaggtcctgtacctaagactggaatatttgaacacattaatgcatctagtatgatgggaaaccaggatctttgtggagcaaatttcctatggccatgtaaagaggcaaaacattcactatccaagaaatgcatatctattattgctgctcttggatcacttgctatacttctattactagtgttggtgattctaattctcaatagagactacaattcagcattgacacttaaaaggttcaacccaaaggagttggagattgcaactggttttttcagtgcagacagcatcgttggtactagcagtttgagcacagtttacaagggtcaaatggaagatgatggccaggttgtagccgtacttggatatgcctgggagagtgggaaaatgaaggctttggttcaagagtacatggagaatgggaatttgaataggatcatacacgacaaaggagtagatcagtctgtaatctccaggtggatattatccgaaagaggagagtgggaagctcatctcagtgactttgggacagctcgaatacttggtcttcatctgcaggatggtagtaccctttcctcattagcagttttgcaagggacagttggctatatggcatcagaattttcctacatgaggaaagtaacaactaaagcagatgtgttcagcttcggtatcatagtaatggagtttctaacaaaaagaagaccgacaggactctcagaagaggatggtttgccaatcactttgcgtgaaaagtgtccagagctcattaagttatccttgtgttgcaccctcccggatcctgaacatcgaccaaatatgaatgagggtcttgatgggttggaaattcttgggaaacggacaggactgcttgaggaggttcacagctgtatcgggagggacaattctggcttccattgtattgaaggaagatgggagaacccaaagtgctttcatgtatcttag

SEQ ID NO: 43595 - DNA, 3492 bp, Glycine max
  Peptide Sequence Number=SeqID_160373
atgttgtccctaaagattagtttgactataggcatagtcctttccattgcatccatagtttcccatgctgaaacaagcttggatgttgaaattcaagctttgaaagctttcaaaaactccatcactgctgacccaaatggggctcttgcagattgggttgacagtcaccaccactgcaactggtctggcattgcatgtgatccaccttcaaatcatgtcatttcaatttccctggttagtcttcagctccaaggggagatttcacctttccttggaaacatttctggccttcaggtttttgatgtaacttcaaactcattctctggctacattccttctcagctcagtctttgcactcaacttactcaactgattcttgttgacaattctttatcaggtcctatccctcctgaattaggaaatcttaaaagcctgcagtatttagacttaggtaacaacttcttgaatggaagcctccctgacagcatattcaactgcacttctttgttgggtattgcttttaatttcaacaaccttactggcagaatcccagcaaacattgggaatccagttaaccttatacagattgcaggttttggaaatagcttggtagggtctatacctctttccgtaggtcaattagccgctttgcgagctcttgattttagccagaacaagttatcaggtgtaatacctcgagagattggaaatctgacaaatttagaataccttgaattgttccaaaattcattgagtgggaaagttccttcagagctaggtaagtgtagcaaacttttaagccttgagttatccgataataagcttgttggaagtattcctcctgagctaggaaatttagttcagttagggacattgaagttacatcggaataacttgaattccaccattccatcttccatattccagttgaaatcattaacaaatttaggcctctcacagaataacttagagggaacaatatcttcagagattggatctatgaactccttgcaagttctaaccctgcacttaaataagtttactgggaagatcccttcgtcaataacaaacttgacaaacttgacatatctgtcaatgagccagaatctcctctcaggtgaacttccttcaaacttgggtgcgcttcatgatttgaagtttcttgttttgaactccaactgctttcatggatccattccctctagcattaccaatattactagtctagtaaatgtaagtttgtcttttaatgctttaactgggaaaattcctgagggtttttcaaggtcgcctaatcttactttcctgtctcttacatccaacaaaatgactggggaaatcccaaatgacctctataactgctcaaatcttagcactctaagtttggcaatgaacaacttcagtggattgataaaatcagatatccagaatctctctaaactcatacgcctgcagctgaatggaaattctttcataggaccaattccaccagagatcggaaacttgaatcaactcgtcactttatccctttctgaaaatacgttttcaggtcaaattcctccagaactttccaaactttctcaccttcaggggatctctctctatgacaatgaactacaaggtacaatacctgataagctctctgaattaaaagaactaacagaacttttgctgcatcaaaataagttggttggtcaaatacctgattctctctcaaagcttgagatgctttcatacttagaccttcatggcaacaaacttaatgggtccattccaagaagcatgggaaagcttaaccatcttttagcattggatctctctcacaaccagctcacaggaataattcctggagatgtcattgcacacttcaaagacattcagatgtatctcaacctttcttacaaccacttggttggaaatgttccaactgagttgggcatgttgggaatgatacaagctattgatatttcaaacaataatctttcgggtttcattcccaaaacacttgctgggtgcagaaatcttttcaatcttgatttttcaggaaacaatatttcaggtcctattcctgcagaagcttttagtcacatggacttgcttgaaagcttgaacctctcaagaaatcatttaaaaggtgaaatccctgaaatattggcagagcttgatcgtcttagttccctagatctttctcagaatgacttgaagggaactattcctgagggctttgccaatctttccaacttggtgcatctcaacctttcattcaatcaacttgaaggtcatgtaccaaaaactggaatatttgcacacatcaatgcatctagtattgtgggaaaccgggatctttgtggagctaagttcctaccaccatgcagagagacaaaacattcgctgtccaagaagagcatatctattattgcttcacttggatctcttgctatgcttctacttttgctgattctagttctcaatcgaggcaccaaattctgcaattctaaagaaagagatgctagtgtgaatcatggaccagactacaattcagcattgacacttaaaaggttcaatccaaacgagttggagattgccactggttttttcagtgcagacagcatcataggtgctagcagtttgagcacagtttacaagggtcaaatggaagatggccgggttgtagccataaaaagattgaatttgcaacaattctctgccaaaactgacaagatcttcaagagagaagccaacaccttgagccagatgagacataggaatttggtcaaggtacttggatatgcctgggagagtgggaaaatgaaggctttggttctagagtacatggagaatgggaacttggagaacatcatacatggaaaaggggtagatcagtctgtgatctctaggtggacattatctgaaagagtccgagttttcatttctattgctagtgcattggattatttgcactctggttatgattttcccattgtacactgtgatataaagccttctaacatccttttagacagagagtgggaagctcatgtcagtgactttgggacagcacgaatacttggtcttcatgagcaggctggtagtaccctttcctcatcagcagctttgcaaggcacagttggttatatggcaccagaatttgcttacatgaggaaagtaaccactaaagcggatgtgttcagctttggtatcatagtaatggagtttctaacaaaaagaaggccaacagggctctcagaagaggaaggtttgccaatcactttgcgtgaagtagtagcaaaagcccttgcaaatggaatagaacaatttgtcaatattgtggaccctttgttgacctggaatgttacaaaagaacatgatgaagtgttggcagagctctttaagctatccctgtgctgcaccctccctgatcctgaacatcgacccaacacaaatgaggttttatctgcccttgtgaagcttcaaacaacactgtcttgttaa

SEQ ID NO: 43596 - DNA, 654 bp, Glycine max
  Peptide Sequence Number=SeqID_160374
atggacaacaaaattcgaccattatcagtgtcatcgcattccaatttcttctcctcactaaaacaggttgaaaaaaggttaaaattagaccaaactttacaaccagcaatagaatctcagatacaagaaagcactttgggttctcccatcttccttcaatccagtggtagccagatttgtccctcccaagatagcagtgaacctcctcaagcattcctctcagtttcccaagaatttccaacaatcaatcaagacccttctcattctcaaacagatcacatcacttctgcaaatgaagctgaagacaatgatgatgatgatgacattgaacagttaatgcagctcttggggttatcagaggtaaaagaacaaagggatggtgattttgatgaaggtgattcatgccactgtgacggtggcttttatgcaaaaattgttggtgtggaagggccaaagtgtaggaaagaggtgctgaggttagatgggtggatcaaccactttatgaatggtggtggggaggagaagcaagagcctttgagattggcacacctgcttttggggaaatctgcttttgtttctgatggtgcttttggagaattggatttcccttcaaccattcaagaatttcttcatactgatcctcccactgattga

SEQ ID NO: 43597 - DNA, 216 bp, Glycine max
  Peptide Sequence Number=SeqID_160375
atggctcgcttagcgtgcataagtggcttttggcttagtgccagtcttctcgctcagcgcggagtattgcaggagattcttctctgcactcaaccaacaatggttacgcttagcggattgctcgctcagcggatgaattggcttagcgagttgacaatttctacactttaccaatcttgcctatttcacctgaaattgatatggaaggatcattaa

SEQ ID NO: 43598 - DNA, 468 bp, Glycine max
  Peptide Sequence Number=SeqID_160376
atgaaaatatttcaaagcaacaaagaaggagctaggaagaagaaacccaacgatctcgaggtgaatcttaagaatgaaaatatcattacattcaccaaaaatttcatgaaagtaagaagaggtatgcctttgaatttcattttcagcatttgtttaaagacaaggaagaaggacaatccaatagtgatgacaatctttgttgctactgcgatcagagtgaatgagaaggctattttagagatagaagaatctttccatttggctttcttcggtggcgagaaaagatgtataaaagctgcagaagctaccagagccattgctatagagtttgttaccatgaatgctttcaagaggctctttgcccccaaaatagggctacctttatgttcaccatcttgtatggtacctcctagtggcgtaatctcaactacaaagcttacggttgcaattgtaaccactaatagatga

SEQ ID NO: 43599 - DNA, 591 bp, Glycine max
  Peptide Sequence Number=SeqID_160377
atgcagggagggcatggtctccattcaacactctctgcccactccaaaaagttcattggtattcttaatggtattgatactgatgcatggaatcctgccaccgatgcatttcttccagtccagtacaatgcaactgatcttcaagggaaagcagagaataagcaagccttgagaaggaacctaggtctttcatctacagatgttaggaggccattggttggctgtataacaagactggttccacaaaaaggtgttcatcttattagacatgcaatatatctaacattggagttgggaggacaatttgttctacttggttcaagtccagtgccacacattcagaatgaatttgagggcattgccaaccactttcagaatcatgatcacataaggttgatattgaagtatgatgaatctctctcccatgtcatttatgctgcgtctgacatgttcatcattccatcaatctttgaaccttgtggcctaacacaggtgacatccaatgggactagatggtctacaagcgagttaagggcagatataaggaaagggctagattcagatttgggaacaagacctggggtttctgag

SEQ ID NO: 43600 - DNA, 201 bp, Glycine max
  Peptide Sequence Number=SeqID_160378
atggtattatggtacacttttcacaccttaccaccacctctcttgtccccaactacaccttaccaacatgatggtgaagctaacatgcttggggggaagaaggatagtgtggttgcgctgttgcagttgaggattgttggtagccggaagaagaaggctaccaggaatcgtgatgatttgcgacaaagagaagaatggtaa

SEQ ID NO: 43601 - DNA, 2262 bp, Glycine max
  Peptide Sequence Number=SeqID_160379
atggcgtcgaagctgagaacgtgcttcgtgtgctggaacctgagcggtttcaactgcgttaaccaccacaacgccaataataattgggtagtgcgagtttcgtttccagcttcttgcaaaatgcgacaccgcgccactttcagttcacagcataagagacaacagatcaagccttccgcagagggaggtctccgtcaaaatcaagatgaagaagacgacaccgaggtttcgttgaacaacgatgattctgtggagaatttgaatgatgccaccgcgcctttggccataaacataaatggagcagagcaggctgaacagttgtctggtaggcaacttgaggatttgctggtcatgataaaaaatgcagagaaaaacattcttcttttaaatgaggctaggattcgtgcatgtgaagatcttgaaaagattcttgtagaaaaggaagcattgcaaggagagattaatgtcttggagacaaggttggctgagactgatgcacggattacagttgccaaccaggaaaagatacatgtggaattcttggaggggcagctagagaaactgcgtaatgagttggcccaaaagggaagtactgaaagaaaatatgctgaattgcatgaccttcaaaatgatgatttgagtgatgcaaaccctctaagtcataatgttagcattcattcccttactgaggagcttaattcattaagagcagaaaatgcctctttgaagaatgccatagaatcatttaaaacccagcttagtgatgtcaagaataatgatgaacgtttggttgcattggaaaaggaacggtcctctttggaatcagccctaaaagacttggaatcgaaactatcaatctctcaggatggtgtatcacaaatttctacgcttacagttgaatgcaaggatctgtgggataaggttgaaaatttgcaatcattgctagataaagcaaccaaacaagctgatcaagctgttcttgtgctgcaacaaaaccaagatcttcgaaggaaggtggataaattggaagcatctcttgaagaagctaatatctataagctatcatctgacaaattgcaaaaatataatgaactaatgcaacaaaagataaaactattggaggatcgtcttcaaaaatcagatgaagagataaattcttatgtttggctatatcaacagtcagtgaaggaatttcaagatacacttgatactctgaaaaaagaaagcaagaaaaggaatttggaagaaccggtggaagatatgccgtgggaattttggagtcaactgttacttcttattgatggttggacactagaaaataaaatatcagtagatgatgcaagtcttttgcgagaaaaggtgtggaagagagacaggcgtattagtgatacctatatagcttgcaaaaaacaaactgaacaggaggctatttctgcatttcttgggcttttatcatctgcgacaagtccaggattgcacgtgattcatattgcagcagagatggcaccagtagctaaggttggtggtttgggggatgttgtcagtggtctaggtaaagcactgcaaaagaaaggacaccttgttgaaattgtgcttcccaaatatgattgtatgcaatatgaccgtgtctgtgacttacgggctttggatgtgctgatagattcatactttgatcgtcaattatacaaaaataaaatctgggttggcactatagaaggccttcctgtttatttcattgagccccatcatcctgataagttcttctggagaggaaaattttatggcgagcatgatgatttcagacgattttcattttttagccgtgcagctcttgagtttcttcttcaagctggcaagaagccagacatcattcattgccatgattggcagacagcattcattgctcctctgtactgggatatatatgccccaaaaggattaaattcagctaggatttgctttacatgccacaactttgagtatcaaggaactgcggcagcttcagagttagaatcatgtggtcttgaaagccaccatctaaacagaccagacagaatgcaggacaactcagcgcatgatagagttaattctgtcaagggtggaattgttttctcaaacattgtgacaacagtttcacctacttacgcccaagaagtgagaacttcagaggagagttggtccttgacttggtatttgagtctttatgaacaagtggttaagaaattgatttttgctgcttctgtctttccaatcaaacaatag

SEQ ID NO: 43602 - DNA, 1152 bp, Glycine max
  Peptide Sequence Number=SeqID_160380
atgactcatcaacattttctggaaaaaacatactttaccttaatcggcatcaaacagaagagtggaaaggatggatgcagtaatggttcatctgttcaagcttttgttccatttgttcaggtcctctttttaatgtatcattattttgctgcaacggagatatacaatgcaatacgtgttttcattgctgcatatgtttggatgactggatttggaaacttctcctattattatgttagaaaagattttagccttccacgttttgctcagatgatgtggcggcttaatttttttgtggccttctgttgtattgtgcttaacaatgactatatgctctactatatatgcccaatgcacacgcttttcactttgatggtgtatggagcattgggtatatataacaagtataatgaaattccctctgtaatggctgcaaagattttggcatgctttcttgtggtgatcttggtttgggaaatccctggattctttgacatattttggagcccatttgctttatttttgggttatactgatcctgcaaagcctgatctccctcgaatgcatgagtggcatttcagatctgggcttgatcgctacatctggataattggaatgatttatgcctattttcatccaaatgttgagaaatggatggaaaaattggaagagagtgataccaagaggagagttaccatcaaaactggcatcgtttctgttgcattatttgttgggtacttgtggtatgaatacatatacaagctggacaaggtctcatacaacaagctccacccctacacctcttggattccaattacgtggcttggcaagattactttggagacatacatttcccagtttcatatttggttaaggtctaacatgccaaacggacagcccaagtggcttctttctcttatcccggagtatcctatgctcaacttcatgctaacaactgctatatacgtctttgtatctcatcgactttttgaattaacaaatacacttaagacagtgttcatacctacaaaagacaatcggaggctgctgcataattttattactggtgttaccctttgcatttctctgtattgcattgcacttattctgcttctgattcctcattcaacggtgcctgttacatgttgctaa

SEQ ID NO: 43603 - DNA, 255 bp, Glycine max
  Peptide Sequence Number=SeqID_160381
atgagtaatgagaagattggaaggattcgtgtggtcggagatggtggtttcggggccaatcacgccggggcagcaagtagtgagattgttcagtctggatttggatggtgtgtggaagcaaagggaattcgttttttgagttggattgagagcaattgtgtgtctttcttgctgggggttattccagtttttgtttcatggatatattcagagtacttagagtacaagaaactctcatctcctcccaaagtgtaa

SEQ ID NO: 43604 - DNA, 183 bp, Glycine max
  Peptide Sequence Number=SeqID_160382
atgtcttatacgttgatgaagatttgggtcatagagaaaaggaaagatcacagtgttgatgacctccttattgatggcaacgaaggcaacgacaatggaagtgttagagttcaagacaatgaccttttcgttgacggtgacaaaagcaacgacaacatagatgtcacagttcaagggcactga

SEQ ID NO: 43605 - DNA, 192 bp, Glycine max
  Peptide Sequence Number=SeqID_160383
atggtaagctatttcaccctcttggttcctccattcttgcacctcgcaacacctcacgcagggaacaacatcattagtccttgcatgactaagaagggaaagaaggagcctagatctaagctaaagactacggattgtgatggagagaacaggagcgcgacggagaacaacgtttggccgccaagaaagtga

SEQ ID NO: 43606 - DNA, 747 bp, Glycine max
  Peptide Sequence Number=SeqID_160384
atggctatgcaaaattcatcgtatactatcattctttttagggagttgctaggtgcacccagcaatattgctggtgcacccagcaatttattgaaagcttttctcctctcttctctcttccgcgaaaaagcattctgtcttcttctcttcttctccgcgaggcttctccggcttcatcttctccgcgaggcttgtcttccatttgcattcgaggacgccggaaaaaatggcggaagcttggtgacggtgagccttccggaagacccgttaggggttattccggaacttccggaagaagggttcttccgtagatgtacttgttccggaaacattccggaagagggtttttccggatggcctttcagtggttccggaagcactttccggaagagccttcttccggaattgttccggaagaagtacttcttccggaaagatagagctgctgacgaggatgctgacgatgttcccgagaggcgtaggcctactgcctcagcccgtaggctacgcgttcatcagatgactacggagggacgtgatatggctgaggacgtcgctgacatgactgatgatgtccctgagcagcctacggaggcacctgagatgcgtgcggacgcacagggtgctgatagtggtgaggggtcagatggtgatgatgctgcagagggattccctggtggtccacgtgacccgtcagtgctcacatcatttgccgagcatgttgcacatgccgtgtggagtggacag

SEQ ID NO: 43607 - DNA, 240 bp, Glycine max
  Peptide Sequence Number=SeqID_160385
atggagagctgcaagattgctatacttctcactatctacattatggctatgttggtttttgctcactgttgtgtggctgagaatgtagctgaagatgttgcggcaattccacctgcaccaatggaaagtgcaggagtgcatctttgtgcctcagctgtctttttagccactgcttttgtggttgctagtgggttgatgtttgtgaaaacagagttgggatctggaaattcatccatgtaa

SEQ ID NO: 43608 - DNA, 336 bp, Glycine max
  Peptide Sequence Number=SeqID_160386
atgggaagcgaagatgcgaaagatccattcaaaggggtggattggaaagccgttggtggcgagatgcagcaaaatccgagtgctaaacctgcattgaagaaacgattaccgaagaaagttagggaaattcctgaattctatttccttccacgatggccgctgcccaaggccattttattctgcagcgcatgcattggtggtggtgtagctgctggaatgcttattgagacctggattgaaaagaaagttaaagcgatttctgatttttctaatgctcctaaagtactgccaaagttgagtgaacaactactctcatgggagctagttacatcttaa

SEQ ID NO: 43609 - DNA, 1063 bp, Glycine max
  Peptide Sequence Number=SeqID_160387
atgggaggtttaacggtgttttctgacggtgttcaggctctgattgagaaggggcacaggaagataacgccgttttttattccgtatgccattactaacatgggttcggctttgcttgggatagaccttgggttcatgggtcccaactattctatatccacggcttgtgctacctccaactattgcttttatgctgcggcgaaccatattcggagaggggaggctgatttgatgattgcgggtgggactgaggctgccattattccaattgggttagggggtttcgttgcttgcagggcgctttcgcagaggaatgatgaccccaaaactgcttccaggccgtgggataaggaccgtgatggctttgttatgggcgaaggtgctggagttttggtaatggagagcttggaacatgccatgaagcgaggcgcacctattattgctgaatacttgggaggtgctgttaactgtgatgcttatcacatgactgatccaaggtctgatggacttggtgtgtctacatgcattcagagcagccttgaagatgcgggtgtgtcaccagaggaggcagagagtggcataactgcctacacatgtggcaatggatatgggaaggtgggagaactctctacaggaggggagaaccgagaaaaagggttggaagatgaagggagaaatgggggatcacagggaaccaagcacatccatcaattgcctaatgcctctgctgggctgagttttggtataatgccaaccatggatgattggaaactcaaagttcaaccaaataaggccttaaatatcaggattagcatagatgacattattgatgttctggtgatgtgtcagaaacttcccgactttctcctagaggacaaggtgaaaatgcatggggggcaacacggcacaatagcgaacaatgaccctttgttccctattgtgccgtgttgcaaattgttgggggatagtcttagctggcaggttgtaatcgtcatagaggttcctgttaggttgtttgacattgcacttgcaccaagaacacagatgcagcaggaacttttag

SEQ ID NO: 43610 - DNA, 945 bp, Glycine max
  Peptide Sequence Number=SeqID_160388
atgtactttgcaataacaataaagagataccgagctgtgaaggaagttggacaaattaagatgagtgttggagttaaccaattgatgcttgtttgccaggccgaatattttcgtcagttgcttaaacctgttacgaacttccttccagctttagtacagaataattgccagttgcataggctaaatcagcattgcttgctcgaacgtcagtcagattcaacagataatataatgcagactcaggaatattttctcccggataagatggtacttcctttggcagatgaggccattgatcctcatatgcgtgctccacttgcttctgcctttgatgcatatttacctccaggtgtgaggcagataacacccttcgaaagatttaatgtgcaaccctctgaggcttgccccaagaactttgttatctttgatcaaacagatcaacgaagcaggatcatgttccatcctgcaatgacctacaaatttaacagtcctggcttaaatgttcatgctactggttctcaagattttgagaaaaataaagccaatcaaatggaaagagaagtgtcatctccttttgaagaagatcctaatgacattgacgcattgttgagcataggagtggatgaactagatgactttgacgaggaagaagtcagcacagcaaggactcaagaaaattatgaaagtttatccgatacttgctccagttattgctcaaaatcaaggaagaggtcatcgtcatcttctgtacagaagtcgtctggggccgggggtttctgccacaatgaagggaagcactgggagatgaagaggatggtgaggatgttgagaaagattgtgccaggtggaggtaatcaaatggattctgttgctgttttagatgaagctgtaaaatacctcaagtctctcaaagttgaggttgaacaattcggggttgaaccatga

SEQ ID NO: 43611 - DNA, 435 bp, Glycine max
  Peptide Sequence Number=SeqID_160389
atgagcaaagtgagagccgagaaaccttcatctgaaatgtggaagttttctcaggttgcaggtttaactattgtctctgtaatatgcttcacatcaagttcctgtgtagaacttttaaccgacatccctatgcagtataactggcatcagcggcgtctgaatgatgtttactcctctcttttactcattttgtattattttgtgggttcatcaataccttcagcagtggtactgtgggtaatgagagaattaccacctgaagaagctgctagcatacccgaagaatcaagtacaatagcttttgttgctgatagttcaattgcaatccatcatcctcaacgctgggctacagcaacaagcatgcagaatcagagtgagcatattcttctatcctgcttgcaagctgaattatctgtgtcgagaaggatattttga

SEQ ID NO: 43612 - DNA, 258 bp, Glycine max
  Peptide Sequence Number=SeqID_160390
atgtcgggattcagagacactcacggttttcctcgtccaatcctcgctgtgaatctcgctctcgctcttctccacgccgccgttgcgttcctcgcgttctttcagttgctgagaattcacatgaggaatgcgcagcttggttggactcggcaaaagtgcagtagcctcactgtgaacaacaatgatggggtttctaatgcaacattcgttagagcattaggatacgagttactggtccaatgtgtgtatactgtctag

SEQ ID NO: 43613 - DNA, 159 bp, Glycine max
  Peptide Sequence Number=SeqID_160391
atggttatggggagctatctgcttggagccaactatgtaattggatttttggatgttactattattcatcaattagttaccattgtccgcaacgttttcagtttagagtgggggcatgcggacaagcatgtcatgggagaaaagcctattggcaaatga

SEQ ID NO: 43614 - DNA, 471 bp, Glycine max
  Peptide Sequence Number=SeqID_160392
atgacatttggtttaactaatgcacctagtaccttcatgagctcgaaaagaataagtgtggatgaagaaaaggtaaaggaaatcagggaatggcctgtacctaagaatgttaatgaggagattgattgggtttgtgttcatgcgaggaaagcaagattccctgctcaaagaaaatccaagttgcaactaagaggagatagaccttttcaatttcttgaaaagataaatgacaatgtttacaagctagacttgccaagaaaatatggtgacgaatcaaatttaaggacgaatacttatgaagaaggagagaatgatgaaggtgcaacaagtttgtttaatgatcctttacatgggattggaggtactgcgacaaggttcaagactaagaggatgaaacaagatttgcgaggcctaattctaaatatcaaagagaaagaaaaccaatgtgaattaagggctgctcctaattga

SEQ ID NO: 43615 - DNA, 288 bp, Glycine max
  Peptide Sequence Number=SeqID_160393
ggatcgcgcctgcaagacacccagtggacccgaagaagtccaacaaggtcttggagttgtcaagctctaattacgggtctctgtcagttctacggagtgcttgtcacctccggcaagggcatcaggccccctactaatcgagctttcatcaagaagtactgcgtccccaggcaggcgcagggcgaaacaccacagcagcctgggcgaaataccatcacctctagagttcacctcagctcatccacaaaaaggttagagcgttgcttacgacccatggccgaccaatag

SEQ ID NO: 43616 - DNA, 642 bp, Glycine max
  Peptide Sequence Number=SeqID_160394
atgaaggataaattattcgtattaataacaggatttgagaaatttggaggagagaaaataaatccaagtgaaaatattatcaaaaaaattcgaaagaaaaaattcgacaacgttctgattgatactatagtcttgccggttagctatgagaaaagtattaaaattcttgaggagtactattctaaaaaccaagttgatgtagcaattcatttagggcaagctgggggaagagcaactattaatcttgaaagggttgctatcaatcttatggattctatccacccggataatgataatgtaacgttaagcgataaaaagattatcgaagatggaaacgacgcatacatgacaaaaataaaaataaaagaacttgcggaatttttaaataagaagaacatcccaacaagcatatcatatacggcaggacagtatatatgtaatgaagtttattatttttcactttacaattccgagaaaagtagtaatccaaagttttctctattcatacacgtgccatttttgcctcagcaagtaagtgaaaagtaccccaagaatgataaattgccgtcaatgcctattcagttacaatttaaagctgttatggagaatttcgcttggaacaccggcaacttctctttttag

SEQ ID NO: 43617 - DNA, 345 bp, Glycine max
  Peptide Sequence Number=SeqID_160395
gcgatgatgacatcgttgaaaagtttgcgctttaccgcacttaccatggctgcgccatgaaccctgccgtacaggcagccagtatcgtggcatggaatgacgaagcgcatgtcatacacaaccgtgcgctttacagcgaaaaatttaatgccgtcaccccggtcttacaacaggtatggcagaagacccaattacccgatgccgctttttacctgtggatcaatacagaacaagacgatacagtggtcgctaagcaactgtatcaagcgttgaatattaccgtattgccaagctccttcctcgcacgcgaggctaacggaatcaatcctgacaaaggatttattc

SEQ ID NO: 43618 - DNA, 503 bp, Glycine max
  Peptide Sequence Number=SeqID_160396
gcccgtctatctgctacaaggtcaccgctcgtgcgtcgaaaaaggaaaggattctatcttcatgcgaaggatgtccaaatgttcccttgatgggaacaaggggttgtattaattataatcccgtcctcgccataagacagcttggctaccccatgagaggagtgccatcagacgaaagcatcatgcctttcattgcacggggtttcagtgaccacaacgcgagggacagagagcttaggggaagcagtaatgggatcatcggcggctatcataagtggctgagagtccggacacaaggattggattggctcccaaatctaaagactgtgagagacaatgaggttaaagcttcggaagaaagtgatcaggtacaagccctaaaggcaaagcttgaaagagcccgggtagtcaaagagaagttcaagtccatagccatcaaaggcagcaatagtgagctcaaactccgaagaggtgaaaggaatcatcacgggtcaaaggcatga

SEQ ID NO: 43619 - DNA, 435 bp, Glycine max
  Peptide Sequence Number=SeqID_160397
atggctggtacattcttccttttgaaacagcaaaataatttagataattatgagcgggacgccacatcgcgcctttcattgtatggagtttcagtgacctcaacgcaaggatacttcaaggagttcacaaggcatgggatgcagtgcaaaggaaggacaaagagcttaagggaagtagtaatgggatcatcgacggctatcctaagggctgcaagagaggaagaggccgaagctccggaagaaagtgaggaggtacaagccctaaaggcgaaacttgagaaaggccaagcaatcaaggagaagttcaagtcaacagccatcaaagtccgaagggagtgtgatgaactgaaggatatcaacatggccactgccgaagacttggaacgggaaaccaagagggcccggaagaaagaacatggccgaaacaagttctga

SEQ ID NO: 43620 - DNA, 441 bp, Glycine max
  Peptide Sequence Number=SeqID_160398
atggaaatgtttattcattcaattgatcctgatgcatggaattctatttttaaaggtccattcataccaactaaagacttaaatggtgaattggtacctaaagaatgggatgagatgaaagatgacgagaaaagaaaagtgcaagatgataaaaaagctaaagacattttaacttttggtgaaaaattgcgaaggagatatggaaaatgcttgaagtcactcatgaatgtagaagcaaggcttcatgatgaatgtgattcaaagatgatgacaaaggtgatgaacaaaaagctcaaagatcaaagaacaactaaagtgaatcaaagaacaattcaagagttcaagaatcaagaagaattcaagactcaaggagaaagcctagaatcaagaatcaagattcaagattcaagatctcaagaatcaagatcaagattcaagtga

SEQ ID NO: 43621 - DNA, 249 bp, Glycine max
  Peptide Sequence Number=SeqID_160399
tccatgtgggataattggcaaaacaactggcagaccgacccgttaagcaactttggagccaacagagagaagaatcctaaggaggagtgcaaggctgttatgactagaagcaaaatggtgagcatgaatgaaggtgagaagaggataggtgaagaaaaacaacagctggtaactgaaccaaaaattgatctagtggtggaacctttgagtgagactgaggaagaagtggaagcagaagatgatcagtag

SEQ ID NO: 43622 - DNA, 738 bp, Glycine max
  Peptide Sequence Number=SeqID_160400
aagcacttggaagagaaagcgaaagctttggcggatcaaggagagtggacttcattcattgatgttttagcactgttggtgttcgggttcatcctctttccaaatgtggatgggctagtggatctagcgacaatcgatgtttttcttgcttatcactatagcaaggaaagtcccgcaattgttgttttggccgatgcctacgatatgttcgatcagagatgcgagaagagcagcgcgagaattgactgttgcacacccgctctttatgtatggctggtcgctcacatttttcatcatgaaagtagacctgtctgtcacatacaaggtcaccgcatgtgtgctgagaaagggaaagcaaattgggagcagctcttggtagggttcccaaacgtccccttgatgggaatgaggggggcaccatcggaagagagtatcacgcctttcatcgcacgaggcttcagtgaccccaacgcaagaatgcttcaaagagtccgaaaagcatggaatgcagtgcaaagaaaggataaggagcttaaaggaagcagtaatggcattattggcgaatatcataaatggttaaaggctcggatgcgagagatatcttggctcccgaagctaaagatttcaagtggggaagaggctaaagtccctgaggagagcgaagaagtgctagccttgaaagcagaacttgaaagaacgcgagtggtcaaggaaaagttcaagacgatagccatcagg

SEQ ID NO: 43623 - DNA, 328 bp, Glycine max
  Peptide Sequence Number=SeqID_160401
atgaacggggctaagcgatctgccgaagctgtgggatgtaaaaaagaatcggtaggggagcgttccgccttagagggaaggacccgcgcgagcagtgctggacgaagcggaagcgagaatgtcggcttgagtaacgcaaacgttggtgagaatccaatgcctcgaaaacccaagggttcctccgcaagggtaataaggggtagagaaaatgcctcgagccaaagttcgagtaccaggcgctacagcgctgaagtaatccatgccatactcccaggaaaagctcgaacgaccttcaacaaatgggtacctgtacccgaaaccgacacag

SEQ ID NO: 43624 - DNA, 444 bp, Glycine max
  Peptide Sequence Number=SeqID_160402
atggaagggttagtggacctagcagcgattgacgctttcctcgcctttcatcatggcaaggaaagcctggtcgtcgtcattttggccatgtatgacacgttcgaccggggatgtgaaaagagcggcgcaagaattgaaggaagaatcaggattctatcttcatgcgaaggatgtcccatgagaggagtgccatcagacgaaagcatcatgcctttcatcgcacgaggtttcagtgaccacaacgcgaggactgtgagagacgatgaggttaaagcttcggaagaaagtgatgaggtacaagccctaaaggcagagcttgaaagagcctgggtagtcgaagagaagttcaaggcagcaatagtgagctcaagctccgaagaggtgaaaggaatcatcacgggtcaaaggcatgatcttgaaggacgagctaaaggcttgccttag

SEQ ID NO: 43625 - DNA, 696 bp, Glycine max
  Peptide Sequence Number=SeqID_160403
atgagccatcagggcgcagtaggcggtcaggcgatgcaaatagcggtagcgacgtcggcgctggtgatgctgtgcacgtcgctgttggcaagcggccgccacctgcgcgccggaacggttcactggcgctccctgctgccgatacttggcggcatcgccatcggcggtattgccggcgcggcgctggcgctgaaggtcaacggcgagtggatccgctggctgttcattttgtacctggcggtgaccattgtggattgctacgctcgccccggctttatggcgccgtcgacggcttgcgcaccgtcgagtgcagggcgcgagactatccttggcggcgggattggcctgattgccgccttccttggcgttggcggcagcgtgatgaccgtgccgctgatgcgccggcgtggcgcgacgatggcgcaggccgcggcaatggccaacctgctgacgctgccgctggcggcgaccgccagcctgacgtggctgctgatggcgccgatggcggcgctgccctccggtttcatcggtaatatctggtggctggcggccgggctgctggtggccgggagctggttgggattgcggggcgcatcgcgctggttggcaaaactccccgatcgctggcacgtgcggatctacccgctactattgctactggtgttgctggcgatgggctttggcggggtgggctga

SEQ ID NO: 43626 - DNA, 994 bp, Glycine max
  Peptide Sequence Number=SeqID_160404
atggctgacagaggaggaaagagcatgaccgttgacagactaaaacgcgatctgctgaacaagctgatcaatgcccgaatcgacctggccgcgtacctgcagttgaggaaggcaaaagggtatatgtcagtcagcgaaagcgaacatctgcgtgataacctgtttgaactttgcaatttcatgcgtgaaaaagcaccgaccctgaaggcgaattacggcgaaagcgaacttatcgcactgcgccgcgccgccgaggtgctctccattgcaggggtgtgtctgatgaacggacgccacgactgcccgaattttatcgccgtaaacgcggagaagcttgaaaactgcctgacaacgctctctctatgcatcatggttgagatgctgcaaaacagactcgatcatccctggtctctggcgtttctgccggacaataacgggctgctggtaaccctgaagggcggccagcttaaacactggcaggccgggaaagggctttccgatccgatcgtcggtgtaccaaaggtttgggcaaacgggcagggcggattgctggatgtcgtcctcgccccggattttaaacaatcacgccgcatctggctcagctacgccgaagcgggaaaagacggcaaagccggaacggcagtaggctatggccggttaagtgacgatctgacgcgcattgaggctttccaggtggtgttccgccagacgccgaaactctctaccggtaaccattttggtggccgactggtgttcgacggcaaaggctatctctttatcggactcggcgagaacaaccagcgcccgacggcgcaggatctggacaagctacagggtaaagtcgtgcgtctgacggaggacggaaacgtgccgccggataacccgtttgtgcgtacgcccggcgcgcggccggaaatctggtcttacggcattcgtaatccgcagggaatggcgatgaacccctggagcgatacgctgtggctgaacgagcacg

SEQ ID NO: 43627 - DNA, 312 bp, Glycine max
  Peptide Sequence Number=SeqID_160405
atgggtgatcaagaggagacacaggaacagatgaaagccgacatgtcagctttgaaagaacaaatggcttccatgatggaggtcatgttaggaatgagacaactcatggagaaaaacgtggccaccgctgtcgctgttagttcggctgccgaagcaaacccaactctcctagctaccgtgcaccatcctccctctatttttgttgaacccagtgtttcctctaaatggtcatttagaaacgaaatgctaacatccaaaatctcatttatggttatgagcatatctcatcagcatactccctttccctggtag

SEQ ID NO: 43628 - DNA, 641 bp, Glycine max
  Peptide Sequence Number=SeqID_160406
atgcaacattggaaagaagcaaacattaaataccacactaaaggcctatcatctactttcttctgcaaatcctttttcattcctctgtccaaactctactttcacgccatacaaaaaatgagcaccacatcctcaaccgcatcaactaagaggaaaaatgccatcatgcgaccaccacggatcatgcaatttatcgctgccttcaacaatgacaagaataccatacaacttccagccttctatcatactcaatgggcaccaaactatcctgagatggctcatctcagatacaatggagccatttatgaagtacaagtaagacaacacagagataaagtgtatttagcagatggactccaaagcttccggaaagatttgaaaatttatgagtcaaccaacatcaacttctttgcatgtgaccatcactctgtttttgacatacatttcataccaccatcggagcggcaaacttgcggcaggcaaaggcattcatccagaaaaaaactcccccattgtacaaaagttcctcttagaacttgcggcaaccacatgacagttttaaggcggcatggccccccactgcaatggaaagttgaaacgctgaatcctgctattggtggaaaaggtgttgtccaaccatg

SEQ ID NO: 43629 - DNA, 204 bp, Glycine max
  Peptide Sequence Number=SeqID_160407
agccagggctttacttcttttccgtgccctactccggaccagttcagggcagaggtcgcatggcctggggattggcctgaggcccaagcaggagaggcaccagtaggggcaccagcagaggcccccgacgaggtagatgaggcccgcgaggacgaggagacgaccgatttacttgatttcttacgaggaagcggggccacatga

SEQ ID NO: 43630 - DNA, 743 bp, Glycine max
  Peptide Sequence Number=SeqID_160408
gactacacgtccttgcctacaaagggctacacgccctcgccttcaaaggattatacgtcctcaccttcagcgggttgcacgccctcgccttcagaggactacacgtcctcgccttcagagggctacatgccctcgccttcagaggattacacgtcctcgcctttagaggactatacgtcctcgccttcagaggactacacgtcctcgccttcagaggactatacgtcctcactttcagaggactacacatcctcgccttcagaggactacacgtcctcgccatcagaggactacacgtcctcgccatcagagggctgcacgccctcaccttcagaggactacatgtcctcaccttcagaggactacatgtcctcactttcagagggctacacgtcctcaccttcagaggactacacgtcctcacctttagagggctgcatgccctcgccttcagaggactaaacgtcctcgctgtcagaggactagacgtccttgcctttagagggctgcagcccctcgccttcagagggctgcagcccctcgcctttagatggctgcatgccctttccttgagaggactatgtgtccttaccttcagaggactacacgtcctcgccctcagaggactacacgtcctccacttcagaggactacatgtcctcgccttcagagggctacatgctctcgccttcaatgggctccacatccgcaccttaagagaatttaaggtcctctacccttaa

SEQ ID NO: 43631 - DNA, 489 bp, Glycine max
  Peptide Sequence Number=SeqID_160409
atgcggacacaccttatggttatccgcaccttttgtcagctagaggcaagcgagcccattgacacgcagagacaaacgtcgtcatctgcacctttgtcattcagagacggtgagtccgatgacatgcggagataccttatgattatccgcaccttttgtcaactagaggcaagcgagcccgttgacacgcagagactaacgacgtcatctgcacctttgtcatccagagacggcaagtccgatgacatgcggagataccttatgctagaggcaagcgagcccgttgacacgcagagacaaatgtcgtcatctgcacctttgtcatccagagacggcgagtccaatgacatgcgaagataccttatagttatccgcaccttttgtcagctacaggcaagcgagcccgttgacacgcagagactaacgtcgtcatctgctcctttttcatccagagacggcgagtccgatgacatacagagataccttatg

SEQ ID NO: 43632 - DNA, 231 bp, Glycine max
  Peptide Sequence Number=SeqID_160410
atgattggaaattggatcgctgccgctgaagaggctttgtttataagtatcacttatttacatttgaaatccttgcctgagctcccttcacggattgacttgcaaactggtgcagtaagagcaggattatacatgtttaactgcccagaattagttgatagggaacgctgcattgacatggctttttcatggatgatgcaattgtttcaggaatcaggaaatgacctatag

SEQ ID NO: 43633 - DNA, 294 bp, Glycine max
  Peptide Sequence Number=SeqID_160411
atgggtgccaagcacctcaaaatgaccaaatacaagttgcatgccaccaagccaaggtccccggacgaaattaggcgtgactcaaatgtcagtatgatagatcttgtgagcgcgggagatgacgtaaatctccgcgtgtcaacgggcttgtcggccgcgattgacaaagggcgcagaatgaccataatttgtctctgcgtgccatcggacacaactgtttctgaatggcaaaaaggtgtgcggaatgaccataatttgtcttcgcatgtcatcgggcccgccgcctctggatga

SEQ ID NO: 43634 - DNA, 1116 bp, Glycine max
  Peptide Sequence Number=SeqID_160412
atgtacctgttttatttcgggcatggaggaatcagcggatgggctcaggaaagagtgcttacccttgatgagatcaataatgccaataacttttccaatgtgtacagcagatttccattcgtgtctacgattacttgtgaatttacgctctgggatgaaccggaaaccttttctgccggagaacgttttctaaaaatgaaacagggagggccggcaacaatgatcacctcaagccgtgctattggtgtggattatggtcgtgattttacagacctttataccaaagatattttcaaacttgtgaatgatgattttgaaacccttggtgttgcccatttaaatgctaaaagacaaaaaggtccgcaagcagaccacttgaaagtaaaccttctgggtgatcctgctatgaaattaagcagaccaaaaaggttattggtaatcgatgctatagaaactccggtaccgggactgatcagaggtctggactttgtaaaagtaaaaggacatatcaacaatacaaacggaagtattaatacctcttttaacggaagagtggttatcaatatctttgataagagacttaataaaaaaacattgaataacgacggaaacctcacccctatccttgaatatactgaagaaggaagtgctattgtgaaggcctcaggtactgctgtgaatggggtattcactgtagaattttatgtgccgaaagatattaattatgccgtaggtgaaggaagaatcctcggatatgctgacaataaagctacagacgtattcaataatcaggcggtacaggttggagatattaacccgaatgggattaatgacagccagccccctaaggtaaagctgtacatgaacaatacaaactttgcggatggaggtattacagaccagaatccgatgttgcttgcctgtattacagatgatacaggaaatggatgtctgagtccgagtcttgcagattatcagaaaggaaatgtaacctaccctttcaggaatttatcggtaggtcagcatcaattatcatttaaagtttgggatataaacaataattctacatctgcaacgttaaactttgaagttaaggatgaagcggatcagcatctg

SEQ ID NO: 43635 - DNA, 468 bp, Glycine max
  Peptide Sequence Number=SeqID_160413
atgaagcaaattaagttgaacatgtgtcaagaaaatcccaaaatcttagaaagttggagcttggtgtttgtgctcaaagaaactcttttctcccctctttggtgttcattggttgttccttgtggcatttcattatctgatgatcttttggccattgctgtgataatatttggagtgtggatgagcactcatcatgatggctgccgaaagtctctcaccgtgcctgtcataggcctcggagcgtatcaccctgttctttgtcttggtgggaattttggtcttcatagtattggtgtaagtataaggaataccaacttcaagattttagttctgggtttctcaaagagactaggagaggatattaataatattgcattacgtactaatatgagtgtttgggaacagccatggcccatgagagaacaaggtgtcattgaagataagctcccactcaagtcgatgaaatga

SEQ ID NO: 43636 - DNA, 225 bp, Glycine max
  Peptide Sequence Number=SeqID_160414
atgcccttgcggggtaggattgcatcaggaggatgtgcgcaaaaaggcacaggccatccaaaaacagaactctgccccccacgtatctaccaatactttggattggctccatggacgtcccgcagctcttcctccttgcctcctaaagaattacagcagctgacccagcacacagacactcatcatagacacacacacgctgatgatacacacacaccctcatga

SEQ ID NO: 43637 - DNA, 303 bp, Glycine max
  Peptide Sequence Number=SeqID_160415
atgaaagattgcagaaatacaagtagtggagatgtctcctccacctctaggacctcacaatcactcacaaactcatctcaagctctaaggatggcttcctcttcaagctctggtggctttgttcgtgctcgtgcacttaccacaattttgaaccgcttagcacgcattagtgaatttcagcttagcgcagcttttgtcactcagcgggtggaccaaagcggtgcgcttagcgggatggcccttcttccagattcttccttgcgcttagctgaggattgttgcggtcagcagatagctcgctaa

SEQ ID NO: 43638 - DNA, 358 bp, Glycine max
  Peptide Sequence Number=SeqID_160416
cctccgaagacaccggtttcgttggctcactagaccgagcaacgctcggtctagagaaaaaaaatcaagttagccatttccgattctacttccacgagaccttcaccgcgaacaacgctaccagtgttcccgtcgttccagcgttgcccaagtacaacaccaccacctccttcgggacggggttgtatgctgccacctcgcagacggagttcaacctgttggtggttttgaacttcgtgttgaccgaagggaagtacaatggcagcaccatcacgatcttggggaggaaccgcatctctcagaatcttagagagattcctgttattgggggcagtggggtgtttagatttgctacggg

SEQ ID NO: 43639 - DNA, 252 bp, Glycine max
  Peptide Sequence Number=SeqID_160417
atgtttgatgtgctattcgagcccaaattccattcaaagtgcaaatcacggttgaagttattaaagatgagactagagacaatacacaagaaaaagagtgcaatgcagaaatttctcaagaaagacatcgctggccttcttagcaacgcccttgattacaatgcacatggaaggttcttgattattcaaatttctcttatccaatcacaagggattgctggaagtagcgcaagaaagtacttagtggactaa

SEQ ID NO: 43640 - DNA, 129 bp, Glycine max
  Peptide Sequence Number=SeqID_160418
atgcctctgatgttgaataagcttgggctaagcgagtcaatcttgctaagcctaaggcttagcgagccagtcttgctaagccaattatgttccaatggtcaagctaggctaagcgcctactggcgctaa

SEQ ID NO: 43641 - DNA, 300 bp, Glycine max
  Peptide Sequence Number=SeqID_160419
atgcatagatctcccacaggcaatttagttcctctggacttggagattgaagctgcgttaagaaggaacagagccgagaggagaagaaaattactgcaagacaagacagtagcttccattctagaggaagaaactcatttttctgattctacatcatctgactcaccatcatcaagggaatccacgacatatttaccaaaagccgttatcatggctgatgaacaccagcaaaaggttacccttgaggactactcaagcagttcagtaccacaattctttaccagcattgcacgtccgaaa

SEQ ID NO: 43642 - DNA, 800 bp, Glycine max
  Peptide Sequence Number=SeqID_160420
gtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgattgaattatggaaagctttgggcaacgaaagcaacattgaccatgcagaatgggtgaaagctgacgaagctgcgatggtagaagatgaaaaacttatcgtggtgcaagtcaacggtaaagttcgtggtaaagtgactgttgcagctgatgctgatgaagaaacagtgaaaactgttgcatttgcagatgaaaatgtgaagaaatttactgacaatacacaaatcgtgaaagtgatttatgtaccaggtgatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcacgagaaaaaaggctgcaccg

SEQ ID NO: 43643 - DNA, 504 bp, Glycine max
  Peptide Sequence Number=SeqID_160421
atgggtgaaatagaagaggtgcaagagcaaatgaaggccgacatggaggccttgaaagagcaaatggtgacaatgattgagggcatgatgagcatgaagaagataatggaagtcaatatggctgcagttgccgctaccaatgttgttgctaaggcaaagatttgggaagtacgggcagcccccatttatttgcaaattcaaaacaagcatgccttcccgccatatggcttgcctcccaactatacaccacccaatgtggcgtacactctcgatgaggatgtcaataactctgctcccatactcattgagagccgacaacctcatcctgcacatgtctctcaacccatgggggagacatatgaaataccccaccacaatctagttgacttcaagccttgcctcgaatatgccactaagggcaagcagttggtggtatacccctgcaaaacactttggagggcccttaatttcgcccccaaccacaacccttgcattccacagcgg

SEQ ID NO: 43644 - DNA, 579 bp, Glycine max
  Peptide Sequence Number=SeqID_160422
atggacattagtctcggaagaaaggttggagcagagtttctgggcacgtttcttctcatgtctgcggcaataggcgctgcaattgaagaagagaagtcacaaggatcagtggtgcctgtgtatattggtgcacaagttttggcatcagtgagtgctgcatttgctctgaagttaatttttcatccattcatgagcggtggagtgacggtcccttcggtgggatatgggcaagctttcgctgcagagttcatggtcagctttactcttatgttcgttgtcactgcagtggccggcggcacaagagttgtgcgagagttcccgggaatcattatggtgcaggtgcgattgttcgcgggaatcgtggtgggagccactgtcatgatcaacatactcatggcgggggcagcaactgggagttcaatgaacccggctagaacactgggtccagcaattgctgcacacaactacaagggcatatggatctatctcacagctccaatacttggatctctatgtggggcaggtgcctacactgtgctcaagctgcctgatcgcaacactactatgcaggaagagtga

SEQ ID NO: 43645 - DNA, 204 bp, Glycine max
  Peptide Sequence Number=SeqID_160423
atggataagaagcttggagaggatgcttcaatggaggaaaagaaagagggagagaaagagagagccaatgatttcttcttagccttagccaaggaaacaacttcctttttacccacaaggggtgaagctagattagtagaggctgaagttgaggtgaagagcgagaaggttaaggtgaaagggctagagaagagtgaaggttag

SEQ ID NO: 43646 - DNA, 591 bp, Glycine max
  Peptide Sequence Number=SeqID_160424
atggcacccaagaagaatttggtggttatgattctaggcattaacgatggacaaaatgccaagaaagtgtttctagaggactccttcatcctagatgatgggttagacaagcttcctagaaaagttcaattcttgccactatgtccatatatgcattgttctaggactgctcgtcaagacaaagtcatcatcagaggcatcgtccaaggaaaagaggtcaccatctctccaataacaaatgttgttgcatctagatgtctagaagagaggtttgtgtttgataaggaatgggagaaggagataacttgggaaatagtggatattatgctctatggtggtccacaaccagttacaaatgataaagttgtgttgagaaggtttctgaggcctacaaacctatcccacatgtgcagacttattcacatattctatatgtgtaaggtgttggtaggtgaaaagatgaagaagaatcttgttccctatgaccaagccaagaaaaccaaaaagcaacctctatttgatcccaagccttctgaccctaaacctacccaaaagaggaaggctcaagactctactaagtctaaaccttaa

SEQ ID NO: 43647 - DNA, 450 bp, Glycine max
  Peptide Sequence Number=SeqID_160425
atggaactccaacgtcttaatcaaaatgaagaaatcgacaaaaggaagagaagtatagcacttaaagcctcatcatcaatacaagaagaaaaggaagaagaagattcagatgatgaagaagacttctcactctttgtgaagaagttccagaaatttgtcaagagaagaagaatagagagacgtcagaactttaacaatggaagaagatcacaagaaaactctcaagttcttagatgttacaaatgcaaccaatttggccacatcaaagcaaattgtccttcaaatgaagaatggcctgagaaaagtgataagaaaaggtatgatgagagaagaaccaagaaggcctacattgcatgggatgacaatgattcattcaatggcacaaaaaaggaaattaatcttctaaccaaggattatgagagtgatgagaaaatttctcaagaaggttaa

SEQ ID NO: 43648 - DNA, 204 bp, Glycine max
  Peptide Sequence Number=SeqID_160426
atggagaaagtaacagtccaagttgcatcacatgttgctagcgaccctggaaaagtaccaaccagtaaaaaggtagttgttttggtcacccaacatttttgttggaacatccagcaacacggaggcaagatggcaggagataatccacacacctcaagaaataggtggaaccatggaaatgttgtaactgttgttacaacttaa

SEQ ID NO: 43649 - DNA, 204 bp, Glycine max
  Peptide Sequence Number=SeqID_160427
atggctagtcttttgagtccagtgataacaaccaaaaagttgtacccacttcttgcaatgaacccaaaaacggttagtcttttggatccagtgatcaaccaagaagcaaatccacttcttgcaatgaacccaaaagcggttagtcttttgagtccagtgtttaaccaagaagaccttctcttgaaaaatagtcaccaagagtag

SEQ ID NO: 43650 - DNA, 267 bp, Glycine max
  Peptide Sequence Number=SeqID_160428
atgagtgacactgacagtcgtgttagtggcaaccatggtagtcatgatggtagtgattgcgacgacaatgatgaaaaagaaataatggtcgatgccaccgttatcatgaccatcatcgttaccattactattgctgctaccatcatcatcatgagcgacagtgacaatcatgttagtggcaaccatggtagtcatggcgacggtcatggtggtggtggtggttgggacgacaatgatgattgtagtgacgatcttgacgtaaattaa

SEQ ID NO: 43651 - DNA, 1200 bp, Glycine max
  Peptide Sequence Number=SeqID_160429
cagataccacaccagcgcccaaatcatgcccgccacgccggtaatcagaaacagcccgcgccagccaaacgcagcctgcacgtgaaacagcagcggcgtcatacaggcgaggccaacaaactgtgcggacgagtagatgccaattgcactggcgcgctcctgctcggggaaccagctggaaatcacccgattgttagccggcatcaccggcgcttcgaaagcacccacgccgaggcgcagaccgaacagcgcgccgaagctgctggcaaaagcgtgcagtgcggtgatcagcgaccaggcaaacagccccgcgccgtataccagccgcgcgccgagacgatcgatcaggaatccgccgggaatctgcagcgccgcatagatccagccgaacgccgagaagatcagccccatctccagcggcgtgaagcgcagttcaccggccatctgcgtggcggccaccgacaggttggtgcgatccatgtagttaatgatgatgttgataaacaccagtgccagcatcataaagcgtgtgcgtccggctcgcacgctgaccgcgctttggctaagtggctgttctgtcataatacaactctcccgaggggcagaatggcgacctgcaaattgaacccttcaaggaggactttcgtgaaactgaaagcactggcgctggccgccgtaatgagcacgggcgcactgtccggtctggtccaggcgggagaagtgccgaacggaccgcacgtggtgacatcaggacaggccagcgtggatgcccgtccggatatggcgacgctctccatcgtggtgaatgtttcgtcgaaagacgcggcggatgcaaaaaaacaggctgacgaccgcgtggcgcaatattttgatttcctgcaaaagaacggcatcgagaagaaagatattgatgcggctaatctcagcacccagccggagtatgactacaccaaagagggtaaatcggtgctgaaaggctaccgtgcggtgcgtcaggtggaagtgacgctgcgccagctggataagctgaatgagctgctggacggcgcgctgaagtcgggcctgaatgagattcgttctgtcgagctgggcgtggctaacgcagacagctacaaagatcaggcgcgtaaagcggcgattgccaatgccacacagcaggcgagcgccctggcggaaggcttcaacgccaaactgggcccg

SEQ ID NO: 43652 - DNA, 239 bp, Glycine max
  Peptide Sequence Number=SeqID_160430
acacgactgtgtctgaatggcgaaaaggtgtgtggaatgaccataatttgtctcccatgtcatcggacccaccgctctggatgacaaaaggcgcaaaagacgatgttagtctctgcgtgccatcagacacgactgtgtctgaatggcgaaaagacacaactgtgtctgaatggcgaaaaggtgtgcgcaatgaccataatttgtcttcacatgtcatctggcctgccgcctttggatga

SEQ ID NO: 43653 - DNA, 765 bp, Glycine max
  Peptide Sequence Number=SeqID_160431
tgtatgatggtgtttttgaggtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggaattcgatcctcaagagacaatcacttgataggtagagaagggagtgttttcgaaggcgtaggtagcaaaggggaagaggatgacgccagagaaaacgaaggaggagacaacgtgttggaagatggaattggggcagagtttagccaagccagccgcctgtaccaacatcagtggttgcagggcctgaacttcaaggcgaatctccagggtcaagccggaaatgaagcagctcaagaggaattgcggtgcgagaccgatgattcggtttgccaggacctcgaactcagaaagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcagagaaaaaaggctgcaccg

SEQ ID NO: 43654 - DNA, 315 bp, Glycine max
  Peptide Sequence Number=SeqID_160432
atgatcaatacattgctctttgttttgtgtctagtaactagtggtgctagacataaagttcatggtactcaaaatgcactacaagaagatttggagttggaaagacaactagagctccttaacaaacctcctatcaagagtattcatacaaattttgggtacattgttgattgcattgatattaacaagcaacctgcatttgaccatcctttattgaagtaccacaagctacaggtatgtatacatgattttgatgatgtcaaagaagaatctaacaaggctgctacaaatgataagcatttgcttcaagaataa

SEQ ID NO: 43655 - DNA, 186 bp, Glycine max
  Peptide Sequence Number=SeqID_160433
atggccttctcaataccaccacctttgctcccaatcatgactactacaggttttggccttgtttctaaacagtgcagttttgtggcatcggttaatgggaaagaagatgtaagaaagaggaagaccaaggcagaagcaatgtggggagaaagaagaaaagggtacaacaacagaaagaaaaaatga

SEQ ID NO: 43656 - DNA, 1424 bp, Glycine max
  Peptide Sequence Number=SeqID_160434
atttcctggatttcagcctgaaaaaaggcgaccgcatcggcctgattggcgacaacggcagcggtaaaagtaccctgctgaaaattctcagcggtgaactggccgccagtcacggcagcgtcacacccgccagccactgtctgctggcgcgcattgaacaacatctgccggaaacgttacttgaggcctcattgctggatggcgttatcgcccgactgcccgcagcacagcgcaacagcgagcgctggcgtgccgaggcgctgctgcatacgctgggtttcagcacagcgcagcagtcacaaaccgcggcgacgctgagcggcggacagcatatgcggctgttgctggcgcgcgcgctgattctgcagcccgatttactgttgctggacgaaccgggtaaccatctcgacctgccgaccctactgtggctggagaattttctgatcggctggcagggcagctttgtgctggtgtcccacgatagcgcgctgctggaccgcgtcaccaactgcagcgcaattctgcgcgatcgcacgctgcatgttttccgtctgccctgcacggccgcccgcgaggcgctggcgcagcaggatgaggccgatgcgcagcgccatcaggcacagcagcaggagatcgcccgggttgagagcagcgcaaaacggctggcgatctggggccggacctatgacaacgaaggtctggcgcgtaaagcgaaacagatggagaagcgcatcgactggctgaaagctgcgcagaccacgctcagcgccggcagtccgtggcagctgcagttacagggcgaagcgctgcaggcggatcgcgtgctggcgctgccgccgatgtcgattcagcctgctgccggggcgccgacccttttttccctgcccgcgctgcaggtgaaaagtggcgatcgcatcgcgattgtcggccacaacggctgcggcaaatcctcactgctgcgccagctgtggcatagctggcagcaaggcgacagcccgctgtttcatccgcgcgcccgcgtcggctattacgaccagagcctgcaacagttgcgtgacgaccagacattaagcgcggcattgcacggtttcgctgcgctgagcgatgagcagtgcaaaatggcactgattagcgcaggctttccctggctgcgccaccagcagaaggttgcctccctcagcggtggtgagcgctcgcgcctgctgtttgtcggcctgacgctggcgcgctactcgctgctgctgctggatgaaccgaccaaccatctggatatgacaggcaaagaggagctggcgcaggcgctgcagcagttcgccggcgcggtgctgctggtgtctcacgaccgcagcctgatcgccagcagctgcaatcgcttctggctgattgaacagcagcagctgagcgagtggcacgactggccgcag

SEQ ID NO: 43657 - DNA, 402 bp, Glycine max
  Peptide Sequence Number=SeqID_160435
atgaaagctatcaaaacactgaccattgccgccgccgccgcgctttccctgatgtctgctgccagcttcgcgcaaaccgtttcagccacctccaccacactggatggtgccgaagcgaaaattgccgctcaggctcagcagcaggggatgtgccagaacgggtcgcctgacgggcggccttttttgtcgtgcagtcaggctcgcagcgtatcaatcattctggcgatgttgctgaacttgcagcgcagactgtctggcaggagaacgcaatatgctgaacaacgtggatatcaaccggcaggcgctggcttttgcagatgcattacgcacgcaacgccatgctcacgttccggtgattcgttttgcccacaggccgcaatttatcgcgacggtgcgcgctga

SEQ ID NO: 43658 - DNA, 414 bp, Glycine max
  Peptide Sequence Number=SeqID_160436
atgaaaaccattaaagctatgtcaatcgccgctgttgccgctctttcactgatgtcagctgccagctttgcccagagcgtaaccgtgacttcctctacgctggacggtgcagaagctaaaatcgccgcgcaggcgcaacagcagggcgctcagtataaaattactgaagccaacaccaacaaccgcgtgcacatgacggctgaactgcggagcccaggcgtttatccacaggataagccagcctctttgcacgcagtcgcggcaacaggctatttgcggatggtggatacgcgctaccgtcagcgcctgatgcacggtatacaaagagccgataaagcgcttctcttcctcaaattccagtacgtaacagccttttttatgcaatacccagccggcgtccggatcgtgacataa

SEQ ID NO: 43659 - DNA, 678 bp, Glycine max
  Peptide Sequence Number=SeqID_160437
atgattgtgctgggatcggtgccggtgcgggttattggcgtggccaacaatgaagatggtctgtcgcccaaccgtctcagcgtctggctgccgtggagcacggtgatgtatcgcatcagcggccagaccgcgctcaccagcatcagcatcaaacttaaagacgatgtggtgagcggcgcggcggtggaatcgctcacccagctgctgacggcgcgccacggcaccaaagatttcctgatgttcaaccgggacaagtatcgtaaagcgatagaaggtgcggcggccacgctgacgctgctgattttactggtggcttcgattgcgctcatgatcggcagtattggcgtaatgaacatcatgctggtgtcggtgaccgaacgcacccatgagattggtgtgcgcatggcggtgggtgcgcgacgcggcgacatcatgcagcagtttatgattgaagcggtgctggtgtgcctgttgggcggatcgctcggcgtggcgctgtctctggtgataggtccggtcatttcactgctggctggcggcgtgctgaccgccatctactcatggcaatcggctggcgcagcgtttgcctgctctacaatcatcggcatgatatttggttatctgcccgcgcgcaaagccgcacgaatggatccggtcgccgcgctcgccagcgaataa

SEQ ID NO: 43660 - DNA, 1471 bp, Glycine max
  Peptide Sequence Number=SeqID_160438
atgcctgcacccgcgtcgcgtttgccgaaaatcagcgtgattcagtcgttcaaagtggcggcggaacttggtagcctggcgaaagccgccgcacagctggcgctgacgccggctgccgtcagccagcaaattcgtcagctggaagcgcagctgggcagcgcactgtttgtgcgtacccagagcggcgtgatgctgacggaaaccggcaaagagtatctgcgctacgttagtgaagcgttcgacattctgcatctggggcagcaaaatttgcgccatgcggccagcatgccaaagctgacgctctattcattgccggcgctggcatcgaaatggctgctgccgaatatcaccgcctggcgggctcactgccagggctgcgatctcagcctgcacggcacccatgcaccggtggatttcagcgccacaccggcagattttgtcatctgctttggtgaggatcgctacccgcaactcgacaagcaacggctgttctgtgacgaggtgctgccggtcgccagtccggcgctgatacagcgttacccgggcgaatcgttgctcagccaggcgccgttgatccatctggactggggcaatgagggacgctttctgcccgactggcgcagctggtttcaggccaaaggcagtatggagccggcggcccagccagcattcagttttaatctcacttcacttgcgatcgacgcggcggtagccggggctggtggtggatccgctcagcctgccgctgagcaaaccctatttcctcgcctggccacagcgttcccgcagtcaacccggcagcgaggcgctgattcagtggctgacgcagctggcgacgttctggctggtgctgagcggttttgtgctgggcgcggcgatccgcaaagtgggccttgcccaacgctgggccaactggctggtggtgccgttcagccagagctggccgcggatggtggcgggcacggtgctgctgagttatctgctggcgctggtgatgccgtcgaacatgggacgcatcgcgctgctgatgccggtggtgctggcgctgggcgagcgggccggtatccggccgggcagtcgcggcagcattgggctggcgctggcggtgggcttcggcacctttcaactctctgccagtattctgcccgccaacgtaccaaacctggtgctgagcggcgcggcggaaagcgcgtaccagctgcatttgcaatggctgccgtggtggctgctgcacatgccggtggtggggctgggcaaaggtattctgctggttgcctgcattacgctgctgttccgcgctcagccgcagccggtggcaacgcgggaagcattgccggcgctaagcgggcgcgaatggcggctgattggcctacttgccgtcacgttactgttgtggatgaccgacagcctgcacggcttatctgctgcgtgggtcgggctggccgcggcgtgtctgtgtttgttaccgcgc

SEQ ID NO: 43661 - DNA, 1335 bp, Glycine max
  Peptide Sequence Number=SeqID_160439
atgtcgatgacggagaagcgccgcgagcaggtggcgttcagcgatatgctatacatcacgcccagcgcgctgctgacgcctgccaacagcacgctgacggcggatatcagcacgctgcgcgggaagaatatcggcgtcgcgcagggcaccatccaggaaacctacgccaaaacgaagtgggcaccgcagggcgtcaacgtggtctcgtatccgaatcagatggagatctatccggatctggtagcgggtcgactcgatgccagcctggcgaatgcggtttcggccgagcagggctttctcaacacgccggaaggcaagggttatgtcaataaagccacgctggtggataaagcattattggggaacggcgtaggtatcgggctgcgtaaaggcgatacggccaatcttactttaatcaacaatgcgctggctgcgctgcacagcaacggcacttacgaccggctggcgcagaagaaaatcatgtctttactccctgattatacccagcagcgggcgcgattcctggccgccgtcacgcgccagcacggcgcgctgactgcctatcgccatccgctgaccgcgcccgacggggccgcgctgtacaccgacgttgcggtgatcggcgatccggcggctcccaaacgcatgctgattctctccggcacacatggtgtggagggctattacggttcagacagccagatcgcctggcttgatagcttcgatgtcgccgcgttaccgcccgactgcgcccttgtgctggtccatctgctgaatccatggggcgctgcgcatctgcggcgcgtcaatgaagacaatatcgatctcaaccggaatttcatcgatttcagccagcccgcacccgctaatccgcactatgcgctatggcacgatctgtaccacggcgaccgcgcacatgccgatcggctgctggcggagacactgcagcagtcaggctggccggcgctaaaacgggtagtggaagcgggacaatatcaggcagcagatggcctgttttatggcgggcagcagccggcctggtcgcaccgcacgctgcactccatcgtcgaacagcatctgcgtcaggcgcaggtcatcctgagtttcgacctgcacaccggtgccggcgcgtggggccatccgatgctgctggcgattgctgaacagcgctatccggcgcatgactggggcaagtcgttatacgatgagtggctgacgctgctgtttaccggcgccgggcgcgacagcgacaccggggtgactgccacggcaacgggctatgtctcgcagtttctgctgacgtcgctgcctgacacgcagctgctgccattggtg

SEQ ID NO: 43662 - DNA, 1838 bp, Glycine max
  Peptide Sequence Number=SeqID_160440
atggcattgcccagatcaatatcaaaaccctgcagcgagccatcgctggctttggattcgaacggtggaaaagtgggatcgacgccaaaacgcagcgtctgctgcgccgcagccagttggctgagggcgctgagtgacaacagtaaggcaaaagaccaacgctttttcatgatgctctccggcaggctatctcacaggggctcatgccgctgtcagcctcggttttctatgctaacccgcgttatactgcccgccatcagcaagcggccgccactgccgggagatcgcatgaaaatattggtgatagaagatgaagccggggcgcgtgattacatgcgcaaaggattgaccgaggccggttttatcgtcgacgtggcggaaaacggtcaggatggcctgttttatgcgcaggagcaccattacgatctgattctgctggatgtgatgatgcccggcatcaatggctgggaggtgatggcgcagctggataagcaattacaaacgccggtgattttcctgactgccaaaggcacggtggaagatcgcatcaaagggctggaactgggtgccgatgactatctggtcaaacccttctccttcgccgaactgctggcgcgcgtgcgcacccaattgcggcgcggtagccagcaaaagctgcccgacatcctgacgctggccgatctgcagctggatattgcccgtcgccgggtcgagcgcgccggacagcgcatcgacctgaccaacaaagagttcaatctgctgcatctgtttctgctgcatcccggcgaggtactgacacgcacggtgattgcgtcgcgcgtctgggatatgaattttgacagcgacaccaacgtagtggatgtggcgctgaaacatgaaaccccgctcgctcgccgtccgcctttcgctactgctcagtgctacggtggtggtcatttttacactcagcggaatggcgctgtatcacgcactggcgaagcagatcggccagaagccgcgactgttcgccaacatgctgggcaataccgaatcgttgctggtgctgcgctttcccggccagccgccgctgatcgtgatcaatcccggcgggcgtccggtgccagccattacgccggtcgccgccgatcagccgttaactctgcaatcgaccctcaccggctatcgccaccagattatcctgttcaccgcgctggcggcgctgctggtcgccgcgatcagtgtgctgctggtgcgccgcggcctgacaccgctgcgccggctggcagcggaagccggggcgagctgcaaccgctgctggcggcgctcaaccagatgctgagccggctggagcagggttatcagcaacttagccaggtctcagcggacatggcacacgatcttcgcacgccgattggcacgttgcttggtcagacggaagtggcgctgaaccagccgcgcagcgtcagcgactatcaaacgctgctgggttccaattatgcggagctggagcggctggcgaagatgattgataacatgctgtttctcgccaaagccgcagacgccagccaggcgctggacaggcaacgcatcgatctgaccccgctgggtgagcggttgagtgactattttgagggtatggcagaagagcatggcatgcagcttgtcatctcgcttcacggcgagttgcacgccgatccgcagttattacagcgcgcgctggctaatctgatcgctaacgcactgcattacggcacgcgcgacggcaccattcacgtctccagcattccgcagccagacgccgtgcttttggtggtggagaatcaggggccgacgctaagtcaggcgcagcaggcacgcct

SEQ ID NO: 43663 - DNA, 630 bp, Glycine max
  Peptide Sequence Number=SeqID_160441
atggcacacgatctgcgcacgccgattggcacgctgcttggccagacggaagtggcgctgaaccagccgcgcagcgtcagcgagtatcaaacgctgctgggttccaattatgcggagctggagcggctggcgaagatgattgataacatgctgtttctcgccaaagccgcagacgccagccaggcgctggacaggcaacgcatcgatctgacaccgctgggtgagcggttgagtgactattttgagggcatggcggaagagcatggcatgcagcttgtcatctcgctgcacggcgagttgcacgccgatccgcagttgttacagcgcgcgctggcgaatctgatcgctaacgcgctgcattacggcacgcgcgacggcaccattcacgtctccagcattccgcagccagacgccgtgcttttggtggtggagaatcaggggccgacgctaagtcaggcgcagcaggcacgcctgtttgaccgcttctggcgcgccgatgcgtcacgccagcagggcggcagcggactgggtctgtcaatcgtgcgcaggatcatgcaactgcatcagggcagttgcacggtgagcagcgaacacggcattacccgtttctgcctgcggttcccacgttaa

SEQ ID NO: 43664 - DNA, 559 bp, Glycine max
  Peptide Sequence Number=SeqID_160442
cgacagcagcgctgatgctgccgccgcagaagccccggcttccgcttccgctccggtcgaaaacaacgacagcgcttcgccgtttgccagcggaccgaccgtcatcaatgtctcccatctggtgacgcgcaccgacgatggctcatccgtgtacgtgacggtggatgggcaggaagccggactgctgcaaaagggcgagagtaaagagctccgcgtcccggccggtaaacaccagatcggcggctatgtgcaaacactgtttggttttggcaaagtgaccattcctgcggtcgatgtcaccacagacaccaatggcccgaaaaacgtgggtgcgcatttatgcgcacctggttacccggcagccattaatgctaatcctgcactgaaacccgcaaaggcaaaggcaaaggcaaaggcaaaggcaaaggcaaaggcaaaggcaaagcgcagcgcaataagccatcagtgcatcagcgcatacacgacatcaatggcgttgatgaccaggaagaacaggataatgtgggtgagggcattaacggacatcgctttgggttga

SEQ ID NO: 43665 - DNA, 933 bp, Glycine max
  Peptide Sequence Number=SeqID_160443
atggcgagaacgtcgatgattcgtttagaagatgtcaccctgtttgtgcgctctgccgcgctgggcagcttttcccgcgcagcgcgcgaagccaacctgctgcccggtcaggtcagcgccgccattcagcggctggagcgcgatctcgatcgccgcctgtttgcgcgatcgacgcgcagcctgcgtttgacggcggaaggcgaaaagtatctgcctttcgcgcaggagatgctggcgctgatgcacgccggagcggaaagcctgcaaagccacgacgatgccctgagcggcgagctgaaaatcgctctgccgtctgacatcggccgccatattattctgccgctgctgacagaattttgccgggcgcatccggcgctcgggctgcgtctctcgttttccgatcaggtgagtgacgtgttccgcgatccggtggatatcgctattcgctacggtaagctggaggacagcagctatgtcgcgctaccgctggcggaagaaaaccgccgtgtgatggtcgccgcacccgattatctcgatcgacatggccgtccggaaaaactcgaggatctggcccagcatcactgtctgccgtttgtcatgggcggtcacgtgtatgataaatggacttttccgcaggaagggatgcggcgacagattacggtgaaaagccggctgctgtgcgacgacgctgaagtggcgcgccgctgggcgattgccggaatggggattgcttataaatcctggcttgatgtctgcaacgatatcagacacggccggctggaacgggtgctgccgcagctgccaggtgaaagcacgccgctgcatttaatctgcccgcatcgcaaacaattctcgccggcgattcgcgctttacatcaattactgcgtgaacatttacgcactctgacggcgcaaatcttaccggcgatttaa

SEQ ID NO: 43666 - DNA, 1617 bp, Glycine max
  Peptide Sequence Number=SeqID_160444
atgtctggctatgctgctgtcaacaccctgaaaatattcactcacctggagcctccaggcgcacgcgatctgctggtgaaaatcagcgcgattgcggttaacccggttgataccaaagtgcgtgctggcgccccgacggacacgccgcgtattctcggctgggatgccgtgggcgtggtcgaggcggtgggcagcgatgtcacgctgtttcagcccggcgatgaagtttactacgccggcgacatcacacgcgctggcagctatgccgagtatggactggtggatgaacgcatcgccggactcaagccgcgcacgctgagcgacgccgatgccgccgcgctgccgctgacgtcgctcaccgcgtgggaactgctgttcgatcgcctggaaattgatgctgccgacgaaggcacattgctgatcatcggcgcgggcggcggcgtgggttcgatgctgacgcagctggcgcgcaaactgacccgactgacggtcattggtaccgcctctcgcccggaaaccgccgactgggtgcgctcgctgggtgcccatcatgttatcgatcatcagcgtccgctgggtgatcagctggcagcgattggccataaagaggtgcgctacgtggcctcactgacccataccgacagctactatccgcagttgatcgatgtgctggctccgcagggcaaactggcgctgattgacgatccggaaaccctggatgcggtgccgctgaagcgcaaagccatctcgctgcactgggaactgatgtttacccgctcgctgttccataccgccgatatgcagcgccagcatcagattctgcagcaggtgagtcagctgattgacgatcaaaccctgcagaccaccgctggcgagcatcacggcagcatcagcgcggccaacctgcgtaaagcgcatgcgttgattgagagcggtcgcgcacgcggcaagattgagactctcatgacccttaatgatgcggttgcccgccgtcacaccgtaaaagctttctctgcgggcaaaacgctgccgcagcaggagatcgacacgctgcttaacctgctgcgcaacagcccgtcatcggttaactcgcagccgtggcactttgttgtcgcatcgactgcagaagggcgggaaaagatggcgcaatccaccagcggcgcgttcatttacaacaaccctaaagtgctgaacgcctcacacgtgattgcgctgtgcatgcgcaccgatctggatgaagcgcacctgcaaaatgtgctggcgcaggaagagaaggacgggcgttttgccaaacccgaagccaaagccgggcaggataagagccgccgcagctacgtggatatgcaccgttatgagctgcgcgacgtgccgcagtggatggagaaacaggtctatctggcgctgggcggactgttactgggcgccgcgatgctcggcattgatgccaccccgatggaaggctttgatgcgcgcgcacttgaccaggcgctgggcctgcgtgaacagggctttaccagcgtggtgctggtttcgcttggctatcgcagtgaggaagatttcaacgccacgctgccgaaatcgcgtctgtcgcaggacgaaattttcacgtttatctaa

SEQ ID NO: 43667 - DNA, 1066 bp, Glycine max
  Peptide Sequence Number=SeqID_160445
atgacgcaggacatccgctttgaccaggtgagctttgcctggggcgaaaaacagctgtgcgatcggctcaatctgcaactgcgtggcggcaagaccacggtgctgctgggctgcagcggcattggtaaaagtacgctgctgcgtctggtggccggcttagtgcagccgcagcagggcagcctgagcggtattgcgcagcacgtggcatggatggggcagcaggatctgctctatccgtggctaacggtgctggagaatgtgatgctgacggcgcgtctgagcggtgcgaagccggaccgcgtgcgggcgcaccatttgctggcgcaagtgggactggaagacgaggcgcaagccgcgccctcacagctctcaggtggtatgcggcagcgggtcgcgctggcgcgcacgctgtatgcgcagcgcgagctggtgctgatggatgagccgttcgccacgctggatgtgatgactaaacaccagctgcaaacgctgaccgcgacgctgctgcgcggcaaaacggtgctgctggtgacgcacgatccgctggaagcctgccgcatggccgatgacattctgctgttgcacggccagccgctgcagtggtatctacctgatcgcggtggtgctgggcgtgtggctgctggcgcgccacaacgacgtaccggcatttctgctgccggcaccgcaggcggtgctggaggctctgtggcaaaagcggcagctgctcgcgcatcacgcaatgttcacgctggcggaaattgtgctggcgctgctgctgggagtcggcggtggcgtggtgctggcggtgctgatggcttccagcccgctactgcgtcgggtgctgtttccgctggtgacagccagccagaccatcccggtatttgcgctggccccgctgctggtgctgtggctgggttttggcatcgcgtcaaaagtcgtggtggcggcgctgattttgtttttcccgctgtgcctgtcgctgttcgacggtttatgccgtacgcctgccagctggctggagctggcgcaaacgctgtatccctcgcgctggcgaattttctggcgt

SEQ ID NO: 43668 - DNA, 1620 bp, Glycine max
  Peptide Sequence Number=SeqID_160446
atgctgctggctgaacgcggcgaaaccgtcgaggtcattgacgatgaagcgcgtcagcctgcctcgtggtttgccggtggcatgctggcgccgtggtgtgaagctgaaagcgcgccagccgaggtgattaccctcggccagcatgctgcggcatggtggcaaacgcgcgtcagcagcgtggtgcatcagggtacgttagtgctggcaccgtcgcgtgataacccggagttaaaccgcttcgcgcgcatgacgacggcgcatcaatgggttgatccggcgtcgcttgaaccggcgctggaaaaccgttttgtgcgcggactgtttttcccgcgcgaagcacatctcgatccgcgccgcgcgctggctgaactgcgtgacaaactgctgcagcgcggcgtccgctttgatgcgcgccagccatcgggccggatcatcgactgtcgcggtatccatgccagagcgcagctctccggcctgcgcgcggtgcgcggggaaatgctgatcctgcagagtcatgaggtgtcattttcccggccgattcgtctgctccatccgcgttttccctgttatctggtgccgcgtcgcgacggccacttcatgctcggcgccaccatgatcgaaagcgacgatgccagcgctatcagcgcgcgcgccatgatggaactgctcagcgcggcctacaccctgcacccggcgctggcggaagcgcgcgtaatcgaaagcggcagcggtctgcgtccggcatggccggctaatctgccggaaatccactatcacaacgccatgaatattcagcttaacggccgcaccgtcagcactgaggccaccagcctcagcgaattgctgatcgaacagcaaatcgatgcggcctgtgttgccaccgcctgcaatggcgattttgtgccgaaaagctacccttcaccggcgattttgcagcaggcgatcgccgcatccggcagtgaaattatcactgtcagcttgcgccgcgaaggcacggcgggcgcggcttttcgcgagctgctgacgggcctgaatgtgcgcgtgctgcccaataccgctggctgccacacggtcaaagaggccgtcaccaccgcgcacatggcgcgcgagttgtttaacacgccgtggatcaagctggaagtgattggtcatgccgacacgctgcagcccgatccgttcgcgctggtcgaagcggcacgcattctgtgcgccgacggcttccaggtgtttccctacaccacggaggatctgattgtcggtgaaaaactgctggccgccggctgtgaactgctgatgccgtggggcgcgcccatcggctccggccagggactgcgaaatattgacgggctgcgggcgatgcgagcctggttcagcgatattccactgatcattgatgccggcatcggcgcaccgtcacaggcagcgcaggctatggagatgggcttcgatgccatcctgctcaataccgccgtggcgaaagcgggcgatccggtggcgatggcgcgcgcgttcagccaggcgatcgctgccgggcagggcgcgcgcgaagccgggctgatggagaagcgtgatatggccgtggcctcaacgccgatcttcggcctcgctaacctgaactaa

SEQ ID NO: 43669 - DNA, 453 bp, Glycine max
  Peptide Sequence Number=SeqID_160447
atgaataacgttccgatacaggtgaagggaatcggcgccagcgatcgggctcgcctttgcgccagacggctttgcacatcaaaccgtcagtcttcctacgccagtatcaactgggtcaggcgctggctggcgtcaagcagcacgttaactgcgctgcccgcgttgtggatcaaaattgcaacatatggatggcatcaggcgatcgtgaacaacgcgctggtgggatttgagcaggaactggcagaacaaggcgtcgagaatacattaaaaagctatgacgtacccggcgcgtttgaaatgccgctgctggctaaacgcctggccgaaaccggcaaatttgatgcgattgtctgcgccgcgctggtggtcgacggtggcatctatcgtcatgactttgtcgcgcaggccgtcgtcgatggcctgatgaatgtgcagctcgccaccaatgttccg

SEQ ID NO: 43670 - DNA, 477 bp, Glycine max
  Peptide Sequence Number=SeqID_160448
atgatttcatgttattccagtctcctacggtgggggcccgttgctgtgtattaccaaccagagagggtcatgcggcaatttggatacacccaggccattcctactccacctgtcgattcatgggtgtcgtacgatgatatacacgataggtggatgcactattcggatcatatgattcaagcaggtgaggggtgcattgtgccaggtcagtgtgccagcgactacatagactggttcttccgcatttcccatcctttcatgacaccaggccaagcatcaaatcctctgccagatggtcatgctccacagccccgagtcgtccctcaggccccagagactccctcacgtgccggagccaggagcaccatcgacatctgcaaggcccgctatggaaaagtttgctatgggattgttgagaggttggagcgtcatctgagcctaagggggtcacgtcaggctcatcgacacatgaggtga

SEQ ID NO: 43671 - DNA, 294 bp, Glycine max
  Peptide Sequence Number=SeqID_160449
atggccacagatccgacgtctcccccgcagtccgatggtcaatcagaggcgacttccaagaggagtagaacaacgacacggttgagaacattgacattaagaaccgtggatcagcccagaccggcagtttatgtggatcccgctaccgggagagcatcgggaccgatgcgtgaaaagttccacagctacctaggcgtagtggcgcgagaaaaggttcccattatccacaataattggaaagacgtacctgaaacgctaaaagacatagtgtggaatgacattctattgatttga

SEQ ID NO: 43672 - DNA, 251 bp, Glycine max
  Peptide Sequence Number=SeqID_160450
tgagacccaataaggctgctctacctgagcccacacctgtgcaagttgatctagagccaactgacccacaatctcgagtggtgaatccaccgtcttttcctgagcgtgaagtagttcccccatctccacctctaattgtcatctccgatgcatcatcagatgaagcggctgcccctcctgattcaccagctggagaaacagctgaccctcttgcttccccagttggaggaattgccaatctttctgattaa

SEQ ID NO: 43673 - DNA, 519 bp, Glycine max
  Peptide Sequence Number=SeqID_160451
atgaacgcaagcatgcagcaaaagaaagtgaaaaacaaaggagaagaacctgaaaaaatcaatgcttggttcacaaaccaaaaaactgaagaagaaacaaaacaacaaggcaacagaaagaaaagcaaagcattgtttggcgaaagaaaaattgacagcaacaaaaccaatgaggaagtgaaaaattcaaacagaaacaaaagcaagaacaggcaacgaaagagatgggcaacaacaattaagaacgaagaaacaaaacaaacttcaacattatctggagcagctaaaggcaatgataggaaaattgaggatacaattaatggagttttcaaaagcaatataatcattatcaaggttggaaaagaagacacgtggactaagcaagagaactggaagtgtgatgcggaaatgctaaaaaatccaccaaatgagttggatgtgaagcaatcctaccccgcaagggcatttgatagaaaaactccaagtagattgggccaaagatgcaaaagaaggccctag

SEQ ID NO: 43674 - DNA, 801 bp, Glycine max
  Peptide Sequence Number=SeqID_160452
atggcacgtgctccagataacatcaagtctattaatggatcaaaagagacacttaagcttgctgtaagaattattgatctttggtttcttgggactcccaacaggtctaaacaagcggaaatggtcataattgattctcatggagatgcaatctatgttgtctgcaaacaagatcagctaaagtcttggaaggctgatttgatggaaaattttactattgtgaggcaatccgatttggaagatcttccctttaagaaatataaatttgctgatttcaccaatgtcattgttgggctcttccaacctaagttgttggttgacattattggcgtcatggatgaggtggtctatcgccatgtgggatcaaagagtacaagggttgttttcaaactcaaggatttgagggcctccaaattattgatcaatgaagttgtgtttgaaattcaagaattcagggagaggctttctgatttaggcattcaggtctggtcaattttgacacctggtggccaagggagttcgcaggtttcaggttcaagccaaatatcgtcaaaggatgcatttctttcaaaagctgaagcaaagacaatctctgaggttaacaaaatttctgaggaaattgtttgtgttactgtcaacaccattaatagaattgttatggataaccattcaaggtgttattcagtttgcagttacagctacaaaaaaactgatgttgagacaaccgcattcacatgcgcatgtggcaaacataatgatggaagcttgcttgcggggcttctatggaggctggatctttga

SEQ ID NO: 43675 - DNA, 477 bp, Glycine max
  Peptide Sequence Number=SeqID_160453
atggatcgtccagtgtctaacaaagatccatatgcacatttgattacctttgtttgcatctatgagattatgaagatctaccaaatggatgatgagtttatttttgtaagcctttttcctttctcacttgaagtaaaggctgaacattggtatgaagttatcccaccaaattggtcctgggatgagctctatgacaagtggttatcctactggtcaatgaagcatgctaaatggttcccaagaagaagcaaattatatggtgaatcaaaatttttagggaactacaacaacaattggtacccttatttcaatcaagggtggaggacaacaattctggctagaagcaaaaggttggaccctccaataaaccttcttatcaaaaccaaaaccaacaacatcaacccttacaccaagatagagccactaagtttgaagagacctttaaccagtttatgcaagtctcccttacttacctag

SEQ ID NO: 43676 - DNA, 171 bp, Glycine max
  Peptide Sequence Number=SeqID_160454
atggtgaggatgaggagtaactctacacacaggctaaaaagtagacctggtggatctcatgttgaggatgaaggaaaagatttggaggaggatacatctattatggaggatctgtctatggatgaggaggaccccatcacggagctagcattgatgaaagaggactcttaa

SEQ ID NO: 43677 - DNA, 339 bp, Glycine max
  Peptide Sequence Number=SeqID_160455
atgaagaatgaatctctagttgatgggacacaaaatcgtatcataaggaggtgcatgaggtcggtcaaattggactcccctggacctgcaaaggccaatgatgatagaagggaatcccaaagaacccttgtgtgtagggtttttggggttggtcaagagcataaactcttcaaccttattgaaaatgatgtacccaatgttcatggacatccccgcgatgatgacatagatgagttaagtgacgtctttgttgaggtcagaaacatgggagttaggggcgatgttggcatagtaaaaggtcaaccaagtctgggtgaacggcctcgtatcgatcaatga

SEQ ID NO: 43678 - DNA, 1197 bp, Glycine max
  Peptide Sequence Number=SeqID_160456
atgttgagtgtaggattgacctctgttgatgttgatgatgcttttgattcggcttctcaagtgaatgtccatgggtggactatcaacaataagtactacactgctgatgtttctctttggatggctcatcttcacgacgatttttctgctgccaacgtgaccctgtctcgacgaatgactgcactggtgatggtttttgacatgaatgaaccatcttccctagctgcacttcgagaatgggtatctcgcactgatattcagaactttgagatattactgtgtattggaaacaaagtggacctggttcctagtcacccagcccatgctgaatacaggagacggttgctgaaacttgaagactctgctgcagatttttattcggaagagtatggaatatctgaatcggagggaactagtttattgggggatgaagaaccgtcgtgggacatcagaaggtcctgcttggactggtgcactgatcacaatattgagttcattgaggcatgtgcttccaatgctgattttgacaaatgtttgtcgattgatggtgatttacaaggagttgagcgtctctacggtgcactttctgctcatatgtggcctggaatgagaaagaaggtatcttatctcttctttaattttccttctttggagcatgctgattgctgcttttgtcaacatagaataagtgctgattttgttttatccttctcctctcctccccccgcccttgcccccacaccagagttatcttcagaagaatctgattatgaacaagagtatgaagtcttatcagctggctcagccgattgggatgaaagtgaacaaggatggatttctgcatcgtccttagattcagggggatcagctcctcaaaacaatcctggcacagttggtcaacatgaggatggaattaaatctgataaagagtcacatcccacaacctcaagcactgcaattcaggatgagagtgaaaaggatatggtgcacaataccatggattccgaaggtgatgggaaggaaaacgagggtaaatgtctcgaattagaggatttggaacacttgatgtctgagattgggaatatgcgtgcaggcttgcgattgatgcctgattttcaaagaagggatatggctgcaaagctggccatgaaaatggcttccatatttgggggggagagtgatgaagaggaaatttag

SEQ ID NO: 43679 - DNA, 447 bp, Glycine max
  Peptide Sequence Number=SeqID_160457
atggagaaggacaaagcccccgagtggagaaggatgaaggcccaaacttatcaaggtaatccttgtggcgtctaccctgacttatcttccttcaccggaagtggcgtctaccctgacttatcttccttcattggaagtggcgtctaccctgacttatcttccttcaccggaagtggcgttatccaaaccttcgtagcctgtaatccttgtggcgtctaccttgacttatcttccttcactggaagtggcgtctacccggacttatcttccttcaccggaagtggcgtctaccctgacttatcttccttcaccggaagtggcgtcatccaaatatccgtagcctgtatcaagcgatccgccccgaggaacatatggcttgcttggaccagcgacattctgaaaaggagggacaagctattgttgttttggaggacttgcccatcttag

SEQ ID NO: 43680 - DNA, 615 bp, Glycine max
  Peptide Sequence Number=SeqID_160458
atgaccattaaatatctttatgatgttggaaagcttattgcacaaatttttgtaaccaatcaagcaaggactcatcctccaaatttgcctatccaaaggtccattgatatcgagtttctacctaacaaagtatgtccaaggttaccagttctagaccttggtaagaagaaaggattcaaggcctatgggccaattgaaatgaccagaaaggacaagagattacatgtcatcgcctacaacactatctttgatctacataagcttcatgaagacacatttgaagatcaatttttggttgccttagacatacacgatgaagtgctagtggatgttgagcactttgccaatcaagtgcccaatctgatcgagacaaatgaggcagttggattcaaacttgatgatgtgtttgaagaagggattccttatgacaagtccaataaggaagagcttattcaagaactacctcagactgagcaaactcaagcatcctcatctgaagatccttccaaagctcttactactcacatggtggtaaacaacaattctatgagttcgagggggacaatgcccctgttcaaatatattgaaccacaaggtgtaactcaagatgtttga

SEQ ID NO: 43681 - DNA, 396 bp, Glycine max
  Peptide Sequence Number=SeqID_160459
atggttgtctaccagtttccacgagaacttccagaacttagtggtcttacacttaagtattggattattgttgggagtatacctttaaccatgatccaaacagtgcatgaacttggttcaacgagcaggctttgtgaacatatcagttggattctccttcgtataaactttctggattacaatcctcttctcaatacgaatgaagtggtatttgatgtcaatatgtttagtcctttaatgatggacttgatccttggtgtcgcaacgtgcccttttgcgggcgagcgaggcgaggctcacgggtgcgctttccaaaggaggaaagatacacggagtcgccaccaacgtttatttgtggaaaacgtcggaaaaaccaaaggaaaccggtcaaaatga

SEQ ID NO: 43682 - DNA, 240 bp, Glycine max
  Peptide Sequence Number=SeqID_160460
atgacgacgttagtctctacatgctaccagactttgagtctgatggatagcgaaggagtgtttatacggataaccacttgggtcacgatagcacaaggtggggtggtcgacaaaagcagtctcgggcaaggatgggcattctcaccctgggtcaaggctaatggtgagttgggattttggctcaagaggcttgcagaatggccggacatgatgtatgtcagggtgttggtttggccagcg

SEQ ID NO: 43683 - DNA, 816 bp, Glycine max
  Peptide Sequence Number=SeqID_160461
aggatacacgtcctcgcctttagagggcttcacaccctcgcctttagagggctgcacgtcctctccttcagagggctacatgccctcgccttcgaagggctgcacgtccccaccttcagaggactatacgccctcgccttcaaaggactacacgtcctcccctttagaggactacacgtcctcgccatcagaggactacacgttcttcccttcagaggactacacgtcctccacttcagaggactacacgtcctccccttcagagggctacacgccctcgccttcagagggctagacgccctcgcctttagaggactacacgtcctcgccttcagagggctgcacgccctcgtctttagagggcttcacgtcctcaacttcagagggctacacgccctcgcctttagaggactacacatcctcccctttagagggctacacgcccccaccttcagaggactatacgccttcgccttcagaggactacacgtcctccccttcagaggactacacatcatccccttcagaggactacacgtcctccacttcaaaggagtacatgtcctccccttcagaggactacacatccttgccatcaaaggactacacgtcctccccatcagaggactacccgtcctcaaattcagaggactacacttcctccccttcgaagggctacacgccctcgccttcagaggactacagatcctcggctttagtgggctacacgcgctcaccttcgtaggagtgcatgcccttgccttcataggactccacatctgtgccttcagagaactcaaggtcctccgcccttaa

SEQ ID NO: 43684 - DNA, 306 bp, Glycine max
  Peptide Sequence Number=SeqID_160462
atgttttctaagaaatctatgttgtgtttttcgtatataatcattttccccttcttctcgcgcctactcttacactcagtcacactctcacgctctcatcctctgcggcggcgcttcctctcgctcccactttcgctctcactctctacggcaatgcttcctctcgctctcactctccgcggcggcgcttcctctcgctcttgctcttggtttgactctcattgtcgctctcactcacaaccgtctccacggcgacaacgagctggcagtgatcgtggcccctcccagtcttccttttcaatttaa

SEQ ID NO: 43685 - DNA, 1614 bp, Glycine max
  Peptide Sequence Number=SeqID_160463
atccatgcaggggggctgagttacatcaaacaagagttccacttggaaacagaccccaccctagagggtctaattgtgtccacatcgtttctcactggcactgttgtcacaatattctctgggacagtctccgacatgctcggaaggcgtcctatgctgataacatcatcgatcatgtttttcctcagcggtttggtgatgctgtgggcacctaatgttctcgtggttctgttgtcgaggctgttggatggaatagccattgcactgactataacactcactcccctctacatatcagagattgcaccacctgacatcagaggcactctcaacactctccctcagttttcgtgttccgggggaatgtttgtggcgtacatcatggtgttctggttgtccctgatggagaatccaagttggagagcaatgcttggcgttgtgtctgttcctgctgttgcttatttttttctggctgtgctttacctccctgaatctcctccttggcttgtgagtaaagggagaatcactgaggctaagaaagttttgcaaagaattcgcggcactgacgatgtttcaggggaattggctctgctggctgagggtatgaatccagggggtgaaaacaccaccatagaagagtacatagtagcccccgccggtgacctcatagccaacaaggaagcaggaagggattgcataaagctctatggaccccaccaaggaggagtttcaatggttgcacaaccattgagtggacaaggtagcatggtatctcgcagcatgttaaccttgtctcgccaaggaagcattgttgcacaggctgcaaatctcaaagaccctctagtcaatctctttgggagcatgcatgagaatgttaccccccttgaagctggtgcaggttcaagaagcatgctaatgggggagccagatcagagcccctatggcaacagtgagaacctgcatgctccattgctttcagcacaagggagcactgtggagagggttggatccaaagacatgttaaaagttgggagcaataacactgacattggtggaggttggaaattggtttataaatcaactgaccagggtgggaaaagggaaggggcacgccaaagggtgtatctgcgtgcagatcctaatgctgcagtattgtctcagcaaggatcttttgtttctggctatgatttgcatgcagatggtagtactgaggcttttccagcagctgcacttgttagtcactcagttatcagccctaaggatatgagcatcaaaccagaagttgctgccaaacgtactggttggggaggtttgttggatttaggagtcaggcgcgcattggttgttggaattggactgcaagttcttcagcaggctgctggcataaatggatttctatactatgctccccagattcttgaacaggcaggtgttgggccacttctgtcaaatttgggtattagttcaagatctgcttcattacttgtaaatgtcattacaacattcactatgctcccttgtatagccgtttccatgaggctcatggatattgctggcaggagatgggtggaatgtatagcagttttacaaggttactacttcaaggttcattaa

SEQ ID NO: 43686 - DNA, 732 bp, Glycine max
  Peptide Sequence Number=SeqID_160464
atggccactgttagagttgttcttgctctagcatcgattaatcgatggcacctccatcaattagatgttagcaacgctttcttacatggggatctcagggaggacgtttacatggagatccctcctagcttgcttggttacacatcaagtcagagttgcaaattgaagaaatcaccctatggattaaagcaatccagcagacaattatggtgtccaggcaaaggcttattttttccaaggacttgctctcctcatctacttgggtttagtgatgctgattgggcaacgtgtattgactctaggcgctttattactggttattgcttctttataggcaattcacttgtttcatggaaaactaagaagcaaactatagtctcacgttcctcttccgagactgaatatcgagcacttgcttccacaacttgtgaattacaatggctttcttatcttctaagagatctacggattcccctttccaagccttccgtactttactgtgataatcatagtgctcttcacattgttgtcaatccgatctttcatgaacgcaccaaacacttggacattgattgtcatcttgtccgtgaaaagtcccaagctggattgatgttactgctcccaatccctttttcaaatcaacttgcggatatattcacaaagactctccctcctcaatccttcggcaccaatctttccaagttgctattacaaaatatttttgcgggctaa

SEQ ID NO: 43687 - DNA, 1647 bp, Glycine max
  Peptide Sequence Number=SeqID_160465
atgaacctgttaccggcgcgatccgtggacgaaactgtggaggagataatgaggctgcaccggtcgctaccggctcggctgggaatcgaggaagtggaggcggcaaggactctggtcgcgaacgtggagcgcgaggaccaggcgaagctcgaggccgtggcacgtgcgagggagcgcaagggcccgcacgtgccggaggagctcttcgcggtgctgcaggagatgcagaagagcgtggtgctcttccagagcaaggaacagaggcgcgaggcgctcaaactcctcgatctcgaaaacgtccatgtcctgttcgacgaattgattcagagagcttccaattgcgtctcctcgcgctcgggttcgaagaactccgttttgaaacgggaaacttcttcttcttcttccgtttctgtttctgcgttcaagaaagagcctgtgaagagttccgagatactgttcacgagagatgataactatatgaataagatcaaacccaatttctaccctgatgggtatacaattgggcccagtgtctcatccaaaccgctgatacttgactcctcgataatacccgcgtccacttcaggtgaagataagttgagtttgataaaactggctagcttgatggaagtttctgcgaagaaaggtacacgcgagctcatattacagaacaagttgatggaccaagttgattggcttcctgattcaatagggaagttatctagtttgatcaaattggatttatctgagaatcgaattacggtgctgccttcaacgattggaggcctttcttccttgacaagtttgaatttgcattcgaataagatcgcggagcttccggagtgtgttggagatctcttaagtcttgtgtatctaaacgtagggggaaaccagttatcatctttacctgcttcgttgggcagattggtgcatcttgaggaacttgatttgagctccaaccagctttcagtgcttcctgatgccatagggtctcttgtcagcctaaaagtactgaatgtggagacaaatgacatagaagaaattccgcattccattggtcgttgtgttgcacttagggagctttgtgcagattataacaggctcaaggccctgcctgaggctgtggggaagattgagagccttgaggtattgtctgtgaggtacaacaatgtcaaacagctacctacgacaatgtcgtctctgtcgaacttgaaggagctcaatgtgagttttaatgagcttgagtacgtgcctgagagcctgtgttttgctacctcgcttgtgaagatgaacatagggaacaactttgctgacatgcgatccttgccgaggtccattgggaaccttgaaatgcttgaggagttggatatcagcaacaatcagattcgtgtccttcctgactcttttaggatgctcactcgtttacgtgtcctgaaagtggaagagaatcctcttgaaatacctccaagacatgttgctgaaaagggagcacaggctgtggtcaggtacatggctgatcttgttgagaagaaggatgctaaattgcagccacttattaagaagaaaaagggttgggctcatcatatgtgcttcttttcaaagtcaaacaaaaggaagcgtgacggcgttgattttgttaaaacctga

SEQ ID NO: 43688 - DNA, 291 bp, Glycine max
  Peptide Sequence Number=SeqID_160466
atggctcctatatttcaatcctcacaaccaaaagcaatcccacgtggtgggcatatagaaactcaagttgtagttaagcatccagcaggcactgaaaaccataccttggttaatgagactcctcagaaggacaatcttattgctcctcgcacagttggcaataacctttctgatttagacctacttcctcatggattggcagcgaatgctaaacatcaggatgccacagcgtcagtttctactgatgtttcgatttttgctaaccttgaaaaggatctgcccaaggtttag

SEQ ID NO: 43689 - DNA, 198 bp, Glycine max
  Peptide Sequence Number=SeqID_160467
atgtgtttagcatcacccttgtggtctttgaaagaggtgtttgttgatggcatcaacctcaaaggggagggggttttttcggggatacaggtagcaaaaggaggtgcaggaagtaaaatccggcaacgtattcagttaattcttgaaacccaatgggccaaaatcgtgcgaggtcgacaacgggctcccaaaggctga

SEQ ID NO: 43690 - DNA, 1032 bp, Glycine max
  Peptide Sequence Number=SeqID_160468
atgggaagggttcaggtgaataacaaggaagaattttctcaaatggagaacgatgatttcagtgattcacagttagttcgtcacttcagaggcgtgcttgttgcagtaacaactggtgatcgagagaattacgacgagctcgtcggttatttgcacccgaagaagaatcttaatcctgatgaggttgctatacttgtgacgactttgaaggcgctttctggagcagtgtcctatatagattctgttcatcatgaatccctgctctttgctgtttcgagaatgagcctctggaattatggaattgatattatggatgcgctgctggaactcataatatctttggctgcttccaatggaaaatacatcgattggtgtttggagatgcttgtgaaacattttgtgccgcctttttacctcttagattctctgagacaggagaatggaattgacagaaaaaataaagttctgtcacgggtacatgcagctttgaaagagatagctgatttggtgcctcttgcacctttgcgactatctccaatagttatccagaaaatgccaagtgtcttcagtaaggaaactgagattgtcatgtatgtcgagaatatgttaaggctggagagtggtgcaattggagaaactgtcggttctataatgctgcctgctcttgtggataggttgctagagttggatgtggaaattggatgggatggaatcctgcaagaagatgccaaaggcatatttgaaatggagttagaagatgttactgaatttgcagatgaggatgagaattgtgatagtatggtagctcatgctgcttgtgaaagtgaaacattaatgcactcaaatgaaagagagggaggtcggtggcgatgtgatggtggtcgcaaagtgtctggcacgacggtagcgtccaaatgcctcggaaatgtgatcatgccgccatgttctgctgcgatcgtgggcatgggcatgacaaccgcaccattgaaatgctccacaactgattttgacaacataggtttacaccagtaa

SEQ ID NO: 43691 - DNA, 519 bp, Glycine max
  Peptide Sequence Number=SeqID_160469
atggagggcatcaaagcagaggtaaagatgctactaaaggtcaatttcattcgaactataagatatttaaatgcagcaacacctaaagatgaatatcctatgccagttattgatatgctagttgatttgacagcaggcaatgagattttaattttattagacgattattcaagatataatcaaatatatcttgttaaaaatgatgtatctaaaaatgattttcaatgccatggggcattagagacatgtgaactcttgggttttgttatccatcaaaagggagttgaagtagataaaagtaaggcgaaagacattttggagactacccctccaaagaatatgaaacaacttcagtcattatttggcgatggtggtggaggttgggaaggtggtggtgaagatggaagagggggtggtataggggctaaggttagtggtggagggtctagagacataggtgcaggtggtggttgcggtactggtgcatgtgcaacaacaactccaagcatacacatttaa

SEQ ID NO: 43692 - DNA, 672 bp, Glycine max
  Peptide Sequence Number=SeqID_160470
atgaaagacctaaatgagactgatgaagaagatgaaggctttgtacaagtagcctttcagaagaggaaaacagttggcctggttactactgccccaaaaagggttaagaaagtccaaccagtctctgaaccacacaaatttagaagggctactccaagggaaccaataacagatgctcagaggtttcctcttgcattcatccatggtaatcctacacctaaaacctcgtactctaagtttatatactttaaacccattgaaaaggaaacaatcaatgtccaagcacctacatggacaaagcatgactatgagcatactccatctaaggcctttaagactcttccaatagatgtcataaagggactcttcgcaagatgtggaacccccaaagagcgagttttagaagaaggtgcatctgtgtggatgctaatcaccaaactcttaccagtgcatccagttgatctcaatctctctcaagaagaccgctcatcccttggaccttctagaatcaaattgtgtgaatggactcttaaaaggcctccacttctagttttgatggaagtgacagtgctgagcaccgagacatcgttcaagtgttacatcctgttaggaagtaccacttttatgatgtttccatctgcttcacaaaagatgccgacaactacttgttga

SEQ ID NO: 43693 - DNA, 318 bp, Glycine max
  Peptide Sequence Number=SeqID_160471
atgtcatccagaccacctaagcccttcaagttcctcgatatgttgatgtggatgacaccttgttgccttggctataatttcgatggacagcacaaccttgactcccaaaaccttggatgctattgtcttcttgttgacaaactcaacatgcctccaaaagatccacttttctacatgaatgaatggttcattgtctatgtggatggtggtgatttcaatggttgggataatctcggtagcaggggagttagaggtggccattgcaaagagtttgagagctatggtttgaattttagagaggaagttgaagtgttttag

SEQ ID NO: 43694 - DNA, 465 bp, Glycine max
  Peptide Sequence Number=SeqID_160472
atggccttccctactgtattgtgtggcattatgttgagtcagcatcccaatatgttaaactacactgactctgtgatgaagagagaatcgcctctatccctgcattacaaactgtttgaggggacacatgtcccagacattgtctcgacatcagggaaagctgcttcaggtgctgtgtccaaggatgccttgattgctgaactcaaggacacatgcaaggtgctggaagcaaccatcaaagccaccacagagaagaagatggagctagaacggctgatcgaaagactcacagacagtggcattgatgatggtgaagcagctgaggaagaagaagatccagctgagcaagaagaggcagctgaggaagacaaagaagcagctgaagaagaagaagaagctgctgaggaagaggaagatgcagcagaagagacagaatcagatgatgattctgaagccaccccatga

SEQ ID NO: 43695 - DNA, 826 bp, Glycine max
  Peptide Sequence Number=SeqID_160473
ataaacggcagcaccagccacaggccgaagaagaaggtgacgtccaggcgcggcgtcagcgcccagaagtccgggccgacttcccacagggcccaaatagtggtgcccagcaggaataccgcgtacagcagcagcgcggtggcgcggcggcggaacagcagccaggaggtcgccagcagcaccagcccggcgatgatgtgctttgccttattcaaagcggtaagacaaggtggcgccgccaccccagttgcgacccggcgccggctcgaaatagcggccgttgccttcgttgacgatcaccgaaccgacgtaacggcgatcgaacacattgtctacccggctgaagacgtccagcgcccagcggttccaggtaaagcgataaccggcgtttacgccggccacggtgtaagagggcgcctgcgcgctgttggcgtcgttagcctgaatgtcgctcatgtagcgcagctccgcgccggcgtgccagccttccggcggcgcccaggccagcgaggcgtagcccatattgcgtgcgatgcccggcaggcgattgccggcgggggtacagccggatttaccgcacatatcgctgcggtaggtggcgtccagcagcgtccaggccatattcaggcgccagtccagcgcaaactcctgatccagcgccagttcgaggccgcgccgccgggttttgccggcgttggcatagctggtgcgcccgccgctgctttccgccaccaccagttcgttgtcggtctcggtctggaacagggcggcgctcaccaggccgttgccgaggcgcagcttgctgcccagctcgacggtgtcgctg

SEQ ID NO: 43696 - DNA, 2427 bp, Glycine max
  Peptide Sequence Number=SeqID_160474
atgtcagaaacttccgatcagattgataatgttgctgattcagtagttccttcagtctatgtgggtcaatttgcccaattactcgagcaaggagataatgttgatatgctacctctcactgatgaagaatacatccactatgccatttctgaaggaaaaaggttccgagattcacttgaaattattgctcttcttaaaaaagcttatgaatcctacagcagtatgaaaattcagaggatgagctctttttgtgcattccagatgtctaaagaatatttcggtgaaggtgatatcagtaatgcaaaaaagacttttgatagtatagctagcctatacagaaaagagggatgggtaactttattatgggatgtcttgggttacttgcgtgaatgctctaggaaaaatggtactattaaagattttgttgagtattcccttgaaatggctgcgctgccaatatcatctgatactggtgtccggagagacactggtccagccggtcctgtaaatctactgcaaagagaaattgtacagaatgaggtttttgagcttgtccgtggagcttcaggaaaggcaacaaatgaacaccccagtaatcttaagatcacgggagatgaatcacttcagcttgaggttgatcttgtcagtcctcttaggttggtgatgcttgcatcagttgctttccatgaacagacaatcaagcctggggcatcaactttgattacagtatcacttctttcgcagttaccccttactgttgagattgatcgattagaaatccagttcaaccaatctaattgtaatttcttcattacaaatgcccaaaaacctcagtcagtaaaagttagtaatggaattcaacaacatcgaaccgagacggaaccttctctttcacttgaatcaaacaaatggctaaggttgacctatgacatccaatctgatcaaagtggaaaacttgaatgcttatctgttattgcaaaaattggatcacacttggcaatctgctgcagagctgaaagccctgcttcactggatagtttacctctttgggcattggaggatcgtgtacaaactgttccaataaaagatccaatacttgtgttatctggtcagaagtccacccaagttgaagaaccagactcacaggtggatctgcatcttggtgccgctggtcctgcgctagtgggagaagttttcttggtacctgtaacattggtctccaaaggacatgatgtctactcaggtgaattgaagatcaatcttgtggatgtgaaggggggtggcttgtttagcccaagagactctgagccatatgctctggatagtcatcatgtccagttgcttggtatatctggaccagaaggagaagatgattctcaattggattctgacaagataaagaaaatacagcaatcatttggattaatttccgttcccattcttaaaaatggagcttcctggtcatgcaaattagaaatcaagtggcaccgacctaaacctattatgctttatgtatctttgggttatactccatttagtaatgaattaaatgcacagacagtccatgttcacaagaatttgcaaattgaagggcacactgctattcttcttaaccaccattatttgatgcctttcagacgagatccattgttactctctaagaacaagcaagcatccgagtctgatcagccagaatcactgcccttgaatcaaaaaaatgtgctcattgttagtgcaaagaactgcaccgagttgccattgaggataaaatccatttccatagaagtagaggatgatgctgaaaggacgtgctctattcaacatggaactaaggagctttcaaacccctcacttcttgttcctggggaagaattcaagaaggtattctcagtcagttctgatatgaacatttccaagctcaaactgggaaccatgtgtttgagttggaggagagaccttggggttgaagagcaatctgcttctacttcaacattgccttgggttgtgactaaacaaaagctgccggatgtgaacgtggagttacctccaatgattgtgagttttgaatgtcccccttatgccgtagtgggcgaccccttcacgtataatattagaatttcaaaccaaacgcaattactgcaagaaatcaaatactcacttgcggacgcacagagttttgtattgtccgggtatcataatgacacaatatatgttcttccaaaatctgagcacattctcagctacaaacttgtaccacttgtctcaggcatgcaacagttacctaaattgtccatgacttcagtgagatattcagcagcatatcagccttcaaattcttcaaattctgtttttgttttcccttccaagcctcatttcaaggctacagtctcaactaactctagggtggagtcagttgctaatgaatag

SEQ ID NO: 43697 - DNA, 672 bp, Glycine max
  Peptide Sequence Number=SeqID_160475
atgattgccttgcggaagcgagcggaagtggatgccaaacacgtcgtcgttttgaacccgaacgacacttcggatctcaaacagctagcgagtacgttttctgaattggccggcacgtattatagagaagaagggaggaggattaagcagcgggtagagaagaagaatgttagctcggttgagttgattgttcgctactgcttcaaagttgctgtatatgcagaattccgaagtgattggactgaagcaatgaaattttatgaggaggcctatcatacactgcgagagattgttggggtgacaacaaggttgccagcagtacaacgcttagttgagataaaatccatatctgaacaattgcatttcaaaatatcaaccatgttactgcacagtgggaaggttacagaagcagtgacgtggtttcgccagcacatgaatgcatataaaaggcttgttggtgcaccagatggaatatttcttcactgggagtggatgagtaggcagtttttggtattcggtgaattgttggagacaagttcaaaaataactcaaggcgtttcacctattgtcctaggcaatccatccaagcctctgtctgagtgggaatattattctgcttattactaccaacattgccaactaggaaataaactgccaagtcatgggttgtaa

SEQ ID NO: 43698 - DNA, 252 bp, Glycine max
  Peptide Sequence Number=SeqID_160476
atgtcttcctttagtcatccatggagaaagacagttttgacatcgagttgctctaacttcatgcccaaagttgccattagagcttcatgtagagcttgtaggccttggatcttcttcattaatgaagtcctttacttcttgaagatcaatgggagcgaaatggagaaagaggaaaggcgattggagaccccacatcaaggagaagatgagtcaagaacaagctcaccatcatgggaaggtaggagaagatga

SEQ ID NO: 43699 - DNA, 465 bp, Glycine max
  Peptide Sequence Number=SeqID_160477
atggaatcgagatcggagcagacttggagccactgggcggggtcgccgaggaggtggtgggaggggaagagggcggcgaggacggaggggagtttggtgcggtgtttgagcagccaatcgcgtttgaggatgccggcgacgatgggggagggtgaggtggcagttgttgaatcggtggagtcagtgcttttcttgttgaagaggtggattttggagaagtcggggagggcgagggtgttgatgggaggctgcgccgacatgaggtgggtggagatcagagtgtggagctccgggcaccccaccagggacgctagcgtcaccggcggagtgcgcaactcttccgggtactcttccatcggatcggatcggatcggatctctaactcaccagcaacaagagctgctgtgtgtatgggtgcgtccgtgtgctattcacttgcgaattgagatttccactgctctttag

SEQ ID NO: 43700 - DNA, 423 bp, Glycine max
  Peptide Sequence Number=SeqID_160478
atgggaccccattttgaaatccctccagcatgtctcatagcacttagacagaccattgaaaaatggattttcatcattaacatacaaaagagacatgcctttgatggcttccctaggagtcttaaagccaagtacaatggacttccaaaatcgagtcccaccctttccgggactcgattttttcctagttttcttcgacctgcgaaagtgagcaaatgttcaaacgaggaacgcctaatgttaaaaccaaaggacgtacctcaaaagataagtgccagacacgaattccacaaacacgaactcgacaatgtggttgcagtcacggaagcgcagcccagtttgcgtcaaacaccaactcaggcagaaggagaaacaacaagaatgccctgggagtaccctttccgggactctttcctttcctag

SEQ ID NO: 43701 - DNA, 285 bp, Glycine max
  Peptide Sequence Number=SeqID_160479
atgggtaaccaattgtcattttgttaccttggtaggaagtgtttgggttcgcaaaaacatcatccaaaaccaaggacgggacttgtattccttgacaacaaatctagtctagctagttcattagctactgttcatagatctgtgagtgtaataattgaagaatgggtccacgacaaaatgaatccatatgtggtgctgcagacaaaggatctaacagggcagcacatgcgttatgcttgtgcttcagggcaacttagactgaccattgttaccctaaatggttaa

SEQ ID NO: 43702 - DNA, 472 bp, Glycine max
  Peptide Sequence Number=SeqID_160480
gcgtatagagtgttcgagatatctatcaagaaagggtatgacattttgagaggagatggtgtattgattgcttttacttccttcaaatggctcattgcctacttcttactttggaaattggtcctaggtgcacacaaggttaggagactctcctccatttgtttcgagattgcaatgcctctggccaggtgtggcaacatctacagatggattgtgatccaagctttctctggtgcttgtggtgtcacttttagtcttaaggcgaaactatatggaatattttatggtcttcctaaggcttgggaagatgggacttacaatggacaatttctttcaagcatactcttcacgaaggcaatgcatgcgtgtgtgcattggcttgccaaatatggtgccatgtatggagactcttacttcacttggaatgtttgcccagttcagttaactccacttatgttgactgataaaatgg

SEQ ID NO: 43703 - DNA, 165 bp, Glycine max
  Peptide Sequence Number=SeqID_160481
atggcaaaagatgcggtcgcagttgcgcgccttaaagcctcagtgttactcgagctgtcagattacatacaaggtttaaagcaaaaactggaagaattgaaccagctgttaacagtggcaacggcacgaaaaatcgctgactatgatccaatgcctaaggtatga

SEQ ID NO: 43704 - DNA, 1200 bp, Glycine max
  Peptide Sequence Number=SeqID_160482
atgagaattttcccaaacacgttcttcaccaaagcccgcaatctcataggcctcgggttcgcttcctcgaccgccgccaccatcgcggcctccacttccgccgcgtcttcttctccatcatccacctcttcttccgacgccggcgatacttcttcctcctattcttcctcctccgaagcccaaatcgtccaccggaaaatactgaaaacgaagctctgcatcatcggaagcgggccggcggcgcacaccgccgccatatacgcggcgcgcgccgagttgaagccggtcctctttgaaggctggatggcgaacggcgtcgctcccggtggccagctcaccaccaccaccgacgtcgagaacttcccgggatttcccgccggcatcctcggcaccgacctcatggaccgctgccgccagcagtcgcaacgcttcggtgccgaggtagtcacggagaccgtcaccgccgtcgacctctcccaacgtccgtttagggtttactccgactccaccaccgtggaggccgaatccgtggtggtcgccaccggcgctgtggcgaaacggcttaatttcgatggcgccggtgacacccctgacgggttctggaaccgcggcatatccgcgtgcgctgtgtgcgacggcgccgccccaatattccgcggcaaaccgctggtggtgatcggcggcggcgattcggcgatggaggaagctaccttcctctccaagtttggctccaaggtgtacataattcataggagggacaagtttagggcttctaaagtcatgcagggaaaggtgatgagtaatcccaaaattgaggtgttgtggaattcagtggtggttggggctcatggggatgataagggtaggattcttggaggggttaaggtgaagaatgtggtgactggggctgtgtctgatttgaaggtttctggattgttctttgcaattgggcatgagcctgccacaaagttcttggatggtcaacttgaattggactctgatgggtacattgtgaccaaacctggcaccacaaagactagtgttgatggagtttttgctgctggtgatgttcaagataaaaagtataggcaagctattacagctgctggcactgggtgtatggcagccttggatgcagaacattacttgcaagggattggtttgcaggaggagacaaatagactaacatcatttgagtaa

SEQ ID NO: 43705 - DNA, 441 bp, Glycine max
  Peptide Sequence Number=SeqID_160483
atgctagccctggcctcggtgtcatctctgtggccgccaacccccttcgtcactgcctcctcctccctcggtaacttcgttcgcatcttcgatgtcaattccaacgccaccattgcaacactcgaggctcctccctctgaagttgaagtttcgcaaatgcactttgatcccaagagagaaataacagtgcaagaaacagaaattgtgtgctctaagggccctcaaacactttggtctgctaggatatcaggaaaagtcactgttttagctggtaatggaaatttttggagagttggatgtgaagatggatgtctgcagatttacacaaagtgtgggagacgtgcaatgcctaccatgatgatgggttctgcagcaacatttgtagactgtgataaatgttggacattactgctggtcacaagaaaaggatccctgtactag

SEQ ID NO: 43706 - DNA, 1044 bp, Glycine max
  Peptide Sequence Number=SeqID_160484
atgggcaccaaaacatattacatcagattatcaagaggtagcgaagctctagaggacctcccagatgtgaaccactttgctcgaggtggtgagtatgatggtgacagaaagatagaggacttgaagctcctttatagagcatatgttgtaaatgctttgtctagtggtcgcatggaaattaataagatagctgaactaaatcagttggggaatattattgggttggttaaacgtgaagctgaagccattacacttgatgttacatcaagagtatatcccaaaaaacttgtacaggctgtctcaaatgaaatttaccgcgaaaaccttcagcatttgggggatgatggggagctcagtgataaagatgctgctgctttgttgaggttgcgtataatgctctgtgtacctcaacagaccattgatgcagctcactccgatatctgtggcagttggtttgaaaaggttgtcaaggatacgattgcatcaggggttgatggatatggtgcggatatctggaaatcagtaagaaaagcagcacatggcttgcgactaaccagggatactgctatgtctattgcaagcaagaccataaggaaaatatttattaatttcatacaacgtgcacgagcagctgggaatcataaagaatctgcaaaagaactaaagaaaatgatagctttcaacaccttggttgtgactgagttgagcaggcttttaggcaacaagctgagagagaccctcttcagaaaaactgttggtgttattttctcaccaggcgctcgagagttcgatgaagaggaagtttctccactcaataacatgctgacttgtgagaaagcggtgccctatcagccacaatcgtggggagtgcaagaggagcttgctgatctttatactacatacatcaagagtaacgaaactcctgaaaaattgtctagtttgcagtatctgttgggcataaatgattccacttcagcttctcttcgagagatgggagaaagattgcctaataatactgcagaagtagaggagtttgtattctga

SEQ ID NO: 43707 - DNA, 249 bp, Glycine max
  Peptide Sequence Number=SeqID_160485
atgaaaaccaagggtggttcaaagaataatgtcaagaacaaagatgttgaagatgggaagttccatgatttggtggagaacgataaggaagccttgtctgacattggcaggttagaaaagaggataaagatagcaatttggtgcattcaagagcatcttgaaatgaggccaactatggggaaggtcaaacaaatgatggacggtttggttgaagtccctaacccaccatcacctaatcctgatgtttga

SEQ ID NO: 43708 - DNA, 639 bp, Glycine max
  Peptide Sequence Number=SeqID_160486
atgagagggttttttatttccccaatttcatcatgtttttacttctctctgttcccctcctccgatgctctggcgagtccatgtggcggcggcggaggcagccatgagagcggcgaacacagtcctcactccaatttccgcgagcaggaccgcttcctccctatcgccaacatcagccgcatcatgaagaaagcgcttcctcccaatgggaaaatcgccaaggacgccaaggaaactgtgcaggaatgcgtcttcgagttcatcagctttgtcaccagcgagtacacttctttgtttctcgcagcgagcaataagtgtcaaagagagaagaggaaaaccatcaacgacaactgtaacaggactataacagtgtcagagagagaagagggcgctttcatcatgtacgattatgatactttcaacatgtacatcaagcaggttgtgattgaaggttttaagagttatcgagagcaaattgccactaagcctttcagttctaaagttaattgtgttgccatccattttgtgttaagtgatctctttcaaaacctacacggtgaagataggcaggcactactccatattgagggtgattcaaagggttcggccaaaagggtggagatgcatcttagatattag

SEQ ID NO: 43709 - DNA, 1128 bp, Glycine max
  Peptide Sequence Number=SeqID_160487
atgcccataatcgatgaacttctcgatgaactgggtagcacttcttggttttcaaagcttgaccttagtcaaggcttccaccaaatccgcatggctgaagatgatattcctaaaattgcttttaggactcactactacgaatataaggtgatgccatttggcctttccaatgcgctagcaatgttccaatccaccatgaatgaattgctaaagcctttcttatgccaattcgtagttgttttctttgatgatatattggtgtatagcctatcattggtagagcacctttcatatttggaggaaatttttgttgttttaggccaaaaccaattctacttgcggcgcaataagtgcttatttgccagacaatcacttcaatatctgggtcacattgtctcggcccatggtgtgggtccagatcctagcaaactcagtgcaattaatgagtggccaactcccttgtccaccacagatcttcaaagattctttgaattggcagggttctaccgacgttttatacacaattatgcatccatcacgagccccttaacctcactacttcgaaaagaccaattccattggtccaaggaagcccaagtcgcttttgaccagttgaagcgcgctttaacagaagctctggtgttagcaccacccaatttcattctccctttcacacttgagactggtgcctcagttaccgccatgggagttgtcctcaagcaacaatcgcatccaatagccttctttagcaaggtattttgccctagaatgcagagagcttccacttacgtaagagaattacacgccatcactgtcgtagtgcgtaaatggtgccattatcttctcggccaacatttcatcatccttacagaccacaagagtcttaaggatcttatgtcccaagtgatccaagccccagagcaacaacaatatctttcgaaattattgggttatgattattcaattcaatatagaccaggctccggcaacgccgccgccgatgctctgtcctgcctctttcttccaaccccacattgtctcactttgaccatgccctatttcaccttcctggaccaacttcgacactcactccgggatatacaggaattccgagaactcatgacttag

SEQ ID NO: 43710 - DNA, 366 bp, Glycine max
  Peptide Sequence Number=SeqID_160488
atggagttacatgttggaggatgcgacgaccacaagatgaatgaccacacccccgatggagttacatcgatgaaacagagcgccatgaagttatatgttgatgaccacaccttcgatgatgcagttgaaggcgatatgcgacggggccaatgcggtctgaaattaggaatggaccataaaatcttttggacaactttgtataggaaggttggagggagcattgacgataaggacgcaaacgcacaaacacctaatctcccactagaatggaaacatcatggcagtggcagtcaacatgtagcttcatggcactctgagctttggttaatttacggtgcaactccacatgaagttgggatcgtgtag

SEQ ID NO: 43711 - DNA, 273 bp, Glycine max
  Peptide Sequence Number=SeqID_160489
atggcacatcaacctttaaatggacttggtggcccaagtaggaaaacactattgttaaaaaggtgtaatcatactccgctatttccaatcatgacctggagaggagtaataggcaaagatatctctggggctggcattctgaccatctcattgaggcttagtagtggaggttcatcgagtggagatgacggaaggaggttgtggcgtctgtgtcagcctcgatggaaaaggaggtgtcgacatcatcatcagcgatcaaaagacggtttttag

SEQ ID NO: 43712 - DNA, 231 bp, Glycine max
  Peptide Sequence Number=SeqID_160490
atgtggatgtgcagtgaggctgagatatacctgtttggaggttacattacttcttggaaagttcccagtggtgaaggaggagagagaggggtaggtattgctaggatggatgatggtgaagatgccaaaggtgaaggaggaaaatacgaaaataaggaagaggatgaagaaagaaaggtccttgaaggagatagatctcaatttataaaagtatgtgaagtaaaattgtaa

SEQ ID NO: 43713 - DNA, 249 bp, Glycine max
  Peptide Sequence Number=SeqID_160491
atgaaaacccatccagaaggttctcccccgtgcacgctagctcagtctcagaaacacaaaagcctctttctcccttactacgaagacatagaaggttactctggtctcctccacaccatcgttgtcgttggggtttgtgaccgctgggatttagttgcaaggcatagggaatacctcttcctctaccttggtggtttgctttcttctgggctatccattcatcaattacactcttcaagtttgaggtaa

SEQ ID NO: 43714 - DNA, 216 bp, Glycine max
  Peptide Sequence Number=SeqID_160492
atggtgttattcgagttggatcatgttaatcagtttgcagaatggaagggtctgatgtcggttaaaaggttagctaggatagctatgaggcatgtgcatgagtcacactcaagcaaaagtttcaacgtcggtttatatgtatctcttgtatggatttggggcggaagtttcaacgtcggttttgtaaccgctggaggtccatttagtggcaattaa

SEQ ID NO: 43715 - DNA, 198 bp, Glycine max
  Peptide Sequence Number=SeqID_160493
atgtatattggaaggagtttggccttcttgtatttgtttgggtttcattccctgcactacatattggcaagggcatatcgccactcctcctggcaagttggtttgcagctctataaagaaccttggacatgcatgatcagagaaaacctttgctccccttctgccttccttgcttcgtccgtcgcctttcttgcttag

SEQ ID NO: 43716 - DNA, 282 bp, Glycine max
  Peptide Sequence Number=SeqID_160494
atgtatgaacaccaatcaatacaaaaatacggtgaacatattgatcaaagaaaggggccaaatagcatagcagcaaatttgtggagttgtgggccagttgtttttcgagctgattcccggattgccctcgagtctttcgccaggaaaaacggtgtgtcagttgaggatttcatttgcagcctgagttactccttgaaggatcttgaatctggaaagatcgttgcttggtactctccaaaaagaaaagagggaatggttgagtttcgcatgtatgagttttag

SEQ ID NO: 43717 - DNA, 252 bp, Glycine max
  Peptide Sequence Number=SeqID_160495
atggacttggtgaggaccaaggaagaggtgaggacaaggccgaagctgccctctaatggatcactatcagcagtgatggacttggtgcaactcatagatgaaggatctttgatgcaagaagaccaaagggaagatgaaatcttgaaggaagggggaggaaccaaactagagaaaagaaatggaagaggcaaatgggctaatcgatggagacaagaatgcaagggaaaacaatccaagcaggtggctgcatga

SEQ ID NO: 43718 - DNA, 381 bp, Glycine max
  Peptide Sequence Number=SeqID_160496
atgtcacgaaactttacagattacgcaaccatcccttcttcggcttctggaatgttacagaactttacggattgcgcaataatatttcctttcgactcccgacatgtcacaaaacttcacggattgcttaacgatgggtgtcaagttcctcgaagcagtcaagcaaagatatgtaggcaacttgctagtcatggagtgactgttgtactgacttcaagagatgaaagtgttggtgttgaatcagctaaggttttgcaagaaggtggcctcacggaggtggcttgtcatcaacttgacatattggatccttcatccatcaaccaatttgctgactggttgaaagaaaattatggtggtttagacattctggtcagtttctaa

SEQ ID NO: 43719 - DNA, 177 bp, Glycine max
  Peptide Sequence Number=SeqID_160497
atggaagatgcacccgttagcccccgcgtcgccctcccaccgaagggtaggttgcgacaacagagggcagaggcagctgaacgagacgttctaccgttacaacatgcaccagtagaaccaggaccccaatcctttcccttggcctactccgagcagttcgaggccacggtggcctag

SEQ ID NO: 43720 - DNA, 1133 bp, Glycine max
  Peptide Sequence Number=SeqID_160498
atgtctcttccaagcttcttcaccatcccttctgctgctcatcaatggctaagccttgtaggcatcatttggctccaggccattaatggaacaaacaccaatttccctgcttactcatgccagctgaaacacctttccatatcccaagtgcagctcaataaccttgcctttgcttctgatgcagggaaacattttggctgggtttttggtcttgtttctatttacatccccctctggctagtcctcttgattggttcaactcttggcttaattggttatggtgtgcaatatctcttcataaccaaccatatttcctctttgtcctattggcatgtgttcttgctaacttttcttgctggcaatagcatatgttggattaacacagtatgctatgttgtcacgataaggaatttcccatctcaaggccaagttgctgtgggactaacaactagttatcaatggctaagtgcaaagatttatactaacattgttgatgttttttctccacacaagaaggctagaacctttctcttccttaactctctcttgccctttatagttagcctaatagcagctcctctagccagagaaattgagaacacaggtcctaagaacattgattttgagtttgctttattgtttgttattacagttgccactggaatatatgctgtgatgaccagcttgcaatttgtcacaagcaaaatgtcctcactggttatccggaatggtattctagtatctcttcttttgcctccattagtcccagtttctttcaagttcaaggaactagttggatcatggaatacaaaaagagagagactaagagtctacaattttactatggagaacaccaataatgaagtgtcagaggatgaagataatagcatagaaggtcaagtgattggtgttagagaagaaattggagagacgttgatgcttagaagaatagatttctggttgtatttcttcatctacttttttggagcaacaattggtttagtatatctcaataacttgggacaaatagctgaatccaggggtttctctggtacttcatctttggtgtcgttgtcttcatcttttgggttttttggccgtctcattccatctctttcggactacttctccag

SEQ ID NO: 43721 - DNA, 159 bp, Glycine max
  Peptide Sequence Number=SeqID_160499
atggaatattggaaacttaaagccattcaagaaatcaatcataaaaatgccacaactatagctcaacagaaatggagacatcgagtggggcctataagctttgctcatataagggatcaattggggggacttcaagagttgattgaaaattctggctag

SEQ ID NO: 43722 - DNA, 388 bp, Glycine max
  Peptide Sequence Number=SeqID_160500
tagagggtacatctacttgggtttgattgagaacaagagagggtacatctcttgtggatcagttctagtggagggtacatccactaggttgttcaaagagaacaagggagggtacatcccttgtggatctttgcttgtaaaaggatttttacaaggttggaaaagaaatctcaaggaccgtaggtcatttggggactggatccctaagtcaccattgtttgaatttttggttccatttggccttattgctcactccatacaagttagtacaccatcctttggttctctaaattctatgtatttgctcaaatccatgaagcaatttttccttgaatttgtgcttgtcttgttgaattggggggttgtaagggatggccttaggcctatg

SEQ ID NO: 43723 - DNA, 102 bp, Glycine max
  Peptide Sequence Number=SeqID_160501
atgaagcaaaatcttgaaaatgaagtgaaacgccaaattgtggacataatggaaaagttatcggcctctgaatcacctattaactcaagtgctcaggtttga

SEQ ID NO: 43724 - DNA, 399 bp, Glycine max
  Peptide Sequence Number=SeqID_160502
atggagtcgcgagtgcggtcatgtgtcggaaccttgtcctccctccctcaccttcgcaagccaccgcgggaggtcggtgccggcccctccctcgtaactatgaaggtcgtgggctccatggcgaatggcgggaacctgttttgggggaggcagttgcgcccagagctttgctcgcaggcgctgaagaaggagatcgtcctcctccagccatgcctcgctgccgcctcctcgtcggtcgagggcaatgattccggcagagaagcaaaggttgctccggttgggtttttcaagaagtatccggctctggtgacaggactcttcttcttcacgtggtacttcttgaacgtgattttcaacatccttaacaagaagatctacaattacttcccctattcatag

SEQ ID NO: 43725 - DNA, 270 bp, Glycine max
  Peptide Sequence Number=SeqID_160503
atggaggtggaggacgagcatgtcaaaagagagcttatggtgaggagaatggtcgttggtttgaggataacatggtatggaaggttggaaaagggaagaagatatcataaatggctcagtgaagcttcattgatggagaaatatccaaggctatttgcaaattcagagcaaaataaggctttggtggaggaggatgaggaacatgttttcaagcaaatttggcatctacccgtaccttgtaacacacaagcttttgtggagattgtttaa

SEQ ID NO: 43726 - DNA, 243 bp, Glycine max
  Peptide Sequence Number=SeqID_160504
atgatgaatgcgcattggttccagacaaacatgcaccctctacgatgggtgcagctgaagaggcctcgcgccagtgaagtggtctctgacgaagttgttggcgacgtcttctgtgttgaagatgagtttttcggggtggaagagctgtttggttgcgcggcggacttcgtcaatgacagtgagctcgaggtggacaaacacggtgcagactggagacatacttctccgtctcgaacaaactga

SEQ ID NO: 43727 - DNA, 204 bp, Glycine max
  Peptide Sequence Number=SeqID_160505
atgagtaagttgagaaatgaaaaccataggaatgtggacaagaggcacaaagataaattccctaaatggtttgaacatgaggtaaagagttgtcaagaagaatatgaactagatgaaaatgaccttgatattgatgatgacaatggccaagaagaatatgaactagatgaaaatgtagaggatgaggattttgacatagcataa

SEQ ID NO: 43728 - DNA, 279 bp, Glycine max
  Peptide Sequence Number=SeqID_160506
atgggggagggatgttgtacgcagccttacccttgcatatgcaaagaggctgtttccggattcgaacccatgaccaacaagtcaccaagagatattcttagccatgattggctaaaaattgtcatggccaaaagatatcatgatgaggctggccaaaagaagctcaagccaagaccaactgaaaattgttctagccatgttagccaaaagttgtcctgggcgaaagatgtctcgtggccaaggctaatggaaaaaagtcatgaccaaaaaatgtcttag

SEQ ID NO: 43729 - DNA, 279 bp, Glycine max
  Peptide Sequence Number=SeqID_160507
atgtccacgacgagcttgcggcaagtatcgaaggtcacaacggaggttgtggcagactgctacttgttattggtacatactgcacaatgccaagaggtagctggaagcaatagagggaatgtccacgacaagcttgcggcaagtatcgaaggtcacaacaaaggttattggtacatactgcacatttccaagaggcagctggaagcaatagagggaatgtccacgatgagcttgcggcaagtatcgaaggtcacaacggaggttgtggcagactgttga

SEQ ID NO: 43730 - DNA, 228 bp, Glycine max
  Peptide Sequence Number=SeqID_160508
atgtcaaaaacaaccaaaacaaccaaaataaccagaaccatgaacaaccactgtcgaaaaagctttgagagaaaaacatatcgtgagagcgagagtaacaatggcacctacacctggtttcaacgccgcgagagtgagaatgagactgacaaaggagggttcgtgagggagacaagtcgtgagggagagacgagtgaattgctagaagcacgaaaaaattataaataa

SEQ ID NO: 43731 - DNA, 975 bp, Glycine max
  Peptide Sequence Number=SeqID_160509
atggcttctaatatccaaactctgcttgtgcttgttctggctacattggccatatttatgatcccttccaatgcacaacttactcctaatttctataagaaagtttgtccccaagcattgccaatcataaggtctgtcgttcaccgtgaaatcattcgtgaacgacgcattggagcctccttgctacgtttgcatttccatgactgctttgttaatggttgtgatggatcagttctgctggatgatacgcgcaacttcactggcgagaaaacagccctacctaatctgaattcaataagaggtttggaagtggttgatgagattaaggaagctgttgacaaagcttgcaaacgccctgtggtatcatgtgctgatatcttagctacagctgctcgtgattctgtggccatattaggtggtccacacctacggtactcagtattactaggcagaagagacgcaagaaccgcaagcaaggatgctgcaaacgccaatctccctcctccatttttcagcttctcacaacttctctccaacttcaagtttcacggattagacctcaaagacttggtggcactttctggaggccacacattagggtttgcaaggtgcactaccttcagagaccgcatctacaacgacaccaacataaatcctacctttgcagcctctttgcgcaaaacatgccctagagttggcgctggcaacaacttggcaccgttggatccaactcctgcaacggttgacacttcttacttcaaagaattgctgtgcaaaaagggtcttcttcactctgatcaagaactctacaagggaaatggcagtgaaagtgacaagttggtggagctttatagcagaaacccttttgcatttgctagagatttcaaggcttctatgatcaagatgggtaacatgaagcctctcactgggaacaagggagagatcagacgcaactgcagaagggttaataattaa

SEQ ID NO: 43732 - DNA, 534 bp, Glycine max
  Peptide Sequence Number=SeqID_160510
atggtaatcgattaccagagagtaaaaactctggtaaaagccaatgataatgaaactgaaatagaactgcaacttatacactcagaagatcaagatataggaccctcagcctcagatttcactccaagtcctaaacaagttcaatttgctcctattgctgctcctatgtatccttatttatttgatgaatctaaccaactgatcttaactcctctaagtgaccttatacatttcaatagtgtagaggcagaagaagcatcctttattccatcatgggaggaggtatgtccttggcatccatcactaatagagaatcaaagaaggagaagtcccaggttcatattgtgggcattcattgccttgggccgagttctacatttccttaagactaagacaatttgggatatgggtaatgatgattgtatgaggcaccttcaagttctatgggaagaacttcaaccctttggatttgacttgacatggctagagccccatgttcaatcaacaatgagtgcaaaaacttattttgaatga

SEQ ID NO: 43733 - DNA, 513 bp, Glycine max
  Peptide Sequence Number=SeqID_160511
atggtcattctgcgtcctttgtcattcggggacaacaagtcaagaggtgggcggagacaaattatggtcattccgtacaccttttcgccatccagaggtggtcgtgtctggtggcacgcagagacaaattatggtcattctgcgcctagccgcccaggctcgatcgcatccaaagacacgcagagacagattatggtcattatgcgccttgtgtcaaccaggaggaacgaatttgacaacaagtatagagggcaactttcataccctaatttcgtccggggaccatccattgttgggatgcgaccctcgtttgaccacttcgaggcccatttgggccttccaagaagttctccagaaggtgccttctggaggaagcaacctagctcgcctgggcgagctggaaaatccaagccgaggcgcttccgtgacgtttctgtgggtgatttcgcgaagattttcaaccgttcttcgtcgttcgtcgttcgttcttcgtcgttcttcggtcttcaatcg

SEQ ID NO: 43734 - DNA, 189 bp, Glycine max
  Peptide Sequence Number=SeqID_160512
atgggggcgatggtggtggtggcggaggcgtcgtgggttttcgccattgatcaggataactatgaactccttctctctaggtgcatcaaagaggacttggggttcaaaaatgagacgcatgaagaagttgccattaagaaggttggcaatgcatttgacaacagaatcgatgccaaaaggaccctatga

SEQ ID NO: 43735 - DNA, 696 bp, Glycine max
  Peptide Sequence Number=SeqID_160513
atgtatctaacagtgcttgatggatctataggttacgtgttagggcaacatgatagttctacaaggagagagcatgctatatactatttgggcaagaagttcattggttacgagaccaaatattcatttttagagcaaacttattgtgctttaacatgggcaagaaggattgctcgttggcaagttcttttatcagaatatgacattgtatatgtgacacaaaaagctgttaaaggtagtgctctagcagattatatagtacaccaacctgttgaaaattatcagtcaatgcaatgtgaattccccaatgaaggcataatggcgttgtttgacaatgaagattcgtcaaaagaaagaggatggatcatgtggtttaatggaaacatcaaggaattggtgaaacaatttgatgaaatcatgttcaagcacattcctcatgaagataaccaattggcagatgcactagccactttatcatccatgttagcattgagcaaagatggggacatgccacttataaggatccaacatcatgatcagcctgcatattgtcacttggtagaagaggaatctaatgggaaaccatggtgctttgaaatcaaagagtatatcaagagtagagagtatcctccaaatgcctcagagaatgaccaaagaacattgagaagactagcaatgagcttttttcctaaatga

SEQ ID NO: 43736 - DNA, 807 bp, Glycine max
  Peptide Sequence Number=SeqID_160514
atggaccatgtcttggcaagagttctagttgataacggttcctcgttgaatgtcatgccaaagacaacattggcaaaactattgtctaatgaatcatacatgaagccaagcactatggtagtacatgttctcgataggtttcgtagagaagtgattggggaaataaggctgcctatccatattggtccaattacctttgaggtagtatttcatgtgatggagattgcgtcgacatatagttgtcttctaagaaggccttggattcttggcgtaagagcggtgccctctactttgcaccagaaactgaaattcattgttaatgatgataaattggtcattatttttgttgaggatgatctattagttagtaagccatcatccactccttatattaaagatgttgaggaagccttagagacctcattccaagggcttgaaattgtgaatgctattgatgagaaggaagggaaggagattacccaaccttcaagtgcttccaagatggtggcaaaagttatgctagagaatgggtatcaatatggccatggactaggaagacatgggcagggtcctacacaatcgcttgatttggtggaaaacaaagaccgattcggtctgggctacagaccatcaaaagatgataaaaagtgggttatgcttggaaaaagagaaaaaagactagcccgattggaaaacagagtgcctagaattgaggaagtccctatctgcgatttacaagagagcttttggagtgttgggtttaagtttcctgacgcgataactgctataaaggaagacattttttaa

SEQ ID NO: 43737 - DNA, 129 bp, Glycine max
  Peptide Sequence Number=SeqID_160515
atgttggaggagaggttgaaagctattgagggtagtaattatggcatggcggaagctgcaaatctttgtttggttcctgatgacagtctaactggggcagccttgaaatggtacatgcagcttgagtga

SEQ ID NO: 43738 - DNA, 216 bp, Glycine max
  Peptide Sequence Number=SeqID_160516
ctcataggctcacctgatgacactagccttggatttctacgaagtgataatgcttgtagatatgtgagacaacttccacaatatccaaggcaacaatttgctgctagatttccaagtatgtctcctagtgctgttgatttgttagagaagatgcttgtccatgatccaaataggcgcatcacagagactcttggacggaactgcttgatgttgtga

SEQ ID NO: 43739 - DNA, 300 bp, Glycine max
  Peptide Sequence Number=SeqID_160517
atggcggttcttgaggttgtatcgggatcagaaccaccaatgagttttgaattaaaaggggtaataactccgtgggaatcaatcctcactttcctcatgccattctccattctctcccctatgaagactatatcagaaaagtttgacaagggggttccacttgagctgccactgctcgccatctttaggcatacttcttacatgttccatattccttctttgtcaaatatgtcaggagtcaagttgatgttgtacttgtactacttggtgaaagcttcacctaaatctttccaagagtga

SEQ ID NO: 43740 - DNA, 519 bp, Glycine max
  Peptide Sequence Number=SeqID_160518
atgacatgcttgaagttgacaatgcctagtatcacatccagcagttttgattgtctcgataatcaatcaaatgaagaaagcaaagacgaagagggtatttcttcagagttattaaggttggtagagcaagaaactaaaaagattcgcccccatgaagaaccagatgatataattaatttggggactgaagatgagaaaatggaggttaaagttggcacattaatatgtaaaaatgagtacaacaagctaataaagctcttacatgaatatactgatgtctttgcctggttataccgagatattccaggacttgatgtcaacatagtggagcataagttgccactgaagccagaatgtcctctagtcaaacataagttaaggcaaatgaaaccagagttgtccctaaagagtatagaggaggtcaagaagcaactcggcacaggatttatagttgttgccaaatacccacaatgggttgccaacatagttctagtccctaagaaagatggaaaagtttga

SEQ ID NO: 43741 - DNA, 216 bp, Glycine max
  Peptide Sequence Number=SeqID_160519
atgaacatttatggctcgtgtgaaatttttcatcacaataatagcaaagaccaatggccttgcgcttatgcaattgggcttgagagttacatcttagaaggaggatcaatggaagcgaaatggatatggaagaaagatgattggagatgccacttcaaggagaagatgagtcaagaagaagctcaccaccataggaagccatggataagagcttga

SEQ ID NO: 43742 - DNA, 261 bp, Glycine max
  Peptide Sequence Number=SeqID_160520
atggtggtccctactccacatgaactaaggctgaatataattcttttcaaaacattgtcacgacataacttgattcaccatgtacacatgaacatcatacattacaattcacactttcaagaagcaaggcttcaagaagattttgatgatgccaatagtcaagcatatccaagaccaactcaagaagattttgatttcaagaaagatttgtcttcatggataattcaagtaaacatcaagcaatccaagatatttaagtaa

SEQ ID NO: 43743 - DNA, 309 bp, Glycine max
  Peptide Sequence Number=SeqID_160521
atggcatctcaaaagggtttaatagggattaccttgaattctgactggtatgtgctggtttctaaagagaaatgttatcgagacgctgcatgtaggggccttgacttcatgtttggatggtatatgggcccactcataaaaggtgagtattcaaaaaccatgcgatctatgttgggaaaccggctaccagagttctccaaagaagaagccaggcaacttaaaggatcattactgcaacacaatatcactacaaggaaaatgacttatacctacagtcaaaatctgtcactagaagtccaaaatccgtag

SEQ ID NO: 43744 - DNA, 366 bp, Glycine max
  Peptide Sequence Number=SeqID_160522
atgctgatggtatgcagtggagacccaaccatatatgaaagattttggagacaagtgggtgacaagaccacaatcataattccaggatggcaatccttgagttatttttctgatggctcaaacatttgctggtttttagagaccgagtttgcaagggaagtagtgaggttacataaagtggtggggaatgctgtgacagaaggtcgccatattgttgttgggacaggttcctctcagctaattctggctgccctttatgccctgtcctcgcctgatgctgctgaaccaatcagtgtggtatctgccgcaccctattattcggaattctataatgtgctcactaaccaaagtaataataatatataa

SEQ ID NO: 43745 - DNA, 234 bp, Glycine max
  Peptide Sequence Number=SeqID_160523
atgggaggaattgaagctagctatgtatgtgtaagagggattgtggggtatggaaagcgagagaggggtggtgatgagaatttaaggaagaggaaggtggtgacacgtggagagggtgatgaacacttgggaggaggcttgcatgggaagaggtacatgtcgtttgatagcgaggaaagtcacgttctcccgtggaaagtgaggagtaatcctttcaaggatttctatggttaa

SEQ ID NO: 43746 - DNA, 207 bp, Glycine max
  Peptide Sequence Number=SeqID_160524
atgactgtgattatcgttgttgtcaacaccaccattgcaagcgatgacaacgacgaagacaacggtcatggtagcagagacggtgacaacaatggaggtgacaacaacgacgatcatactattggagatgttggcacttggcacggcagtgaatgggacgcatgggattcttctctgaaaacaggaatcagaatcttgttcaattga

SEQ ID NO: 43747 - DNA, 625 bp, Glycine max
  Peptide Sequence Number=SeqID_160525
atggcatcatccagctcttacaactctccatgtgcagcctgcaagttcttgaggaggaaatgcatgccaggatgcatctttgcgccatacttcccacccgaagagcctcaaaagttcgcaaacgtccacaaaatctttggtgccagcaacgtaaccaagctcctcaatgaactcctccctcaccagagggaggatgcagtgaactccctcgcctatgaggcagaggcacgtgtgagggacccagtttatggctgtgtaggagccatctctttccttcagagacaagtccaaaggctccaaaaggagcttgatgctgcaaatgctgatctgctacgctattcttacactgacatcactccagcatcactttctgtgccaccaggacttgcttcatttcaccatgttccccagaggcagtttagtgcaagatttggcaacgaattagcaagtgggttttatcgccaccagtctactactgctactgcttattcctttccttatgctcttccttggactgatacctcctcggaggatatcagtgagggagcaggaggaggagcccttcgaaactgttgctatccaccaccaacaccacctccagacaatactgtgaaacagtatgaat

SEQ ID NO: 43748 - DNA, 276 bp, Glycine max
  Peptide Sequence Number=SeqID_160526
atggcccttttcctttttttggttgtggcagaaggtctatcagacctcatgacacaagccttagctaagggcatgtatttgggggtcaatgtgggatgtaacaatgttgagatctctctactacggtttacaaatgacactttattttttgcaatgctgaatttgaaaaacataatgtgtatcaaaaatccccatagggtccaacccatggaaggaagcaacatggatgccaatggttctaaaaatgcaaagcaaacaaagtgcatggaagcataa

SEQ ID NO: 43749 - DNA, 339 bp, Glycine max
  Peptide Sequence Number=SeqID_160527
atgaacgagaggaaagaaaaagaaaaagaacaaggacttgatctaaagcataaagtgccatgtcgattctgggctaatgttggtcctgggccatttttgggattgaatgatggtgtcaactcggctttgacctcgcttgctggtgtcggacttgactgttggtcggtttcgagctttgaagatggaatgttgatgttagaccgcttggtcattgaaagtgaaatgattgtaagtactgggcttaaaaggtgccaagtaagtattggcttgaagagaaagggcaaggggctaggtaactctataactaaaggaacctatgatacaccttggaatgtctaa

SEQ ID NO: 43750 - DNA, 552 bp, Glycine max
  Peptide Sequence Number=SeqID_160528
atgactgacgattctagaaatgtcgtcgaatgtgttttggaactgacagtgaaagctttcattctaatagtgagtattattgtagttatgtctctcccaagattagatgctggtagggacagactagtgtggagaggatcatcagatggtgttttttctgtgaagtcagcctatggagttattagctcaagtcaacatgctccagaatcgaaattgtttaagctgattcataggtgggctggtccagaaagaattagaagctttctctggaaactagctcatgaaaatgtgttaataaatggcaagagaatgaggattggcattagtgggagtgatgaatgttattcctgccataatgaagtggaatctttattccatcttttcccagactgtagggaatccaaacaagtgtggcatttacttgttgttagggagcaatgcagagagttttccagctgtaataactggaagtactggttgagaactgccgagtctgagcccaaatggtgctatccccaacctggtcaaattgtgttagagatgcaaatatag

SEQ ID NO: 43751 - DNA, 252 bp, Glycine max
  Peptide Sequence Number=SeqID_160529
atgggagagggatgttgtacgcagccttacccttgcatatgcaaagaggctgtttccggattcgaacccatgaccaacaggtcaccaaggcacaactttaccgctgcaccagggctcgccctcacgttgaataatagtattaatacaaaaaatgaacttagcaagctttgttcgtataagtatctcaatatgttcaaatacacctacctagaggcaatcaagaactatagtccaattttttatgtgagctaa

SEQ ID NO: 43752 - DNA, 960 bp, Glycine max
  Peptide Sequence Number=SeqID_160530
atgagaatgagagtgagtagagttgtgtgtgagagcaagaagaagagcgtgagagtgatagtaagaatgggagtcagagatgatagcgagagcgagaatggtgtgggtggtgatgtttctatggacacaaacataagtgtgcagaaggttgatgtgttggaagaagtgtctaaggaagatgttggtagtacgaccaaacaaatggatggaccgatgatccctctatcggatgcagaacttttacggtgggcttctttgcggcttaatacatttgttgttaatgcctttatgttggctggtgactacaactttgccttgttagaaggcatgtggatggtggcgaatcactatctaatattgcagaggtggagaccactttttctaatgaatgtagaaaaagaaaaaaatgttgcaatatggattcaaatacaacgattacctattgagctctataatgatgttttcttgaacaaaattggatcgtctttggggaagtttcttaaagtggatcgcttgacgtctatacattatcgtgggaagtttgcgagaatttgtgtagaactagatttggaaaaaccactagaaatgcatatatatgttagagggcacaagttgtatttggaatacgaaggtcttcactcaatttgcttttggtgtggacttgttagacataagaaggaccagtgtagggaggtagtggaggttatgtcgagatttccacttgagaagcaagttgaagatgaagttgttgtggttgaaccactattggagacttctctgaaagaaagagctaacatcaatgccataatagcaaatcaaccaaatattgtaactgccaatcaagactgtacaaagattgataaccgttttggagcaagttttgttaataaaggatcaacaaatgttacaacgaatattgaggggattgaagacgcatttaaatctcaatgtggggtctag

SEQ ID NO: 43753 - DNA, 594 bp, Glycine max
  Peptide Sequence Number=SeqID_160531
atggataccgccgctaatagcttattgaatgaagaagctaggaggaaggaacgaggtatggttgtccaatctgaagctaacattgtagaaaaccataaaagaagtgagaatcgtggaagaagtgcaagtagaagccgtgataaatctcaaggacgatctaaatctcacttttctaggattaccaattactactgtggcaagctaggtcacaagaaatttgaatatatatatctcaagatttttctcgacctatcaaaggggggactttgtatagtaaaaatcgaaaattatgtcacaagcaaaatagtaggcatttgtgacatcacttttatgactgacacatggcataagctcgtgttgaaggaggtgagacaagtaccagacatgtatctcaatcttatctcagttgggaagcttgatgatgttgggctgatcaatcaatttggtgcttgcaaatggaaactcacaaaaggcaatatgattgttgctcgaggaaagaaagaaggctttgtatatgtcatacatggaagaatatgcaagggagaggccaacattgcccatggtgactcaagcatggagttgtgggatagatga

SEQ ID NO: 43754 - DNA, 936 bp, Glycine max
  Peptide Sequence Number=SeqID_160532
atggcggagaaaaccctcaaggaggacggggtaatgagctcaacaaggaaggaaagaccacgtttaagaaaaataatgcttgtaaaatcaagtataagaagcatgctggtgaggaagatacaacaaagtgatagagaaggagaaagcatagataaagccaacgagaagtgtgaaaatgatgagagcctctacttccttaagatgaatcttccatattcagataaaggatgttgtggatcattcagcgggaatttcatttcattggaagccagaggattcgagagtaaaggttctcagaagtttctcttaattggttcatataaaggtgaagtagagatgaaatgggaacacactgaggctacttctaattggtctaaaaatattgaaaattttcctaaccaattaagaaggtggaataaggagaatgtaagcacacttggcaggaatatgatcaaattcttgctgaggaagagattcactggttccaaaatcttaggcgaagatagtgatggcaattgggtttctatgcttgtaaagttggagactatggtcaccaaattttataaggatctttattcttatgattctcactatcaccccttcgtcatctttcatgtctttcctgagctaggggatgatgctagaaaggagttggggagtatgccaactatatctaaaatttttcagactattaagtatatggggagcttgaaggctcttgggctagatggtttccaagccggagtcttacagaaccatcatgcagtttttgaggtgaacaagaattttatcacgctcatcttgaataaagatgagagtggagataatattgttgctgctcaggagatcttccattctatgagcaacagaaaggggaggaaagagtggatgataattaaaattgatttggagaaaacatatgataggccgagttag

SEQ ID NO: 43755 - DNA, 267 bp, Glycine max
  Peptide Sequence Number=SeqID_160533
atggtacatgtggtagtcttgaactcaacgagcgtgttgttggtagcctccttgcagtcggcgtcagaccttggagttgccagaggcgacaaaggggatgaggtgtgtgtcgaggagtttgaggattccatcacagatgttggagagctcagcctcgatcttagagtggtagtcgcggatggcgatgacatggtcctcgttgccacaactttcttccttttgcttgatcgaggagatgatgcaccaagaggcgtggcgtgccaatga

SEQ ID NO: 43756 - DNA, 317 bp, Glycine max
  Peptide Sequence Number=SeqID_160534
gggcaagtgagcccgatgacacgcagagactaacgtcgtcttctgcacctttgtcatccagagacggcgagtccgatgacatgcggggagacggcgagtccaatgacatgcgagggtaccttatggttatccgcaccttttgtcatccagagacggcgagtccgatgacatgcgggggggcaagcgagccctttgacacgctgacactaacatcgtcttctgcacctttgtcattcagaggcggcgagtctgatgacatacgggggtaccttatggttatccgcaccttttgtcatcagagacagcgagtccgatga

SEQ ID NO: 43757 - DNA, 840 bp, Glycine max
  Peptide Sequence Number=SeqID_160535
tttgaatgggcttggcagcaccctgttgaatcattggctgtaaggaaggcagctgtggaatttaaatccctctctggaattgccaacaagattaaacttgcatacacaatgctcacccttccatcctggcagagcatgaatatcactgtgaacttcttctccactaagtacatgaaacactgtgctggttgcccgagcttgccagtgcacatgaagaccaagtttggctcactggatgaacttccatgttataataaaggcattgatggtttgtcagagaatgaagatgatactattgatgaagtacaatttgatgataataatattagtactagtggttctgttccagatgtgagcgatgatttagtcactcctgattcaccccaaaatccaaatgacggggacaagattagtgaagcatttgagtggaacaaagaatctgaagcaagagaacctccactaggtaattcatttgcttcacaagagcagagccaactgtttagttctacaacgccactgacaatgaaatcatcatcaacaacttcattacaaagagctgagattattgaagaagacgattttatgagtgtgatgaataagagtgatgctgatttgagtcaaccagaaccagagcaatcaggtgctactacattggtagccaataaaaatcgagatgtcggccgcacatttgttgtgccccatgaaactgaaattatcgatttgtcaaccccctctcctagttgcagaagcgttttggataggaagaagagaagagtttcctcttctgttggtactgattttattgacttaaccaactcccccaacttcattgaattgtaa

SEQ ID NO: 43758 - DNA, 3036 bp, Glycine max
  Peptide Sequence Number=SeqID_160536
atgggggagtatcaaacaatgaagattgaagggaagcttgctaatgtaactgtagaggtgctgattgacagtggagctagccacagtttcatttctccgaagctgactacggccttaggactaacagtcacgcccacaactgtgagaagtatcaaactgggagacggtcatagagtgatgtctgaaggtgtttgtaggggagtcagaatcgcacttggaacccagaattttgtgattgatgcgttggtcttggagttaggaggattggatgtggttttgggggtgtcatggttgagcacgttggggaaagtggtgatggattggaaggatttatctatgcaattctggcataatggtgaaatggtaaccttgcagggccaaagtgggagacagctgcaacagggttttttgaactcttttttggaagacagaaaaaaggagtttagtaatgagtggtggtggtcccctaatgtgaagattgaagggggaaaagcgcaaattaacaaaggaattgcagaggtcctgggctcatttccacaaatcttccaggaacaaataacattaccacctgaaagagagcaggtacaccagattaatctactacccaaccatggtccagtcaatgtcagaccgtataaatatccacaccaccagaaggaagagattgagaagcaggtgacagaattgttgcaagctggagttattagaccaagcatgagtgctttctcaagtccagtcatcttggtcaaaaagaaggaccactcttggaggatgtgtgtagattatagagcattgaataaggcaattgttcctgacaagtaccctattcccattgtggatgaactgttggatgagctatatggagcaactgttttctcaaaaatagacctcaagtcaggttaccatcaaatacggatgcatgaggatgatgtgcataaaactgcttttaggactcacaatggccactatgagtaccttgtgatgccttttggactaatgaacgcgcctgcaacttttcagtctaccatgaatcatatattccgaccttttctcagaaaattcgtattggtcttctttgatgacattctggtgtatagcaacagtgagcaggagcaccttacttacctcaaacaagtgctaactgtgttgatgaagcattgctttgtagccaacagaagcaaatgtaaatttggtcgtttgcaagtggattaccttgggcacatcatctctggagagggagtttctgtggaccctgagaagataaaatgcatcttagagtggcctgaacctaagaatgtcaaagaggtcaggggtttcctaggtctcactgggtactataggaaatttgtcaaagattatgggaaaattgcgagacctttgactgatctcacaaagaaggataattttctgtggggagaaactgccagagaagcttttaatcagctgaaaaagatcatgaccacatccccagtgttggttttaccaaacttttccatcccttttgaagtagaatgtgatgcggctgggaggggaataggagcagtcttaatgcagaataagcaacccattgcttattttagcaaagccttatctgacaataatttagcaaaatctgtctatgagaaggaacttatggcattggtcctttccattcaacattggaggcactacttgttaggaaaggaatttgtggtatatacagatcacaaaagcttaaaacacttcctgcagcagaggatctcctctccggatcaacaatgttggctggccaagttattgggttaccaatttgaagtgaagtataaaccagggccagaaaacaaggcagctgatgcactatcacgttgttatgatgaaggggacctaactgcactaaaatctggtcctacttgggtggatagcaaacagttactgcaagaggtgaagcaagatgcatctgtgcagaaaattattgcagaagtggagctgaatcctagtgctaaacctgggttctcagtgcagcaagggaggcaaaaatatgctgctacgtcccctggtggcctgcttcaacctttacctttaccaaatgctatttgggaggacatttctatggattttataactgggttaccaaagtctaagggttttgaggcagttttggttatagtagacagactttccaagtatagccacttcattttgatgaaacatccgtacaatgcaaagactgtggctgaattgtttgttaaagagggtactacactcaagatgagctcagcttatcatcctgagacagatggacaatctgaagtgatcaataggtgccttgagagctatctgaggcaaccacctaatctgatgagatttttgagtaatgagactaaggtggctgctgtagccttggagttgcaggatagagatgaggcactgaaccaactgaaactgcagttgttgaaagctcaacaacaaatgaaatactatgctgatttgaagaggaaaaatgtgcagtttgaggtgggagattgggtattcttgaaactaaggcctcatagacaacaatctgttgtcagaaggataaaccagaaacttgcagctcgtttctatgggccatttcaaattattgctaaggtgggggaagtagcctataaggtgcagttgcctgaacagtctagaatccaccccgtttttcatgtgtcactgttaaagaaggctattggagattatcaagtacagggcgagttacccaaggagttagaggtcattggggatgacgagatttacccagtcaaggtgcttggctcaagagttactgtgcagggaggggtttccattcctcaaagtttgattcagtggaacaagaaatcaattgatgatgtaacttgggaagacaatgctgtgatcagaggacagttcccaaattttagccttgaggacaaggctctttctgaagagggtggtaatgataggaacgtgaatgaggaattgggccttgacagccccaagcccaaagtgtggagagtgtatgaaaggaaacgtgggaaaagagttactaagtga

SEQ ID NO: 43759 - DNA, 309 bp, Glycine max
  Peptide Sequence Number=SeqID_160537
atgcggaagagaaaggttgcatctgtgattgaagaagaagaaagtgtgcaaaaccatggccataataaccaaaacgaaaacgaggattgtgaaggaaatgggttctttgcttgctacctattgacctctctcagcccccgcttcaaaggccacacttacatcggattcacagtgaatccgaggcgccggatcaggcaacacaatggggaaattgggtgtggagcttggagaacgaagaagaggaggccttgggagatggttttgtgtatctatggcttcccaacaaatgtctcagctcttcaggtttga

SEQ ID NO: 43760 - DNA, 558 bp, Glycine max
  Peptide Sequence Number=SeqID_160538
atggaacacgtccaagtcgttaagggcaaagagaagcaacaaggtgagcctgctcaggtttctgaggccaatgtgcactgcaagggaaaagctattcaatacgcaggcctaggcatgccaaggaataagaaatactttcttggccctgtggtgattgactggatcagggacagattagccttcaaagacaatataagagcagggagagaagtgggggaccaggtggaaattggagaactgaaaggaaggttgactgaagttatcagcaactgtgatgctttgtgcaagaggattgcaacaaagggtccagaatctctcgtgtcatcaatcaaaccttttgcagttactacggctgatcaagaaacctacttaagttcatctagtttgcggataggcatgaaacttcccattaattgggaccaagtcattgccactatcctatcagttgctatttcgcctactatactatctgcaggggccactacactcacctactatgctttggcagcagcccctgtagcagccacgggccacaaagccactataacagcactataa

SEQ ID NO: 43761 - DNA, 126 bp, Glycine max
  Peptide Sequence Number=SeqID_160539
atgactcttttccatattattaagtgtcctcaactattgaatctcccaagtgacatggatcacctcactactctcactgaacaaaacctgaggtacgataatccataccttttggagtgtgtttaa

SEQ ID NO: 43762 - DNA, 252 bp, Glycine max
  Peptide Sequence Number=SeqID_160540
atggaaaaaggtacaagtcttcctatggagaaagattctgttgagatttgtttacatgtacatattgttgctcagtgctcacatagtgatgatgatttagacagtggagataatgatgatgaatatcgattgccaatgcaaagggtgcaagagaaatgtgaagagatccatgaaaaacatggagcaccatccacgcttgaacatgcgagcttcttcgaggacgtgaattatgtcgcagcttttcaaccatga

SEQ ID NO: 43763 - DNA, 1065 bp, Glycine max
  Peptide Sequence Number=SeqID_160541
atgtctgattatgaggtaacaggaatcgaagatcccattactcattttgctttgttttcagattgtgaccctacaacttttgaaagtgttgtcaaagaagaaaaatggagaaaagtgatggatgatgaaattgattccattgaaagaaatgatacttgggagttgtgtgatcttccaaatggacataataccataggagtgaaatgggcatgcttggtggccaagggttacaagcaacagtatggggttgactgcacagaagtgttttcactagttgcaagacatgatacaatcagatttcagatgcataattgcaattctgtatacactccagttgagtgtggtttcaagttgcacaaagatcctgaagggaagaaaataaacagtacactttataaacagattgtgggaagcttaatgtatctaactgcaactaggcctgatataatgtattttgtaagtttgattagcatgtacatggagaatcctacagaaatgcatttacttgctgctaaaagaatcattcgctacttgcaaggaacaagagaatttgaactgttttataagagaggtgaaaaattcaatttgttgggattcactgatagtgattatgctggagattcagatgacaggaaaagtacttctggctatgtttttatgatggggtcaacagcgatctcttggtcatcacggaagcaacccattatcactttatccacaacagaagcaaaatttatagcaacttcaacatgtgcttgccaagcaatttggctaaggaatattcttgaagaagttcacttcaagcaacaaggtccaactctcatctattgtgataatagttccaccataaagttgtcaaagaatcctattatgcatggaagaagcaagcacatagatgtgagatttcattttttaaggaacctatcaaatgaagaaattattgatcttatctactacaagagtgaagagcatattgttgacatcatgaccaaaccattgaagttgtctgcatttcagaagctaaggaatttgcttggagtctgcaagcttaatgaatctcattaa

SEQ ID NO: 43764 - DNA, 99 bp, Glycine max
  Peptide Sequence Number=SeqID_160542
atggaaggaactaaaatcaaaactaccttcaagtgccatcagcagataactgatgaaccagattaccatggctatggaaagagcccttccaagatctga

SEQ ID NO: 43765 - DNA, 1554 bp, Glycine max
  Peptide Sequence Number=SeqID_160543
atgataaaacggtttccaagtaggaacaaccagaggtccaaaggcatcaaggttaagcacaatcatgataaacagaatgaatttgccaacgattcaaaactgtcagtcagtacacagacagatctgatcctgaaacttggtaggagagaccttcatccaggtaagcatgaagaaattcagaatgaaaaacatgaggaggaagaggaagatgaacataatgaagaggatgaagaaaataaacatggccatgaagaacaagaagatggaaacaagcatgaaactgaggaacgtgaagagtacaagcatgaaggcagagaacaaggggacgaagaaaataagcatggagcagaagaccaggaggaagctgaaaacgaaaatgaagatgaaggaagaggaggaggaggagacgatgatatagatgaaaatgatcaagagaaatcagagttggataatactgatcgtgatgatgagttattggatggagagcaagaaaaagaagaggttgatgagaaggagaatgaaaacgaggatgatgaaaaggagagtttagttgaaaaccacaacaatcatgaggcccgggaggaacattacaagggggatgatgcttctagtgctgtggctcatgatactcatgcaactagcactgaaactgagacacttagtttggaaaactctgatgtaaacttagaaatgaatattccaaaacctgaaaatgagacaacttattcagacgaaagtgtcgggaagcaaaatgattcagatttgaaggtttcagaaggtgacatgatagatggtatttcttcaaacacaactgctgttcaagagactggaaataacactttgtccaaccctgtggatgatagctcattactaaataaaacaactgcaacaaactctgacagtcacttggaatcaagcagtaacctgacagtagtgaccactgaagcaagcaataacttgaccggagctggtaatgacacatcaagttcatctgaacaaaataaaaaagtgatgttatctgaatctgaccaagctcaaagcagcacgatgaacacaacaatccctggagatataaaaaatgtgcagacagagggattagagcagagtggcaatagaacttcagatgaaaacctgcatgataccaattcgacgatctctgttaaaactgaaaatggaggtgtggatgcaggagaatcatctaatctagtagcttcgaatgtaaccgagaacacttacagaaatgagaggtctgaatctgatatttctgaaagtggcaagttcaacggtaactctgaaacaagtgaaacagatgaaaatcagaatgttgatgccacagaggatgagatgttcaaaggtgacacactaacaggtgaaactgatgaaacatcagactcttcctctgccaacaaaactatggattcagctgaacaagatgcaattgattcttctgatactcatatacacgaggatgtggctgaggctctaactgatcttgatacactaccagatatcagaaatgaaggagatgacagtgacgaaactgctgcagagtaa

SEQ ID NO: 43766 - DNA, 2319 bp, Glycine max
  Peptide Sequence Number=SeqID_160544
atggaagaggagagtagcatcatagaaggtggtgcttcgcttccatcgtcgggttcagacgccaagaagcgaagagtgacctacttctacgagcccaccatcggcgattactactacggtcaggggcacccaatgaagccgcaccgaatccgcatggcgcacaacctcatcgtccactactccctccaccgccgcatggagatcaaccgccccttcccggcctcccccgccgacatccgccgcttccactccgacgactacgtcgacttcctctcctccgtctcccccgagaccctcgccgattccgccttctctcgtcacctcaagcgcttcaacgtcggcgaggactgccccgtcttcgacggcctcttccccttctgccaggcctccgccggtggctcccttggcgccgccgtcaaactcaaccgcgctgacgccgacatcgccatcaattgggccggcggcctccatcatgccaagaagtctgaggcctctggattctgctacgtcaacgacattgtcctcggcatcctcgaacttctcaaggctcacaggcgtgtgctgtatgttgacattgatgttcaccatggtgatggtgttgaggaggccttttacaccactgatagagtgatgacagtgtctttccacaagtttggggactttttccctggcacagggcacgtcaaagacattggggtgggctcaggaaagaattatgcagtaaatgtcccattaaatgatggaatggatgatgagagtttccgtagtctgtttcgatccatcattcaaaaagtcatggaggtttatcaacctgaggcagttgttctacaatgtggagctgattcattgtctggtgacagattgggttgcttcaacttgtctgtgagaggtcatgcagattgccttcgttttcttagatcgttcaatgttcctttaatggtcttgggtgggggtggatatacaattcggaatgttgcccgttgttggtgttatgagacagcagtggcagtaggagtggagcctgataataagttgccttataatgaatattatgaatattttggcccagattatactctctatgtcgatccaagcaacatggagaacctaaacacatccaaggatttggaaaaattaaggaacacactactagaacagatttcccgacttccacatgctcccagtgtaccttttcagacaacaccacctaccttgcaacttccggaagaggcggaagagaacatggatagaagaccaaaacttcgcaaatgggatggtgaagattatgattctgatcccgaagaaggtggaaaggataattccaagttctcaaacatcactgcccatatgagggacattgcagatgaaatggaagaagagaagccagaagagcatccatcatcttcaaaatgccagcaacaacaaaaaactcaagaagacggcattcccgcggacgaggttaaaatccttgcgaaattcaagtcccgccacaactacatccgcgttctagaagtttctagaaaagcagaacaccccttccgcggctccaggctcctccttctcgacacccccggaaacatccacagcatatctttcctcttcaagtccctcaccaatacttacttcgacgtcttcgccacgctccctcccatcgttccccccggccccctcgccctcctcggcttcggcgccggcaccgccgcccgcctcctcctcctccaccacccctccgccctcctccactgctgggagctcgaccccgccgtcatccaggtcgcccgcgagtacttcaacctcgcccgcctcgagagggacaaccaagaccgcctcttcatctacgtcggcgacgccctcaacgccaccgtccccaacggcttctccgggatcgtcgtcgacctcttttcgaagggctctttaatccccgagctccaggatcccgccacttggcggatgctgagggggaggttgaggaagggagggaggatcatggtgaacgttggcgggagctgcgtggaggcggagaataggctcagagatgggaaggttgttatggaagagactctcggagcgatgaaggaggttttcggaaagaaggtttttgttctgagtctggggaatcgtaaggatgatagctcgcttgctctcactggggatttgcctcaccttgaggaatggaagaaccgccttcctgatgcttggtccaatttcaagcttcttgtttgtccttcagcagaggagttcacatgggtgggagaccatatcacaaagaagttcttattgaagtctcctgttgaaacaacagatgcaactgaaacttga

SEQ ID NO: 43767 - DNA, 285 bp, Glycine max
  Peptide Sequence Number=SeqID_160545
atggtgctagcgtttgaggagaaagcacagacaaaaggattttttcttcatccgtacaacaaccaagatcaaggttcgacaacattacccattgagtgcgatttcggggtctctgatcttagaacagaaattgcaccccttcctcagacagtgttactgaatgcagagttcttaggcctgtcaggttgttttctttttgtgatcacagaaacacttttctcccctcattcttgcaatgttcttgcaatgccactgatttcttttatgaattgggattgggattag

SEQ ID NO: 43768 - DNA, 1092 bp, Glycine max
  Peptide Sequence Number=SeqID_160546
atgggtcgccattcgtgttgtgtgaagcaaaaattgaggaaaggcttatggtcccctgaagaagatgagaagctattcaattacataacaagatttggagttggatgctggagttcggttccaaaactagctggactgcaaagatgtggaaagagttgcaggttgagatggataaactatttgaggcctgatttaaagagaggcatgttctcacagaaagaggaggatctaataatcagtcttcatgaagttctaggaaacagcagcaagttaccagggaggacagataatgagattaagaacttctggaattcatgtttaaagaagaagcttctgaagcaagggattgacccaagtacacacaagcccctcacagaagctcatgtgaaggaagaaaagaaaatcacagagacattatcacctatgcaaacaccattgtctcaaggttcttcagttccattaatatttccttcatcacagggatcatcacttctaataagtgattccaattactatgatggaggactaaaagaagcctcaagagaaattttcatgaccaagccagcattggatcctttgtcctactacgattttccaatgggtgttgcacagtctggttttaacttacctatgagtcagtatcagacaagccttaaagcatctgatcagaacccctttggacccaattcaagctatgtattctctacaatgccaagtctaaccaattctgatcacgggaacgtgtcggtgactgagttttcagacaacaattcagcttccaaaatcagttcattgttcatgagtgaccaggtgaaagaaagttccagcaacagctcaaacatgagcactatttaccctatcagcagcagcatgatggagaatgcagggttctcgttgtgggagggtgacaacaagtttgaccctttgtttcagttccaagtaaatgccacaaaatcagaggattttaagacaagttcatgggaagaagagcagctgcatactcaaaattccatagatttcactagctttccgttaacgtcactttcagaagatctaactggagcaaattttgatgtattccagcatatatga

SEQ ID NO: 43769 - DNA, 1803 bp, Glycine max
  Peptide Sequence Number=SeqID_160547
atgggtaagcctaaccctaaccctgccccggaagaagaaaagagtctccgggacgagctgctgggtcccatcctgctcggagagcgcgtgataaaactggctcaggaggcggagtcgccgaaggtggactgcacggagctggcgcgtaaggtgcaggtggtctgcgataacctccgctccgtggtgcgcgtggtgtctggaacccagtgcgtcaacgagcgcccaatccgccgcatcgtcggcgaggtctcgaaaaacatagagcgcacgttagccctcatccgcaagtgcaagaagcacggtggcgtcctccgccaggtcttctccatgaccaccaccgccgacttccgcaaagtccggagccttctcgaatcttccaacggcgacctggtgtggctcctcaccatcttggactccaaagacggcaccaatgtctcactcccccctatcgccagcaacgaccctattctcgcttgggtctggaccttcacctacactctccaattgggccagcccaaggaccgcgcagaagccgccactgaactcggttctctcgccagagacaacgaccgtacaaaatttatcatattggatgaaggtggggtgatgcccctcctcaagcttcttaaagaagcttcttcccctgctgctcaggtcgctgctgccaatgctcttgttaacatcacaaccaatcaagacagggttgttactttcattgtggagtcccatgctgtccccatcattgttcaggttctcggtgattcccctatgagggttcgtgtctctgttgccaatttggtctctgctatggccgagcaacatgaacttgctcgcgaggagttcgtcagggccaatgtcgctaggccccttgtgtccttgttgtccatggatatgggtactgtcctcactgaccccgtggccgaccgcgccaccagcattcactcgcttgttctcaatttatccaatgttggggaggcgaattcagatgggagtagccgcggctccggccagcatcgaagagatagagaggtcgagagccccgagttgaggaatgaggtcaaagtcagttgtgctaaggctctttggaaactctccaatggatgtctctcaagttgcaggaagattaccgagactaaaggtttgctttgtcttgccaagattattgagtccgagagtggggagttgcagcttaattgtcttatggctgtcatggagattgctgccgtggcggagtccaatgctgatcttagaagagctgcttttaagcgaactgcgccggcggcaaaggcggttttggatcagcttttgcgggtggttcaggaggagagcgacccggcattgcggattcctgctattaaggcaattggttccttggccagaaacttctctgggaaggttccgcaggttattggtcctttagttgctcagcttggtaacagagatgttgatgtggccagtgaggctgctattgctttggggaagtttgtgtgcccggacaactacaactgtgttgaccattctaaggcaatacttgagcttgatgggattcctaagctaatgagcctgctgcagataaatgatcgccaacaagttcatggcctgaaattactttgttaccttgccttaaatgttggtaacagtagggtccttgagcaagaacgtgccttgaataccctagagagatttgctcgtcctgttcaagcacaacatcctgatttgaaggacctttttgcaaaggccttacaccacctcactctttatcagccaggagctcaattgcacagacagcccttggggctgtaa

SEQ ID NO: 43770 - DNA, 405 bp, Glycine max
  Peptide Sequence Number=SeqID_160548
atgtctaggacccaatcaagccatcctttggaccctttatctgcagccgaaatctctgtggcagtggcaactgtgagggcagctggagccactcctgagctcagagacagtatccgctttattgaagtagttttgttggaaccagataaacatgttgttgcactggcagatgcttatttcttttctcctttccaaccatcattgcttcctagaactaaaggaggagcagtaattccaagtaatctccctccaagatgtgctagaattgttgtttacaataagaagacaaatgagactagtatatggattgttgaattatcacaagtacatgctgtaactcgaagaggtcatcaccgtggaaaagtaatttcatcacaggttgttccagatgctcagcctccaatg

SEQ ID NO: 43771 - DNA, 201 bp, Glycine max
  Peptide Sequence Number=SeqID_160549
atggaggctaagcgttcgtggaagggaccagaatcccactatctgattcggatggaggaactatccaagacgaaaatggatgattataaccaagagcagccacattaccaatttgttaaaaagcgcaaggagtactccatcaaaatcaaacttcttctcaaatccactggtggtgaatactacactgggaatcttatctag

SEQ ID NO: 43772 - DNA, 168 bp, Glycine max
  Peptide Sequence Number=SeqID_160550
atggccttagttctgcaaaaggcgacgcctcctccttcagttctcgctgcctccacccatgccaacaagctacccacgcctgtcatctctgaaccttctgccactcatgcccttcctcctaaaggatctttacttcctaaacttttgttcgactgcaaaagtcactaa

SEQ ID NO: 43773 - DNA, 495 bp, Glycine max
  Peptide Sequence Number=SeqID_160551
atggaagatgtgaatcgcaccccaagagaagcaaaagattactattctagatcaatatggttgtcagaaacggcacaggcatttgggaatctcaagagaagtgacagagataatgttaatggcagagattcctacggctataacttccaagaaattgtgactcctgaagtttctggagcatttgatgaaatcaaaggtttaatcagagttaatgatgaggttattggcgaagaagaaaacggtgactatggccactattctagacaatcgttgacaacagaaattgtggagatagttgaagatggcaagagcataagcaacaaagatagaagagttgacgatctttatgtggctgtaggcaaagatgacttgaatgtagtgaaatgggctcttgatcatgctgtttctcccggttcccggatttttcttatccatgtctcttctccaatcaccttgattcctacgccaggaagacttttccatcaagttcagtag

SEQ ID NO: 43774 - DNA, 1689 bp, Glycine max
  Peptide Sequence Number=SeqID_160552
atgaacccctacgacaatagatattccgacgccgcttcttttcgcggccgtcgcagtgatttcgttggacctattccgcctccgtctttcgtcggccgcggcggcgcagttccctacggcgtccccggacccaacgggttcggatccgcacccgttgctccggtaccaccctttgtgcctccttccggaggcttcaacgtaggtcgaggcggtggcagagcgggcaatggtcccgtgagtgatagaaaacacgacatgggtcgtggccgtggtggcggcggcggtggtagagccggagctcacggttttaggggctccgcgagaggaggaggtagacacggtggtggttcttctagggatgatttgaacaacattgcactcccgaagcaggattttaagaatttggtcccttttgagaagaacttctatgttgagtgccctgccgtgagggccatgtctgagcaagaagttttgcattaccgtgccagtagagagatcaccgtgcaaggcaacgatgtgccaaagcctattatgatgtttcacgaggcgaattttcctgattactgccttgaggttattgccaatctgcgttttgctgatcccactccaattcaagctcagggttggcccatggctctgaagggtagagatttaattggcattgccgagactggctcgggtaaaactttggcgtatttgcttcctgctttagtgcacgtcaatgcacaacctcgattggcacatggggatggtcccattgtcttagttttagcaccaactagagagttggctgttcaaattcaggaagaggctcttaaatttgggtctcgggcaaataaaagaagtacgtgcatctatggtggtgcaccaaagggtccccaaattcgggagcttaaaagaggcgtcgaaatagttattgctacacctggtcgtctaatagatatgttggaagctcagcacacgaacctgcggagagtgacttaccttgtcttagatgaagctgatcgaatgctagacatgggttttgaacctcagatacggaaaattgtagcccagggtctcaaggattcccctgttcaacagcgttttcctgaccttccatctgcccttctttcaacaatttcaattcagaaatctaaagcagacacacttccttcttcaactgcttgttctaaagctcaaatccaaatggaagcactatccatccatggtgataaaaaccaggctgaaagggattgggtcttggctgaatttaagagtggcagaagtccaataatgactgccactgatgttgctgcacggggtcttgggccatattgtcagtgtgttggaactgcctgtaacttgaccaaggttggtagactatctgctcctgttaatttgggaactatattttttagaggtgtcaagttatatggatgcctggatgtgaaagacataaaatgtgtgatcaattatgattttccaacaagcctggaagattatgtccacagaattggtcgaactggtcgtgcaggggctaaaggaactgcatacaccttttttacacatgccaatgctaagtttgctagggatctgattaagattttacaagatgctggtcagactgtgagtcctgcgttgactgcattggatcagggggaggttttcgctcaagaggacgaggaggctatggaaatcgtggtttaa

SEQ ID NO: 43775 - DNA, 432 bp, Glycine max
  Peptide Sequence Number=SeqID_160553
atgttagctattatcaccaagtaccaagaagaactaaatctagtcgtggcccacgagcaaaaagtggcagacgagtatgccaagtgtacgcggaaaaggaggctagaggaagggaaaaacaccataactaaacacgccccaaggcatccctatcgcaccagatccaaatcaagaatgatgggtgatcaagaggagacacaggaacagatgaaagccgacatgtcggctttgaaaaaacaaatggcttttatgatggaggccatgctaggaatgaggcaactcatggagaaaaacgtggccatcgctgccgctgtcagtttggctgccaaagcagacccaactctcctagctaccgcacaccatcctcccccaaacgcagtaggacaagagaagagtacacaggggcacaacagcaacccccaaacgcagtag

SEQ ID NO: 43776 - DNA, 105 bp, Glycine max
  Peptide Sequence Number=SeqID_160554
atggctaccattgcattatcaagtagatatgggagcaagttggcatatgacaccggaatttgggggatggcctttgtggataacttggtggtgggtaaggagaag

SEQ ID NO: 43777 - DNA, 630 bp, Glycine max
  Peptide Sequence Number=SeqID_160555
atggctttgttgcttcttcctattctaagggggttggccgtgtttcgcatacttggcattcaatttgaagcttcagttagataccacacatggattggaactgcaatgatactttttgctacaatacatggcgcaagcactttgttggtctggggggtcagccaccatattgaggatgagatttggaagtggcaaaagactggacgcatatacctcgctggggagattgcacttgttgttgggctagtcatttgggtcacttcacttccccaaattagaaggagaaagtttgaaatcttctactacacacatcatttgtatgcagtctttctagtacttttcttgtttcatgttggggataggcacttttatactgtcttcccgggaatattcctttttagccttgataaactgatccgaatcatacaatcaagtccaaaaacttgcatggtttcagctagaatttttccaggcagagctctggagctaattctgcccaaagatccagggatgaaatataaccctactagtgttatattttttgaagattccaaccatatctcatcttcaatggcactcttttcagtatcatatctagttccagggctgatgatcacattttatctgtga

SEQ ID NO: 43778 - DNA, 879 bp, Glycine max
  Peptide Sequence Number=SeqID_160556
atgaaaacaattgtctgcagatatgacacccttcttctggttgctgggggaagtggaataaccccatttctgagcattttggcggaagctgattcagctaccaacaaaagtagatttccctcgagaatacaacttgtgtatgtcattaagaaggcacaagacttttgtctgttacatccaatctcacatctgttactcaaccaatcaactgaaaagtttcatttgaatctgaaattgtttgtaacccaagaaacacaagcagaggtgggaattagggagctactaaacgagttctttaaagtaagaaccctgcaagtgaacagcatgtgttcaaattatgcagcatacgggcctgaaagtccatcttggatggctgccattacaggattttgctccatcactttccttattttcgttatctgtttcaaccatattataatcccctctggaaagcgctccaaaatggccaaagaaaagactccttcttgggttgtggatcttcttctgatagctgcttttgtcctagctttagcttttagcgcctcggtggcagctattttgagatggagaaggctgaggaaagggattccacaaatatcacacagagaaatccaaccccttgatctaagttcagctgaagctaggaatgcacttgaagaccatgaagtgcatttcgggggaaggcctaactttaaagatatatttggcaagcttcatgatgaaagcgatggatctaatatcggagttttggtttgtggacctgagagcatgaaggaatcggtggcgttcgcatgccagcaggaatctgagtgttttaaggctagtggaaagagaacagaatcctgcttcactttccacactctcaacttcacactgtag

SEQ ID NO: 43779 - DNA, 630 bp, Glycine max
  Peptide Sequence Number=SeqID_160557
atggaatccaaagccatagataatactattaaaatcctctatagctacggcggaaagatccttcctcgccacaccgacgccaagctccgttactacggcggccacaccagagtcctctccctccatccttccacttctttctcaggcgcgtgtgtgcttacgcttcagtgttttacagagctgatactaaagcttaccgagttgtgcgcttcgccggtcacacttaagtgtccattgccgaacggagatttggacaccttgatttccgtcaccagcgacgaagatttggctaatataattcacttatacgatcgagcttcttcgtcgttgcctcatcgcttgaagatcagagccattctttcgccgccgaagaaactgtctccttctccgtcttcaccttcttccagcgcagctcactctccgtccggtggttcgcctcactccgccgccgattccctgccgtgcccggcggcgcaccagttcgtccgccgtaagtgctcgccggtgccggttgcgtatccgattagcgtccgtagcggagcagcaaaaggctgtatgtacacgaggcagttagacggaagtccgagattcctttaccgtggggttcactggaataattattgccactga

SEQ ID NO: 43780 - DNA, 222 bp, Glycine max
  Peptide Sequence Number=SeqID_160558
atgatgttaccatatgcaggaaccaaagaagacagaacagggaatagctatttggcagctgctgctgatcaagaaaagaatagctatgtggacataatcatctcagaaacattcttcatccaagaggtgcctcgtgctaaccagtcattctctccttcttcttgcaacacttgcgtgctttttctttcttcctctgccaatatgtctctggaagttctctaa

SEQ ID NO: 43781 - DNA, 373 bp, Glycine max
  Peptide Sequence Number=SeqID_160559
atgaccaagatttccataatcataacgttgttgatcgccgtgaccgcgtcctgttttgtctgcgtgttacttgatcgcaaaattgaaggattctatatggttgtggcgcttgtgactattattgcatcagcgatggtgttggctttccgagcaacaatggtgacatttatcacagtcttgcgttatattcagatcagagaaggggctcttgggtctggcttgtgccacctttatcagcttgtttgccacctatcgatgaatgaagaggaagacctatccgaacgtctctctgcagaattacggaccaatcttcggtttgataaagttgatccctgtcagccagcggctaaggatctcttgcagaagttgggag

SEQ ID NO: 43782 - DNA, 1434 bp, Glycine max
  Peptide Sequence Number=SeqID_160560
cctcatgtttcaaccggtccattcacaaaaaatggtgttcctgaagaacctatcacttttgaagcaagaggtcaacagatcccatctgcagacttggctttcaatgccactcaacaagtggaggcaggagttgcccctgttgatctcaatgtccctccttttgatccttttttagctcagttccctgatggtgatggcaagaagggtgaaatgctggctgtcaatagttctgctagtaaggatgacaatagtgggatatgctcaagttctgctggtcctaataacaattctacccagactacatcattgacttctggtgctttcattgactgtcctgggtcatattattcttggccacctccacttcctggaaactataaaatgcccccatttaaaaggagccatagtcacactgatgcaatgtctggtatgttccataagggggtccgctgtgatggctgtggtgtctatccaataactggacctcgtttcaaatccaaaccaacattaccaccacatattttaaagaaaggtgccattttgaagcatgcaaggccaaggctagatagtcggtttattttggatgtcaatgtgatagatggtacaatgatggctccgtctaccgcatttacaaagatctggcggatacgcaataatggctctatagtctggcccaagggaactcaacttgtttggattggaggagacaagtttagtgactttcatttagttgacttacaggttcccgaggatggtgtccctgtggagaaggaacttgacattgcagttgactttacagcacctccgttacctggtcgatacatatcatactggaggatgacaactccatctggacataaatttggccaacgtgtttgggtccttatacaggttgatgcatctctccaggactcattttatgatacctctcaaggtctgaacttgaatattccccttgatatcagtggctctaaaggacctcagattatagatatcaatgtccagcctactgaggaagatactgttcttcaaacccgcaatcctaatgctcccattgaacctgtgaatcaaatggttgataatgaaccaaggtttgagctggaaaatgaattccctataaatgaagctacatttgttggccctgctgcctcagcccctgctgcaacccctgtggcatcttcatcagtttcttatcctattattgatttatctgaaacaaccccagctgttccatctaatcagcaatcctcaactgtggatgtgccttcatcatctatggggactggtggaattaattctgtggaggagagtctacttaaagagcttgaggagatgggttttaaacaggttgatttgaacaaggagatcttgaggaataatgagtacgatctgtaccaatccctagactttctctgtggtgtttctgagtggtag

SEQ ID NO: 43783 - DNA, 1908 bp, Glycine max
  Peptide Sequence Number=SeqID_160561
atgaatcgcgttaaggcaattgcgtcttctctcagaacgcttgagtcgtcactcgctacccgagttctggtaactcggaaccaggtgactcacttctctctccacaatccactaccccttttcgataggtctcaccatttacgttttcccatcactcaccacaaactctatttttctacgaaaccgaaaccgaactccattgtggagcttcttttgaccaacgattggtcccaagcgttagagctcaagttagaaaatcgtttcccatctatgccccacgaaaccgttctttacgttattaagcggttggataaaaacccagaaaaagcttcgtgctttttcaattgggtctgtaagaaagtttggtttaggccaagttgttcggtgtatagcttaattgttaggatcttagcggccaaggatactatgaagcagttttgggttactctgaggatgatgaaggaaaatgggttttttctcgacgaagaaacatatttgaccatatctgttggctttaagagggaaaaaatggacagtgactctgttgctttgacccacttctataatcggatgctagaggaaaatgcaatgcaaagtgttgtctccaacgtggttggtatcatttcaaggtctgaatggggtgatgaggttgtgggtgaacttgcaaagcttgaaattcagctgtcggataattttgtaataagggttttgaaagagcttcgaaaaactccgttgaaggcttacaagttctttcattgggttgggaagcaatctggttatgagcacgatacagtgacatacaatgcagttgcaagagttctcccgagggctgagtcaattgaggagttttggagtgttatcgaggagatgaagagagtgggtcatgaattggatattgatacttacataaagataacgaggcagcttcaaaggaataggatgatggaggatgctgtcaagctttatgagcttatgatggatggttcatgtaagccgttggttcaggattgcaatatgcttctaaagagtatctctgcaaatgataagccaaatttggatttggtttttagggttgctaagaaatacgagtcgacagggcacactctctccaaagctatctatgatggaatccacaggtccttgacaagtgctgggaattttgatgaagccgaaaatattgttaggactatgagaaatgccggctatgagcctgataacatcacctacagtcaaatggtttttggactttgtaagatgaggaggtttgaagaagcatgtaaagtactggaggatatggaatctagtagatgcatccctgatataaagacttggactatcttgatccaagggcattgtagtgccaatgaagtagataaagcattactttgttttgctaagatgattgaaaagggctgcgatccagacgctgatttgttggatgttctggctgacggttttcttagtcaaaagagaatagaaggtgcttacgagttggttgcagagataagtaggaagtgtcgtatatctccatggcaagctacatacaagaaactgattgaaaagctattaggagtcatgaagtttgaggaagcacttgaacttcttcgtttgatgaagagccacaactaccctccataccatctaccctttgtgccttatatttcaaagtttgggtctgtggaggatgccgaggcattcctgaaggcattgagtgtaaaaagttacccatcacatatcgtttacgttcaggtttttgaatccttattccgagaaggtagactctctgaggctaaagatctattgtacaagactcctcaccatatacgtacacatagtaaaatctgtaaactttttggttcatctgagacaaagagtgacactcaggctcagctgctgcctgatccctag

SEQ ID NO: 43784 - DNA, 540 bp, Glycine max
  Peptide Sequence Number=SeqID_160562
atgcattcctatttcccagtgaccagaaaaaggagaaagaagttgcgtctgcttcatatgtcagatgtgaggccttgccttccacgaaatgccatgaagaagaggccagagatccaacaacaccaacacgagccacaagacttggaagttctgaaagccgtagcacaagcctggtacagccactccggtacttccaagcccatgagcgagttctacgctcacagaagaaacttcagaggcagcaagccttcaaggtttaagctcgaagcattgaacaagccacaagcttcttcttcttctagggacactactactatttactgggattttcagcagtctctttgggactcctatgagcttgtcacagtgtccagaaggattgagactgggttaactttggataacccttttgatgagttgtgtggttccgcttcaatccaacataagcgcaagcctgagagtaagaatagcctcaggaacctgttcaatcttatgtcttctaggagatttaatgcccacaatactccacaccaaaaataa

SEQ ID NO: 43785 - DNA, 198 bp, Glycine max
  Peptide Sequence Number=SeqID_160563
atggatataatgctgcaaatgggagacttaaagaagatgaagcaagaagttatttccaacaacttattaatcttgttgattactgccatattagagcctgagaatcttctagactcaaatggtgtccttaaagttttacattttggtttgagtacatactcacagaaaacattgaagttgcctaaggttaaaatttag

SEQ ID NO: 43786 - DNA, 222 bp, Glycine max
  Peptide Sequence Number=SeqID_160564
atggacccaggaactgttgatatatatccttcatctcgcatccccaagaatctgcactatcttgtaaagcctatctatagttcaaaatctttaataaccaaggatttatcagggtccaggggaaccctaaaagagaaaggatttcggattacgacagacccacaaactcttacttctgtattacaattttcatcagatgatgaggtagtttctattcaatga

SEQ ID NO: 43787 - DNA, 101 bp, Glycine max
  Peptide Sequence Number=SeqID_160565
atggagcttgcatcagtggagtgcactaaccttgtcggatggcccagacgtgggtggcaagcgtggttaaagaatctaagcatttctgaggggatgcttag

SEQ ID NO: 43788 - DNA, 1416 bp, Glycine max
  Peptide Sequence Number=SeqID_160566
atgagtcacctaccatcaaacttgttgcccgttgacggaagcccagagtggatgaacaggggtgacaacacgtggcagctgacgtcagctactctggtgggcctgcaaagcgttccgggcctggtcatcctctacggcagcatagtgaagaagaaatgggctttgaactctgccttcatggccctctacgcttttgcggcggttcttgtttgttgggttgggtggtgctacaaaatgtcattcggcgagaggatccttccatttctgggacagccaaacacggccttggaccgggaattcgtttttcgcaaaacttttgctggggaatttcccaacgccaccatggtgtactttcagctggtttttgctgccatcacgttgattctcatagcgggggcgttgcttgggagaatgaacttttatgcatggatgttgtttgttccattatgggttacgttctcttacaccatttgtgccttcagtatatggagcaccgatggatggttgttcaagatgggcctcattgattattctggtggctttgttattcacctttcttctggggttgctggtttcgtcgcagcatgttgggtaggaccaagggcagtgaaggacagagagaggttccctccaaacaacatacttctgatgctggctggggctggcttactatggatgggttggtctggattcaacggtggagatccatacgcagccagcatagatgcatctctggccgtgcttaacacccacgtgtgcacagcaatgagcttgttgacttggcttttccttgacatcctcttctttggaaaaccttccgtcattggtgccactcaaggcatgatcactggccttgtttgcatcacccctgctgccggtgtggtgcaaggttgggcagcaatcataatgggaatgatgtccggaagcatcccatggtacacaatgatggtcctgcacaaagaaagtaagctcctcaaacaagttgatgatactctagcagttttccacacccatgccgtggctggtagcctaggtggcattttggctggtttttttgctgaccctaagctttgttatctcttctatggagtagaagattccctacattatacgggtcttgtttatggcatattcaatgggaggccaaatgcagggttcaggcaaatgatggttcagcttcttggcattgtgtttgtgatacttctcaatgtcaccacaactagcattgtgtgcttgttggttaggatcatagttccacttaggctgagtgaagatgacttgcaagttggggatgaagcagtccatggcgaagttgcatatgcattgtggggtgatggagagaagcttgagactgctactgagcctttgacatctgaaaagaatcttgaatggccaactgtggaactaagaacttaa

SEQ ID NO: 43789 - DNA, 1020 bp, Glycine max
  Peptide Sequence Number=SeqID_160567
atgtacaacgactactggatgctggacaacggcttcctggaacgcccgcagcacggcgacctgcgcgacctgatcctgcgcccgtacggccagcgcgacactgtcgtgatcggcccgaacgacctgctgaccaccgcgtaccagcgcatgaagctgtatgacgtgtcgcagctgccggtgatggacggcgaccagctggtcggcatcgtcgacgaaagcgacgtgctgctgcatgtgtatggcgatgaggcacgtttccgcgacaccgtcgccaccgccatggtcagcaagctggaccggctggacgtgaagtcgccgatcgaggccctgctgccggtgttcgaccgcggccaggtggccatcgtgatggacggcgacacatcaccactgaattccggtttatttgcgtcaaagctcgttaaggctgcgctgatagactcccgatcctttgacggcgccgcacgtcggcgccattcaggaaacgacatgtccaactcctcttcgcccgaccgcgcgctggccctggctaccctggccattcacggcggtcagtcgcccgaccccagcaccggcgcggtgatgccaccgatctacgccacctcgacctatgcgcagtccagcccgggcgagcaccagggcttcgagtactcgcgtacccacaacccgacccgctttgcctatgagcggtgcgtggcgtcgctggaatgcggtacccgtggcttcgccttcgcttcgggcatggcggccagctcgaccgtgatcgaactgctggacgccggcagccacgtggtggcgatggacgacatctacggcggcagcttccgcctgttcgagcgtgtgcgtcgccgcaccgccgggctggacttcagcttcgtcgacctgaccgatctggcggcgtttgaagcctccatcacgccgaagacgaagatggtctggatcgagaccccgaccaacccgatgctgaagatcgtcgacatcgccgcggttgccgccatcgccaagcgccatggcctgatcgtg

SEQ ID NO: 43790 - DNA, 216 bp, Glycine max
  misc_feature (30)..(30): n is a, c, g, or t
  Peptide Sequence Number=SeqID_160568
atgcttccttttgatttccggcatgtctcnggaacttcacgtattgtgcaacaaagggtgccaagtacctcgaagcggtcaaacaaaggttgcatgccatcaaacaatggtccccggacgaaattagggtatgacagtcatttaaggcgttggaccattaaacgatctttcgattctgttgaaaggagagaaaacattaatgcattggaccattaa

SEQ ID NO: 43791 - DNA, 402 bp, Glycine max
  Peptide Sequence Number=SeqID_160569
atggggacaaatcaaaacggaaaaagattctatcaagtcaagattaagggcctagatgtcaccagccttaaggagttgggacggttgatgggacccctccaaaggcaagccttccgcaaagtgtacgcaaagattttagatttgaccacagcggagcaagattgcagctgtggtcggagattcagcaagagagttggatcgtatgaagcaaacttgaaacggcggaaatacctggaagacaagacaagggatatggcgaatcaagaggagtgggtcccgtttgtggatatactagctttgctaatctttggggttgtcctctttccaaacgtggacggtttggtggacctagccgcaattgatgctttccttgcatatcaccatagcaaggagagcccggtg

SEQ ID NO: 43792 - DNA, 284 bp, Glycine max
  Peptide Sequence Number=SeqID_160570
gtacatcacatatcgagatgctggaaattgaacaacgaaaggtctcgagaaattcaaatggtcataacttttcacacggaagtccgattctagcgcataatatatcgagacgcccgaaattgaacaacggaagctctcgtgaaattccaacggtcattacttttaacacgaaggtccgattcaggcaaataatatatcaagatgctcaaaatttaacaacgaaagctctcgagaaattcaaatggtcattattgttcctacgaaggtcagattcaggcgcataa

SEQ ID NO: 43793 - DNA, 663 bp, Glycine max
  Peptide Sequence Number=SeqID_160571
cggctgcagaatcagctctttcgccagcgagtaaatccccagcatctcggcacccatcactttaccgacgatcagcgcatcggcctgagtacgcagctggttttgccgtcgaactcccacgttggccgccacgacttctcgccaaagtagatcatgcagagaatgcgcgtgaaggcgttgatgaacagcccgagaatcgctgccgctaccgtcagggaggtgaaatagagcatcgccaccgtacacaggaaggcaaacagcttggtgcccatctcaatcttcgccagcgtcaccatgcgtttggttttgacatagtgcgcctgatactgcgacaggtgaccgagcacgaggaagttgaggctggtcagcataatcagcgccgtcagctccggcagatggtagaaccacgccaccggccaggcgatggccagcatgatcagaccggtacagaagctcagcgagacgttaacccagtaaatggtgctctgctcacgacgtgtaatctcctgacgatgcacgatatagctgctcatgcccatgtcctgcagcacggtagctaccgccagaatggcgttgatgatcgccagcaaacccagctcgtgcgcttccagcttgcgcgccagcaccgccagctgcagcacctgcagcagcgcggcaaagcag

SEQ ID NO: 43794 - DNA, 339 bp, Glycine max
  Peptide Sequence Number=SeqID_160572
atgtggcaatggggtgtagatcgcatcacaaaaggtgcggataactataaggctcgcttgcctctagttgacaaaggtgcagatgatgacgttagtcactgcatgctaccggacccgttaattaggcaagctttggaaaatgttgtttttcaccttctcgctaagccaatatgttggcttaatgagcgtccgctaagcgcaacactgctaggctatgcgcgaggaagaatccaaaagacgatgagctatacaggttcgctgagcgcaccgctccaggtcatcaagcgcaccgcttcagctcatccgctaagcgagagaagtgcgctaagccaaaatcca

SEQ ID NO: 43795 - DNA, 402 bp, Glycine max
  Peptide Sequence Number=SeqID_160573
atgttgaaagatgaaaacctagctgatgcggtggaaacatcggctatggttgcacctcgtgggagagggggaggccgtaacagtagaggaggtcgtggtggaagaggtgaaagtcctcattgcacctattggaagaggatgggctacactcaagaaaactgttactcactacatggctctcctgaaaaagtagcacaggtgtctaagtcagaaaaaccggagtccggattctctaatgaaaagtatcaggagtatttgaggctcaagtccgagaagtccagcaatcaagcatcatcctcatcagcaccatgtttttcaacagcttgtgtttctcaattcattggaagtcctagtccttggatacttgactcaaatgcctctgatcatatctctggaacatga

SEQ ID NO: 43796 - DNA, 976 bp, Glycine max
  Peptide Sequence Number=SeqID_160574
gtcgatggaaacagattgttgcaagcatgccaggaagtgccacaaatgccagatttatgctgacagaatgcatgtaccaccaactacacgtaaggttctttcttctccgtggcctttccctatgtggggcatcgatatgattggtagaatcgaaccgaaagcttcaaacgggcatcgtttcattctagtggctattgattacttcaccaagtgggttgaagcagcatcttatgcaaatgtaactaagcaagttgtggtccgctttatcaagaatcagatcatctgccgttatggtgtgcccaacagaatcattacagataatggaacgaacttgaacaacaagatgatgaaagatttgtgtgaagagttcaagattgagcatcacaattcttctccttacagacctcagatgaatggcgcagttgaagctgcaaacaagaatatcaagaagatagtgcagaagatggtggtcacatacaaagactggcatgagatgttaccgtatgctttgcatgggtatcgcacttcagtgcgtacctcaacaggggcaacccccttctctttggtgtatggtatggaagcagtactccctgtggaggttgagattccatcaatgagagttctaatggaggcccagttatcagaagctgaatggtgccaaagcagatatgatcagttgaatctaattgaagaaaaacgcatgaaggccttgtgccacggacaactttatcaacagaggatgaagcaagcttttgacaagaaggttcgtcctcgtgtatttcaagaaggagatcttgtgctcaagaaggttttatctttccaacccgattctaggggcaagtggacgcctaattacgaaggcccatatgtcgtcaagagaaccttctctggtggtgcactgactcttacgactatggatggagatgagctccctcgtcctgtgaatgcggatgcagtcaagaaatactttgtctaa

SEQ ID NO: 43797 - DNA, 462 bp, Glycine max
  Peptide Sequence Number=SeqID_160575
atgttggagattggattgacttttggtcgtcctcttgttctaggtatactagaagttgtatccaatccttggaggtttatactagtaaactggttctatgatgcagatctagttaatcctactaggattgatcgggttcttactaacaaagaccttcttgccgattcgtatccagatcttgaggcttttaatctagatgaaaaagaatttctcctattgaaggttatttctaccttaccggagttatcttgcttaatttgttctatggttggagcgggtctagggactgacaatgtggccttgtccatgacccatttcccgaaaagagttgcctcatcccattttatggttcttgggagagaaacattggcctttgtcatatcagtgataaacaaagttgtctctcctctttgtggttttaaaaagactcttgtctcacaagtattcatgaccttgtactga

SEQ ID NO: 43798 - DNA, 336 bp, Glycine max
  Peptide Sequence Number=SeqID_160576
atggaggactactacaaggagatggaaatagccatgattagagccaatgttgaagaagaccataaggcaactatagccatatttattggaggtctaaagaaagatatagccgatgtgatgaatctaagttcaaattcatttgctacagctaaagacatagagagtgagagatcaagtgatgatgaaatgccaccattggaggattgcattgatgttgatgttgctgaacctataaatgaagatgtgcttgttactaggtgtgctcttaacatgaagcctaaggtaggaggttgtcgcaacctacccttcggcgggagggcgacgcgtgactcgcgg

SEQ ID NO: 43799 - DNA, 540 bp, Glycine max
  Peptide Sequence Number=SeqID_160577
atgggactgtatgtgcagcgtaaggatggtacactaaggttggtggccatggggaaaataatgcagggggattcaatcatacacacagtggcatatgcagatgatgttgccagggatccagaaagtattccgcacaacgaggatgcacatgtgccgaagccgactaatgtggatgcagatgatccgttgcgtggattgataaagtacagtttcgatatttacaacaagccagttgaaatcaactttgatgggagctgctttggaattgtagatgcacctacatcgatattcatagcatattcagatgttagtgaaataatagcaggagacaaaagtcttaacatatctgtcttacaattatggttaatgtatatgcatgagtggagtcagatatttagtcaaggttccatgtatgcattccttgagccacagtcgttggtttgttcaaaggatagatgcagcgaatgccaacaatatcttgaaagatggcttaaggaatatgaccgagaggtgtacattggaccttacttccttcagtaa

SEQ ID NO: 43800 - DNA, 174 bp, Glycine max
  Peptide Sequence Number=SeqID_160578
atgactaatgcaaactgtccgcaagaatcattgcattcagtctcaaacgggaatctaagttgtttgtatagcatattacattctgtagaagcaagcttcatgatgatgaatcaagaagttttgataatgacaaagatgatgacaaaaagcccaaagaatgatttcaagatttag

SEQ ID NO: 43801 - DNA, 228 bp, Glycine max
  Peptide Sequence Number=SeqID_160579
atggggatgtcttctccacctctaatcactcacaaactcatctcaagctctcaggacaacttcctcttcaagctccattctctgcagattcttcctcgtgctcagctgaggagtgttgcgctcagcggatggctcgttatgccaaaagattggcttagtgagagggtgaaaatcaacacttcacaaacttgcctaattaacctgaaattgagaggaaatgattattaa

SEQ ID NO: 43802 - DNA, 582 bp, Glycine max
  Peptide Sequence Number=SeqID_160580
atgtgggaagcactttctcaggttttgtatttaaacctctctcgtaatcatatccatggtgagattgggactacattaaagaatccaatatctatcccaactattgatctaagctcaaatcacttgtgtggtaaattaccctatctttcaagtaatgtgcttcagttggatctttcaagcaattcattctctgaatccatgaatgactttttatgtaacgatcaggacgagccaatgcaattagaatttctgaatcttgcatcaaataatttgtcaggagagatacctgattgctggatggattggacatctcttgtggatgtaaatttacaaagcaaccattttgttgggaacttaccccaatccatgggttccttggcagagctgcagtctttacaaattcataacaacacactctcaggaatatttccaaccagtttgaagaagaataaccaattgatatccttggaccttggggaaaataatctttcaggaagtattccaacatggttgagaaaacctcttaaatgtgaaaatcctccgccttcgatcaaacagatttggcagccacattccaaatga

SEQ ID NO: 43803 - DNA, 180 bp, Glycine max
  Peptide Sequence Number=SeqID_160581
atggctgtggggtctaagctggagtggtctcctcctctgctgctgctggtgatgatgctggtggctcctcagtcacaggctcctaggttgtggaggccccacacactccagaggaagaaggctgacagaggagctggtagtggaatctgtgaaggtgttggaggaatcactggaatctga

SEQ ID NO: 43804 - DNA, 165 bp, Glycine max
  Peptide Sequence Number=SeqID_160582
atggggaagctagctgctatgtggggccatcgaaaaacacttttgaatttggggatagaacatatattccttgaaggtgattggacagtaggaaagaatgaggaacgtggcaaggtacgattgggtgacgcaggagctgggaatgtccgttcagatcctctctaa

SEQ ID NO: 43805 - DNA, 195 bp, Glycine max
  Peptide Sequence Number=SeqID_160583
atggcaactcccaataacagactctctcttgccatggagagaactgggcaatgggttttctctcaagacataccaactgatgttatagttgaagttggagaaaccattttctctctgcacaagggtacgttttctgcagttcatgctagtggcaaagagcaactacataagaaaactgatattggaatcaaatga

SEQ ID NO: 43806 - DNA, 1231 bp, Glycine max
  Peptide Sequence Number=SeqID_160584
aacaacggaagcttctggaagcaatcgtggatctattcccctcggagaaagccgcgttccgatccacttcctctgctgcctcctccgctgcgcgatctacctccgcgcctccgccacctgcaaaaccgagctcgagaagcggatctcggaaattctcgagcacgtcaccgtcgacaacctcctcgtcctctccttcacatacgacggcgagagactcttcgatctcgaaagcgtgagaagaataatatcagaattcgtagaaaaagaaaaaggcaacgcggttttcaccaccgccgagttcaaagagccttgctccgccacgatgcagcgggtcgcgaggaccgtcgacacctacctctccaagatcgccgcctacggcgatctcagcatctcgaagttcaacggcatcgctattctggttcctaagaatgcgcgtaaggtcgacgacgatctctaccgtgccgttgatatctatctcaaggcgcatccgaagctggatgagatagagagagagaaggtgtgcagcgtgatggatccgttgaagctttcatacgaggcgcgtgtgcacgcgtcgcagaacaagcggttgccggtgcagattgtgctgcacgcgctttactacgaccagttgcggctgaggagcggggcggaggagcgtgacgtggagccggagaagaatcagcttcagatggacgtgtccttggtgagggagaacgaagagttaagaactgaactaatgaagatgaagatgtacatttcggatttgcagaataagaacactaataatgacgcgaaccctcaggtacatggaacgacgtcgtctgccacccccaagaaggccacgttcttctcttccgtgtctaagacgctggggaagttgaaccccttcagaaacgggtccaaggatacgacccatttggaagatgctagcgtggatttgaccaagcccagaaggagaaggaaaaaacttttgcagtcacttcatacatttcttatgctttcagtctctggtgcttgtgtaagaggaaagaaagagagagatttaatgaatatggtaacctcgtcatataccagatcgatcccttttttcatatgttgtataccctctagattaggtcttatgccaaccgatcccgtgagggttgacgctttggctttattccaaagcatgtcaacgttacggtggaattgtttatccggtcgaagatcttgggataatggtcagttatga

SEQ ID NO: 43807 - DNA, 705 bp, Glycine max
  Peptide Sequence Number=SeqID_160585
atggaggagggaaagagcaagccggcgttggcgaaaaatccaagtggtagccttcgacgtgtcctccggccgccacacgggctccattcctccatcgaccaccttgacaagggacgttacctcccatgttgttgctttgcatgttgtgcatggtcatgccttatcatgttcctcttaatcatagccattctctttcttggcatcacctacttggcttttctcaagtcagggatgccaaaagtcaacgtgagagccttcaacataacaaagttgcaagttgatgatgggtcacaaaagatgaatgcggttataggcttaggattaatattctctaacaagaatgataagcttaagcttttatatgggcctcttgatgttgatgtcactagtgaggatgtgctgttggggaagaaaaaactaggtggcttttatcaaaatcccttgaatgacacccaattggacatgaccatgacattggaaaatgctgatgttgacaagtatgctgcggaggacttgatatcagacatcaaagcctatgagatggtgtttgatttgtatgtgggtggacacattggttttcaggttgggaaattgcagatgaataatgttccctttctagcatcttgtcatcaaatcaagagggaggatgtggattttggaagaaagcctgaatgtgatgttaagctgtttgctgccagtgaatga

SEQ ID NO: 43808 - DNA, 1896 bp, Glycine max
  Peptide Sequence Number=SeqID_160586
atgaagttccattctacttcagtggcatcttttctttttgtcatagttattctctttcctctggctattgctgatctaagttctgataagcaagcccttcttgattttgctaatgccgtcccgcatcgtcgaaacctgatgtggaatccatcaacctcagtctgtacatcttgggtaggcatcacttgcaatgaaaatagaactcgtgttgttaaagtccggctccctggagttggactagttggcaccatcccatccaatacacttggcaagcttggtgctgtgaaaattattagccttcgctccaacctactcagtggaaatcttcctgctgacattggttctcttccttctcttcagtatctctacctccaacataataacctttctggtgatatacctgcctcattgtctctccaactcgttgtactcgatttgtcatataattccttcaccggtgttattccgacgacatttcaaaatttgtcggaattaactagtttgaatctccagaacaactcgctatccggacagatacctaatctcaatgtcaatctgctcaagcttttgaatttaagctacaaccaattgaatggctcaattcctaaagctcttcagatttttccaaattcttcctttgaaggaaactctctcttatgtggaccacctctaaagccatgctctgtggttccccctacaccttctccttcctcgactccacctcaatcaactcctggaagacaaagctcaaaaaacaagttgagtaaaatagctatcattgctattgctgttggaggagctgtggtgctattctttgttgctcttgttttctttatttgctgtttaaagaaggaagatgacagaggctccaatgtaattaaagggaagggtcctagtggtggtaggggtgagaaaccaaaagaagagtttggaagtggggttcaagaacctgagaagaacaagttggttttctttgagggaagttcttataattttgatcttgaggatttgctgcgagcttcggctgaagttctggggaagggtagttatggtactgcatataaggccatactggaggagtcaatgacagttgtggtgaaaagattgaaagaagttgttgtaggcaagaaggactttgaacagcagatggagattatgggaagagttggacagcacacaaatgttgtgccgcttcgtgcttattattattcaaaagatgaaaaacttttggtatatgactatgtccctggtggcaacctacacacactcttgcacggtggtaggacaggtggaagaactccattagactgggactctcgaataaaaatatcccttggaacagccaaaggacttgcccacgttcattctgttggtggtcccaaatttacacatggaaatattaagtcctcaaatgtcctcctcaaccaagataatgatggctgcatttctgattttggccttgctccccttatgaatgttcctgctaccccttctagaactgcaggttatcgtgctcctgaggtgattgaagcccgtaaacactctcataaatccgatgtgtatagctttggtgtcctccttcttgagatgcttaccgggaaggctcctctccaatctccgggacgtgatgatatggttgatctccctaggtgggttcagtctgttgttagggaagagtggacggccgaagtttttgatgtggagctaatgaggtaccaaaacattgaagaagaaatggttcaaatgttgcaaattgccatggcctgtgtggcaaagatgccagatatgagacctagcatggatgaagtagtgagaatgatcgaagagatccggcaatctgactcagagaaccggccatcttctgaagaaaataaatctaaggactcaaatgtttaa

SEQ ID NO: 43809 - DNA, 624 bp, Glycine max
  Peptide Sequence Number=SeqID_160587
atggcatcgaaacgcatcgtcaaggagctcaaggatttgcagaaggaccctcctacttcctgcagcgcaggtcccgtggcggaggatatgtttcactggcaggcaacaatcatgggacctcctgatagcccatatacagactgtattgtggatcagttccttgttatactggtctacccagtctttcaagttcagcagcttgtcagggtcagtttttccattgctgcaaatgctggtatccttcattgtgatagtggttcaattttctatgaaggaggaaggaaatttgccttgggtggtggtgcctcaggctatctgaggtgcaaagccaaaaacctgcctcacctcagtggctcaaatgctctggtggtcaaggttgcatttaggactaaggtattccacccaaacatcaatagtaatggaagtatatgccttgacattctaaaagaacaatggagcccagcactaaccatttctaaggtccttttgtccatttgctcattgttgacggatcccaaccctgatgacccgcttgtgcctgaaattgcccacatgtacaaggctgacaaggctaagtatgaagccactgctcgtagctggacacagaagtatgccatgggataa

SEQ ID NO: 43810 - DNA, 222 bp, Glycine max
  Peptide Sequence Number=SeqID_160588
atgggagggtttagggtggttattgcaagggtgagtgaggttggcgggaaagaggagagagagtggagggaagaaagcaaggagagagaggtaggattaaagggtatttatggtgcaccacggggtgtgtccccattggaggatcaaggaaatatttttctcgtgaaaggtggagatttgggtaacgaattgaaggagagagagagagggagaaaagagtga

SEQ ID NO: 43811 - DNA, 429 bp, Glycine max
  Peptide Sequence Number=SeqID_160589
gttgccactgatgtcgcatctcgtggcttggatgtcacaggagtgtcacatgtcatcaatctagatcttccaaagttagtggattgccattctgttactgctatgatggcatctcatctgcctgggcgtgcgggatcaactggcttagctacttcattttacaccgatcgtgacatgttcctcatggcaaatataaggaaagcaatagctgatgctgaatctgggaacacactgacatttgcaactggaaaggttgctagaaggaaggagaaagaagcagcagctgcacaaaaagaggcaaacattgctttatccaaacagttaggattgggagctgcttcaatgaacattgaagataaatataaattcatgattactgccacaaacactaaaagagagggagcagcagatagtgcctgggatgattaa

SEQ ID NO: 43812 - DNA, 1623 bp, Glycine max
  Peptide Sequence Number=SeqID_160590
atgacaaaacgatccttaacctcagagatggaacgcaacgtgaggcaaatgcagaagttgatggaagaggatggagactcatttgcacaaaaagctgagatgtattacaagaagaggccagagttgatttctcttgttgaagagttctaccgtgcctacaaatcaatggctgaacgttttgatcacatcaacacaccgtgtgatcttcaatcacaggcttcaggtgtttcagattatggttctgagccaaactcttacgtgccttctccttctcctaggaagatggggcgtcgtatatcaacaaatcgcgccgcggggtttgatgtttttcttggttctggtgggaatgtgaatacttttgatgcatgtcaaaaggatggagatggttcttctacattgacagagactgatgaggattatgatgatgcttcatccatgaacagtttttcaggcttctttgggaatggaaatgatcataatagtatccacagaagggtgatggaattggatattgagataccacatgaggggaaagaaaagcatgaggaggaacgtgtgaagaatgatgaattgaaaattgagaacaacgccgaagattttcgtgtcaagattaatgcatatgaacaagagctaaggattgtgaatgagaagttgagggtatcagaagaggagattggtaagctgaagattgagcttgaaaaatataggtcaatggaatcaaaaaatttgaagggtggtgttggattatcttcaattgtagaagggatcaaggtgggaggggaaaccttggagttgaagaaacttcgggaggagctaagggtgactaaagaaaaacttgagtcttcagaaatgcaaattgtttcgttgaaattcggggctactaaaacatttgagactattcagcaattgcaggaacagcttgacttggctcagaaggacattgcaagttggaaaacaaagttcaactctcagaaaagagagaactctaaactccaagaaaggcatgcaaggatgaagactaatgtagccgaccgggatcacgaggttagagatttaaaagctgctctatctgatgtagaacggaaaatcttctttgagagagcaaatatgaagtccgaaatgtccaagttgttgggggaacaaactcatttggaggagaagttcaaggaatgggaatgccaatgccaatctttggaagaggaaataagaaaaatctactttgaaaaaatagagatgggagagacactcaaaggtgaaattgagctgttaaaggaagagattgaatcaaaaaagaaaaacatagaagatgtcaatgtaaaccttgatgtcatgaagttagatagagataatctcaaagaagaagttggttcactcaaggaagttataaactcaagagatgatgagattgaagaggcacataaacaagtggaggaactaacatcaagagctaagaaacaagaggaagagattgagaggcaaagggttgagatcttagaaggagctgaagagaaacgtgaggccataagacaactatgcttctcacttgagcattacagaaatgggtacaatgtacttcgccaagctttcataggaaacaagagggttcctcttttgtgcacctaa

SEQ ID NO: 43813 - DNA, 156 bp, Glycine max
  Peptide Sequence Number=SeqID_160591
atggtaggaagaatgaagagagaatgtgacaatgtgaaagcgccacctcgcaagaatgtagcagtgctagtgaaacggcctcatctccaccgcggagctccacctcgtgaaagcgctgcacctaagagtctagccactgtgatcagtagagattga

SEQ ID NO: 43814 - DNA, 1653 bp, Glycine max
  Peptide Sequence Number=SeqID_160592
atgatgcaagatatcaaggtttcacctatatgttcttcggactacccatttaacaaagtaaggcaaagctcggcaattgttggaaacgacaagcatttttatgaccatagtaagagaagtggcttttctgttattgaagaattcttcaagactaaaaatagagatgaagacttgtggaatgcatgttccggcttccttgatgagagttttgacaacgagatgggatatgatacctcttgtaagaagacttttcaaatgggttctaaatctcctgaattattgaaaagtggggcctacaaaatggaaaattatgcttttgaagacctactcccaaagaaatggtcttcagctatagcgatgaaagagatcgacatgagtgagccacggtcttcattttccaaagatgaattagagaatgattttgacttttacgttgctagcagctcaagattaggtgggaacttcaatgctcaaaatttaattccagaagatgtaagggataattcgagcttgctgagcgaagagtcaagctcacgcactgccgagaggggtgtgtccactgcgcattcaccatcaacaatattgacgggagagaacagaagaaaacacagaaatgcttttgcaagccctagaaaacatagaaatgtttttgcaagcactagaaacaagtacagtactaaggacgaaaagtacagaagtatgccaaattcatcaaagcgaatgccatctcatgactcaaactctattctacaggaagagttggacgcacataacagttggcagtttgaggaaataaatccttcagttgataagagttctgttgccgcctcattctgtctagatttggaggcagattttgcagtcttcggatccaagaataaaattgaagatccttttagcgtctttattacccctgaattaagtaacaaggccagtccttcctttggtggatttagaaaagctgcacctcttgcagattcacctccttgcagtttcacctctgagaagtttgcatttgattcttcaatcgcattccccaatgttggttcatggccaaccggtccaagtttatctccagattttcagcccaagggaaagtctgaagatgcttgtggtggtttcgattgtgagacttcatctactgatatgtcagtgcagggaagtgtaagcaaaggggagagacaagtgaaaatgcaaaaagacaccaacaaaagttttgagcaagaagatgttttcctgggagataatgaattgtcctcagaaaagaaaatgtcagaagatgctccatcttccaaaaatcacacgaaagaatgtgaaggcaccgaggacacaaatccaaagacaacaacacagtgttttgtagcagctgactcttctggtcatgtggaggagatatcatccttactgaagaagcctgacaaacaagaaagccaagtagataaaagaaagaacaattgtgatgctgaaactcctcttaaatgtaataagagtacaaaagaagaagtgaaattttggtcacctgaaggaagaaccacgatgagtggtggaaaacataaaaatggtaaaattagcttgtcgggtcaggtgatgtttgaaagctacgtctttaagcttctgcgtgttcagaaggtattgaaggaggcatgtacatga

SEQ ID NO: 43815 - DNA, 408 bp, Glycine max
  Peptide Sequence Number=SeqID_160593
atggcagaagccaatgtagtgccgttggatttctggccaagctcttatggaatgagagtgaaaatcgctttggcagagaagggtatctcatatgagtgcaaacaagaagacttggaagctaaaagttctctgattttagagatgaacccgaccatggaagatgaacttggagacaagccatattttggtggtgaggactttgggtatgtggatgtggctcttgttcccttcactagctgcttttacacggttgagacctgcgggaaactaagcatagaggaagagtgtcccaaacttctggcttggccaagaggtgcatggaaaaagagtgtggccaagtcactccctcacccacaccagatctatgcctttgccatgcagtataaacagagacatggactagagtag

SEQ ID NO: 43816 - DNA, 192 bp, Glycine max
  Peptide Sequence Number=SeqID_160594
atggcggaaaatcttcacggaattacccacggaaacgaaaatgggggaggagcttgccacccagctcgcccaggcgagctcagctcgtccaggcgagctaagttgtctcctccagaagtaactgccttctggaggaacatcctggaaggcccaagtgggcctggttgctatttgcacccccatgtttactaa

SEQ ID NO: 43817 - DNA, 348 bp, Glycine max
  Peptide Sequence Number=SeqID_160595
atgaccggaagactgtttgccgattatttggctcttgaaagccgcatcctccattatctaattgtccgtatcttactccctagatcttcaaaccttgcagagagatctttcttgatcggtgctgttgtggttgcctcctttggttaccacaaagagcgtgatggctcttggagtattttggataggtttgatggacttcaaacctatgttggtgagaggtttgactccttggaacctcaagtggacacacgattcgaggtgatgaactcaaggattgcaaaggttgaagaagatgtcaccatcattcgcaactgctttgatttacctccaccgccaccattagtttag

SEQ ID NO: 43818 - DNA, 1028 bp, Glycine max
  Peptide Sequence Number=SeqID_160596
atgggcgacgcgcgcggcgggtaccagatcgagcatgccttcgagaaggccattgcctgcgcgcaggatcgaggcgaagacaagcttcttgccttcaaggaccggcgcgtccattggcatcaacggggtttcgatcggcatggtggtcagttcgagatcgcgtgtcacttcatagcagagcaacagcgatatttccttcagcagccgccgaaagctggctgtggacgtttccttcttgcgcatgatggtgagcttgtgctggacaagcggatggctgacgactgtaacgcccatgatctttccacttttcttgttatctttttgactttagcggcaaacggcaatgcggaccgcgtgggcgcacaaggtggcatggagcattcattcggcttcaaggcggtcgacgaaagcgaaaagcagggtctggtcaacgacgttttccataaggtcgccagcaagtacgacgtgatgaacgatctcatgtcggcgggcatgcaccgcgtctggaaagatgcgatgatcgcatggctggcgccgtcgaagcgcccgggctggacctcgctcgacgttgctggcggcaccggcgatatcgccttccgcatcgtcgaggcttccggtcgtcaggcccatgtcaccattctcgatatcaacggctcgatgctgggtgtcgggcgtgaacgcgcgatcaagaagggccttgccgacaatctcgaattcgtcgaggccaatgccgaagaactgcctttccaggacaacagcttcgacgcctatacgattgctttcggcattcgcaatgtgccgcatatcgacaaggcgctgtccgaagcctatcgcgtgttgaagccgggcggccggttcctgtgcctcgaattctccgaggttgaactgccggttctcgacaagatttatgaccaatggtcgttccacgctattccgcgcatcggcaagatgattacgggcgacgcggattcctacagctatctggtcgagtcgatccgcaaattccccaagcagcatggatttatgcg

SEQ ID NO: 43819 - DNA, 255 bp, Glycine max
  Peptide Sequence Number=SeqID_160597
atggttacttccatacttcaacttgactcgatgaaccttttcgtaaaagcacgagcttggctcaaccccataacccagggaatggcaattttgatcgccaatacttcatcaacatttcatagggatgaaagactcgggaatacgcatgctatgcatggaaaatgtaattatgagattaagatgcccgaagaacatcctttcttagttaaccatgcattagaggaaaacacaaggatcacgcatgagcaaacatga

SEQ ID NO: 43820 - DNA, 255 bp, Glycine max
  Peptide Sequence Number=SeqID_160598
atgatggttagatggagaacatacagcttcaaggtagatggagaacaaagagagcaagaaagcttagatggagaagaagacagagagaaggacaagacaacacgaaggagacgaaacatacctaggtatggtggcgaaggagaagaagcagagacttgtgacgaagctcgagtgcgacgaacacgatgctcagatgcacacagggacggtttcgctagacggagattagaaaaagaagacagcgcggaagcttag

SEQ ID NO: 43821 - DNA, 222 bp, Glycine max
  Peptide Sequence Number=SeqID_160599
atgcagctcatagttaatatgaatggccttcccaatattacaggaatgtcattatcttcacagatgatgcaatcctaccccacaagggcattggatagaagactccaagaagattgggccaaagatgcaagagaaggccctagggttctcatgagccttagggtagggtaccctagaaatgtaggattttccagcccttgtattttagggcatgtagactag

SEQ ID NO: 43822 - DNA, 219 bp, Glycine max
  Peptide Sequence Number=SeqID_160600
atgggggttcaaatagcaaccaggcccacttgggacttccaggatgttccttcacaaggcggttgcgtctggaggaagcaacctagctcgcctgggcgagctggaaaatccaagttgaggcacttctgtaacatttccgtgggtgatttcacgaggattttgaccattcttcgatgttcttcgttcgttattcatcgttcttcggtcttcaaccggtaa

SEQ ID NO: 43823 - DNA, 330 bp, Glycine max
  Peptide Sequence Number=SeqID_160601
atgaggaaggaaaggtttcctgctcaaataaaatccaagttgcaaccaagaggaaataggccttttcaagttgtagaaaatataaatggcaatgcttacaagctggacttgccaagagaatatggtaacagatcagattcgaggatgaatcctttcgaagagggagggaatgacagaggtgcaaccagctcgtctaatgatcctttacacgggattggaggtcttatgacaaggtctaagactaagaggatgaagcgagcattgcaaggcctgatactaaagatcaaagagaaagaaaatcaatttgaattaagggttgcacctaattag

SEQ ID NO: 43824 - DNA, 147 bp, Glycine max
  Peptide Sequence Number=SeqID_160602
gaaagattctgcgatgaggaaacagaactttcccagggattagttcctgcgttgcacgagttgcaggaaggagcgccggttccgtctcaagagcagatcagaccagacattaagggctatcatgaagctttgaaccacaaatcctag

SEQ ID NO: 43825 - DNA, 822 bp, Glycine max
  Peptide Sequence Number=SeqID_160603
atggctacctcaccaaaagaaacttcagctcctggttcaccctctgcaccatcatctccatcatccaccaaagcaccagcaaaccaggaacgacctgaattcaatatccagcccatacaaatgattcctggttcagcccctgttcctgaaaaactggttcccaaacgacaacagggagtgaagatttctgaaaaccctagccttgcaacaagtcctagggaagtagacacagagatggataagaagatccgcagtattatggttccaacatcttccaccccagatgttgctgttcctgatgctgagaaagatgttccaacatcttccacccccagcaaagaggaatcaacagaggaagatgatcaagccacagaggagacccctgcaccacgggcaccagaacctgctccaagtgacctcattgacctagaagaagtagaatctgatgaggaacccattgccaacaagttggcacctggcattgcagaaagattacaaagccgaaaaggaaaaacccccattaagaggtctggacgaatcaaaactatggcacagaagaagagcactccaatcactcctaccacatccagaaggagcaaagttgcaatcccttccaagaagaggaaagaaatttcctcatctgattctgatgatgatgtcgaaccagatgttcccgacatcaagaggaccaagacatcagggaaaaagacttgctgtagaaagagaactaggaagagatgccttggattgcaaggagatcatggacctcatcacgactgctggactgctgaagactgtcaccgagttgggagactgctatga

SEQ ID NO: 43826 - DNA, 216 bp, Glycine max
  Peptide Sequence Number=SeqID_160604
atgagtcttcattcttcatctagtgttaatggtgagggttctactcctaaggaccccttgtataagatattagatgagttgagatcccttaagttgtggaaagaaaaacaagagagaaaagaaaaaggctttgctaagtatatagtggaggaatggggaaaattacatgtggaaagcggcttatgtgttgacaggaagcttgaaagtatggaataa

SEQ ID NO: 43827 - DNA, 222 bp, Glycine max
  Peptide Sequence Number=SeqID_160605
atgtttatcactgaagcatatcgaacactttgtgacaagggtccataccctgctgatcaggtcctcaaggaacttgaaggcagtcttggatttatgatctatgaaaattttagtagcattttggaatggagaaggaggaaaggtgattggagatgccacttcaaggagaagatgagtcaagaacaaggtcaccgccataggaagccatggataagagcttga

SEQ ID NO: 43828 - DNA, 348 bp, Glycine max
  Peptide Sequence Number=SeqID_160606
atgaaaaattctcgatgggagaaagagttacaccattataatcaatatgaagaagaaagacttaaaaatcttgaggatgtgttgatgcaattcatggaaacatctcaagctaacttcaaagccaatcaacacgcaattcacaaaatctggagattcaagttggaagaaaggtatggagaatgtgataaatctttaagtatcattctctttttgatcaccaacacttctgttgcaatgacatggaagacatttccgggatacatgagtttcatggagtctttggctaaggacgaaagtgcaaggaaaatgtgttctatgcgaccttcatgtcaccttgaaggtatctga

SEQ ID NO: 43829 - DNA, 825 bp, Glycine max
  Peptide Sequence Number=SeqID_160607
atgttccgcataagcaacactgtggtcggagccctcaacgtgctatcccttctgctgggcatcgccgccgtgggctcctccgcatacatccacgtccgcggcggctccgactgccagaaggtgctgcaggtgccgctcctcgtgggtggaatcttcgtggtgctggtctcggccttgggaatcgtggggtcgctgtgccgcgtgaacggggcgctctacgcgtacctgttggtgacgttcatggtgatcgtggggctggcgttcttcaccgtgttcgcgctcttcgttaccaacaggaaggtgggccagcgggtttccggcaagggctacggcgagtacagggtcgccgatttctctcactggctgcagcgctacgtggttaacaacaagaactgggacgaggtcaagagttgcttgatggacgcccacgtctgccagaacctcgccctcaacggtggccgcaacaacgactctctcattttcaaacacttttctaccacccaggctgggtgctgtaagccaccagtgtattgtggattcataatgaagaatgctacgttctgggaagtgccaaagaagggtccagcagcgaataataatactgattgcagcacttggaacaatagtaaggagaaactgtgctacgattgcaattcatgcaaaggaggagtgctggccaacataaggaaccagtggaggcgtctcaccgtattcaacgcatgtgtgcttgtgctcgtcaccgccatttacgccttgggctgctacgccatcaaaaacaacagatccgattcccactgcaaccaccgcaaaccacccatcccttga

SEQ ID NO: 43830 - DNA, 441 bp, Glycine max
  Peptide Sequence Number=SeqID_160608
atggctattgtaagattgatgaagacaagcaacaagaaacgacacacttataataatggatcttctacgtctcctataaaatcacttccaaaagatttgttggtagaggtggttgcaagggtagcctctgattccatcgttgatcttcgcaatatgaaacaatgttgcaaggattttcttgatgcttcggaagataattacgtgtggcagcaagtttctttagacaagttcccattaatgcgatggcttcctaatgacaaagcatcgtgcttcttaaaatgttgtagggagagtggaaatattgaaagtttgtatagagaaggattgctgaaattctttaattacccaaacggaaacattaatggtctcggagacttgaaaacggctgctctaaagggtcacatcgaagcaaaatatgtatacgatgggattatgagatag

SEQ ID NO: 43831 - DNA, 912 bp, Glycine max
  Peptide Sequence Number=SeqID_160609
atggaagagggtgacagtgaggccatttttggtgctcttaatctgaacccgcaactcttctgtaacgaagttctcaacattgtcgacgatgtgctcgacgaagctttcaatttcttctaccaggacgcatccacgaagctcaacatcgaaggcacccaaaggtcccaggatctgaaaaagggtgttgattgcgttcggctgaatgttcaatctgttttggacaaacaacttgctgcttgggagagttacatcctccgtcactgttttgctcttccccaaggttttcgtatgccaaacaccgcaaatgttagcaattattatgttatgctagtggtggaattcaaagccatgaccagtatcgcctcaacccctatgttagttgttgatgttgacctttatagcatttgtgttcgagatattgcaatagacgatgatgaaattcctaacttccaggatgaatcaaatgagaatgccctagatccaggtgctccttttgatccagatatagatgcccagttagattcattgagagaaaaactaattgaggtggggaaggagtctgaaatgcttaatcaagaaatgcaagcattagaaagaaagtctgctgtcaatgtggctggacatatcaatgaagctgtacaattatatgagcaaaattctatgcatgaggtgtttcaggagattgtgacgaccgcctcagaacttggagcaaagatggcaaagctaaactctagcatgattgaagagactgaccaaacaaaaactaaaaggatttacagcacagaaatggatctatctgctataaatcctgctaaaggcctgtcaaacatgaagttagacgatgttgaagaattttggttactaaatgagtttatgaagcagaactttctgttgctcattctaaatgcatag

SEQ ID NO: 43832 - DNA, 591 bp, Glycine max
  Peptide Sequence Number=SeqID_160610
atggtatgtttgtctatcattattctcagttacttaaaaggaaatcaaataagagagaacctgggtggtagaaaagtgtttgaaaatgagagagtcgttgttgcggccgccgttgagggcgaggttctggcagacgtgggtgtccatcaaacaactcttgacctcgtcccagttctcgttgttaaccacgtagcgctgcagccattgagagaagtcgccgacacggtactcgccgtagcccttgccggaaacctgccggcccaccttcctgttggtgaccaagagcgtgaaaacggtgaagaacgccagccccacgattaccatgaacgtcacgaagaggtacgcgtagagtgccccgtttacgcggcacagcgaccccacgattcccaaggccgagaccagcaccacgaagacgccgccaacaaggagcggcacctgcagcaccttctggcagtcggagcctccgtggacgtggatgtagacggaggagcccacggcggtgatgcccagcagcagggacagcacgttgagggcgccgaccacggtgttacttatgcggaacatgctcgatcggaacaaacgaggatgtga

SEQ ID NO: 43833 - DNA, 639 bp, Glycine max
  Peptide Sequence Number=SeqID_160611
atgcaactgatagcagtgctgatgcatccagacttccatctagaaatcaatttgacaaagcttacttatcatcttttctcattatatcagacggctgtgcggactagtcttatgcctggcattttgaaaactgttgctcacaacaaggatcatccaaagcccataaaggttatctatggcaggtggaggaatatcacagaaattccgccatctaaacatttcattgtggcctattgtgccactctagcaggcctctcttcccaaattgcctatggcagagggatttttgaagttggtgatatagcagttttggatgaacaaagagatgttggtgcaaaaaatcttcgccaacttgctgctctgtactgtggtgctaatgctggatttgagataattcatggcttggtcgacagagtaatggaaaagaatggggttccctttgtttcacctggtgataaatcaggttattatattgagcggtcagatgagcctgagtttcttgctggtagacaagctagaatcatttacaaaggaaagcatattggcacttttggcattgttcatcctgaggtattaaacaactttgacattcccgatccctgctcctttgttgaacttaacatcgaaagtttcctataa

SEQ ID NO: 43834 - DNA, 216 bp, Glycine max
  Peptide Sequence Number=SeqID_160612
atgttggtgttggggaatgaccccttgaaaagagacgatgttttgactaaagaaagaaattggaagaggaacatgtgggaaggggttgaaggtagaggagctcagtgcactagtgcgggatgtcacgatggagggagattagtgcaatcgttgtcgctgggctctaggcttccaccttcatgtgaggccacacattccacatcgtcacaaacatga

SEQ ID NO: 43835 - DNA, 1011 bp, Glycine max
  Peptide Sequence Number=SeqID_160613
atgatgatagctatctctgcaacttttatgattttcttcttgtgttcgccatcagtggctatactaatcaccaggttgccgctaccctcaccagtgacaggccctgagtccgtagcattcgaccggaacggtggagggccatatgtcggtgtttctgatggaagaattctcaaatatgctggtccaaccgagggcttcaaggaatatgctttcacttcaccaaacagaaacaagacaatctgtgatgggcttgctgatttctcagaactccaagcaacatgtgggaggccattaggattgcgtttcaaccatcaaacaaacgaactatacgtagctgatgcttattccgggcttatcaagattggacccaatggaggggctccaacccaatgctttaaagatatacaaccacaacaagagaatgttaacactactctaggctttctcgatggtttggatgtagacgtcaacagtggagtcgtttatttcacccaagctagtgctaactaccgtttcaaggatgctcaggcactacaaagcagcagagaccaatccgggagcctattctcactggacccaaaaacgaaccaaacaagagtgttgatgaggggtcttgcattggcatctggggtggcagtaagcagagacgggtcatttgtgcttgttagtgaatacttggcaaacagaattcagagattttggctgagaggaccaagagcaaattcctctgaactattcttgcaacttacgggaagaccagacaacattagaagcaaccagagaggtcaattttgggtggcagtgaatggtgctttaggaccaaatccacctcctaggcccactattttacctggtggactcagaattagtgagaatggtgtcattttacagattttgtctcttgtcaaggaatttggtagtgaggcagcgagtgaggttcatgagcataacgggacactctactctggctccttgcgtgcttcctatgttcccatttcttctatgatctag

SEQ ID NO: 43836 - DNA, 327 bp, Glycine max
  Peptide Sequence Number=SeqID_160614
atggcaagatgtgggctttcttggaaagttgatttgggaagttatgaaaggaagtcagaagttgtgggttcaaatagtggcaaaaagatatatgaaagatgggcattggatagaagactccaagaagattgcgccagagatgtaggagaaggcccttgggttctcatgagccttagggcgagcgaggcgaggctcacgggtgtgctttctaaaggaggaaagatgtgcggagtcgccaccaatgtttatttgtggaaagcgtcggaaaaaccgaaggaaaccggtcaaaacgaaaattctaagtttgggagttgtatttacgtttga

SEQ ID NO: 43837 - DNA, 897 bp, Glycine max
  Peptide Sequence Number=SeqID_160615
atggacccgttaagatgctacggcccatataaatacctaagacaaatagtatcggattctgaacatctctttctccgtcgtggtttcacttgtactcactcactccaagaccaaaacggcgccatgcctaccgtcagtgtggggcgtgatcgcctgtatgctgctctaggaaagacttacacgcaagaggaattcgaagacttgtgcttcagtttcgggatcgagctcgacgacgttacgacggagaaggcaattgtgagaaaagagaagcatttggatgaagaagaagctgacgaggacgaagaagttatctacaaaatcgaagttcccgccaacagatatgacctcctgtgccttgaagggcttgctcaagccctccgagttttctgtgagttccaggagattcccacttacagattgtccaacatcagtaaagatgcaatacagaaaatgcacgtgaagccagagacttctctgattcgtccatatgttgtatgtgctgtattaagaggtataacctttgataaagtaagatacagcagctttatcgatctgcaagacaagcttcaccaaaacatatgtcgccgaagaactcttgttgccattggaactcatgatctggataaattggagggccctttcacctatgaggctttgccaccttcaagtataacttttacaccattaaagcaggaaagaaacttcagggctgatgagctaatggagttctacaaatcagatttgaaactcaagaaattcttgcatataattgaggattctcctgttttccctgttatatatgacagtaagagagttactcccaaccaactagctgtttccaagggtcacaaagcagtagttgtactgccaactgccaacgctcaccctcaaagttga

SEQ ID NO: 43838 - DNA, 1323 bp, Glycine max
  Peptide Sequence Number=SeqID_160616
atggtgatgcatctaaacgggacaccgtgcgctctcggattccacatgcctgcggagtgggaaacccacgcgcagtgctggatgggttggcctgaacgtgccgataactggcgtgacggcgccgttcacgcccaacgcgtgtttgcgagggtagcgtcagcaatctcaagattcgagtctgtaacagtttgtgttagttctgcacagtgggagaacgcgcggagtcagctaccggagcatatcagggtcgttgagatgaacatgaacgattcttggttccgtgatattggacctacttttgttgtgagaagaagcaccacgccggaatctggtgatgcagtgagcaggattgcagggattgactggaattttaatagttggggaggcttagaagatggatgttactgtgattggagtcttgatttgcttgtggctaagaagattttgggaattgagaagattcctagattttcacattcgatggtgcttgaaggtggaagcatccatgtggatggagaagttccttggatgccgatggtgttgttctccaataagaattggagtttcactttgataatctgcatagtaaaggtttgcaataaagatcaatgtagattaccgaggtggaagttcaattttgatttgagaacaaaaccaacaacacttaaagaactgcatcattttttcctttcttcaggaacttgtcttaccacagaagagtgcctcttgaacaagaacaggaaccctcacttgagtaagaaccaaatagaggatgaacttaagacatatcttggaatccggaaggttatatggttgcctcgtggattatatggagatgatgacacaaatggtcatattgataacatgtgctgttttgtgaggcctggtgtggttatgctgtcttggattgatgatgaaactgatcctcagtatgaaagatctgtagaagcatattctttgctttcaaatgaaacagatgctaatggtagaaagtttgaaatcattaaactccatgttcccagtccactctatatgacagaggacgaggctgctggggtttctctggataatgaggctaagccaagacttccaggtactaggcttgctgcttcctatgtaaacttttacattgcaaataaagctatcattgcaccacaatttggagataaaaagtgggatgatgaagctgtccgagtcctatctaaggccttccctcatcatgaacttcaagcagtacggaaatttaggggtatattttatcctgaaaatctcgaagaatatccagttaaagaaacaacggtggttggtaactcgaaaaaatga

SEQ ID NO: 43839 - DNA, 1341 bp, Glycine max
  Peptide Sequence Number=SeqID_160617
atgtgggacttcacttcacacttgtactccaacaagaaggtagcagaaggttccaacagtgtcgccagcggcaaggaatttaatggcttagcattgattggcggaggagcaattggatctggggccatagatactgtttctggtgttgactcgcctcggcgacgtctattacgagatcaggttcaagtggttaaaagaaaggattccaatcgctatgaaattgttcctatccaagattctttgtcatttgagaaaggattcttcatatttattcgtgcatgccagttgttggctcaaaagaacaatggaatcatattagtaggagttgcaggtccatctggagcagggaaaactgttttcaccgagaaggtcctcaattttatgccaagcatagctgtcataacaatggataattataatgattctagtagaattattgatggaaactttgatgaccctcggttgacagattatgataccttgctcgaaaatatacagggtcttaaagcagggaagcctgttcaagttccaatatacgatttcaagtctagttctcgcatagttggtcatgggttcaaatccagaaacaacctctttgtatatgcaagcttaagactgctaataatggccctctcgataccttctcatagcgagggccaagggactgttgaagtccctagctctcgtattgtaatcatagaaggcatctatgcattaagtgaaaaatcacgacctttgcttgatcttcgtgtttctgtcactggtggagttcattttgatcttgtcaagcgtgttttgcgggacattcatcgtgccggtcaagagcctgaagaaataatccatcaaatctctgaaacggtgtatcctatgtataaagcttttattgagccagatctcaaaacagctcatctaaaaattattaacaagtttaatccattctctggattccagaatcccacttacatattgaagtcagcaagagctgtgacagttgatcaaatcaaggcaattattgctgcagagcatactgaaaccaaagaggaaacgtatgacatatttcttctaccccctggggaagaccctgaagcttgtcaatcatatctgagaatgagaaaccgtgatggaaagtacaatctcatgtttgaggaatgggtgacagatagtccattcataatatcacctagaattacttttgaggtcagcgtgcgccttcttggagggctgatggccttgggatacacaattgcagctatcctgaaaagaagcagccatgtctttcatgatgataaagtgaccataaaaactgattggctagaacaacttaatcgcacctatgtccag

SEQ ID NO: 43840 - DNA, 358 bp, Glycine max
  Peptide Sequence Number=SeqID_160618
atgcaacaactcgtgtctaagccaatcgtcgcgtgtgcacaccatcaccacccaaatccacctatgtgcatgcgcaacaacaacgacccaaccaccaccaaccatcgcatcatcatacacacctccaccctcaccacctccatgcagatctgccaaacacgacccaaaacaacatcccacgaccaaaaaacattatcatcaacgcttattttcacatattcctattttctttaatgtcgatggtgttgtagtagggaagaattgggctcggaggttgcgaaaggagcaagggacagtgtcaaaagggaagaaggaaaagaggaagaagaggagaagagttggatttgattttttttaa

SEQ ID NO: 43841 - DNA, 1032 bp, Glycine max
  Peptide Sequence Number=SeqID_160619
atgctttttgatcctcccctaggccttgggctgccattttttgttttttgttctttattaaccttcattatggttcaagggaaagacagaaactattgtaaatttgtagcagagaaactggggttggatggttcctatgttcctcgcacttacattgaacaaatccagcttgaaaagcttgtaaatgatgtgatggcattgccagatgatcttaagacaaaactcagcatagatgatgacttggtttcaagccccaaagaagccctttccagagcttctgcagataggagaatgaagtatcttaatcgtggtatttcacaatcatattcaactcaaagggacaagattctacctaagctgactaaacttgctataaataacagaagattcgatgcaagagcgctagaatcacctgcaccaattgctaaccaaggagtcatcacacagctttctgatcaaatttccacattaaatgaaagaatggacgaattcacctcccgtattgaagagctgaattcaaagttcgctatcagtaaagattcagcagccagtcaacaaaacttggctttacaggctgaggcctgcaatggctctggccccacttccttctttgtaactggactaagcaatggctcattgactggatcattgctacctaattcttcatcatcttctcaattggctaataaagagtctcccctgatggaagaggtactagttattgcacgaggacaacgtcaaatcatgcatcaactagacactctgagcaattttttgcatgaatactttggagaaaggtcacgcctgggaagaccagaccatacaggaagaatgcgtgaagctgaatccgttgccatccccctggttctgactctggcctttggtgctgttggtgtgcttttgttcagagatcagccgtttgattgttttagtggcgagttgctcagcgtctgcaagaaggaagaaaattttctttaccgcgtgtttagtttctcgtctcaaaccaactggcctgtctcctctctaaagtag

SEQ ID NO: 43842 - DNA, 1329 bp, Glycine max
  Peptide Sequence Number=SeqID_160620
atggggtgctcattctccggtctgaatgccttatacgactccgttaacggcggaggcgatgtttggatcaacgagaaccgtttccgcatcgttcgccagctcggagaaggtggcttcgcctacgtctacctcgtcaaggagactcctaatgattccgccgtcgctgctggcctctccaagaagctcaaaggctcctctcatctctccgatgacgggacttatgctatgaaaaaggtcctcattcagaacaatgaacaactggagttggttagggaggagatccgtgtttcatcactgttcaatcatcccaatctgctgccacttcttgaacatgcgatcatttctgtcaagcctacccaagaaacatcttggaaccatgaagcatatttgttgtttccagttcatttggatggaacattgctagacaatgccaagataatgaaagccaagaaggaattctattccacctcagatgtgcttcaaatatttcgtcagctttgtgcaggactcaagcacatgcacagttttgatcctcctcatgctcataatgatgtcaaacctggtaatgttctcataacacatagaaaaggacaaccacctcttgccatactgatggattttggcagtgctcgtccggcgaggaagcaaattggctccaggtcagaggccctccagttgcaggaatgggcatctgaacattgctctgctcctttccgagctcctgagctgtgggattgcccaagccaagctgatatagatgagaggactgacatttggtcgctaggatgcacattatatgcaataatgtatggggtatctccatttgaatatgcacttggagagtctggtggaagcctgcaattggctattgtaaatgcacaggtcaaatggccagcaggacccaagcctccatatccagaagctcttcatcagttcgtgtcatggatgcttcagccaacggcttccatgcggcccaggatagatgatatcattatccatgttgacaaaatttatcagcataaatggaatatcatttatttattgacgttctttgttcatatttcgcctaccttcaatgagcaagtatttgaccatcacttttcgttaacgttggaatggggatgtcaatatggctatctcaagggttttgtgcataattctccaaataagattccaagagaagatttcgctgatatccacccttcctgcttgttgaaaagagcttgctgcagtgcagcagcagcagcagaagaagaacccatctacagctttagagtgaaaacaatctgcatcatggaaccaacactctcattattgctttccgtatga

SEQ ID NO: 43843 - DNA, 246 bp, Glycine max
  Peptide Sequence Number=SeqID_160621
atggatattttttctataactgttggttattgttgttcatgctatctcatatatcatgttcaagaaactccaattactatgcaagatcttgcaggcgcaggagcaacaaagaggcctacttgctgtgttctggtacagacaaagcctgcaaagggtgaaatagagcaaggggaacaagagaaactaaagtcagattatgatcaagttgtagcggaagttactgagcttacaacttcactcttttga

SEQ ID NO: 43844 - DNA, 576 bp, Glycine max
  Peptide Sequence Number=SeqID_160622
atgtctatgtactacagcactgtcacgtttttgcacgatctcattaatatgaacacgatggagtcttccaaacattggctacccatcgggtcaaaccttacggtgaaatccgagatgccgcaatgtttagcagaacaatacccaaaccaacacgctgttaagaaggttgagaaattgaaagctgccaaatttcaaatgaaaatgcttaggatcgggctttttaagctaagcgttactattgcgaggcaaaaactggtgtgggaaatattaattgatggtttgctgaagaaaattgaaatacgctggcagaatatttcggctattcgagctgttattggggaaaatttgcaaggaatgctagaaattgagttatttttcttctacatgctcgtgctaccaaagctcgcttcaagatacaacattaatgtcttggagtcaaggcttatgtttcaaatgagttggtgtctgatagcaacaaggcacaagatagcagtagaccaagatgatcatcaggaaaccagcccactacaaggacttcgtttgagatgcacattgctcttcctgactagacgatag

SEQ ID NO: 43845 - DNA, 2918 bp, Glycine max
  Peptide Sequence Number=SeqID_160623
atgccaggaatgctagctcctgaaacctttcgtgcgtatggcaccgttcagcatcacaagctcaccatccttgccgatggtggcagtacgcacaaatctgtgcaattgcgagtggccaagtttctcggccttccttccacttcgatcgacccccttccaatcatggttggtaatggaggtgtcatgcagtgcaggttccgctaccctcaggtatccatttccattcaaggccaccagttcaccgtggacctttttgggttatccttgagtggtgttgacattgtactgggcgtccaatggcttagggacttgggcccggtcactactgactacacctccctttccatgtccttcacccacctgggccatccttttcacctcgttgcgaacatgcccgtcaacccaccctcagcctcggcccaccaacttaaacgcatgttgcaaacccaagctgtcttggccctgttccatttaggacctgcaccctcctcttcccaaatagcttcaccaaccttagtctccgacaaccttcccacacctttagccctctccaccctccttgccaagtttcaccaattatttagcgaaccatcccagcttccccctgttcggcccatctcccaccatatacacctctcgcctgactccaaactcatcaccgttaaaccttaccgctactcccatagccaaaagacagaactcgagaaacaggtccaatctatgctcaattctggactcattaggctcaaccatagtcccttctcctcactgatgcttctagtcaagaaaaaggatggtagctggcactactgcattgactatcgggcccttaatgctatcaccatcaaacaccgatttcctatgcccaccattgatgagctcctcgatgagcttggcgcggcgtcatgtttttcgaaattggatttgcgccagggctttcatcaaattcgtatggtggaagaggacattcataagacaacttttcggaccaacataggacattatgaatattacgtcatacccttcgggctttgcaacgcgccgacaacatttcaggccaccatgaacaaattgcttaagcctttcctccgcaagtttgtggccgtgttttttgatgatatattggtttacaacccttcttgggtcgttcatctccaacacttggaagctatttttgttgtgctctcccaaggttccttccatttgtgtgagtccaaatgcgcctttgccaaagccaagctccaatacttaggccatattgtgtcggcggacagcgtggccccggacccatccaaaattattgccatgttgaactggtcaacgcctaccaacactactgaccttcaggggtttcttggcctaatgggcttttaccgacgcttcatacgtggttatgcgcccatggcagctcctctgacagctctcctctacaaagacaattttctatggagtaacgaagctcagtgtgccttcgataatttgaagcaagtcatgacttcggcaccggtgctcactccgccgaacttcaccattcctttttgcgtggagaccgatgcttttgggttcgcgatgggggcagtgctttcccagcaagctcacccgatagcattctttagcaaaatcctttgctcaaggctccaacgctcctctacatacgttcgtgaacttcacgctatcactacaacacactacttggccaagcttttgggctatgactacaccatccaatattgttccggttcgggcaatgtggcggccgacgcactttcgaggattgttccgccggggcactatttaattctctctattcccaacctcgaatatgctcactctgattattcggtcaagaaggactggattttctatcgtggcaagctttggcttccgtccgacaatccttatattcccatgcttttggaagaattccattcaaccccactagggggacacatgggtaaggccaagaccctacaacgactccaggataattccttctgggacagtatgcgccgtgacgttcaccgcctggtctcagagtgtcgcatttgtcaacaaatgaagtataagagtaagaaacccatagacctcctccaaccaatacccaccccttcaggattgtgggaggatttatccctggatttcatcactgggctgccgccgtcccatggattcacgaccatcttgattgtcgtggacaggtactcgaaaggcacccatcttggagtcttaccgccaaagtactccgcccacaaagtagtcagcctcttcctcgacattgtctgcaagttgcatggcttcccccacaatttggtgtccgacagagacccaatttttcttagctccttctggcgtgaattgttctgcctaagtgacaccaaactccgttacagcactacctatcaccctgagtccgatgggcaaactgaagtccttaatcggactctcgaacaatacctccgttcattcgtccatgatcggcctactctctggtactcattccttccattggcggaatggagctataacacacagtatctctcggggtcctccccaattgaggttgttgattcgatgatggccactaggcaggccttgcacaccaaactacaacaccacttgctgaaggcccataatgctatgaaggcctacgccgaccgccaccgtcatgacgtacacttccaggtcagagatttagtctatgtctgcctccggccatacagacagctgtccgttcgaccccattattccaagcttgctaaacccttttataggccttttcgggtcacgaagaaaattgggcctgtggcatatcgcctccaactgccaacgggatctaaaattcaccccgtcttccacgtgtcactcctgaaaccccacaacagcccaccccctaccaccgacgagacacttccactagc

SEQ ID NO: 43846 - DNA, 1278 bp, Glycine max
  Peptide Sequence Number=SeqID_160624
ccaggctctgtgaatgccgtgactgcagagtatggtggtatgttaggatccaattgtaaggaaaatactgatgacaatgttccaatgcctacattttttcacttccttgctttacttgccttcaagatatttgcagcagagcaggtagatgtttctataatggaggttggattaggtggaaaatatgatgcaacgaatgtggtcccaacacctattgtgtgtggtataacctcccttgggtatgaccacatggagattcttgggaatactcttggagaaattgctggtgagaaagctggtatcttcaagcatcggattccagcatttactgtgcctcaacctgatgaagcaatgcatgtactcagagagaaggcttctcagttaaatgtacctcttcaagtggtaaccccattagatgccaaattgctaaatggttcaagactagcgcttggaggtgaacaccaatatataaatgctggtcttgctattgcattatgctctacgtggctgaaaatgaatgggcatcttgaagactctgactcatctgcctgtatgaagcaacacactttaccagagaagttcataaaagggttaacaactgcaagtttgcaaggaagggctcagattgttcctgatcagttcatcaatgatgaaataccaaatgaacttgtcttctttttagatggggctcatagtcctgaaagcatggaagcatgtgccaggtggttttctcttgctattaaagatcaagaccagattttgtttcatcagaaacttgataattctaacttctcaaaccaagtagtgaagatgcacaatggtgaaactgtacagaagaaatccacacagattttgctgttcaattgtatgtctgagcgaaaccctcagttgcttcttccccacttgatgaaaacatgtgctgatcatggtgtctacttcaagaaggcactctttgtacctggtttatcagtgtatcacaaagttggatcccatgctttaccagcgacagattctgatgttgacctgtcgtggcagcttactctacaaagagtgtgggaaaatctcatgcaagggaacaaagtcacttggctagaaggcaagagtaataattctgctcctgaagaattaaacatggaaatgagtgccagcaattgtgaacacagtgccgtgttttcctcattgccactggttctcaaatggcttagggacacggtgcaacaaaaccagtcaactcgttttcaggtaacattaattcatggttacactggagaattgtga

SEQ ID NO: 43847 - DNA, 622 bp, Glycine max
  Peptide Sequence Number=SeqID_160625
ccatctgactgagacaagtgtgcgagcggggaattctgatgtgtatggattcctcgagccacagtccattcagagatctgggcaatcacaatttgaatccgaaagttatatcaagagttggatacagagttcaaaacgagatgtttaccttggagcctatctgaataggccagacaactaccttaagggaataattaacagtgctttgaaaggacttgatgatactccacaaccgaaatccaaggctgctgctaggtggattgttgttaagtttaatttgacttggcaaatagacaaaaagattaaagaatatattctctcccaggaaaatttggatcgttggcacaatattcacgatacttgtatcctttacgaggggcaaatggggacccttgctacaattgaaagcttttttgctttgttcgtagagaaagttgaaacaacaatagacgaagcacaacgagtagtagacattgtagaagacgtggctgagggggtggacaaggtggcagaagaagctgtgaagcatcttcctgatggaaaacttcgtgatgctgttgaatttgttgaaaaagtagctgaagatatagataagcatgccgaacgcgcagaagatgaatag

SEQ ID NO: 43848 - DNA, 570 bp, Glycine max
  Peptide Sequence Number=SeqID_160626
atggcgcacagcactggatccgatgacagtgtttgccaaggattcgccctcactactcaacaggagattgctatggctaattcatatcaatataactcttcagataatcagtttttgtatttttcataccttcgcgacgaagaccaccaccaatatattgatgatgatgatgatgaacaaactgcatataaaagggccttgaaagagttttcccagcttccaccactcctcgggttgaaaatcactatgacacctgaaatgctgcagccaaccaagacaagccaagttgcagccaataacaaggttgagaaactaaaggctgtgcagtttccaatggatatgctcaggatcggctattttaagattgaggctaagtatccttatgaattggtagctaagtgttattatgcaagacaaaaattgatctgggagatattacatgatggtttgaagttcaagattgaaatacactgccagaatatatcggccattcgagctgttatggaggaaaattcacctggaatactggaaattgaggtatatttctcattatatataccagtattttag

SEQ ID NO: 43849 - DNA, 405 bp, Glycine max
  Peptide Sequence Number=SeqID_160627
atggagttgcttaacatcggttttagaaaaaccgatgttaactacttcatttttggcaaaaacgatgttaacttcatagagttaacatcggttctgccggaaagcgcttgctcgacacctacattgtcccacattgttttcagtactgccggaaaccactcccacagaaccccctatcgaagaaaacttgaagcaaaccctacactgctcttggaactgtggctcgaagaaaaccctacatacactcctccactaggtactagggtggtgaaacagttcgtgtttgtcacttttctgcgaggtactagggtgctgaaacactcgtgggtgctcaaagctcaaaaatttctccacaagaagtttgctaagtttggaaggagtgatgtggttattgcacgatggtag

SEQ ID NO: 43850 - DNA, 327 bp, Glycine max
  Peptide Sequence Number=SeqID_160628
atggtgcaatggtttgaattgagaaaacgcaatactgacttcacatttgaattcacgaaaagtcacaaatccatattgagactaaaagagccgctaaaaaatactgaggaagaaaactaccccaattgcattttcagagtggatagtggagagtggagagtggagacccaccatatgagattgagagaaaatctaacgtcacctcatttctccacctcagattaccattgtcctattcctatatatctaaaagccatcacatattgcgatgtcatgctaccaatggagaagatggagataacaataaaaaggttggaattacgttga

SEQ ID NO: 43851 - DNA, 2121 bp, Glycine max
  Peptide Sequence Number=SeqID_160629
catataggtgattttacttatccaaggcttgcagattttggtgctgcaatatctggggcaaataaattgcaatgccaacaagttcttgaagagctagatgtgtataagcgattaaaacttacactggagttggtaaagaaagagatggaaatcagcaagattcaggaatcaattgcaaaagcaattgaagaaaagataagtggtgagcagcgccgttacttgttaaatgagcagcttaaggccataaagaaggaactgggactggagactgatgacaaaacagctcttactggtaaattcagggaaaggattgagccaaagagagaaaaatgcccgcctcatattttacaagttatagatgaagaacttgcaaagctacagctgttggaggctagttctagtgaattcagtgttacccgtaactacttggactggttgactgcactgccttggggtgaatacagtgatgagaactttgatgttactcgggcacaaaagattcttgatgaagaccattatggattaactgatgtgaaggaaaggatactggaattcatagctgttgggaaattaagagggacttcacaagggaaaattatctgtctttctggtccacctggagtgggcaaaacaagtattggtcgttcaattgcacgtgccttgaaccgtaagttcttccgattctctgtaggaggattagctgatgtggctgaaatcaagggtcatcgtcgaacttatattggtgctatgccagggaagatagtacaatgccttaagaatgtgggcacatccaacccccttgttttgattgatgagattgacaaattgggcagaggacatgctggtgatccagcgagtgctttgttagagcttctggatccagagcagaatgctaattttcttgaccactatcttgatgttaccattgatctatcaaaggttctttttgtttgcactgcaaatgttgttgaaatgatacctaatcccctgttggatagaatggaggttgttgctattgctgggtatattactgatgagaaaatgcacattgctagagattatctggagaagaccactcgtgaagcttgtggaataaagcctgaacaagtggaagtgactgatgctgctcttcttgccctaattgaaaattactgccgagaatcaggggtcaggaatcttcaaaagcacatagagaaaatttaccgaaagatagcgctacaacttgtgaggcaaggggagatgattgatgctaccatgctaccaataaaagacaaagttgactctgatgaattaggtcaaaatgcagttcaaaataagaactctgagttggtggagggtatcgatcctgaaaaagagagtgaaacatctgatgaaattcataaggtgcaatcatctgatcaatctcaatgtctcgaggttgcaaaagaaagtgggggagataaggaaattgaaacaaagactattgaacaagtattggttgatgaatctaatttaactgactttgttggcaagcctgtcttccatgctgagcgcatctatgatcagacacctgttggtgttgttatgggtcttgcctggactgcaatgggtggttccacactgtatatagagaccacatttgttgaagaaggggagggaaaaggaacactgcacctcactggtcaattaggagatgtgatgaaagaaagtgctcagatagctcacacggttgcccgaagaatactactggaaagagaaccagaaaatcctttctttgcaaattcaaaactacacctccatgtccctgcaggggctacaccaaaggatggaccaagtgctggttccacgatgaccacttcattgttgtcccttgccatgaagaaacctgtgaagaaggatctagcaatgactggggaagtgacacttacggggaagattcttcccattggcggcgttaaagagaaaaccatagccgcaagaaggagcgaagttaagactattatattcccttcagctaacaggagagattttgatgagctagcacctaatgtgaaagaaggtcttgatgttcattttgttgatgactacatgcagatctttaatttggcttttgatgatgagcaatctcagaatataaagtaa

SEQ ID NO: 43852 - DNA, 486 bp, Glycine max
  Peptide Sequence Number=SeqID_160630
atgtgggccattcatactggccgacaaattgattgggcacatctagtccggtatcacatgcataaggcattgcgattaaatgctcctttgccctatcctcaattagttactttgtcccttcaacattttaacatccctcttgattctgaaccttatgttccaatcaagagatctttcttgatcggtgctgctatggttgcctcctttggttaccgcaaagagcgtgatggctcttgggtaaaaaaggatgctcaaccaaatgatgatgaaggacacttaccggctgaaggggactcttctctccttcagagtattttgtacaagtttgatggacttcaaacctatgtttgtgagaggtttgactccttggaacatcaagtggacacacgattcgaggagatgaactcaaggatttcaaaggttgaagaagatgtcaccattattcatgactgctttgatttaccttcaccaccaccatcaatttag

SEQ ID NO: 43853 - DNA, 246 bp, Glycine max
  Peptide Sequence Number=SeqID_160631
atggatagagctggtttggttggagcagatggaccaacccattgtggggcatttgatatcacatacatggcctgcttgccccatatggtggtcacggctccatcagatgaagctaagctgatgcacatggttgcaacagtagcaaccatagatgacaaaccaagttgctttagatttccaaaaggacttgaatatgcgtcaaataattcccaagttgaagaagtctacttattggctatgtggtga

SEQ ID NO: 43854 - DNA, 123 bp, Glycine max
  Peptide Sequence Number=SeqID_160632
atggcttcaacgcagggctacgagttcactacggatatctgcgcaccttggctggacgctcttgtgatcaagggtgacttttcccatcccgaaggaaagattgacgaggcagtggaagcttaa

SEQ ID NO: 43855 - DNA, 450 bp, Glycine max
  Peptide Sequence Number=SeqID_160633
atgatggcacatcatcgtctaagttattttcttggtcttgaggtacattatggtgctaacggtatttttctaagccaagcaaaaaatgcccatgacattttggaaagggcaaaattgttggatgtcaagtccatttctacgcctcttgcttctgccagctcctgcaggctcccatcactgatcatttccaagttgtcaagtgaatattgtgctatgtcaagggcaccttgtcctttggcctatccttcactcggggatcctttcttcttgttcttggttactctgatgccgattgggctcgttgtgttgaggcttgtcactccacctatggctactcgatattcttgggaggtaatcttgtgtcctggagtgctaaaaagtagcccattgttgctcgttccagctgtgaatctgaatatcgggctatggcaaatgcagcagctgagctaa

SEQ ID NO: 43856 - DNA, 885 bp, Glycine max
  Peptide Sequence Number=SeqID_160634
atggaggatatttacaagatgaatcctcttctttcatgttccggcggggatgttgttagggaagttaacgttaattccgctactggtgcttctgaattgaatcttggactggtggctaacaacttcttttcggatatttcggatcggttcatcaagtcccagatcgccactcaccctctctatccaaatctagtatccgcttacatagaatgccgaaaggttggagcaccaccagaactggcttcacttcttgaagaaatagcccgtgaaagctacccaacggatgctcttcgtgagataggagatgatcctgaacttgacgaattcatggagtcatactgcgaagttcttcatagatacaagcaggagttgtcgaagccattcaacgaagcgaccttgtttttgtgcagtatcgaatcacaactcagcaatctttgcaagggaacactgacaatgccattggataacaaccactcagatgaggccgctggaacatcagaggatgaattgagttgggagaaggtggaagcagttgaaggtcacgaatcttctggcccacgtccaggtgatcaagagcttaaagaaatgctccttcgtaagtatggtggttatcttagcagcttgaaaaaggaatttcttaagaaaaggaaaaagggtaagctaccaaaggatgcaaggatggtactcatggactggtggaacacccactatcggtggccttatcctacggagaaagtgcagctatcagaaatgactggacttgatcaaaagcagatcaataattggttcatcaatcaaagaaaacggcattggaaaccatcagaggacatgcgatttgccattatggatggtgtaagtggcagtggctttggaggacctatctaa

SEQ ID NO: 43857 - DNA, 153 bp, Glycine max
  Peptide Sequence Number=SeqID_160635
atggcaagtgctctgaatggatttgacaaggttaagacgtcagtcactcattttcacttcgacgtgacatttcgccacgtaactatgtttcattggcgactctgcctgcgtgcgcatcaccggtcacctctccccaaccttactcaaccttag

SEQ ID NO: 43858 - DNA, 291 bp, Glycine max
  Peptide Sequence Number=SeqID_160636
atggagtttctactagtgcgctaccacagaaggctggacttggatgcagtggactccgaggggaggacggcaagccacgtggtggcaagggaggggcacacgaggtgggctaagcgtgcatccatcgctaagcgtagcttcagcgtgcttagcatgacagaagaatctggcagggcatcaatatcaaggccgcacactaagcatgagatcagtgcgctaagcgcagcaggtgtcttctgccaggctcagcgcacgactggcgctaagatcaaatccacttacttgcgctaa

SEQ ID NO: 43859 - DNA, 462 bp, Glycine max
  Peptide Sequence Number=SeqID_160637
atggagatccttaataagactcttgaaatgtacttaaggtgctttgtgtttgataatcctaagccgtggtaccctatgctagcttgggcacaatattggtacaactcttcttatcatcacaatttaggtatgaggccatttaaaactgtatttggcagagaaccacctgcaattgttccttatcaagtccatcctaaggatccttgggagtcatttgatgctagtgaggcttcgtgggtggatttggcagctattaaacaatcttatcctcgattcaaacttgaggacaaggttgattgcaaagggaagggtattgtaatgagtaattccatgggtgacaattatgctagaaattttgttaggaatgatggacacgtggaagacgatccacaaaacttggccaggagaaggagcacaagggcccgtagggagaacatgcatttaagaggttatgctcattga

SEQ ID NO: 43860 - DNA, 453 bp, Glycine max
  Peptide Sequence Number=SeqID_160638
atgtggaggcaagatgttggtggtcttgtgcgaagtagggaagtagataaaagcatctcaggagttggtatgactttccctcaattgaaggtcttgtcaaccattatggtggtagttagtcctctggaacttggacttttaactgtggttgtcgtggttcataaggaggcggatcttgggttttcaagcccttggagaaccgagactcaccaaggacaaaccttgagtttgacgagcctggtgtatgtagcgcatgcgctgtgctcttgcatacgtgtcactttatggagtgacatgtactggagacgtggtgtcattctcttgcatacggttactcgtggagtgacacgtactggagacgtagagtcatgctattgcatacgtgtcactcgtggagtgacacgtattggagacgtggtgtcattctcttgctacgtgtcactcgtggagtga

SEQ ID NO: 43861 - DNA, 354 bp, Glycine max
  Peptide Sequence Number=SeqID_160639
atgggagctcgcccaagcgagctgagacttactcctgaagtaactggctcacccaggcgagctagttccttcagcctgaagtcatttgagggcccaggcgagccaaaggctagcctgagggagttggggtctaggaaactcaataaaaagatccttttgcccctcgtttttgtgaatactacggtagatatgacaaataaggcattaaagatcacagtttatatcctcaacaaggtaccaattaaagtagttgctaaagtccctaatgagctatggactgggaataagtcgatcattaggcacatgcacatttgggaatgtctagccgaagcaaggccttataggtcgcattaa

SEQ ID NO: 43862 - DNA, 870 bp, Glycine max
  Peptide Sequence Number=SeqID_160640
atggcagtggtactaaaaaatagcaatggtactaaaaatagcaattatgtcctcaaatggcatcataggaacataacctcttcagcagtgactcttgaacctgacatgaccccaagagtaggtagttttgctctggctgagtttttgtcaaggaatgagcatggccatcatgtaatcagcaataggagcaacctgaggctgtggattttaagtaagcttagaagttgtggatttaaggctgtggtgcccaagactaggcaacctgaggtgctattggtaaagaaggttcatgaatttgaggtgagaaaaaggccacatgaggcattagcagatatgggactaaatggagagtacaatgtcaacgagttaatgagattggattttgtgaccacaaagactagaaccttattgtatatgagtgcatgtccaatggatctctcttatgatgacctatactctagtgataagaaaaaggaaccactatcatggaaatgcaggctaaagatctgcgcagaagcagcacatgaccacactactttcacacagcaacatggtggccaaactctcagacttccagctttccttataaggactgcattatgcatcaaagcaaaaaccatagacaatatcaacagaaggcaaccattggattacaattcagtttttgtatctttgggttatccaatcttgaatgaaagaaaatgtgggagtgaaagtcaattttcgattgcaagtacaagtggaagccaagttctgagtataggtgaagctcacaatggaagtcaagttgaaaactatatacactgtagctgcacaacttcaattagtcttgttgatcccagctattctctacaatcttcattagtttaa

SEQ ID NO: 43863 - DNA, 153 bp, Glycine max
  Peptide Sequence Number=SeqID_160641
atgacgttggtgtcgccttggactcagtcgtggggtaagttactaaaaatcccgtcgtgggctagcataggtgccgccttgtatcgtgacctaccttcatataggtcagtgtcatcattcggtgaggctgcctgtgtatttacagattcatag

SEQ ID NO: 43864 - DNA, 1470 bp, Glycine max
  Peptide Sequence Number=SeqID_160642
atgtccttagccaaattatatgaggaaaagtatcaaccagtaaactctaatcgggcccacaattattcttatagatatttccccatttctgctcacactgttaatttcaattctgctccttctaatgctgctaaaaatactatcaaaacatatttgcccccattgttgcctactcctaatactccccctcttagaaataattctgttaagaaaatttctcttgttgagatgcaattatggcgtgaaaaagggttatgctacttttgtgatgataagttcacatttaatcataagtgccccgacaggcagatgttaatgttacaacttgaggatgatgaaggtgaagctgagatgagttttgatgttgtgtccagagataataatagtattgtcgaaactgggattaacaatcctcaccatctttccttgaatgccttgaaaggaggtcttggtgttggcactattagatttgtagctcatatcaataccttacccgtgagggtacttgttgatggtggtagttcaaacaattttctccagccaagagtggccaaaattttgaaactacctatagaaccatcacccttgtttaaagttatggttggtaatggagctaactggttgaaaacacttggttctcacattgcggattatgattccttgcaaattaagttcttacatgatgggaaatttataaccctacagggtgacgatgatggtactcctactcaggctcaattacatcatattaggagaatgatttctactgattctattgctgaaactcccacatccttaccacctccaaggtctcatgatcatgctatacccttgttggagggatcaaaaccggttaaagtcaagccttaccactatttacatagtcaaaaagatgaaattgagaaattgttgcaaggaatgcttgaggaaggcatcattcagccgagtaagagcccattttcttctccaattattttggttaagaagagggatggttcttggagggtgtgcactgactatagagcattgaattctattacggttaaagatacatttcctattccaacagttgatgaattgattgatgagctgtttggagctgaatttttctccaagttggacttaaggtctggttatcaccagattttgttgaaacctgaggatagacaaatcgattacttgggtcatgttttgtcaagtgtaggagtgactatggaaaccactaagctggaagccattactgattggccacaaccaactattataaaacaattgaaaggatttctaggactcactgcatttgtgcagctcaagaaagctatgacttcagctccagtgttagcaattcctaattttagagaatcatttgtacttgagattgatgcttttggttcgggtattggagcagtactgagtcaatctcaacatcctattgcttatttctctaagaagttgtcccctagaatgtaa

SEQ ID NO: 43865 - DNA, 366 bp, Glycine max
  Peptide Sequence Number=SeqID_160643
atggtgccacccgcgaatggcggagttgagacagagcagtcaggtgaaaagggtttgcaaaacctcacaaaaatcagaaaagaagtaaaacacataccttgcattgatgtcagactccaacggaggatgctccacttcgcggcagtcacaaaccccaatggcaatcacgaatggcaaagatgggtaagctttatgattgcaacaagttcaagctttttttctcgagattccacactcctcaatgtgggtgcgcccgaaacttttaatcgtcgcaagggatcaaggttgattgttagagcaaatgctgattattattctgtccttgggattattattctatttgttcccttatctgttacacgataa

SEQ ID NO: 43866 - DNA, 273 bp, Glycine max
  Peptide Sequence Number=SeqID_160644
atggagcttagtagaaaaagtaaaaaatcttcctcctttgaagcttcgcagcaaatcctaggtttgcttcttggtatctccggagtagaactagatatcttagatgagttcaaggatgttgaatatactagaactgatgttgaggtttccttgaaggacaagtctgaaaggttacaagtttgcgcttatgtttggagcaacccaaatgatcctaacttatatgcagagtgggattttgagtgtgctaaagcaacaacttggttaaaatcataa

SEQ ID NO: 43867 - DNA, 423 bp, Glycine max
  Peptide Sequence Number=SeqID_160645
atgaccggatgccttcttgccggctcattggcttttgaaagccgcatccttcattatctgattgtgcggattttgcttccacgatcttccaatcttgcccaggtttctgaggaagatcttattatcatgtgggcctttcatatagggcgtcaacttgactgggcacatcttgtcaaaaagggtgctcaacctgctaatgaagaaggcaacctaccagttgaagataattccactcttcttcgaaggcttatggacaagtttgatggacttcagacttttgttggtgacaagtttgatgccatggaattgcaagtcgacatgcggttcgatgccatggaatcaaggatcaccaaagttgaagaagatgtctccttcatccgtacttgctttgatccaccaccaccgcctccatcatcatcttag

SEQ ID NO: 43868 - DNA, 108 bp, Glycine max
  Peptide Sequence Number=SeqID_160646
atgggtgataaggatgtgaagacaagtaccaaagctagtggacctgaggcagccatggttgcagcatcaaagcatttctcttcagctcacaaaataaagttcaattag

SEQ ID NO: 43869 - DNA, 203 bp, Glycine max
  Peptide Sequence Number=SeqID_160647
ctccgcttgatctcgaggacagtttgaattgcagaagcaagatggtcaataagggcgagaataatagctcgttatgctctacagttaaatctttatttgtgtccatttttggtggaaacgtgaagacgggtaaaagtgcagcacctggtggacctgtggccaccatggttgctgcgtcaaagcatttctcctcacctcacaag

SEQ ID NO: 43870 - DNA, 369 bp, Glycine max
  Peptide Sequence Number=SeqID_160648
atgcccagttttcatgttttaatttattcttctcaggacgagcctccaagtgaaagaaagattatcaaattatgtgaatatgctgcaaaaaaccctttccggattccaaagatagcaaaatatcttgaagaaaggtgctacaaagaactcagatctgagcacatcaaactggtcaatattatagcggaatccttcaacaagttgctttccatttgtaaggtgcagatagcgtattttgctgttgatgtgcttaatgtaattttggagctcttgagctattctaaggatgagaccattcagacacttggttgccagtgcttatcaaggttcatctactgtcaggtgaattatacaatccagaaaccctaa

SEQ ID NO: 43871 - DNA, 1398 bp, Glycine max
  Peptide Sequence Number=SeqID_160649
atgaatgctgagatgaaagcaattgaaaagaacaagacgtgggaacttgtaaatattccagacggtgttaaacccattggcgtaaaatggatcttcaagaccaaattcaatgaacatggccagatagagaagtataaagccaggatagtggtcaaaggctatgcccaacagtatggaatcaactacacaaaggtatttgctcttgtggctagacttgacacaataagagtgttgttagctgtggcaactcaacgttcatgcgaagtatttcaacttgatgtcaaaagcgccttcttacatggcgaacttcaagaagaggtgtacgttcaacaacctgttggattcatcaagaaaggcagagaaaatcatgtatacagactcaggaaagctctctatggacttatgcaggctccacaaacctggtacagtaagatagaagcctactttgccagagaaaagtttgtacgttgctctagtgaacacaccttgttcacgaaaaaggttcatgataatgttttgattgttagtctctatgttgatgatctgatttttactggaaattgcaaagatatatgtgaagagttcaaaagttcaatgcagctggaattcgacatgatcgatttgggtaaaatgaggcattttctggcaatagaagtaatacagaatgaggcaggaattttcatctgtcaaagacagtacgcacgtgaggtgctagctcggttcaacatgatagagtgtaactctgttcaaaatcccattgtaccaggaactacattgcccaaggatgatgaaggatcttcagtagatgctacaaagtttaaacaagctgttggtagcctcatgtatttgacagtcacacggctagacttgatgtttggggtaagtctaatcagcatatacatgactaatccaaaggagtcacattgggttgccacaaaacgaatttccaggtatttaaaaggcactattgagcatgatcttttctatcaaaaaggaaagaaaacaggtctctcagcctacagtgatagcaactatgcaggagacttagatgatagaagaagcacctctggatcaatatttatgatgggaactgcagctgtatcatgggcttcgaaaaagcagcctatagttagtttatctactactgaggctgaatacattgttgcagcatcttgtgcatgtcaatgcatttggcttagaagaattctagagcatcttgggttaggagaaaaaggagccaccgaaattttatgtgacaacaagtctacaattcaactatccaagaatcctgttctccatggaagaatggctaacgtgatgactaaagttgtgaagctcgatcaatttgagaagttcagacacatgcttggtgtagttaaagttactgaaataagctaa

SEQ ID NO: 43872 - DNA, 2037 bp, Glycine max
  Peptide Sequence Number=SeqID_160650
atggaaaattttctgcacagtaaggaaatgtggcaactagtagaagatggcataccaacgttgggagccacgcccactgaggcacagaagaggagtgctgctgaggcgaatctaaaggatatgaaagtaaagaactacttgtttcaggctattgaaagagagattcttgaaacaattctagacaaaagcacatcacaagcgatatggagactcgagcacagtggtcagcaagatacttatatctttaaccccaaatttcaactatgtggtgtgtactccattgaggaagccaacgacttgagcaccctaagccttgatgaactacatggcagcttgcttgttcatgagcaaagaatgcagagttttcaacctgatgaacaagtgctgaaagtcactcatgatgatcgttcgggagcaagtcatggtcgcggtagaggaagtcgtggacgaggaagaggacgtgggagacaacctttcgataaggcgcttgttgaatgtttccaatttcacaaactagtacattttcagtacgaatgtcctggagtggagaagcaggttcattatgcaaaatttgaggatgcaacagaggcagaaaatgagactctgttggtggcatatgaagaaatgacacaatctgtccaaagggaagactggtttctagattctgggtgcagtcatcatatgactggtaataagcagtggttcacagaaatacatgaagaagggctcaataagaatgtgaaacttggaaatgacacaacactgaatgttgtagccagaggaagtattcaggttcaaatcaatgatgtaactcatgttatatctgatgtttactacgttccagagcttaagaccaatctcttaagtttgggacaacttcaagaaaaaggtttagctatcttaatccaaaatgacacatctgaagatgatttagataaggcaactctgttgtggcataaacgatttggacatctcaattttaagggacttagcacactcgcaaataagcaaatggtgattgcaaagttcatggagagcatcaatgaaactccaataattcatgctgatatatgtggtcccatttcgctagcttcacacagcaataaaaggtacatcctgagttttgttgatgatcattctcgtaaaatgtggatttactttttgcatgcaaaatccaaaacgttcaatgcattcaagagcttcaaagcatgtgttgaaaaagaagctggcacccacattgtgtgcttaagaactgaccgaggtggtgaattcaattccaaggagttttcaaacttctgtaatcaacactgtatctcttggcaattgaaagctgcctacactcctcaacaaaatggagttgcagagcgtaagaatcgcaccatcatgaacgcagttagagcagtgcttcatgacaagcaggtttcaaaatccttctggcctgaggtagtgcgatggtgtgttcatgttcaaaatcaaagtccaacctctgcaatagatcaagggactccagaaggggtgtggagtggagtgaagccgcgtgttgattacttctgcacatttggatgtgtcgcacatgttcatattccagatcaaaagagaagcaaactagatgcaaagagccaacaatgtattctcttgggcgtaagtgatgagacaaaagcttacaagctctatgatcctattacaaagaaagtcattgtaagcagagatgtggtgtttgaagaagacaaaagctggaattgggatgcgcatgtagatggaggtacaactcctgctcttgattggggagacaaagatgttgaggaaattgaaactgtagaatctgcatcccaacaaataacagtcagtcgtgatcaaccagtaacactcgagccaactttaaattcagcacccgctgattctccaattgaaggaaaggcaaccaggacccggagacaaccattatggatgtctgactatgagaccaacctatctgtagaagaggagagcttactggcaatgatgataaccgattttgtagacccccaatccttttaa

SEQ ID NO: 43873 - DNA, 1854 bp, Glycine max
  Peptide Sequence Number=SeqID_160651
atggattggagcaagcttgccaccacaggtgaaaagccaggccctagagatagccacagtgctgttcttgtagggcacaaaatgatagtttttggtggcacaaatgggttgaagaaggtgaatgacactcatatattggaccttgttaccaaggagtggtttcgtccaaaatgtgaagggactcctccttctccaagggaaagtcacactgcaaccctagttggggatgaaagactagtgatttttggtggcagtggagaaggtgaggcaaactatttgaatgatttgcatgttctagaccttcgaaccatgaggtggacttctcctacggtcaaaggtgattttcctgtgcctagggacagtcacagcactcttgcaattgggaacaagcttattatgtatggtggagactgtggtgatcagtatcagggtgatgttaatgttcttgacatggatacgatgagttggtcaaggttgagaattcaaggttcttccccaggagtcagggcaggccatgcggctgtgaatattggaaccaaggcaagttcttttcagatgcaacattttttttctttttctgttatgacgatcttcaatttctttgcaacttggtttttacttaatatatggtactatttgaaacttaacctcgaatgcaagttcttggaggttctaatttctaagatctacatcattggaggggtaggagataaacgttattataatgacatatgggtctttgatatctgcacttgttcgtggactcagcttgatattcgtggtcaacaaccacagggtcggttttctcacacagctgttgttgcagacatggatattgccatatatggcgggtgtggggaagatgagcgtcctttgaacgaattgttagtgttgcagcttggagcagagcatccaaatgggcgttacaacatttccatgtgcaaagtttttggaacttgttggaaccatgaaaagaggaccatacctggaggagcagataccaactcgacaactccacgcaatgggaataataatatggaagtcttgggtaaatgggcttatgaagttgtatcggataaagtgaacccttgtcactttgattctggcacatcacaacagaagaggaggagaattgctattgcaaaggtgtgggatgttgaatcagaacaagaagaacattctctttcactgtcccagcattcatctccatctcaatctgatcaagaacagaccccaggtcaaaaatcaaatgtttctgtcatggatgctcagagttatcattggttcaaacagatcaataaaagtccaagctattgccagcttgacaatatcccaagtaataacacagctttgaagaatatcacacaacgaagtgttcatctcatagaaaatcaaccaaaacaagaacattatcttcatgttgatgaggatcgaaaaggagctcgacatactcaacacctgattggtgctgaagttcgggggaaagttgatggagcctttgattcaggtttactcatgactgcagctgtgaatggaagagttttcagaggagtattatttgcaccaggagcaggagtattctccacaagtgttgagccaaagtgttctgtatcatgttcatttccctccactcaaccatttatgaactcaaatcatcatgtgagggattctcagcaagtagcaaattgttcgcgtgcagagccctgccacggcataagccaacctgtgctagctcagccaacaccaatcatgagaggcactactgtgtctttagccaaagagcataaagtgaggagtgaccttcaagggttggttttgacacttggagggcctgcaagtggaaaccatgcttga

SEQ ID NO: 43874 - DNA, 249 bp, Glycine max
  Peptide Sequence Number=SeqID_160652
atggcatcagtgaacggcacgtatccgtcacgctgggccccttcttccaagaatggaatcatgttcacgtactacaccaatagtactacggtcaactcatggcattttttttttcgctggaaatcgtgcaaattaagttttatctataaaatatcactactaatctgggagtttgctgagctcaagttactatgtgtatatgacattgactcccgtgtggaatggcaagcaaagacagggcactcgtaa

SEQ ID NO: 43875 - DNA, 1521 bp, Glycine max
  Peptide Sequence Number=SeqID_160653
atggcttcatcgatcactttctttaacctcaaaagtgctcttacaagcctggcattgcaatccactttttatgctagttgcttaactgcaaatgtagtggagcagctttggaattttgcttggccttctgccattgccttgattcatccaagccttttgccagttgctgtaatgagtttcttcaccaaagtggctataattgttggcggtcccttggttggcaaacttatggaccattttccaagagtgtctgcatataattgcttaaccattgttcaggcaagttgtttgataatctatacaaactataaattcaagcaagatatagctcttttcctaaaagtgatcattctttctaatttccaggcagcagctcagttgctatctgcagcgatgattattcgtgcccattctgtccaacctacttcattttctacactgcttctgcgtccctggtttgtcatattggtttcagctggggctattgagaggctttgtggagtagctttgggggttgcaaatgagcgtgattgggttgtgctgctggcaggagtgaataggcctattgcattagcacaggcaaatgctgttctaaatcgaattgatctcctgtgtgagatagccggggcgatgctgtttggattccttctttctaaatttcatcctgtaatctgcttaaaagttgcttctgggttaatgatggggcttctgcctgttacaattgttttcaattatttaaccaacaagctttccaccggtgttcttgaccgacctaaaccttcacaaacctgttgcagaacatttaatgaagattctgcattagatgccagcagtatagttgcatctactggcaaaccagtgtttaaaggtctggaagccatcaagctcggctggaaggagtatctgggtcagcctgttctccctgctagtcttgcatgggtgctcctctgctttaacattgttctcacgccaggcagtttgctgacagcatttttaacacagcgtggcttacatccgtcaatcataggaggattcagtggaatgtgtgctttaatgggtgttgctgcaacatttgtgtcttcaactctggtcaagcaatttggcattttaaaggctggggcagttgggttggtatttcaagcgttacttctcagcatggctgttgctgtatattggagtggaacaatttctcatcagagccctcttcttactttcctatttctgattattctgtcacggttaggacacatgtcatatgatgttgtaggggctcagattctccagacaggaatcccatcatccaaagcaaatctcattgggacgacagagattgctgttgctagtttggcggagtctataatgctgggtgttgcaataattgcaaacgatccttctcattttggatgtttagcactgttgtctcttctatcagtagttggtgctgcctggatgttctgtagatggctgttgaatccaacagatgaacaaaaaaaccttttttcttatgatcctcagttttga

SEQ ID NO: 43876 - DNA, 918 bp, Glycine max
  Peptide Sequence Number=SeqID_160654
atggattgtggtggcacacaagtttcacgtaccatcgtagtcgatcaatctggcaaatcagattttcataccattcaagctgccattgattcaataaagacaagcaacaataaatgggtgaaaattcacataaaggctggcacatatacagagcagattcaaattccatataacatgccgtgcatctttttggaaggccaaggaaaagaagtcaccactgttacatacaatgaccaccaaaaaacagatattagtgccacgttctcttcatttccagacaatgttgttgcatcgggcattacttttaagaactcgtttgatactgcggcaatattaagttatgatgggaaacgaatcccagcattggctgcaaggatatatggagacaaatctgcattttacaattgtagtttcatcggttttcaagatacattgtgggatgtggaaggtcgtcactactacaaaaattgtctcattgaaggtgctgtcgacttcatatggggcagtggacaatcttattttgtggattgtgtgctcaatgtgacttcttcgggttccataacagcacaaggacgcagttcaaatagcgacccaagtggttttgtgttccaacgaggttctgtggttggtagcgggagcgcgatattagggagagcctatgatcgttgttctagagttatattttatgacacaaacttgggatctgtggttgaccctcaaggatggaatgcttggcattatacaaaacatgaggattgcatttactacgctgaggttggatgtacgggtgtaggtgctaatacttccaaacgcgttccttggagaaagaaattgacaatctcagaattcagacaacaattttcgacgtcagtgttcatcgaccacgaaggctggctctcaaaaataccattgaactga

SEQ ID NO: 43877 - DNA, 624 bp, Glycine max
  Peptide Sequence Number=SeqID_160655
atggcgttcaccgtcggcatcggcagcggtggggctataattccctgcggcaacagaaccaccgcaattccttacatccgtggcggcggtggtggtctcctcttccctgaccgaacgagaagcagaaacctccacctccacgtggcgtgcgcgaagaagaagaagaagctcctagagaagatagaacttgaattctgggaatggttcggcaccttcctcaagtattcctggattattgccatcgctgtcgcgactctggcgtcgtcgtggactgcgtctccgcagtcaagaactaacgcggcaagatctgtgacctcacgcatcaggcggccaacactgcgagctgccacaccacggcaagtcgatgaggttgacgaggcaggggttggggatttgggagaggatctcaatcttgttttcggtgagactggtgcagttgccgcaatcagtgcatttggtggcgtggtttttagaggtgctggtggcgacaagtttggtcgttttgacgacggtgaggagcttgtcagcttcgagggtggctctgtagactctgccgtggcggcctcggcccaggaaggtgtcggaggagttgttggcggtggcgacgatgtcataaatgaatag

SEQ ID NO: 43878 - DNA, 1131 bp, Glycine max
  Peptide Sequence Number=SeqID_160656
atgatgatgggttcgacggcgagggtgccgaagctgggttctttccgccacagcttcgcggagaggaaggagagactgctctcaatgaagggcggcatcggcggcggctactcccaaattgggatcccgctgccggagtccgacgaggaggatcactctccgacgcggaggcgctgctgctcctaccgcgccgtctcggacgggatcgtcggcgcgtggaagagcgcgaagcgcgtggctgcgagggcgtgggagatgggtcgctccgatccaaggaagatcatattctccgcgaaaatgggactcgctctgattctcctttcgcttttgatttttctgaaacagccctttgaggacattgctaaacactccgtttgggccattctcactgtcgttgtggtcttcgaattcagcataggggcaactcttagcaaagggcttaacagaggattggggactttgttagctggaggactagcattgggaatgggacttttatcaaaattgtctggaaaatgggaagaaaccattatagttgttagcatcttcactgcagggttttgtgccacatatgcaaagcaatatccaacaatgaaggcttatgaatatggttttcgtgtgttcttgatcacctattgctacattattgtatcagggtatcatacaggagagtttgttgaaacagctgtagatagatttttgctcattgcattgggcgctgctgtggctctggggataaatgtatgtatatatccaatctgggctggtgaggatctacacaagcttgtggcgaaaaattttgtgggcgttgcagcatcattggaaggtgttgtaaataactatcttaattgtattgaatatgagagagtgccttcaaaaattctcacgtaccaagcttctgaggacgtggtttacaaaggttacagatcagctgttgaatctacaagcacagaggattcattgatgggttttgctgtctgggagccacctcatggtccatacaaaatgcttagatatccatggcaaaattatgtgaaagtaagtggggcactaaggcattgtgcgtttatggtcatggctatgcatggatgtatactttctgaaatacagagaggtgattttcaaggttaa

SEQ ID NO: 43879 - DNA, 783 bp, Glycine max
  Peptide Sequence Number=SeqID_160657
atggcgttcaccgtcgccagtggcagtggcgtggctataatcccctgcggcaacaccggcaccgccgcactcttccctcaccgaacgagaagaaacctccacgtggcgcgcgcgaagaagcccctcaacggcgacgacgtttccgtttacgctgagctcctcaaagccgaagtttccgttttggaaaataataagcctctcgacgacaacgatgccgctttgaagttcctagagaagatagaccgtcagtttcaacagcccgatttatgggaaggaccccagtgggactggctcggcatcttcatcaagttttcccccatcattggcatcgctgttgcgaaaaaagaagttaatggaaatagggttagttctcacaaggcaagtcttgctatctacggttgctttacatttcatgaaccaccaaaaaatgtgagggaggctgctgaaaggctgtattctgtgcagtctggtgtggagtccaatgcagagtccgatgatgtggagtccagtgcagagactgatgtggagtctagtgcagagtccagtagtgaagttttcaaagagcctgatgcatatgactcagatgtgtttgattccaatccaacagagatctctcaagttagtgccattgagaaagaggcacagatagtgtggtttttggctgtagtgttgcttgaggttgccacagcaagaccctggagaaggggaagtacgctgcacaaatgctgtgcaaggaataaggagaaggaggcttggtgtgcattgagctatagtggggcttga

SEQ ID NO: 43880 - DNA, 363 bp, Glycine max
  Peptide Sequence Number=SeqID_160658
atggagcaggctgttctaaaatccatgttacatgcatgcagatctgtcaaagatgtcaaggattacttcaagaccttaactcttcggtttggaagcaagtggtggattttgtccacattgtttcagatatctcccgagggttacttgatcattagtaacaaaggccatgtgtgcttgggaatccttgacggtagtaatgtaaatgatggatcctcaattatacttggagacatttcattgagaggatattcggttgtatatgataatgtgaagcaaaaaattggttggaagcgagcagactgtggcatgccaagcagaagattgagaaagaaaaataatttcatccctgatagcatgctataa

SEQ ID NO: 43881 - DNA, 2262 bp, Glycine max
  Peptide Sequence Number=SeqID_160659
atgagtgacagcaccaacacaaaccccccaccacctccggtggcggagccaccgccaccaccgcaatccggttcaccggaaaacgacgtcgcaatgtccccccaaaactcctccgaggacccagactcctccctccccacccaaacaacacccgagcccgccgttccagactccccggactccgccacaacccgacccgacccgaatcctccgcctcgaaaacgccgccgccgcaagaaattcttcacggaactcaccaccgggccatccacgcgccgaaacgacgtcgccaaggactgtgacgtggaagccctaatcgcgatctcggtagggtttcccgtggattccttaaccgaagaagagatcgaagcgaacggtggtttccaccgtcggaggctccgagcaatccaactacatcgtcgtccgaaaccacatattggcgcgttggcgttccaacgtttcggtctggagatccaaaccctaaagctgaaacctttcgatgggtccgaccgaggaacggtgattgtgatcggtgctgggttcgcgggtttggttgcggcgagacaattggtgttcatggggtttaaagttgtgattttggaaggtaggacccgacccggtgggagggttaagactaagaagatgagtggtgatggggttgaggctgcagcggatttcggtggaagtgtcctcactggaataaacgggaaccctcttggggttcttgctagacaattgggtttgcctttgcataaggttagggatatttgtcctctctatttgcctgatgggaggagtgttgactctgaggttgactctagggttgaggtttcgtttaacaagctgctggagagggtttgtaagcttaggcaggcgatgatcgaggaggtgaagtcggtggacgtgcccttggggacggcgttggaggctttccgaagggtttatatggtggctgaggataaggaggagaggatgttgctgaattggcacctcgcgaatttggagtatgcgaatgcgacgctcatgtcaaatttgtcaatggcgtactgggatcaggatgatccctatgagatgggtggtgatcattgcttcattcctggggggaatgagaaatttgttcgcgctttggccgaggatttgccaattttctatgggaggactgtggagtgtgtcaagtatgggagtgacggggtgctggtttatgctggtgggcaggagtttagggggggcatggtgctgtgtactgtgccgttgggggtgctaaagaagggagatattgagtttgtgccggagcttcctcagaggaagaaggatgctattcataggttggggtttgggttgttgaacaaggttgcaatattgtttccttataatttctggggtggggacattgacacgtttggtcatttgaccgaggatttgagtatgagaggggagttttttctgttctatagctactcctcggtgtctgggggcccgcttctggttgcgcttgttgctggggaggctgcgattaggtttgaaatgatgtcaccagtggagtctgtgaagagggtgttggacattctgaagaatatttttaatccgaaggggattgttgttccggatccagttcaggccgcgtgtactcggtgggggaaggatcactttgcgtatggatcttactcttatgttgcagttggatcttcaggagacgattatgatattcttgcagagagtgttggagatgggacagtgttctttgctggagaggcgactagcaagcagtatcctgcaactatgcacggggcgtttctcagtggaatgagagaggccgcaaacattttgagagtggcaaagaggaggtcttcaatgcctattgacacatcaaaaagtgtcaaccaggagaatgatgatttgaacaaattgtttgtgaaacctgatctgacatttgggagcttctctgccttgtttgatccaaatttgaatgatcttgattccagttcattactgagggttaaaattggaggagctgtgttggactctggcagtctttatctctatgccttgcttccaaagaagtgggtcattgagttgagtcagttggagggagatgagaacaggatgagaatgttaaaccgcaatttcggggtgagtttggttgggaggaagggtttaagtagtgctgctgaatctcttattgccagcataaaactgtctagacccaacttaaatgaagcggaaaatggtcttattatgactgggaaggaaaactcgcagtag

SEQ ID NO: 43882 - DNA, 594 bp, Glycine max
  Peptide Sequence Number=SeqID_160660
atgtctcctctaacactagtcattctcatagttccccttgtcacattaatctacatcctaggcaccaccaccgtgtccgccgggaccgccacagttagcgatcatcagaaacctccacgtgctaggaggatcaggaacactcccacaccgttccctccaatccctttccaaacgttacagtcccataatccgcggaactgttccttaagacgcacgacaccgtgttcgcgaacaggccaaagttcgaaacggccctgcgtttgtggagtacgggccgtactggcgaaacgtgaggaagcgtgcaccacgcgccctctgagagcgtcgaaattagcgtcttttggtgctctgagaaagagggagattggggcgatggtggagtctctgaaggaagcagcaatggcgcgtgagattgtggacgttagtgagagagtgggggaagtgttgcggaatatggcatgcaagatggtgttgggaaggaacaaggatcgtaggtttgacttgaagggctatatgagtgtttcggtggctttcattttggcagattatgtgccttggcttcgcctctttgatctccagtctctaatatattaa

SEQ ID NO: 43883 - DNA, 483 bp, Glycine max
  Peptide Sequence Number=SeqID_160661
atggtggaggagaacgatttagcaaaattatgctatttggatacggttgtgaaggagacactaaggctacaccctgttgtgcccttactagcccctcatgaatcaatggaagctattgtgattgaaggttactacatgaagaagaagtcacgagttataataaatgcatgggctatagggagacaccctaaagtgtggtctgaaaatgctgaagtgttttatcctgaaagatttatgaatgacaacgtagattttaagggacaagactttccacttataccatttgggtctggtcgtacaagctgcccaggaatggtaatgggtttgaccatagtaaagttggttttggcccaattgctatattgcttccactgggggctaccttatggtatcgatcctgatgaattggatatgaatgagaaatctgggttgtcaatgccaagagcaaggcatttgcttgtgatacaatggtggcaggtctaa

SEQ ID NO: 43884 - DNA, 756 bp, Glycine max
  Peptide Sequence Number=SeqID_160662
atggaagatgatgaatctcctcagatcaaaggagttgttataatctcccttccacccccagataacccttctttgggcaaaaccatcactgcttttactttctctaacccttctcctcaaccttctattcaaccccaccaacaccaaagtcaaccaacacaccctaatgctcaacacaacactgatcctccacttcagtcctacccatcaaatcctcagcttagtttttcattcagaagactcttccacagcaccccagtgaagcttttctcattctttggtattcttctatttgctctctttctctatggctctgtttcttcaaccactactgtggaactacgtggccgcaacaatgatgacgatgatgatgacaaagccacttcatttctgttccctttgtttccgaaatttggtgttttggggcagaaggatttgaagctccaactggggaagctttctcaaaaagagaagtttttgacacacagagacgatggtgatggttctggagttgtggccgttgactcttcatccgtttttccagtcagtggcaatgtttatccagatgggttgtatttcactattttacgtgttggaaatcctccaaaaagttattttcttgatgtggatacagggagtgatttaacttggatgcagtgtgatgctccatgcataagttgtgggaagaactgtgtttactcaaaggataaaattgatacagggagcacatgtcctatacaagccaacaagatctaa

SEQ ID NO: 43885 - DNA, 1439 bp, Glycine max
  Peptide Sequence Number=SeqID_160663
ctatccctacaatactccttgtgatattcatatgggtggtacaaccaaagcaacgtcatgggaagattgcaccaggtcccaaggcgttgccaattattggtaacctccacatgctagggaaactcccgcaccgcacccttcaaacctttgcaagaaaatatggacccataatgtccttgaagctagggcaagtccaagccatagtggtttcctcccctgaaaccgctgaactattcctcaagacccatgacactgtttttgcaagcaggccaaagattcaagcctctgaatatctctctcatggcaccaagggcttggtgttttccgagtatagcgcctactggcgcaaagtgaggaaagtgtgcacccttcaacttctcagtgcttcaaaagttgacatgtttgctcctttgaggagacaagaattgggagtgttagtgaagtcactgagaaattcagcggcatcacgtgaagttgtggacctcagtgaggtgttgggggagcttatggagaacatagtgtataaaatggtattggggcgtgctagggatcatagattcgaattgaaaggacttgttcaccaggtgatgaacttggttggagctttcaatcttgcagattacatgccttggcttggtgcgtttgatcctcagcaaattatccaagaccacgaacataatcaatatgataattataaagtgcaaaaagctccacacaataacaaggactttgtggacatattgctatcacttatgaatcaacccatcgatcttcagggccatcaaaatgtcattgatagaactaacatcaaggctattatattagatatgattatggcggcatttgacacgtcatccacaacggttgagtgggccatgtcagaactcttgaggcatcaaagtgtgatgaagagacttcaagatgagctagaaaatgtagtggggatgaacagacacgtggaggaaattgacttagaaaaactggcttacttgaatatggtggtgaaggagacgctacgattacacccggttgcaccgttgctcgtacctcgtgagagtcgagaagatgttactattgatggttatttcataaagaaaaaatcaaggatcatagtaaatgcatgggcaatagggagagatcctaaagtttggcataatcctttgatgtttgatccaaagagatttgagaattgcaatgttgacattcgtggaagtgactttcgagttataccatttggttccggtcgaagaggttgccccgggattcatatgggtctaactactgttaagcttgttctagctcaattggtgcattgttttaattgggtgcttccattggacatgtctcctgatgagttagacatgaatgagatatttggactcacaacgccaagaagtaagcatttgctagctacaccagtttatcgactagttgattaa

SEQ ID NO: 43886 - DNA, 1536 bp, Glycine max
  Peptide Sequence Number=SeqID_160664
atgttgcttgaaacatttactatccctgcagcactccttgtgatattcattttgattctatcctatgcccttttccatccaaaccaacctcaagacgatgataaggcacatccaccaggtcctaagcccctcccaattattggtaaccttcacatgcttggaaaactcccacatcgttcccttcaagccctagccaaaaaatatggacccataatgtccatcaagttaggtcaagtcccaaccattgtagtttcctcacctgaaactgctgagctattccttaagacccacgacactgtctttgctagcaggccaaaaactcaagcatcggaatacatgtcttatggcaccaagggtcttgtgttttctgagtatggaccctattggcgcaacatgagaaagttctgcaccacacaacttctaagtgcatctaaagttgacatgtttgcccctctgaggagagaggagttaggactatttgtgaagtctcttgaaaaagctgcttcttcgcgtgatgttgtgaacatcagcgagcaggttggagagcttatgtcgaatattgtctataaaatgatacttggccgtaataaggacgatcgattcgacctaaaggggctcactcatgaggctctacatttgagtggagtgttcaatatggcagattatgtaccttgggcacgtgcctttgatcttcagggattaaaaagaaaattcaagaaaagtaaaaaggcgtttgaccaagtgcttgagcaaaccatcaaagaccatgaggatcctaccgatagcgacaagaaaagtgtgcacaactctgaggactttgtagccatactactatcacttatgcatcaaccaatggatcagcacgagcagaaacatgtcattgatagaactaatgttaaggctattatattggatatgattggaggatcatttgacacatctaccagtgcaattgagtgggctatgacagaactcttaaggcacccaagggttatgaagacacttcaagatgagttaaatagtgtagtggggataaataagaaggtggaagagtctgatttggcgaagttaccttatttgaatatggttgtgaaagaaaccttaaggttgtatccggtcgtaccattgttagtgcctcgcgagtccctagaaaatatcactattaatggatattacattgagaagaagtcaagaattttaatcaatgcatgggcaataggacgagaccctaaagtttggtgcaataatgctgagatgttttatccagagagatttatgaataacaatgtggatattagaggacatgactttcaacttataccatttggttctggtcgtagaggatgtcctgggattcaattgggtctaactagtgttggtcttattttagctcaattagtgcattgcttcaattgggagcttccattgggcatatctcctgatgacttagacatgacggagaaatttggcatcacaataccaagatgtaaacccttgctagctataccaacttatcgcctattgaataaagcttaa

SEQ ID NO: 43887 - DNA, 525 bp, Glycine max
  Peptide Sequence Number=SeqID_160665
atgctggatgagcacaatgtccatgcaaaaagtttcagaatggccagggacagattgacagatagtcaactagataatgtaaaattgagattgatagctgcacgtgagaaagatggtcgtacatacaatctcccaaatgtttctgaagttgctgccctgattgttggtgattttgatccagactcaagaagagatattattgttgaaactcaaaatggagaattacaaagaatccatgaattacactctagctatctaggactccaataccctttactcttcccttatggtgaagatggatatagacctgatatacttcaccgttctatatctagcagcagaaaaatgaagagaaatcgtctaacgatgagagagtggtttgcttatagactgcagtccagatcaaatgaagcacaaactttgttgcattctagaaaactattccaacaattcatcgttgaagcatacaccatggttgagtctgaaagacttagctacatcaggaacaataaaaaaaaaacttag

SEQ ID NO: 43888 - DNA, 360 bp, Glycine max
  Peptide Sequence Number=SeqID_160666
atggcagaattgtcaaagaaacgtaagggttcatccgcctccgcttcggcttcaagagctcatcgttccggagccactagcgcatccacagcaccaattccaccctcattatcctcttccacattgttttcttccgaagaacagcagaaacggtattcaaatcttttctcatctcgttccattatcgaccctaagtttgttgatatggaattcttttctgctgaaacttttgattgcattcaagcctttcagaacctaggtcttatacccttcatgtcattacaattgcctgtttatcctgaattggttaaagctttttattgtaatcttgaaattcaggacaacactttgatttctgag

SEQ ID NO: 43889 - DNA, 129 bp, Glycine max
  Peptide Sequence Number=SeqID_160667
atgagtgagataggaaggtttggaggtttgggaatggaggaacgtcgcaaggaggaaggggctgcacagggatttctggaaaatgtgatatttatagagcaggacgcgtggccatctgttctagtgtaa

SEQ ID NO: 43890 - DNA, 333 bp, Glycine max
  Peptide Sequence Number=SeqID_160668
atggtcgtcaaatctgaccacgggagatactatggtaaatatgacataagggtaccaattaaagtagtcattaagaacccctataggtgttcagccgaaacaatgccttataggttgcatgaagacaagacaacactgagattctctctcaaacaccatctaaagttcaaactcaatagcctaaaaaagtgtcattaccgaccagagagggtcgtgcggcagtttgggtgcacgcagaccattccagctcctcctgtcgattcatgggtgtcgtatgatgatatacacgacaggtggatgcactactcggatcatatcgtttcagcaggtgag

SEQ ID NO: 43891 - DNA, 721 bp, Glycine max
  Peptide Sequence Number=SeqID_160669
atggagtgcggcaacctgatcgtgccggaactggtttccggccagctgcagggcgggctggcgatggggatcggccatgcgctgcacgaatatttaccgctgtacgaagacgggccgggcaacggcacctggaacttcaaccgttaccacctgccgcgcgccagcgacgtggcggtgtggaagcagagcggcgacatcctgccggcgctgtcggaaaccgatccgccgaaaggcatggcggaggtggtgatgatcccgattgtggccgcgctggtcaacgccatcgccgacgccaccggccaccgtttccgtgatttgcccccgatctccctgaccatcaaccagaagcagtacggcccgatcgaggtgccggaaggcctgatgatgatcgatttcctgcacgagtaccttgatctgaccggctcgcgcctcggctgcgggcagggcatttgccacgcctgcgtggcgatcgtcgatcacccgagcggcaccagtgaagaggtgcgcacctgcatcaccggcgcgcatttcttcaacggcaagaaagtgcgtaccgtcgaaggccacgccagggtggacgagcagggcgaggtggttgaactatcgccgatccagcaggcgtttctggagcactacagcttccagtgcggctactgcacgccgggctttgtcaatgccgccaccattttcgtggaaaagctcaagcgtgaacctatcgctc

SEQ ID NO: 43892 - DNA, 232 bp, Glycine max
  Peptide Sequence Number=SeqID_160670
atgacaagtggcgagcttgaaatcagtgtggtgaaacaagttgggaatgaaagggataaaggaggaaatgagaggaacacttacggtgacattgacgccgtgagaagaaaggcgaacacgaccgaggaggctgagggaggagcagttggagtggtagaagggtttatgcacgccggtgctgtcactgcggttgcgcgattcaacagcgtggtttgggttggggctgggctag

SEQ ID NO: 43893 - DNA, 465 bp, Glycine max
  Peptide Sequence Number=SeqID_160671
atgcccttgcggggtaggattgcatcagtagtggtggggatggcggagataggtgttggatttatggatgatgttttggcttgtgtggagcgcacaaatgaattaggatcgcctctccttgttgctaccattttgggttcgactgaactatctggtcctctccttcttagcggaatctctgatgttgaagtgaggggaggtattgcaaaagggactccaacgagcaaggatctcctctctaggtctatatatacatgtccagtgttgagggggttacgcaatgttcggagccacgttggtaaactgctcctctatgcatcatggccgagttcatgggtggcagtcggggatctccatgagccgagcaagtggagccctacgagccgagcaagcaaggccccacgagccgagcaagtgccgagtttcgtgagccgtacggtccagttttttcaatttttatattag

SEQ ID NO: 43894 - DNA, 567 bp, Glycine max
  Peptide Sequence Number=SeqID_160672
atgtggggaatagacatcctcggaccattccccacgaccaagggacatgtcaaattcctccttatcgcggtggacttcttaactaagtggatcaaagcaaagcccatacaacgatcacagctcagaaggtatggcttacctcaagccatcgtgatggacaatgggagacagttcaccgaaaaggactatggagagttcctcaagcagctcgacatcaagcatctcacatctttgatcgggcatccccagaccaataggcaagcaaaagtcgtaaacatggtcatccttactgagttatgcaaaagattgtcgaaagtcgccaagggactgtgggtggacaagctcccgagagtgctatggggtaccactaagcatgttcaacgtggccaacaactcagaatcattggaagtgaagcaagagttcaagaagaagcctacaaatggagaatgaattggaaatacaactcgaaactcaataaatgcagctttaagaccaacaaattggtttggaggctccgaggagatgccgagaaagacaactcggaaggaaaactcgcaccaaattag

SEQ ID NO: 43895 - DNA, 843 bp, Glycine max
  Peptide Sequence Number=SeqID_160673
atggcacataagtgcctcttccgagctaacttggtgctaccttcgccagcgaagccacctgcaatggtgttgatgactgtgtttccccctttgtcaactgtcgagcctattactatgagattgttgtcctcaacctccataatgacttccacaatctcaaccacaaccttgataattacctctattgttgttaggggtgtagatgtagttggcaagggtggtaaggatacaatttctgtgttgaatgcctcctcaagtaaatgtgctcagctgacatttaacgggcagctggttacatattgcactctgaagcgttgggctaaggagaagatagagtcaatggatcgtaggggtaagcacttgtaccatgtcagcgccaaccctttgtgggaggtgggaaagaccttgcacatcacggcgttgtcattgaagtgcaaattgaattttgtgatgaatgcatctaagtattcgttgggatccgagaatggatgggaggttgctcgtggtggttataggaggaaagttgagtgttactttcctaggtatgtgtctaggcatgggtgggtggtggggatggggagcgaggtggagatggtagttgatgcaagctccattggagcttgtaggcctaggatcttcttcatcaatggattcctttgcttcttggaagatgaatggcagcggaatggagaaagggagagagagaggagacgccacttcaaggagaagatgagtctagaagaagctcaccaccataggaggccatggataagagcttggaggaagaaggagatgaatgaagggagagggagagaagagcacgaaattttgtgctctaaatga

SEQ ID NO: 43896 - DNA, 402 bp, Glycine max
  Peptide Sequence Number=SeqID_160674
atgaaggcgcaatgcctagtcgtcttcgtaattgaactatcaaccaacaaagaaccaaaatttgagtggtggaggttgtgtgtggatggttcatctagcaaaaaagggaataggtttggagtcattctagaaagcccagacaaagtcatcctagagcaatctctaaggatcaaatttcaaaaaacaaataaccaagccgagtatgaagctttattagccaaattgagattggctaaggaagtaagggccaaatacttaaagtgttggagcaattccaaacttgtcactggtcaattgaatggagaataccagaccaaagatccacagatgacaagatactaccacatggctactcggcttaaagatgcctttgttaaattcaagatccaacatattgcttga

SEQ ID NO: 43897 - DNA, 744 bp, Glycine max
  Peptide Sequence Number=SeqID_160675
atgaaggactcgcctaagcatgagaagaaactggttaagtctatggaggggcagaatgaagtcgataatgctgaggctgagaaagagaaagaagtagaggtggctaaaaagtcaattgcgactaagaaggaaaagatgacggagaccgatcataacatgatggactatgtggacccaatagagagtttggatgcaaccgagatctttcttggtcaatctcttgttgttgttcgccactggaaggagacagtgtcccaggttgaagagaagaccaaagtgatggttgcgcaactgaagttgatgaaggaggtgatgaaaaagttgcaagatgacttggataagcatgttgggtatctatccaataaggttagagagaacgaaatgttgagcagccgagtctccgaccctgaggagcaagtaaaagatatggggaggaaaatggaggagttgtcttcggagaaaaggattatggaggaggagttggtggaaatgaagaaggctgttgaaaagttagagggcgagaatgctctgatggccgagttaaagaaggccaagaggttgattatgctaaaccacctagagggttttaagaaggcgcaatgccaagttaaggtattggtcgcgagcttcgactctgcacgacttgatgtgaattgcaacactgtagatggtgagattatcagggattcgcaactctgctctgagtctgagggtgagaaggagaaggaagtagaatctaagtga

SEQ ID NO: 43898 - DNA, 411 bp, Glycine max
  Peptide Sequence Number=SeqID_160676
atgcgaagcaattcaagctctccaagttcgacttacgattcgaacctcgaggccccatcaaagggtagtgtctggccgatttccaagtcgagctcccaccaaccgaggaaagtagcaaaggctagtggacattgtatgtggatggagcctccaataataagggcttcaaacaaccaagtagagtatgaagctctcatcgcaggactaaagctagcaatcaaggttggcgtaaagaagttgaggagcaagagtgactctaagctcgttactgagcaagttaatgaggtcttcgaagccagactgcacaaatgcataagaactaccacttggtcaaataactcttggagcatttcaagcataaataactggtccatgtcgacagggaacaaaatgaccgagttgatgctttag

SEQ ID NO: 43899 - DNA, 561 bp, Glycine max
  Peptide Sequence Number=SeqID_160677
atggtgattatagttggcatcaccaattggaatgtcaggaaagtcctgatagatggaggcaacttgattgacatactcttttggtccacttttcatagtggtacaagtccacacccaggtgtagtagagctagtgaccacctttgaaagaggagagttgtcaagaacgttactcgttcagtatgtcctcatcgacgccaacatcttctacaacattttgattggcagaacaacgttgaatgccctgggcgcgatcatgttgacgccccatctcacaatgaagttccccaaccaaagtggcaacatagtcactatcaaagtaaaccaggttgaagcccacaattgttccactaaaagcctactcgtcaagccttacacactcgcctccatgaagcatgtcgatgcaggggtgttaatcatgtggaaagcactacaccgagctaggccgatcttgacccaaggagagatgaggaagacaagaggccaacaccaaccgaggagttgcgttgtttccagcaaagagccacaccaaatgcaccaagataggggaaagacttggtga

SEQ ID NO: 43900 - DNA, 1149 bp, Glycine max
  Peptide Sequence Number=SeqID_160678
atgtccgaagacaagtacggcgtgctcctctattacaagtacgccgaaattcccaacctcgacgacctcctcaccttctaccactccaactgctcctccctcagcctcctcggtcgtgttcgcctttcttctcacggcgtcaatgtcaccgtaagtgttcctctcatttcctcctttatccctttcattcccaactcattgctcttcacacaggttggcggcaacttatcctctctcgggaatcacatccaagccctcaaagcctacagcaccttgtttcaccacactgatttcaagctcgccacttgtcatcatccattaaacgacaaagtagcccaggaatgtggtttcacttccctctctattcgaatcgtccacgaacttgttactctcagttcccatccactgttaaagtcaccgaatatctcaaatgccggaaagcatctctcttccctccacaataccagtagttgctgtaacgttattatccattcatacagtgagagtcccgaaaaaggccttgttttacttgatgcaaggaatctgtatgaaacaagaattggcaagtttgatgtgccaaatgttgaaactttggatccacaagttaggcagtttagtgatttgtcctcttggatagatgacaatggggagcggttgaaaggaaaaaatatactcatgtattgtactggtggaatcaggtgtgaaatggcatcggcatatattaggtcaaaaggtgctgggtttgagaatgtgtttcagttatttggtggcatacaacggtatttggagcaattcccagatggtgggtttttcaaaggaaaaaattttgtttttgatcaccggatatcagttggaagttcagatgctaatgttattgggacctgtcttatttgtcaatgttcatttgatgattactcttctcgctgccggtgtgcttactgccgaatgcttgttttggtttgtggtagttgccagaatgaatctacacagtacgtttgtgagctatgtcagaaacagggaaaggccgttaggtcaacacaattaattgaaaatggtgaatcaaaaacatcattgccaggtgttgaattccagaatttttcttcagatactactatgtgtttgcctcaagtgcctaggggagatggtaag

SEQ ID NO: 43901 - DNA, 369 bp, Glycine max
  Peptide Sequence Number=SeqID_160679
atgatcgcagaggtggaagaaaatattacccaagtactagaagcaaatagagacttattctcatggtccagatcagatatgcctataatcaactctaaattccactatcacaagctagcaatctatctagaatctagacctgttgtgcaaagaaaaataaaacttgatcccttagagtggaaaattatggatgaagatgcaagaaagttgctaagtgcaggattcattagagaagtggaatataccacatggccagcaaacaaagtcatggtaaagaagtctaatgggaagtggagaatatgcactaactacacagatttgaataaggctgttagctcattggaaagtgtaccactttgttttaagtag

SEQ ID NO: 43902 - DNA, 1780 bp, Glycine max
  Peptide Sequence Number=SeqID_160680
tcctcctccacctttggataattgcaagaagaagtttgcatggtttgtggcacccaactttgatggaagtagtgctgctgactggaaggtagcagatggtccatttgatccacttcaataccagcagcaaactaatggatatgatatttcggtatcacacttgaagaatgtgttttcccaagaaggaccatttgatggaatcttgggattttcacagggagcagcaatgactgccttgatctctgcacaacaagaaaagctgaaaggtgaaatggactttaaatttgtagtcctgtgctctggctttgccctccggatgaaggagatggagtgtggccctatcaagtgcccttctcttcatatttttggtaatgaacatggtaaagacagacagatagctaaccaagctagcaaggaacttgcttctctatatgatagtgattgttctgcgatcgttgagcatgattgtggtcatataattcctacccggtccccttacatagatgagatcaaggatttccttgggcgttttctgatgttggaggacgaggcagagggtggcacaaggcaggacaaagggtggtgggtggtgggtggtgtagtgcagggtgaagggttgatgtgcattactaggggaagaagacaaaagaaagagggagtgacatttttgtccattcaacttcctttgggaggttttcgttcctattgcactgacaaggtggttgttgatattggacaaccaacctctgcgtctcatccgcagctactaaaagatggggagctcacaccgggtatatctactgaggaatatatcctaagaagaaaaaagttgttggatcttctcccggagaagagtttggcaatcattgctgctgccccagtaaagatgatgacagatgttgtgccttatacatttcgacaagatgccgattacttgtatatcacaggctgccaacaacctggtggtgtggctattttaggacatgactgtggtttatgcatgttcatgccagaagctaagcctaatgatgtgatttggcaagggcagatagcagaagttgatgcagcattagatacattcaaggctgacagggcatatccaatgaaaaaattgcaagaggtgaatcactggcttgaagccattgttatccaagctttgcagtctaaaaagtctattttcacctccttgatccttccagatatgataaggggatcatcaaaattgttccacaatgtcgagactgcaactcctgaatatatggaactggaagccttcaaaaagctagcttactgtaacaatgtaaagaatctagctgtttatacccatcaactgcgatggataaagtcaccagcagagctcaagctgatgaaggaatctgcatcaattgcttgtcaggctcttttgttggcaatgttgcattcaaagacattcccttttgaaggtatgctagcggcaaaggttgagtatgaatgcaaaattagaggtgctcagcggatggggttcaatcctgtggttggtggcgggcctaatggaagtgttatacattattctaggaatgatcagagaattaaacatggtgatcttgttttgatggatgttggatgtgagttacatggttatgtcagtgatcttactcgtacctggccaccttgtggtagcttttcttctgcccagaaaggactcaaagagctcgggattttgagagatgttggaagcagttcttaccataagctgaacccaacttctataggtagccttgtgctgaaatttgcttgctga

SEQ ID NO: 43903 - DNA, 252 bp, Glycine max
  Peptide Sequence Number=SeqID_160681
atgggagttggaaccgcagcggcgcagctcctcccttccttcatcggcgaccacctctgcggcgccacgatggccaccgcagaaagaggccgcataagccaaaattggaattcttcaagccaccatgctaatcttcaacggttggacacaaagaggtgctgcgaaggtggcaactgtctagggaatctcgccgaaaaagttcatcaaatccgctggagggggcttggagattggagtaacatcctgttttga

SEQ ID NO: 43904 - DNA, 441 bp, Glycine max
  Peptide Sequence Number=SeqID_160682
atggctttcctgaaagagacagaagaagggattcctgggacctcatccacaatctctctctctttcttcccctcttccctgatgaaaaaattggaatgtgtgagcatcctaattatctcatgcaggcttttcatgagactattcatgacagtggcctccatgatcttcctatggaaggaaggttacaaattcacatggacaaaaagcaaaaggaaaccagatgaaatagaagaaaagctagacagagcactggccaatcttgactggcttgacatgttcccagatttcaagctaaagaacttcatagcctctaaatcagatcactcacccatccatcttttgcttgatgccaattgcaggaaatcttttcgtaagcaatttcgttttgagaattccaggtttttggaaccatctctagatgttgtcgttaaggaaggatag

SEQ ID NO: 43905 - DNA, 651 bp, Glycine max
  Peptide Sequence Number=SeqID_160683
atgattggtgagggtaatggtgaatcaaagagagtgttgttgacaccgaaagtgaaatcagttgaaactgtgaaggggaatgagattggtgtgggggcaatagttgaggttagcagtgacagtggagcttggtttgctgctactgttgttaaggtagtgaggaaggacaagttccttgttgagtatcatggtctgttggctgatgatgattcccagcttagagaagagattgatgttctgcacattaggcctcatccaccggatgctgatgttgatggtcaattcagtcttcttgatgaacttgatgctttctacaatgatggttggtgggttggtgtgatttctaaggctcttgctgatttcaagttgaggctgcaccaggattggattggtggcaaatgggtcatgccttgtaagtcatatcatcaaggttattgtggtcaaggttttcggggtctccataaccacaccgtattgacaatctttgtgagtatgttggatttcaccccctgctggaaggcagggcagagcagccccaggctgctacagtgggctgccacggcagcagactggtttaatgtggtggtcgtgccgaaccaaatatcggctgagatagtagtgctatgtgttgactctaaagaagtcctttaa

SEQ ID NO: 43906 - DNA, 588 bp, Glycine max
  Peptide Sequence Number=SeqID_160684
atgggacaacttagggaagcatcttatgaagattcagcaaattgctataatgtgaaaaaggacaagctaaacaatctgattgcacaggaagagtcctgttggaaacaaagggaaaaggtttactggctcagagaagatgagatgaattctcgcttttttcactcatatgcttctgcaagaaagaagatcaacactattgtctccctcactcatgatgatgttaaaattcttgaaatagtgaatcatgttcctctaacacctcccttcttgctcttttccattgatgagtttagggatgctctttttcaaatggactataataaatcacctagcccagatggcttgaaccctgctttctacaaaaataaattggaacctttgtgctgctggcatatggacacaatcgtgaatctgtttaatgatgaagatgcgcaagaaatcaagaaaatttcctctcgtaaacaagctaaaaatggcaacattgtttggaagtttacagcctcgggcaactattcagtcaagactgcatatcactttttaatggagaaactaatatgcaatgatcatctgaaagtgaatgaaagctag

SEQ ID NO: 43907 - DNA, 210 bp, Glycine max
  Peptide Sequence Number=SeqID_160685
atggtagcgagaccattgctgctctacttcgctcttctgactccagcagttgtttcgccaatgcagctggcgaaacaccctccacgtcagctgttgtgtaatatatatccaaatttgggacctctctctcttcacatgcgggccttaagctttaggcacattgtgtcttacaatgtaacaaattatatgcaccaacatgatctaacgtaa

SEQ ID NO: 43908 - DNA, 264 bp, Glycine max
  Peptide Sequence Number=SeqID_160686
atggcaaggccacatgttatggttgtccctcacccagtacaatggtgttggaaggttacgcaagagaaagttaaggagctaatcgaatgcgtaaatagatcagaaagtgagaagattacatgtgtccttgcttatcagagcattggatgggcagttaagatttcagagaaaaagagaattagaagggcagccttctgtcctgcatcagcagcacagttggtattgggatctagcatcccaaagatgattgatactgcatcatag

SEQ ID NO: 43909 - DNA, 1221 bp, Glycine max
  Peptide Sequence Number=SeqID_160687
atgtcagcagaggtaatgttagagaaacagctcacggggcaccgcgtggatcgctccatctgtgcctggttctgggaacaagccatttcactaggcgactccttcaagcaacaaccggtgattgcttctcctacgcattatattttccaagtttttcgtgatggaatcacttttttgggctgcacgcaagttgaaatgccacccttgatggccattgagttcctttgtagggtagccaatgtcctcaatgattattttggggccttaaacgaggacataattaaagacaactttgtcattgtgtacgagctgttggatgagatgatagacaatggcttccccttaactacagaacctagtatcctgcgagaaatgattactccgccgaatatggttgacaaagccttgagcatcgtcactggtagcagttcaaatgtgagtgatacccttcctggggctgcagcatcttgtgttccctggagaacggcagagccaaagtactccaacaatgaagtctatgtagaccttgttgaagaaatggatgcaattataaacagggacgggggtttggtgaaatgtgagatctatggtgaagtccaagtaaattcccggatctcaggttttcctgatttaaccctttcatttacaaatccttccatcctcaatgatgtgaggttccatccctgtgttcgttttcggccttgggagtctcatcaaattctttcctttgtgcctcctgatggacaatttaagcttatgagttacagagttagaaagttgaagagcaccccaatatatgtaaagccgcagttaacttcagatggtgggatatgccgtgttagtgtattggctggaataagaaatgatcctggaaagacaattgattcggttactgttcagtttcagctccctcctttcatcttatcagctgatcttacttcaaatcatggaacagtgaacatccttgctaaacagacttgcatatggtccattggtcgaatcccaaaagacaaaaccccttccttgtctggaacattagtgattgaaactggattggagcgccttcatgtcttccctacatttcaagtgggttttaggattatgggtgtcgccctgtctggtctgcaaatagataaactggatctgaagactgtaccataccgattttacaaaggttttcgagctcttactcgggccggagaatttgaagtaagatcataa

SEQ ID NO: 43910 - DNA, 240 bp, Glycine max
  Peptide Sequence Number=SeqID_160688
atgcagagagactctctggaatccaatgcttcaaatccagctatcaagtacatgtccagtatggaattcatgacaggaaggttggactcaaatccatgcttaaccactgcagcatttacctgcttgcccaaaatacccgatccaattgatgcacaagctttagctgcaattgagaagctgaagagacttaacgctccttcatcctgtttgttagcaagaaattatgttgtacaatactaa

SEQ ID NO: 43911 - DNA, 915 bp, Glycine max
  Peptide Sequence Number=SeqID_160689
atggggagaattgaacttgcccagaaagcagttgctttggctgagaaaagactgccagttgattcttggcctgaatactatgatacacgtactggaaaatttatcggaaaacaagcccgaatgtatcaaacatggaccatagctggtttccttacatccaagatgcttttgaagaatcctgagatggcatccatgttattctgggaggaggattacgagcttcttgacatatgtgtttgtggacttagcaagagtggcaggaaaaggtgttcccgtggtgccgcaaggtctcaaattcttgaagagaaggggttttgcgaaggtggcatggaggaggaggaagaagccccagacgacgccgtgttggagttgtctgaacacggcattgttttgattgtcaagaatgcggttgcctccaagccaaggtttatctcaaatgatagatctgtagattctctggatgccagtatttgtgcagagatcaggacaaagattccagatacaattgcatgggactacaattttgaacctgcaggggcaaaccctttaacctttactgttaaatctgcagctctaaaggaagctattgaggatcttgaatggcctggatcaagcatccagattattctagagccagagcttccttctggcgcaaaaacgcatctccaaggcctaaagaaaagtagagcaagaaggcagttggtggttgtagaacatccactgaaagcaactaatggctggcccgtcgcggtagaaggaggcaacctggagtcgttcgtcgaagcgaggaacctcaaggttcttacgtggagggagctctgtgtggagcctcctcaaggcgagaaaggaagtgagaatgtgtattatcgaccatgggagggatcaatgaaagccccaagtgatggcgctctgtga

SEQ ID NO: 43912 - DNA, 1361 bp, Glycine max
  misc_feature (1208)..(1208): n is a, c, g, or t
  Peptide Sequence Number=SeqID_160690
atgccgggtcgccgccccacctctccgcaggtgctgatcgatctgcatcagcgtcttaacgacgtgattgccgcacgccagctggaagtgagcgacggtgcctttggcagcaaagtgatcatccctgcggacaagctatttgcgccggacggcaccgtagtgaaccaggttggccgcgcgctgctggcgcacgttgccagcgcgatgaagacggtaaaaggcacggtgctggtatcggtctataccgataatcgtccggtggatggccgtttcgcctccagctatgaattctccttcgcccgcgcccgtgccgccgcggcgacagcaatccgctcttacccaatgacagcaatgaaaaccgcgcccgcaatcgccgggtggagatcaccctgtttgcggcaccggaaaccctcggcaatcatcagggaggccagtgatgcgcgcatcactccaacatctgttaacccatcgcctgctgtggggcctgattggcgtcacggcactgagctgcgtgctgtggatgctcggtccgctgtggagctggggcgatactcgtccactggagccggtattcccgcgccagctggcggtcggcctgctctatttctgctgggtgctgttccagtttattcccgccatctggcgcggctggttcaacagcaagctgctcaatcgcctgcaggagatgagtcacgaagaagcgtccgatcgccaggcgaccgagacgctgctgacccagcgcttcatcactatctgtatcagctgccgtggtacgtgatgataggcgcgcccggcgccggtaaaaccaccgcgctgctgaatgctggtctggagtttccgttaactgacagcctcggcaaagaggcggtacgcggcgtcggcggcacgcgtcactgcgactggtggttcaccgacagcgcagttttaatcgacaccgcgggccgttacgcactgcaggagagccagcgcgcgcgcgacggcgccgagtggcacaacttcataaagctgcttaagcgctaccgcacgcgccagccgatcaacggcgtgatcatgaccatcagcgtggccgacctgctgaccgattccgccgaggcacgtcacgcccaggccagcgcgctgcgcagccgcatggtcgagctgcatcagcaaaccggcattcacttcccggtgtatgtgatggtcaccaaaaccgacctgctgaaagggtntatgagcttttatggcaacctgagtaagccgcagcgcgatgccatctggggcttcaccttcccgtgggaaccgggcaagccgcataaagatgactggcaccgcagctttagcgagcgctttcagcagctggagcagcgtctgcagcaacagct

SEQ ID NO: 43913 - DNA, 141 bp, Glycine max
  Peptide Sequence Number=SeqID_160691
atggaaaggatccaaaaagatatcatcctcttaagtaacaacattgtggcggtagggactaccagcgataatgccacaccaaaagaggaaaactctaggttaggcttcactgttatcaagcgagtcggagacccagcatga

SEQ ID NO: 43914 - DNA, 456 bp, Glycine max
  Peptide Sequence Number=SeqID_160692
atgaatatgaacgaagagagtggtgaaggaagcgcgaggagggtccaagtgcgcttcgtgacgaagttaggcgagccgtacaaagttccgaccaccgccatcgccatccccgccgacctcgctcgatttggcctctcctcactcgtcaacgcactccttcaatccaacgacgctgatcatcagccggagccgtttgattttttaatcgatggtgagttcgtccggatgtcgctcgagcagtttcttttggccaagggaatctctgcggaaaggatattggaaattgagtacgcaagggctgtcgctccgcggaaggaggaggacccttctctacatgatgattgggttagtgctgttgatggttcttcttctcgatattcactgcttgaggttcatttttgcattgtggttgatagcagtagccaaagaacacaacctaaccctctttgtgaatag

SEQ ID NO: 43915 - DNA, 450 bp, Glycine max
  Peptide Sequence Number=SeqID_160693
atgggttgtgaacccaacattaaaacgggaggggaaaaggagaatggctatcaagacttggatattgatacatggtcattccttgaagttgtcgacctaatacacgatcttgagtattttgatattggtgggcttaaaatgtggtggaaaggggtgaatgattatgaagaagttactggggatgaagttaccaggggtgaggagttgtttaatggccaacaaatttcatccaagaagcaaaaggagcctagagtgaaaaacaaagtaagccacaaaggaaaacataaggcttttggatatgaagatctttctattgaaaatcttggtcaatgtgatgaagacccaaatgggatggattatgacagtgtgattgacccacaccatgaggaacctaatccaaattttagagagatgcatgatttggagattggctatgaaactgtagagtga

SEQ ID NO: 43916 - DNA, 234 bp, Glycine max
  Peptide Sequence Number=SeqID_160694
atgaccagccattcattcgtccacaacaccctcagcaacacgtccgccgcatctacctccttcctaaaactcacgtatgctcgatcaggtgccgctactgggtacgatagatcagcaaggcacgaaagctggaaccaacttcaagataccatcacttgccactttccgccatcttcaaaaagagtatgtgatggtgatggtggtggagaatgtgaaaacgggggtggtcactag

SEQ ID NO: 43917 - DNA, 702 bp, Glycine max
  Peptide Sequence Number=SeqID_160695
tgatcttccgtcacagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatgagtgcaatcaaagtgatcgagatcggcacgctgatcgccgcgccgttcgccgcgcgcatgctcgccgagttcggcgccgaagtgatcaagatcgaagccatgggccagggtgacccactgcgcaagtggcgcaagctgcacgaaggcacctcgcatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 43918 - DNA, 1050 bp, Glycine max
  Peptide Sequence Number=SeqID_160696
atggctccgaaattggcgaaaacagggtcgttccgtcacggtttggcggagaagaaggagaaggagaagcttctctcggcggcgaagagtagtagtagttattcagagataggaataggaattggcatgatgcaacaagaggaagagcaatcgtggtggaacacgtttaagcgcgtcgctgagaaggcattggaaatgggtcgttctgatccaaggaagattatcttctctgcaaaattgggccttgctttgaccattctttctcttttgattttcctcaaagaacccttcgcggatttgagcagctactgcgtctgggccattctaactgttgtcgtagtctttgaattcaacataggggcaactctgagcaaaggagtaaacggtggaatggggaccttgttggctggaggacttgctctggggatggcagagttatcaacattgggtggaaaatgggaggaacttataatcattatgtgtaccttcattgtaggattttgtgccacctatacaaaactataccctacttttaagccttatgaatacgggtttcgcatgttcttgatcacgtattgtttcatctctgtatccgggtatcagacaggggaatttgttgatatagctataaatagatttgttctcattgcacttggtgctgctgtatctttgggagtcaatatctgcatataccctatctgggctggtgaggatctgcataatcttgtcaccaaaaatttcatgggtgttgcaacatctttggaaggtgttgtcaatcactaccttcattgtgttgaatataagaaggtgccatctaaaattcttacttaccaagctgctgatgacccaatttacaatggctacagatcagctgttgaatctacaagtaaagaagattcattgatgggatttgctgtctgggaaccaccacatggtcattacaaaatgcttaaatatccatggaagaattatgtgaaattaagtggggctctaaggcattgtgcatttatggtcatggctatgcatggatgcatactttctgaaatacag

SEQ ID NO: 43919 - DNA, 3241 bp, Glycine max
  Peptide Sequence Number=SeqID_160697
atggatcaaaaatttatgtcagctgcatttctttccgggatccagtttgtgaggatattgcagaggcctaccggattcaggcaaattcatatgctgacaaatgcatctgtctggtttcacgcttgccaactctacaataatttcagcaagcctctatgggatgttatagcacatatggtatctagtgtgcctttgccaactcctggaaaggagcgagttctgtttgctattgagagttgtctgctttctgtagaggctccacctattgattggcttccccatgctgatcatgtatacattccgttgctgtttttcagtggagtagattatattgatgctcctacaccatatatgatgggactctattcgggtgttgatacttctgctctggcaattgatggggttgttgttgtggaccttgagtataatcgtatcactacctcagaggaaattcctcctattcctgagccagaattcagccttttgcgtggtgagataatgaagctattatatcccaatgtaattggaattgatgagatgaacactggaatatacagtgtgtctgagcattatcctaaacttagggctaagcaatggggagaggaacacgaccttcagctaaggatgatattcctaaagttctttgcaacagttttaagtggctatcgcaatttcctagaaaatagtgctactcaggtcttcaactctcaagcttttttgaagaagcggtctcgatctactaaccaaccaccagagcccatgatagctcagttcctagactctcatggtttcttggattatttggaaagaggagtaggttctgatgaaaacaacaataatctgcttgataagctacaagatgcaattggaaggggtcaaaaccctatgtcaattcttccttcatcctcagtagaacctgagattttaacagtatcagattctgatattggaatatcaggatctggtgccaaatacacttatgatagatttcctgcaaatatcagaacagaagaacaagaagaaaagaggaaacagattcttgcagcagttagtaatgcttttgagtactcaggaaggcatactcctagtaaggatcctttagcagatagtcttagtccagacgagagagctgctgaaagggatcgcatggtgctagatattcaggttaagctgcagggtttatggctgcggcttcttaaactgggagcaacagatgatcctctctcatcctttgaatatggaacgatactcgtctggagagcttgtcaaaaagtgattgaggttggttttgcagctttgattgaatctgatgcagaggggattggcggtagtggatttgttgaatgtataagagagcatatacattcgggttgggactgtcatctcactgaagaacagtttattgcagtgaaagaattgcttaaaacagctattaatcgcgcaacatcacgtaatgacttgttgaccattagagatgctcttgaagtttcttctgatatgtataagaaagataataataatgtgctggactacgtccaacgtcatcttatctctttatctatttgggaggaattacgattttgggaaggatattttgactatttaatggagcaatcttcaaacaagtctgccaactatgcatctttggtgacagctcagcttgttgtgttggcatcacacatggctgggctgggacttcctgataatgatgcttggtacatgatcgaaacaattgcagagaggaacagcatcggatccaatcaatttataaagatcagagggttcttgtctcatatccagcaattacgtaatggatactggggaatcacctcaatgaaagcacagtctgtgttattacttgcattgccatccccgcattctaaagatgccaaagatgagaaccagcaacccactgaggcaactggtgttggtagaaactgggtgcagagtatgttcagccgaaatacaacaactagatccagctcatttagtcgtgttcgtagatggacgtctgatggaggaaactcagctacaaatgagaatgggactcctcgcaaacaagatctgtcaagtggtggccagaaaaagcttcaaaccaatgttcgcatacttaggggtcataatggtgccattactgctctccattgtgttacaaaaagagaagtgtgggatttggttggtgaccgtgaagatgctgttgtttcattgccttctggtacccagaatgaggtgatatgctgttcatgtgcaaatatgcaggttaagatctgggatcctagtcttcgtggttctgaactcagggcaactttaaaaggccatactagaactatccgcgccataagttcagatagggggaaggtggtgtcaggatctgatgatcagtctgttttggtgtgggataagcaaacaactcaacttctagaagagcttaaaggccatgatggaccggtcagctgtgtgcgcacgctctccggggaacgtgtgttaactgcatcccatgatggcaccgtgaagatgtgggatgtaagaacagatagatgtgttgcaactgttggccgttgctctagtgctgttctatgcatggaatatgatgacaatgtgggagtcttggctgcggctggaagagacgtggttgctaacatatgggatatccgtgctagtaggcagatgcataaactttcaggacatacacaatggatacggtccataagaatggttggtgacactgtgattactggtagtgatgattggacggcaagaatatggtctgtttcccgaggaacaatggatgctgtcttagcttgccatgctgggccaatattatgtgttgagtattcttctttagacagaggaataattacaggaggtatacgctgtgcaaaaaatgtaacaattcacaatgctgccatattatctatcaatgctggggagcactggttaggcattggagcagctgataattctttgtcgctctttcaccggccccaagaaagacttggtggtttttctggcactgggtccaagatggctggttggcagctttacagaacaccacagaaaacagttgctatggagaagaagaaggaagcagcttcaccttggttaattgttggcctcggcaatccaggcaaaaagtacgctgccacccgccacaatgtgggttttgagatggttgataccattgctgaagctgaagggatatctatgaccactgtttccttcaaagccttatttggaaaag

SEQ ID NO: 43920 - DNA, 477 bp, Glycine max
  Peptide Sequence Number=SeqID_160698
atggggttgtctttcaccaagctttttagccggctctttgccaagaaagagatgcgtattctcatggtaggtcttgatgctgctggatttaatgtggagactgtggaatataagaatattagctttactgtatgggatgtgggtggccaagataagattcgtcctttatggagacactacttccaaaacactcaggggcttatctttgttgtggatagcaatgatcgtgaccgtgttgttgaggctagagatgagctccaccggatgttgaatgaggatgagttgagagatgctgttctcctggtatttgccaacaaacaagatcttccaaatgctatgaatgctgcagaaatcacagacaagcttggtcttcattctcttcgccaacgccactggtatatccagagcacatgtgctacctctggggaaggactatatgaaggactggagtggctctccaacaatatagctaacaag

SEQ ID NO: 43921 - DNA, 354 bp, Glycine max
  Peptide Sequence Number=SeqID_160699
cttactggtggtacagcttcaatgcaccaattgaaggaacgcattgagaaagacttgctagaggagtcccctcaagctgctagagtaaaagtatttgtcagtggaaatgcaactgaaagaaggttcagtgtttggataggggggagtatactggcttctcttggctccttccagcagatgtggttctccaagtccgactatttcactgtgctatggataggtatgaagagcaaggtgcttcttatatccaaaggaagtgcccttgagttttctaacggatgtgaatacttgtgtttattttcttaccattattgggaacccgggagtttcaggaagtccaatgttgaccactaa

SEQ ID NO: 43922 - DNA, 192 bp, Glycine max
  Peptide Sequence Number=SeqID_160700
atggagcagattgaggaatttgacaaagctaagggcgaagacactggtcaggagcgtgtattttacgagagatgcgaaagtgaaagcaacattatatatacaaatgtgtcttttagacgtatttgtgagtggttacagggtgccacgctcttgagcctacttggccttcattacccaagtgacttcacctaa

SEQ ID NO: 43923 - DNA, 1062 bp, Glycine max
  Peptide Sequence Number=SeqID_160701
atgcctcctgacccatctcatattctgcatccaatttctcgtcctttatcaacacaacttccggagttctacttctgggatgataaattgataatcatgtccatgaatacggctccccgaatgacaaagcacattgcgttccagatattactatcttccttaacaggagtaacaggaaatcagattctatacttcttggggcttaaatattcaacccctacaattgcatgtgcactaaacaacttgctaccagcattcacttttattcttgctgtcctctccagacaagagtatttgagaatcaagactagggcaggggtagcgaaggccttagggacagtccttagtgtgggtggagcagtgcttttatcattttaccatggaaaagtacttggtctaggtgaatcaaagattcactggagatatgcagaaaacatgcaaagagaatcctcttcttctggtggtggaagaaaccatcttctgggccctgttgctgtaattgttagtgctcttgtttgggcagtatggttcatagttcaaaaaaacatgagcaagagctatccagctccttacactagcactttctacatgtgtttgatggcaagcattcagtgtgtggtcattgccttggctgctgaacacaatgtctcagcttggtcactccacagtactataagactaacctctgctctttatgcggggactatttctactgcgctagcgtatgtgctccttgcgtggaccattgagaggaaaggtcctctctatgtgtctgtgttctcccctttgctgcttgtcatcattgctgttgctagctgggcttttcttcacgagcaattatacgttggcactgtcatagggtctctgctgatagtgttggggctgtattttgttctgtggggaaagaacaaagagatgaataagatagacgttgttgaagttgaaggcacggtcatggaggcaataaaggatagcgagaaggatgaggtgaaagacctggaattgcaaccctatgaatatgatccttccaacgttaacggttaccatcatgatgctaattaa

SEQ ID NO: 43924 - DNA, 2205 bp, Glycine max
  Peptide Sequence Number=SeqID_160702
atggtgaactcttggcaacttcctatcactcaaagtttcttggcactgtactcagatggtattgtaccttcaagagttcttgatactgtttcaataagtgatctcctaaggacaggtggcctcccatgcaagaaagtgggaagcgaccatttggccttggtttctgaattttctttctcagttaccaacaatgaacctaaagacaaagtggcagcagcagcagcagcagcagcagcagcatcacctatagtagatattgaagagcctaacaatcagcagatgcaacgttttcttgacaacgtccttgctgttactaaagagtcggtgaagacgtttacttatgaatcgttgaacaatattgtgagagtgataaatggtgtgtcagctcttgtgttgacactgctacctgggaaagccactatacttgtaggtattcaaggttgggagctcaggccaactcttcgtggaacatgctttccacgttggatggataatggtgtgtcctctttcaaccactttattcatgagctttctgtggattccgatgtatcaagcctggaatattcatctgaagaagaagaagaagaagacagtgattatgatggatatgaagaatatcctgaatctccctcatcacaaagttctagagcctccagagctaattggattttggttcctatacacttgttgctagggattccatttcgccttttccagttagcttattctgggtctggggtgtcaaaaccgtcactggctatctctgccaatcaacacccttcacaatcacattttcctaataaagtgcaaagcctcaaggaccaaattatccatcgtactactgacaggagacgtgggatcattgaggatctccatatggccatggagatatttatagaagctgtttttgatgttgttcacagggcagtacatcttcttctttccccatcagaagctcttggaacattatccaggttgttttcatctcatgatgatgttgccgaggatgcctctacttcttcagctacacttggagacaatgagccaacacctacagacaggaatactagttctcgttcatctctgaacacagatgcccggacatgtcaagacgttataacagagctagggtatccatatgaagctattcatgtcatcactgccaatggatatgttcttcttttagaaagaattcctaggcgagatgcatgtaaagctgtttatcttcagcatggagtcttcgattcatcaatgggttgggtatctaatggtgttgttggctctcccgcttttgcagcctatgatcaagggtatgatgtatttctgggaaactttcgtggtttgatttctagggaacatgttaacaagaatatctcttgtcgtgaatactggcgatactccatcaatgaacatgggactgaggatattcctgctatgatagagaaaatccatcaagtaaaaactgctgttagtaagcctgatactgaggaggaaagcaatgatggtcagctttacaagttttgtgcaatttgccatagtttgggaggagcttctatgttaatgtatgttgttacgcttaggatagaagccaagccccatagactttcaagattggttttgttatcacctgctggtttgcatcatgactctaacccagtcctttcagtggcggagcacacattgtttttgctggcccctattctgtctcgtattttcccagccttctatataccaactagatttttccgtatgattgttaacaagttagctcgggacctgcaaaacctgcctgcagttggaggattggttcaaactttagtaggttatgttgttggtggggacagctcaaattgggttggagttttaggaacactacattacaacatgaatgacatgccaggagtatcttttggtgttagtctccatcttgctcagataaaacgtgctagaaggtttagaatgtttgattatgggaatgcatatgggaaagtgtatggttcccctgagcctttggacttgggtgaacactatggactcgtagacattcctgttgatctggttgctggtcagaaagacacggtgatacgatcttcaatggtgaagagacactataaattgatgaaggatgctgcccaattcaaagaaccaagtaaatcaaagggatctaaggttgaggaaaaaggacaagtttcatttaatgggtag

SEQ ID NO: 43925 - DNA, 1959 bp, Glycine max
  Peptide Sequence Number=SeqID_160703
atgaccgaaaataagtcaaccagtaagatcactaagaaacaagagacaaaaaaagtttctagtttcagccatcagccccctagaaagcaacctcggaagggtgaaaaccctactagactcatacctcctcctgaccagtcttctgattttggccattcaaacacttggatttgtaaaaatgctgcttgtagggcggttttgtctatggatgacacattttgtagaagatgctcttgctgtatttgtcacctttttgatgataacaaggatcctagtctttggttggtatgcacatctgaatctgctcaagggggggactcctgtgggttgtcttgccatattgaatgtgcccttcagcatgaaaaggtgggagttattgatcatgggcaactgatgcaactagatggtggctattgttgtgcatcctgtggtaaagttacagggatacttggatgctggaagaagcagctaactatagctaaggatgcccggcgtgtagatgtactctgttacaggatatatttgagctacaggctccttgatggaacctcaaaattcaaagatttgcatcaaacagtacaagaggcaaaggctaaactggagacagaagttggtcctgtcaatggtgtttctgccaagatggctcgaggcattgtcagtagactccctattgccagtggtatacagaaactctgctctcttgctattgagaaagctgataggtggcttgccactgttccttatgtaaatccagattccacagagggttcacttcctgctgcttgcaagtttgtttttgaagaggtaacaacttcctcagccaaaatcattttaattgaaatgtcaaatatatgttctgaggaaattaagggatacaagctctggtattacaagagtcaggacgaatcacccactaaagatcctatttccatgtttcccaaatctcagaggaggattttggtatccaacctcaagccttgcacagaatatacttttcggattatatcttacactgatacacgtgacttgggtcattctgaggctaagtgtttcacccagagcatcgagatagttaaaaacaatccctcttcatctgttgctatgaataaagaaaaagagaaccttctaactaggggtaattcttcggtctctaagatagggcccaatgccacaacagaaggctacggattcaaggttcgagaccttgggaaatttttgcgtcttgcttgggctcaagaacaaggttacttggaagagttttgctgcgccaatgtgaaaaattgctgtggacaaagtgaaatggtggataagcctagaattccagaagcacagttgccttcactttcgcgagtccttgatttaaatgttgtttcagttcctgatttaaatgaagagctaacacctccttttgagtattctagggatgaagataatggttgctctttgctgcaagcagttgaggcagatgatgatgctgcttctcatgatctagagaaaaatggtttagtaagatcacatgggagtggggattcccagacctggacccatgggccaacaggagaagtgtctgctgttgattctcgcatagatatgtgcaggaaaaggatagcaagcacaaacgaagagactcatgattgtgacagcactttgataaatggttctcctttacgcatatctgatggttcatgttccttggatgagaactttgagtattgtgtgaaagtaattcgttggctagaatgtgaggctcacatcaaacaggaatttaggttgaaattgctaacatggtttagtttaagggcgacagagcaagaacgcagggtggttaataccttcattcaaactcttattgatgatccaagtagtttggcaggacaactggtagactctttttctgatattatatccaacaagaggctaagaagtggattctgtagtaaagctggggcatcaaattaa

SEQ ID NO: 43926 - DNA, 192 bp, Glycine max
  Peptide Sequence Number=SeqID_160704
atggctatttcagatgaaagacagagaagcatgccaacaatgagagacaaaaactggcaaatcctagtttaccctgaagcggttctattaaccagactaatcaacccagcattcagaggagagctcttccatgataggtatgtagaagaattagctgctagtgtcgaggctgctgtggaggaagttatctag

SEQ ID NO: 43927 - DNA, 165 bp, Glycine max
  Peptide Sequence Number=SeqID_160705
atgaccaggagtaagatcaaacattcaaatgatatcctccaacaaatggtatcagccatacttaacaaggcccaagtggagaatgatgaaggcccagaggcactatcaagaatcttgattgttgctgaaggcccatctgcacctcagatacactatatgtattga

SEQ ID NO: 43928 - DNA, 501 bp, Glycine max
  Peptide Sequence Number=SeqID_160706
atggggtctgaaggtcctccagcagctgtggcaacagttcatgtaacaggtttcaggaaattccatggagtttctgagaatccaacggagacaattgtcaataatttgaatgaatatttgaacaagaagaagggtttgccaaaaggcttagttattgggagttgcagcattcttgagactgcaggtcaaggagcactcattcccctctaccagacattgaagtctgccattacttccaaggaatcagaatcttcaagttccaataaaattatttggctgcattttggggttaacagtgccgcaacgaggtttgctatcgagcgtcaagctgtcaacgaggctaccttccgctgccctgatgaaatgggatggaagccccagaaagtccctattgttccttcagatggtgcaattacacgaatacgggagctgcagcttacaccatgttcaatatcatttagcaggcttttcgattgtcttttttggggccatagcatctag

SEQ ID NO: 43929 - DNA, 862 bp, Glycine max
  Peptide Sequence Number=SeqID_160707
ggacaccaggatttatttattctgcgaagtgatcttccgtcacagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgataaagccaggcagggagcttccattccaatacagctttctatatctatccctggtagaaacggtttcttgtgaaatgacttcaagaaaacccaacacagggaatgtgaaaatggagcctgactctgtcgcccaggctgaagtgcagtggtgtgatctcggctcactgcaatcaagcttatcgataccgtcgacctcgagggggggcccggtaccagcttttgttccctttagtgaggtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacaggaa

SEQ ID NO: 43930 - DNA, 1175 bp, Glycine max
  Peptide Sequence Number=SeqID_160708
atggatatggtgaggtgcatgctgaaggccaagaaaatgcctaaggagttctgggcagaagctgttgctaccgttgtctacattttgaataggtgcctaactaacagtattcgtgataagatgctagaaaaagcctggagtggaaggcggccatcaatcaaacatcttaaagtttttgggtgcataacatatgcatatgttttagatcagctcaagaagaaattggacgataaaggagaaaagtgtattttcattggctacaacacatctcaacaggagccggtggtgatcgctgacaaccatgaagaaaatgatgaaaggttgtcaaatccaacacctgatgagccaaaatcatccaggaggccacaaaggaatcatcaactcccagctagattgcaagactgtgtcatgtttaatcacaataatccatctgatgaagagattatcaatttttctttatttgcaaactatgatccagttacttttgaagaagcctcaagtgatgagaattggaaaaaggcgatggatgatgagattcgtgctattgagaaaaatgacacgtgggagttgaagactaagtacaaccttaaaggagaaattgatcgcttcaaagcaagactagttgcaaaaggttataaacaaaaaccaggtatcaattactttgaagtatttgttcttgttgcaagtttaggtattattcgcatgatcatttctcttttggctcaaaatagttggaagatatatcagatggatgtaaaatttgcatttcggaatggtgttctggaagaagtctacgttaagcaacttgcagaatatgttgttgaaggaaaggaagacaaagtctacaagttaaaagaaggctttgtatgggttgaaacaagcacaagagcatggtataaaaagaccgattcctggtttgttcataatgtctttgaaagatgtccttgtgagcacatattatatgtcaaatctattgatcctggagatattctcattgtgtgtctttatgttgatgatctaatcttcactggcatcaattcaaagttgattgtagaattcagggaggctatgataagttgttttgagatgacagattcaggcctggtgtcctattttcttggcattgagcctgtttctacaccagttgaagagatgttgaaggcaaaagggtggat

SEQ ID NO: 43931 - DNA, 327 bp, Glycine max
  Peptide Sequence Number=SeqID_160709
atgagggagaatgttagtgtcaggacttggatattagaagttttgttgttgtcgacaattcagatgaaagatggatggagaatgttgttgttgaaggttgagttcaatgaggaagatgagggcttttttgtcctaatgatttcattaacaagggagttgggattcatggggttggcctgcggcaccaacaagttagagagtttgttcttggggtcaacgttcatgggttttcacagcaccaagaacgtgaatgggtttgttattgggtttcagcagcaaggggaggcaaatggagtttatggacctattcatcgaaagcactcttag

SEQ ID NO: 43932 - DNA, 270 bp, Glycine max
  Peptide Sequence Number=SeqID_160710
atgttcacaatcaattacttcattgagaagcacaataacaacaacatagagacatatatagttcgctacaagaagagttttagccgcttaaggatcgatgatggcgatgacgatcgatgtgccttactgctgaaggaaggaagaacctattgccaatggttgtttctgacactggacttgaagaactgctacaatctcattgcaaggatctacaacaccatcatgcactgtaatgatcatgacatcgcgtttcagctttccatcctttag

SEQ ID NO: 43933 - DNA, 189 bp, Glycine max
  Peptide Sequence Number=SeqID_160711
atggaccgcttagcccgcattagtggatttcggcttagcgcgtgcttttctcgctcagtggatggactgaagcgattcttcctcgcgcttagccaaaggagtggtgcgctcagtggatggctcgctaagccagcagattggcttagcgagcagatgaaaatcagcacttcacagacttgcctaatttaa

SEQ ID NO: 43934 - DNA, 183 bp, Glycine max
  misc_feature (39)..(39): n is a, c, g, or t
  Peptide Sequence Number=SeqID_160712
atgtggtttgtggtggtgtggtcgctgtggaaaggtttnggtggacatggtggtaggggtctcagcttggcaacaacgggccagaattatgttgaaggtattggccggagttggttcgtgaatgaggttggtgttcagtctctttattcaactgatatttatggactaattgtggttgattga

SEQ ID NO: 43935 - DNA, 408 bp, Glycine max
  Peptide Sequence Number=SeqID_160713
atgtccaatgacttcagaaacattgatagaaggttacctttgactggggagagcttggattctaggggcctttatatatatgacgatggcttgcaattcattatatggtttggtagactgatttcacctgatatagctaagaacttacttcggtcggaccttgcagaagagttagcaaaggttactcttaaagataatgataacgaaatgtcaaggaagctgaagaaggtacttaagaaattcagaagtactgaccgtgcatattaccagttgtgccacgttgtgaggcaaggcgaacaccccagagaaggattccttctttcaaacctatttgaggaccaaatgggtgctaatattgggtatgctgataggatgctacagatttcccgacaagtgcatcaagcataa

SEQ ID NO: 43936 - DNA, 915 bp, Glycine max
  Peptide Sequence Number=SeqID_160714
atggaggagaggccatggccgtggggaggtcatccccccaacggaaatagtattggctttcctaatggtgttcatggttctagttggggggctggtgaagttgtgaggcagcttggtcatcctgaaattcttgctcctaggttggccagctctggagctttgccggatgttgccaatagtgcgaagaatgattttgtgcataacaactttcagcagcaacagctgcctgtacagatgcaatttgatttctcaagagccacttcaagggcttctgagagatcaatcattgcggagtctgagatttctgatattaaggcgtcgtgcaaggaggagagaatgagtattgccgatgacaggaggccgaggaagcgggggaggaagccggctaatggaagggaggaacccctcaatcatgtggaggctgagaggcaaaggcgggagaagctgaaccagcgattctatgcactgcgagccgttgttccaaacatctctaagatggataaggcatcgctgttgggagatgctattgcttacatcaaccagcttcaagcaaaactcaagaccatggagtttgagagagagaggtttggaagcacttgtgtggatggaccagtattggatgtcaatgcagaagtagaaaaaaatcatcacaacggagctcctgatatggacgtgcaagctgcacaggatggggtcattgtaaaggtgagctgtcctatcgatgttcatcctgtttcaaaagtcattcaaaccttcaaagaggcagaaattggtgttgttgaatcaagacttactgttgcaaacgatactgttttccatacatttgtagttaaatccgaaggacctgatcaagtaacaaaggataagttgattgcattgttttccaaagaatccaacttcatacaaacactatga

SEQ ID NO: 43937 - DNA, 1371 bp, Glycine max
  Peptide Sequence Number=SeqID_160715
atggggactgaaaacccttgtcgtccaacctatccttcaaggccaccctttgctgctgcagcacagggtgtgacaccttttgcaccaactggtggtgccatggttggattagagcctccttcttttcgacctactcctcctgctccacccttggcttccacaccattttcatcatccgggccagcagttcgaccctgggtgccacattttagacccgtgccaccggggcagtttaatgacccttcagtgcctcctcctccttccaatttcccacctgctggtggacctttccagcattttccagggcaacatttttcctcaaatgctcaagcaccttccccacatgttccgcctatgggacaaccggcaattcaaccttctgctggtcaaacacacccttttccaccttctcttcagccgcaaccttggccgcagtcacagacccttttgtttcaatggggtctccctctcctgcactttcagctatcttttcctggatatgcacaaaaacaggctggtgcagatattcaagctccacctatgcattcctctcacccttccaatcaaggaaattatggacctatcccacctgcagcatctttgccttttcaacctcatcaaggaggttatgtttcgcagcccccaatggctgctccgttaggcatccagcccatgcaacacccaggatctggaccgcctataggtgatgttcagggtttgacagaagacttcaattcgctatcaattcaagctcgtcctggactcgtggagtcgtccattgatgctaacgaactgcctaggccattggatggtgacggggagccaaagtctttatctgagatgtatcccatgaactgcaattctagatatctacgtctcacaaccagtgcaattcctatctcacagtccttatgttcgaggtggcctcttcctcttggagcagttgtatgtccgcttgcagaatatcctgatggggaagaggtacccatagttaattttgccgcatctgccgttgtacgttgtaggagatgctgcacatatgtcaatccatatgtgacatttactgaaggtggaagaaagttccggtgcaacacctgctccttgcttaatgaagttcctagtgaatattatgcacaattagatgccactggcagaagaattgatttgaatcaacgacctgagcttacaaagggtactgtagaatatgttgccccaatagattatatggtgcggcctcctatgcctccagtatatttcttcctcattgatgtttccataactgcatttagaagtggaatgattgagcatgaattgaatagttggagcccagttagccaggtgcatgtgatctattttgtccgaccagcctga

SEQ ID NO: 43938 - DNA, 111 bp, Glycine max
  Peptide Sequence Number=SeqID_160716
atgaccaagagaatgggattcttttctaggatcagtggggtgtataaaaatctaaaagctttcctagatttatttgataaatctgttggcctagccactagggaaaagtaa

SEQ ID NO: 43939 - DNA, 276 bp, Glycine max
  Peptide Sequence Number=SeqID_160717
atgcaaataaagtggcagaaaattaatgaggtgagaacaggagtagtgagtagtgacaacacaaaccttgattacaaggtttcagagggtctccactctgagctgcttttcggctttgctaaatgctttgtgacttgtgagtcctatgcagaagattcagcctacatatataaactagcaaagaaagaaaaaaaagcaaatgacatcatgcatagaccatgtttggaaattgaacaagcacaagcaggctatttccaagccaccggcatgacatga

SEQ ID NO: 43940 - DNA, 1170 bp, Glycine max
  Peptide Sequence Number=SeqID_160718
atggataccttcctgttcacttctgagtcggtgaacgagggtcatcccgacaagctgtgtgatcagatatctgatgcagtgctcgatgcctgcctggagcaagaccctgaaagcaaggttgcctgtgagacatgcaccaagaccaacttggtcatggtatttggagagatcaccacaaaagccaatatagactatgagaagattgtgcgcgatacgtgccgttctataggatttgtgtctggtgatgttggccttgatgctgacaagtgcaaggtattggtgtaccttgagcagcaaagtcctgacatagcacaaggagtccatggccacctcaccaagcgaccagaagacataggagctggcgatcagggtcacatgtttggctacgccacagatgaaacacctgagcttatgcctctcagccatgtccttgcaaccaagcttggcatgcagctcactgaagtgcgcaagaatgagatctgtccttggttaagacctgatggaaaaactcaagtcactgttgagtatgctaatgatcatggtgcaatggtcccggtgcgcgtccatactgttctcatatccactcaacatgatgaaaccgttaccaatgatgagatagcagcagacctgaaagagcatgttatcaagcctgttattcctgagaagtacttggatgaggagacaattttccatctcaacccatctgggcgttttgtgattggtggtcctcatggcgatgctggtctcacgggtcgcaaaatcattgtcgacacatatggtggttggggagctcatggtggtggggccttctcagggaaggaccctaccaaggtggacaggagtggagcctacattgctagacaggctgccaagagcattgtggccaatggacttgccagaaggtgcattgtgcagatatcatatgcaattggtgttcctgagccattatcagtgtttgttgacacttttggcactggaaagattcctgacaaggacattctcaagcttgtcaaggaaaaatttgatttcaggccagggataatttccattaacttggaccttaagaggggtgcaagtggcaggttcttgaagactgctgcttatggccactttggaagagatgacccagacttcacatgggaggtggtcaagcctctaaagtgggaataa

SEQ ID NO: 43941 - DNA, 599 bp, Glycine max
  Peptide Sequence Number=SeqID_160719
atgacgttccacgagcatataacagcccgggcttgggccaccatcgcaatccgcgtcggtcaatgtcccgagtcgatcggcggaccggctctcacctccttttcatctttccctcgcggtacttgttcgctatcggtctctcgccagtatttagccttggacggaatttaccgcccgattggggctgcattcccaaacaacccgactcgccgacagcgcctcgtggggacttgggcccggtccgccactgaggacgcttctccagactacaattcggacgccgagggcgaccgattttcatggtgggcttttcccggttcgctcgccgttactaagggaatccttcgggtagccccgcctgacctgaggtctcgttgggagcgtgcgtgcacgcaaagggtcgtcgatgggtccagaactgaccggctcgcacgtgattggtctcgagcgtggctcatccaccattttatcacggcgaagtcggccatgaacccagatttcaaccaaccacgaggcgggcgtgccctcggcctaatggcttcgggcgcaacttgcgttcaaagactcgatggttcacgggattctgcaattcacaccaa

SEQ ID NO: 43942 - DNA, 351 bp, Glycine max
  Peptide Sequence Number=SeqID_160720
gtgttgttggctgattcacgattcactcgaccggatatgggttttcacccaacaaaactcaatttcgtgcctagcgatgcggatgaggcgccactcgatgtttccatttgcctgcatgcctttggtattgtggggtgtggttcgtttagtggtgtcaagtcttgcgaacgtgaggacccattccatccaggcctctttgttggggacgctggaggatttcaaagtcccacacgtgaaccactgaacgtgggtggtctagtgcccccacattgttccttaaaatcggttgtctcggatgacgcttgccctggcgcttgctttgttcaacgcgatgctactactcttagttag

SEQ ID NO: 43943 - DNA, 216 bp, Glycine max
  Peptide Sequence Number=SeqID_160721
atgtctagcagtttgtgctggggacatcacaaattcgtctgcagaatccttggaagcagcatctttgtacgagcaggcagcagttatttccttgtttattgtgccatgcacaatgtcaacaactttaacataaaagagatgaagaggcttcttccttgtgtcaacttgtcaaaaggtgccctcttaggaacaaagaggataggcttacaagcataa

SEQ ID NO: 43944 - DNA, 186 bp, Glycine max
  Peptide Sequence Number=SeqID_160722
atgacaatcagaggaggagatagggggaactgcttcaagctcaggcgaagaaggctatgtagcataggaactaaagttagtgagctttggacatcctgtcatacagttactgacggaggagctggagtggatgacgaagggatgtcttccgttctagctcttttccttgattccttctgtaactaa

SEQ ID NO: 43945 - DNA, 525 bp, Glycine max
  Peptide Sequence Number=SeqID_160723
gtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatcggacaacggcgcccctgtggcgccgttgctgtatctggaggcaggattaacacgcctgtagccctggctctgctacggtcggcacaccctcgcacaggacgtgtccatggccctgcatcgcttcatcgtggccggcgtgctgctggccctggccggctgcagcaccccggcgtcgtacgaaggcgcggatttccctgcatcggcgcaatgccgcatgcagtgccaggccggctatcgcagctgcatggcgcagaatga

SEQ ID NO: 43946 - DNA, 567 bp, Glycine max
  Peptide Sequence Number=SeqID_160724
atgtccgacataaaaacttggttcgacttttgggttactgcattgaggggactcacaggtatcccccttgtcaattacattacagtctcaagtctcaacatgatgttggtctatgagtatgtcaataatggaaacttagagcaatggcttcatggagctatgcgacatcatggatatcttacctgggaagcacgtatcaagattctccttggcacagctaaggggcttgcatatttgcatgaagcgatcgagccaaaggtggtacaccgagatatcaagtcaagcaacatattaattgatgatgacttcaatgccaaggtttctgattttggcctggccaagttactgggttctgggaagagtcatgttgcaacacgagttatgggaacctttggatatgtggctcctgaatatgcaaatactggtcttctaaatgaaaaaagtgatgtttatagctttggtgttgtgctattggaagcaataactggaagagatccagttgactatggtcgtccagcacaggaagtgagtaaacttacttatatgttggaagaaaatccattttga

SEQ ID NO: 43947 - DNA, 1214 bp, Glycine max
  Peptide Sequence Number=SeqID_160725
acgcactctcccccaacaaaaccccttcccaactcttccacctaagactcctacgcgacggcgcaagagtcaaaacactaaactccttagccgcagccacaaatcaaacccgacccactaataccgggtcgggtttcagcagctccgtagtttcgggtctctcacagggaagcggcgagtacttcacgcgcctcggcgtgggaacccctccgaagtacctctacattgtcctcgacacgggaagcgacgtcgtttggctccaatgcaagccctgcaccaaatgctactcccaaaccgaccaaatctttgacccatcaaaatcgaaaaccttcgccggaatcccctgctcctcccctctctgccgccgcctcgactcaccgggatgcaatacaaaaaacaacctttgccagtaccaggtttcctacggagacggttctttcactgtcggagatttctcaatagaaactctcacgttccgacgcgccgaagtcccgcgcgtggccctcggatgcggtcacgacaacgagggacttttcgtgggcgccgcaggtttgttgggcctaggtcgcggcgggttgtcgtttcctacccagaccggaacccggttcaataacaaattctcttactgtttaacagaccgaaccgcttccgctaaaccgtcttccgttgtgttcggcgactcggctgtctctcgaaccgcccggttcactcctttggttaaaaaccctaagcttgatacgttttattatgttgagcttctcgggtttagtgttggcggcgcgccggttcgggggatttcggcttcactttttcggctcgactccaccgggaacgggggtgttataattgactcagggacttccgtcacgcgcctcacgcgccctggttatgtggcgttaagagacgcgtttcgggtcggggcttcacatttgaagcgcgcgtctgagttttcgctttttgacacgtgctatgatctttcggggctgtcggaggttaaggttccgaccgtggtactgcattttcggggtgctgacgtgtcactgccggcgtcgaattatctcattccggtggataatgacgggactttttgttttgcgttcgccggaacgatgagtgggttgtctattgttgggaacattcagcagcaagggtttcgggttgtgttcgatttggcgggttctcgggtcgggtttgccccgagagggtgcgcgtga

SEQ ID NO: 43948 - DNA, 807 bp, Glycine max
  Peptide Sequence Number=SeqID_160726
atgatacctctggagtttcttggacctgactctgacatctatccctggatgtcaattgctgcaggcagcaatgcttcccatcagaacaactcaaaagattgtattcagaacaacatcaaaggagataaaggcattctcttttccataacttgctggtttatctggaggtctaggaatgaagaaatttttaatgataaagttcaaccggtgtggcacattgctaaccagattcacactctcaacgacattatctataaggatgttactcaatcattgcaacagccttctcctatgctagtgctttggattgctcctcccggtaatgtcatgaagcttaatactgatgggagtgcttttggaaacctggggcaagcaggatttggcggaatcataagggataatcttgggaactggcacacaggtttcatgggatcctgtggctttacaacatcagttcatgcagagttactcgccatctatcatggtttgaagatagctagagacataggaattggaagattgatctgcgaatcagatttgaaggttgctttggacctaatcactggagaaatcaacatgtttcatcaatatttccccaccatcatgctgatccattcgttgaagcatatggattgggaggtgacctttgtgcacgtgtaccgtgaagggaataaatgtgcagattggtttgcaaagacgggaaactcttctcaacagggcatgattattcttgatcatcgtccctctcccatataccaagcttaccttggtgatgccatgggtgtcacaacccaaaggatgatttag

SEQ ID NO: 43949 - DNA, 3927 bp, Glycine max
  Peptide Sequence Number=SeqID_160727
atggaaattctcaacatttcaaaccccacaaacttttcaatccccactttctgccaccccaaaaccctcacttcaaaattcacctcaaacaacatcaaacccacatccccatttcgcagaacttcattttctctctacctatcacgctccgccgccataaagtttcaaacttgggcgcactccggccgacccagcaaccgccgcaactccctgaggaagaagctcctccgtgatcacaaggtaaaccctaatcagattcccaacgaccctttttctgtttcgggtaatggcgttgaggagagtggtgtaggtgttcagggtgtttctgttgttaacaatgtggtcgaagctgaaaaaccaaagtctaagattttgcgtgagtctgttttgtggaataagttggagaattgggttgaccagtacaagaaggatgttgagtattggggtgtagggtctggtcctatattcactgtttatgaagattccctcggagctgtcgaaagggtggttgttgatgaagaccagattctgaaacgaagcaaggttaggagagatgccgttgagaatttagctgaagttagaagtaaaattctgaatgctaagaacattgctagggagatggagagtgggaataatgtgattgctaggaatagttctgtggctaagtttgtggttgaagggaaggaggagggtggtggttttgttaaggctgttcaaggttttgttgcaaagccgagattgcttccgaggctttcctgggttgggaggaaagtgttgtatgtgttggttgttgtgtgggtggtgaagaaattatttgttgcttttggagaaagagataaggaggtggagtatacggcaacggagaaggaaatgatgaggagaaagataaaagcaagagaggagaaagagaagctgacgaagcgcgctgttgaagttgttgttgaatcttcggaggcaccggtggtggacattaagaagcctaagttagataaagaacaacttaggaatagtattctgaaagttactggttctgctgataaattggtagtgcatgattcgtctgataaagtgaaaactagatccacagagatggattataaagttcaagaaataagagaaatggctaggcaggcacggaaaattgagggaagcaatggtgttgtaggtaacagggatatggaaacggatgaccctgtgattgagatatcatctgatgatagtgaacaatatgatggtttaagtaatcatcaaaatgaagtttcaaaggaaacaacagatagtaataccattatgcaatcagtttctgttgatgtcccagagagcattgataattcagtcctgcatgaggaagtccccacacataaaggcaatttatatgctttggatgccatagttcctggtgatagggagatcaagaaacaagaaatagaattttctgaaaatgatgtgcacctgaaggacagtgaaaatggaaagccctcagatactcctattaatggctcatctatgacaaatgaaagttctgtgaagaagaaacctaggatcatacggtctgttaaggaagctagggattatctttcgaaaaaacatgacaaacaagatcctggcactagcacggaatgtaaaattgaactcgcgaaagaaaatattgctgatatgaaatcttcaagtgttattgatttaaatggccagaagtaccagaatttggagaagaatacaattgtgtctaaaagtgacacattaaatggaatattggattctaagcctctcataaattctagcgatgattctgatcagaaggataaggaagttagcccaagaaagaatgaatacatcaaaggttctggtattgaacctggattggaagagcttcaaaaggatgagaccactttagaccaagaagtcagtggcattagtacagagacaaggctacctgtaaagccagaaaattggctggagataaaactccacaaagttgagcccataattgagcaaattagaagtgatgctttagatggagtatcagattctaaggctgccacaagtcctagtgaagattctaatcagaaggataaggaatttagcccaacaaaggatgactacttcaaagactctggtgttgaacctggcctaggaaaccttcaagagtctgacaccactttagaccatgaaattaatggcattggtacagagacacggctgcctgtaaagccagaaaattggccagacaaaagcctcattgaagttgagcatagcaggagtgatgctttaaatggattatcagattctaagtctgccacaaatgccagggaagattccaatcagaagaataagaaatttggcactacaaaggatgactacctcaaagatgctggtgttgaacctggaataagaaaccatcaaaagtcaggcaccactttagacagtgaagttaatggcattagtacagagacaaggggctctggaaagacagaaaactggctggagaaaaacttccatgaagttgagcctatagttaagcaaattagagcaggatttagaaataactacatggctgcaaaagagagagtcaatcaaactttagatataccaactgagatggaatcacttgggggtgttgaagatgatggagaacttgactggatgcaggatgatcatcttagagatattgtctttcgagtccgtgagaatgagctgtctggacgggacccattttatttgatgaatgatgaagataaggacacattttttagaggtcttgagaaaaaagtggagaaagagaataaaaaactttctgacatacatgaatggctccattcaaatattgaaaatcttgattacggagcagatggcattagtatatatgacccaccggagaaaatcataccacgctggaaagggcctcctgtggagaaaattcccgagtttctcaatgaatttctcgatgaaaaaaagacaagttccaccagaaatatgaacccagtgaagaaggatgagagtggctttgctataacatcagctgattcctctttacaagaaaaggttgatggctctacagcacctattaagaagtcgaaaaatccaaagactattattgaaggaagtgatggttcaattaaagttggcaaaaaatcaggtaaggaatattggcagcacacaaagaaatggtcccaaggttttttggactgttacaatgatgagacagacccagaagtaaagtccataatgaaggatatggggaagggtttggatcgatggatcactgaaaaagaaatagaggaagcagctgaactaatggacaaactacctgataggaataggagtttcatggaaaagaaactcaacaagattaaaagagagatggagttgtttggaccgcaagcagtggttagcaaatatcgtgaatatgcagacgacaaagaggaagattacttatggtggttagatctttcacacgtactgtgcattgaattgtacacagttgagaatggagagcagaaagtaggactttattcattggagatggcttcagatcttgaattggaacctaagccatatcatgtgattgctttccaagatcccaatgactgcaaaaacctttgttacataattcaggctcatatggaaatgctgggaaatggtcatgcctttgttgttgcacggcctcctaaggatgcttttcgagaagctaaagcaaatgggtttggtgttacggtcatcaagaaaggtgaacttcagctcaatatagaccaaccactagaagaagtagaggaacaaatttcagagattggcagcaaaatgtatcatgatatgatgatgaaggagcggtctgtggatataaacacattaatgaaaggtgtatttggttttagtgaccggtccatcaagaggttaaagaggaagttgaagaaacccagaaagggatga

SEQ ID NO: 43950 - DNA, 1779 bp, Glycine max
  Peptide Sequence Number=SeqID_160728
atggaaggtgtggaaagctctggaaaatcttcagtgttagagagtgttgtcgggaaggactttttacctcgtggatctgggattgttacttggcgtcctcttgttttgcaacttcataagattgacgaagggagagaatatgctgaatttatgcaccttccaaggaagaaatttcttgattttgctgctgttaggcaggagatcgctgatgagactgatagagaaacaggtcacaacaagggtatttcatctgtgcccatccatctgagtatctactcccctcatgttgtcaatctgactctggttgatcttccggggcttactaaagtcgctgttgatggtcaaccagatagctttgtgcaagacattgaaaatatggttcgggcctttattgagaagcctaattgcataattttggcaatttctcctgccaatcaagaccttgctacctcggatgcaattaagatttcccgtgaagcagatcctaaagctgaagctgaaagtaaggaagatgctgaaaatacagaacctagaagttttttgttcagaaatgtatcaagggaaaggacatttggagttttgacaaagattgatcttatggacaagggtactgatgcagctgagatccttgaagggaaatcatataagctaagtttcccttggattggtgttgtcaaccgctcccaagctgatatcaataaacaagttgatatgattgctgctcggaaaagagagaccgagtatttttctaatacacccgaatatagacatcttgcttccagaatgggctctgtgcatccaggaaaggtgctatctaagcatttagaatctgtcatcaagtcttggatcccaggcctacaatcactcattaacaagactatcattgaactggagacagaattgaaacgtattgggaaacctattgctgctgatactggagggaagttgtacatgataatggaaatctgtcaaacttttgatcagttatttaaagatcatcttgatggcatacggccaggtggtgagaaaatttaccaagtatttgataatcaatttccagcatctataaaacggctgcagtttgacaaacatttatcaatcggcaaggtgcggaaactaataactgaagcagatgggtatcaacctcatgtaatcgctcctgagcaaggatacggccgtcttattgaatcatgcttagtatcaattaggggccctgctgaagcagctgttgatgcggttcatggaattttgaaagatttgattctgaaatcaatgagtgagacaatggcaagaattaaagcagtatcccaccttgagtgtagaacttggagtgcagctgttgattcattggagaggatgagagaagaaagtaagaaatcaactttgcttttggtggacatggagtatggctatttgactattgattttttccgcaaacttccccaagacgcagagaagggtggaaatccaactcattcactttttgacagatatgatgattcttatcttcgtcgaattgctaccactgtcttgtcctatgtgaacatggtatgtgggaccctgaggcataccattcccaagtctgtggtttactgtcaagtgcgtgaggctaagcgcagcttacaggatcatttctttacagaattggggaagaaggagggaaaacaactagcttcactgctgaatgaggaccctgcaatcatgcagccccgcacctcccttgcaaagaggctaaagctatacagaagtgcacaatcagaaattgaggcagttgcatag

SEQ ID NO: 43951 - DNA, 1773 bp, Glycine max
  Peptide Sequence Number=SeqID_160729
atgtcgtctgctggtgtcaccactcttagccctgttccaagggaactattgttgtccccagatggatactataccccattgcacttgtcattggatcaagagtttattttcatatatctgtcctattatggatctttgactccaatgcgggttcttccctgcgataccatcgagtctgtgaaactcaaaatccagaagtctgaggggcttccttcattgacaaacaaacaaaagttggtttgcgatgggcgggagctagcgcggagcaattccctgctgaaagaatatggggttacggaaggaaatgttttgcatttggttattaggctgtcggatctccagaccatcagtgtgagaacttcttccgggaaggacttcacttttcaggtggagagatgcagagatgtcgggtatgttaagcaacagattgcgaagaaggagaagcgctttgctgatcctgaacagcaggaagttgtgtgtaacggggagctgcttgaggatcagacgcttattgatggtatctgcagtaaatataacgatgcagtgattcatctttttgttagggtgaaatatgcagaagttaggacgggacaagatgagttgtccgttgtggcaaaggagttgaaagatacaaaagattatgatgttagtgaaactaattgtaggaaaaaatatgatgttagtaaagaagatacaggaagggagtatggagtcgttgagccaattgtgccgaggaaggctattgatagggatcttcttttggagccggttattgttaacaaaaaaattgaattagcttctgaggtttggaatatgataaactctacatatgaagggctagacagtggaaattatccaatcagatctgcagagggtacagggggtgcttactttatgcttgattcaaccgggcaaaagtacatatctgtttttaagcccattgatgaagagccaatggctgtgaataaccctagaggtttacctttctctgaagatggtgaaggcttaaagaagggtacaacagttggtcagggagcattcagggaagttgcagcttatattttggatcatccaatgagtggccgccgatcattatttggtgatgagaagggatttgctggggttcccccgactgttatggttaagtgcttgcataaaggatttaaccatcctggagacttgactgctaagattggctccttgcaaatgttcatggagaataatggaagctgcgaggatatcggacctggggctttcccagtgaaggaagtgcataaaatttcagtactggacatgcgactcgcaaacgcagatagacatgctgggaatattttgattggcaaagagaaggaaaatgaccaggctgttttgattccaattgatcatggatactgcttgcccacaagttttgaggattgtacctttgaatggctttattggcctcaagctcgccagccatactctccagagatcattgactatataaagtcactggatgctgatgaagatattgcccttttgaagtttcatggatggaatcttccagttgaatgcgcccgcactcttcaaatctcaaccatgcttctgaagaaaggagtggagagggggatgaccccctttgccattggaagtcttatgtgcagggaatccttgaacaaggagtctgtgattgagggaattgtaaaggcagctctggattctgttcttcctggcacaagtgaagccacgtttctggatgctgtttctgaaatcatggaccagcaccttgattag

SEQ ID NO: 43952 - DNA, 1833 bp, Glycine max
  Peptide Sequence Number=SeqID_160730
atggcagaaaaggatatcccaaaaatagtctttcgaactcatcagggatattatgagtatcgagtcatgcctttcggcctgtgcaacatgccgtcgacgtttcaggtagccatgaacgccctgctaagtccgttcttgtggaaattcacaacaatttttttttacgatatactcgtctacaatgcaactcttcccgatcaccttcaccacttggaatgtgtctttagttctttatcccaagctcagtatttcctcaagcgttccaaatgcttgttcgagcaacgtcagcttgattacttaggtcacatcgtctccggcaagggtgtgcaaccggacctttccaagattcaggccattatcgactggcccacccttcgctcttcgaaggatcttcgtgctttccttgacctcaccgggttctacaggaaatttgtaaaaggctatgcagccattgcaacaccattaacaaagctactttctacgctatgggcgttgtcctacatcaatgagcatgcatccgcatatgtctgcgagttacaagccatcgtcgtcgccgtccgcaaatggcggcagtatttgctgggtcacagattcattactttcacaaatcatcgtagtctccatgagcttatgtctcaaactatcaagaccccgaagcagcagttttaccttgccaagctacttgggtttgattatgacattcaatataaagcgagaacctcgaacgtagttgctgactctctttcgcgcatagatagctcgactcaaggacagtacttcgttctgtccattcctcaccacgagttcatgattcaactaagggaaaccttatcagctagctcggagttccagaaacaatgcgaggccatacaagctaagcctgaagatcatcatgatttttttatcttaggcgattttatcctcttcaagggtgctatttggattgatactcaaaacccattcattctcgtgctgctacatgagtatcatgctgctcctattggcggccattttggcgtaaagagacgttacatcgcctccgttccaacttccaatgggccagcatgctcaaggacatcaaggcattcgtccgtaactgcagtacatgtcaacaagttaaacatatcacgcgcaaaagtgttggactgctccaacctattccgatacccaccggcatctgggaagacctctccatggatttcgtcacacaccttccgagttcccacgggttcacagttgttttcgtggtcgttgataggttctccaagggagttcaccttggtgccttacctactcactttacggcgttcaagcacgggttttactccttacaaggttacttacgacaagcctcctccctcagttcccgattacctcaaaggctcttcccccaatgacgcagttgacacaatgctactcacacgagaagccattcatgcaactctcaagagaaagcttctcaagactcatcaccaaataagcttgctaagcgctatttcgggccatttcgcatcatggaacgcattggtagtgttgcgtattgattacaaatccctgacgagtccaagatacaccccgtctttcattgttccatgttacgccctcaccatggagtctacttgggagaagtgggaagacatttgtaaatcccatcaccttgaggacaaggtgatttttccagggcgggataatgatagcaccaacagtagagagaacagggaagatatcttgttagtgccagaagaagcacgcgctattgtggttgcaatgcagtcacagaaagttcaaaaccttgacgttgctgttgaaatcaccgttgtggactatttgtaa

SEQ ID NO: 43953 - DNA, 178 bp, Glycine max
  Peptide Sequence Number=SeqID_160731
attatttgggatggctagcatgtttgatatgccttttagaggcttgaaaagtgaagaaaaagaactgcgttttttgcatttttctggaaaatgcgatgaactcgctaagcgagcatgctgcgctaagcaagttcatcagtattcattgaatatacgcgttctcggaagaactcgctaa

SEQ ID NO: 43954 - DNA, 3611 bp, Glycine max
  Peptide Sequence Number=SeqID_160732
aagctgagaatgagcttgttctgaaagggatgctatctgatgaagcttttacccgattaaaagaatcgggaactggacttcactgcaagtctatgcatgatttgattgagttatctcgaaaatattacacagacgttgctctcccaaaattggtagccgattttggctcattggaactctcaccagttgatggacgcactctaactgattttatgcatactcggggtctacgaatgcattctcttggacatgttgtcaagctttcagaaaagctttcacatgtccaatcactttgtattcatgagatgatagttcgagcttttaagcacatcctgcgggcagtaatttctgctgttgacaaggagaaaatggcttcatcaattgctggtgcattgaatttgctgcttggtgttcctgaaaatagagaatcagataaatcacgtgaagttcacccattggtgtggaaatggctagagttgtttttgaagaagcgatttgattgggatcttaacaagttgaattacaaggacgtgaaaaaatttgcaattttacgtggcttgtgtcacaaggtgggaattgagcttgttccaagggattttgatatggattccccaattccctttcaaaaatctgatattgtcagcttggtccctgttcacaagcaagcagcatgctcatctgcagatggaaggcagctcctagagtcatccaaaactgctttagacaagggaaagcttgaggatgcagttacctatggcacaaaggctcttgctaagctggtagcagtttgtggtccctatcatcggatgacagcgggagcctacagcctccttgctgtagttttatatcatactggagacttcaatcaggctaccatttatcaacaaaaagctttggatatcaacgagagggagttaggtctggatcatcctgataccatgaagagctatggggatcttgctgttttctattacagacttcaacacacagagctggctctgaagtatgtgaagcgtgctttatatcttctgcatctaacatgtggcccatctcatccaaacactgctgctacttacattaatgtggctatgatggaagaaggtctgggaaatgtacatgttgctctccgatatcttcacaaagctttaaagtgcaaccaaagattacttggtgcagatcatattcagacagctgcaagttatcatgcaatagcaatagcactctcattgatggaagcatatccattgagtgtccagcatgagcaaacaactttgcaaattctgcgggcaaaacttggctccgatgacttgcgcacacaggatgctgcggcttggcttgagtattttgaatccaaggcttttgaacagcaagaagctgctcgaaatggtactcgaaaacctgatgcatcaatagccagcaaaggccatcttagtgtgtcagatttgcttgactacattaatcctaatactaaagggagagatgcagcagcaaagagaagaagccagataacaaaggtgagagcaacatcttaccagaatactggcatgtcaagttctgatgaatcttcaaaagaaattccaaaagaggcttcagatgaagaggtacaaatatccgaaccagtaggtagtgcagattctgagcaggagagcaactctggacctgatttggaacaagctattttaaagcaaatatcggatgaaaagctacaaatttatgatgaaatcttctctgaagcacatgctgaaggagaggatggatggcaatcagttcaaagaccaagatcagctggctcatatggccggagactgaagcagagacgggcagcacttggcaaagtttatagttatcacaagaatgtggaagttggcacagaatctccttttgtaaggagtcctaatccgaatagtaggtattatttcttgaagaaacgaacaatttcccatgggagttatacagatgatcatactacaaacatcacccaaggcaataaatttggaaggaaagtagtcaaagctgttacatacagggtcaagtccatgccctcaacttcaaagccttgtgcaaatgagacattagaaaatggggataagctgctcagttctcttccagaacctgatccaattgatgctaatccagttaagaattctaaagttagtctcggaaagtctccttcatacaaggaagtggccttagctcctcctgggacaatctccaagtttcaggtctataatcctcaaagtgagatttctgttagcagtgaacatgatagtggaaaacacgaagaggaagttgaagctaatagaaatgttgatgttgatccaaccctgatagaggtaaatgatacagttaaagagaagaataatgattctttatcagattctgtagatgattcactggatgatactggagtggctattgaggggaaagaagaaactgagttgattgttgctgtgcaagataattgtatgagtgctgaggggcaatcgggagatgttaaggctcaaggagcagttgatagcagcatattgattcatgcagtagatgatcatgtggattcttacaagcaagaacttgatacaagtaattcatctggcagtttagaacctagtgccaatacaaatcccatttctcagggtggtgaggatttaagggtcaatgtatcaccatcaagtcagattcgtaccgggggcatcccatataagaaattgtctgcatctgcagctccattcaacccatcacctgccattgcacgtgctgcaccaattgccatgaatatgactcttccttctggtcctagagcagttcctgcaattggcccctggccagtaaacatgaatgttcatcctggacctactactgtgctacccgcagttgccccaatgtgctcctctccacaccatgcatatccatcacctccaacaacaccaaacatgatgcaaccactgccatttatgtatcctccttttactcaacctcaatcagtatcgcctagcaactttccagtcactaacagtgcctttcatgccaatcacttcacatatttgaaccccacaatatctaagtttggtcccagtgctgtttggcctggttgtcatcctgtagaatttcctcttccagtacctattgttgaaccaatccctgatcccatttcagagtcacaagctctgtgtcatggtttggaaagtccaagttcggcttcagttcttcctgaggacattgataatattggggattccaatcaagtggtaaaaactttatcatcagagataagtgaagatgaagcagtgagatctggttcagaaagtataaaagaaaatggtaatatgaattttcacgggtctgaaaatgctgggaacaagcaacatcaaaacattgcttcaaatggcaactctagcagtagtggaactaacatggatggtgagaaaacctttagcattttgtttcggggaagaagaaatcgaaagcagactctgagaatgccaataagtttgcttactcgacctaatggctcacagtcatttaaggttatttataaccgtgtggttagaggaagtcatgctcccaagtctatgaatttgtcttcaagtaaggattgtacagctacttcataa

SEQ ID NO: 43955 - DNA, 681 bp, Glycine max
  Peptide Sequence Number=SeqID_160733
atgaaatgtaacaatcacaaaagacaatacggcacatggagaattcaaaatccaggaagcaatgaatttttatcagcattagcagcaggaatgaaagcaaaactcatagtggaagtgacgtcctgcgtatcgctaaccaccttagcccttgcagctgctgcaagaccaaccggaggcagagtggtgtgtattctacccgagtcaatccttaatgattcacaacaagttatcaacaactcagggcttaaagaccaagttgaatttagaactgaagacccctccaagctactacccttctatgagaacattgatttctttcttgttgattgcaaggataatgaaaactatgcaaggttgctcaacttggtagatgttaacctcacaagatcaatagtggtcgcaaagaacatggttggtggtgatggtgacaaaaaaggaataagatggtgcctaagaggaaaggatgagaaattagaagtaagatctctaaagcatcctttagggaatggcatggaagttactaggattagcaagagtgataacactaataatatgagatttggtgttaaaggagattatagcaagaaaaggagaaagagctcatggattgccaaatttgatgaggagagtggtgaggaacatatatacagggtgcctcaggttgattggttctggagttaa

SEQ ID NO: 43956 - DNA, 243 bp, Glycine max
  Peptide Sequence Number=SeqID_160734
atggagaaccaaagcttgtgccggccaacgagaagactgttgggaagaagaccaacaaagaacacgaactgcgggagggagaagactgctgggaagaacaacaatgaagaagaaggagcgcggaagggagggagaagactgttgggtgcacagaagaagaaggagcgcggaagaagaaacggaatttttggaagttcattgaattgctgggtgcacctagcaacacccaagagtgggtattaa

SEQ ID NO: 43957 - DNA, 242 bp, Glycine max
  Peptide Sequence Number=SeqID_160735
atgaaagatggcagaaatacaagtagtggggatgtctcctccccctctaggacctcacaaactcatctcaagctctcaggacgacttcctcttcaatctctggtctctgcagatcttcacacaacaaaatctctcaaactctatagaacttggacctttctctctgtagaactctctagacatgtagaagcttcaagaaaaggccaaactcgcttccaaaatctgatttcaggcttaaattg

SEQ ID NO: 43958 - DNA, 114 bp, Glycine max
  Peptide Sequence Number=SeqID_160736
atgcatcctgcggaagaagtttggcaggttattccacgagcagaaaatgcactctgcggaagaaggtgttcttccgcgagtgtgaaaggacgaaaatggagccagcggaagaag

SEQ ID NO: 43959 - DNA, 1836 bp, Glycine max
  Peptide Sequence Number=SeqID_160737
atggccaaggaagcttctctgtgcctcttgtttctcttctcctttctcagtacctcctgttctggatctctggtgggtttttcctaccgtgagagaggagacacttcaacatctgctagaaccatatcattcctccagcaaagcaacgtttcgccaactcagattcgaatttttgtcacagatcataggattttgagcactctcagcaactccaaagtgctaactgatgtctacttgaacaaaagtcaagttgaaaatttcattatttcaaaaccctctgaactaaaagctcatctacttaacattctctcacattcaaacatcaagagcatcattgctagctgtggcagtgagtgcttagcacaaaatgaaatgcctttgttcttacatgctttgaaatcaattggttcagttctcagagagcttcacttaggaagggaggtaaaaatctcagtagcatatccactttcattcttagaaaagttgaatgcatcgcatgaaaacagtattcgtaggattctttcatttataaaggaaacgaaatcctttgtcatggtagaagacagcattggtggagaattaagcatgggggatcactttgttcatgctatcatcaaacgagccactcttgctgcttccattcttccttgcaaggatgttcccattgttctgacaataaaaagcacagttatcctcccttcaatggaattagctcaattcagtgagaagatatccaaatatctagaatccgaaactcatattagaaaaagaatagctgcattatatatagaggtgcattcagcaaaagattttgctagcaaaaaactcaaaaggagaagtctagatgatacaaccaacccaacaaacacagttttccccacaaatccagcatcatccacaccaatcattacaccaccagatacaccaacaatcataacagttcctgccacaaatcctgtcacaatttccccttccaatcctgctgcaatgcctgtgacagttccttctaccacaccagtgcctaatcctataacccccacaaatccagccaattcaccagtacctgtgagcaatccagctacgactcctatagcgacaccaccgccagtaaccaaccctgtgacatcttatccacctccatcaggaaatgttcctcccgtcgtaaacccgcaaccacaaccacctcctgcaaacactaatgctcctgccattcaggggcagagttggtgtgttgcaaagcagggagctcctgaagcttctcttcaatcagcacttgactatgcttgtggaatgggtggtgctgattgttctcaaatccagcagggtgggaattgctacagtccagttactttgcagaaccatgcttctgttgccttcaacagctactaccagaagaatccagctccaacaagctgtgactttggagggactgctactttagttaacacaaatccaagcacgggttcatgcattttcccatcatcttcatcgtcatcatcaacaacaacaatgccaaagtcatcacccccgacaccacctacacaatcaagtccaatagcactaccaccaccaagtccattaacacctgaaccatcaattccaacagcaccaccaacatcttcatcttcaggaacaggccctttcgggtatggtgccccaccttcagagttaaattcaagcaatccagcgtcaggtataatgccaggttttgcttctgatagccctcctgttgtaaataccacttcggtgtcgcgttctgtgggtttgagaccttttgttggcttcactattctgatggtatcatttggcactacgagactcagtatgcacccatag

SEQ ID NO: 43960 - DNA, 339 bp, Glycine max
  Peptide Sequence Number=SeqID_160738
atggatggaggagggataaaagaggatttgctagggacacccaacagcattgctggtgcacccagcaaatttccaaaatggcaaaaatgcccttcagccttttgcgaactttcttccgttgacactcgcggaagaaatgttccgcgagcatctgcgaaagaaccttcttccgcagttgacggaagaaggttcttccgtggatgcccgtggaacatttcttccgcgagtgtcaatggaagaagaactgcggaagaaccatcttccgtagaactacgcggaagaacttcttctgccagagtcaacggaagaaggttcttccgtgagttaccacgaaagaag

SEQ ID NO: 43961 - DNA, 4236 bp, Glycine max
  Peptide Sequence Number=SeqID_160739
atggttttcgctgtatccactgttctatcctgtgctgttatttctgttatgaacatggctctagccttttaccaatacagctctaggaaaataattggatttaactctgtttcattggctctaacttgggttttggccactatagtttcgttttattcaatgaggactaaagtgagggagaacaagaggttcgggttccctcttgttctgatcctatggtgggtttttgcttgtagcatagatgcaatcttactgtctttgaagctggtaaaaggttttgaatcaatcgacttgtggtttttcttgtcagaggataacgtagtagattcggtttccttgcctttgttggtacttctttgtttcaatgtgtgtgcaagggaaaacagtgatgtggaacaagaacaacaactcttactagaaaaagaggaggaatcttctatggaggaggaagatgaagaggcttttacgaatgcaagcatgtggagcaaacttgcatttcgatggttgaatcccatttttaaagccggtcggattaaaaagcttgaacttggtcatattcctcctgttcctccttctgaaacggcagaaaatgcttcttccgtgttggaagaatcacttcgcaaacagaaacttgaagggggttccttgacaaaagctattgcctattctctatggaagtctttggccttaaacgcagttttagctggtgttaacacaggtgcctcctatataggtcccttgttgatcacaaattttgtgaattttttattgggggatgatggtgattcaagcatccaatatggattgcttcttgcatttattttcttccttgcaaagactgtggagtcactgagtcaaagacaatggtacttcggtgctcaacgaattggaatccgggtgcgtgctgctctcatatctctaatttatgggaagtccctattgatgaagtgtgctggaccaacacaaggtagaatcataaacttgatcaatgtggatgttgaaagaattggggacttctgctggtacattcatggagtttggttgcttccagttcagatcattttggccttggtaatcttatacataaatctgggtggtactccttcttttgctgcatttggtgtcaccatattggtcatggtgtgtaacacacctttggccaataagcaagaaggtttgcactccaagatcatggaagctaaggattcaagaattaaagtgacatcagagaccatgaagaacatcagaattttaaaattacattcatgggaaacttcattcttgcagaaacttctccaacttagggaaattgagaggggatggctacagaaatacctctatacatgctcagcagtagccacactattctggacatctccaactttagtttctgttgtcacctttggtgcttgtatactggtgaaaacagaactaacaacagctacagtcctctcagctttagcgacttttcgtattttgcaagaaccaatctacaacttgccagagcttatctccatgatcattcaaacaaaagtctctgttgatcgaatccacgagttcatcaaggaagacgatcaaaaccaattcataaacaagcttacttcaaagatttcagaagtggctattgaaattaagccaggcgaatatgcatgggaaacaaatgatcaaactcacacgaaaccagcaattcaaattacaggaaagttagtgataaagaaaggtcagaaggtagcagtttgtgggtcagtggggtctggcaaatcaagtttgctctgctgtttgcttggggaaattccattagtttctggggcagtaaccaaagtctacgggactagaagttatgtaccccaaagtccatggattcagtctggaactgtaagagagaacatattgtttggcaagcaaatgaaaaaggaattttatgaagatgttttggatggttgtgctttgcaccaggacatcaacatgtggggtgatggagatttgaacctggtggaggagagaggcataaacttgagtggtgggcagaaacagcggattcaattggcaagggctgtttacaatgattctgatatttatttcctggatgatccttttagtgctgttgatgctcataccggaactcatttgtttaagaaatgtctcatgaaacttctatatgataaaacggttgtttatgctacccatcaactggaattcttggaagctgcagacctcattttggtaatgaaagatggaaaaatagtggagtcaggaagctataaagaacttatagcatgtcccaactctgaacttgttcaacaaatggctgctcacgaagaaacagtacacgaaataaatccatgccaagaagatgattctgttagctgcagaccctgccaaaaaaatcaaatggaagttgctgaagaaaatattcaagagatcatggaggattgggggagaagtaaagaagaggaagcagagacgggtagagtgaaatggagtgtttactcaacatttgtcacatctgcttataaaggagcacttgttccggttattcttctctgccaaattctctttcaagttatgcagatgggaagcaattattggatttcatgggctacagagcagaaaggcagggtcaacaacaaacagcttatgcgaacatttgttcttctatctttaaccggcaccatcttcatactgggaaggactgttttaatggcagctgttgctgtggaaactgctcaacgcctttttcttggaatgatcacatcagttttcagggcacctgtttcattttttgtcaccacaccttcaagcagaattatgagtaggtcatcaacggatcaaagtatcgtagacacagacataccatacagattagctggactagtatttgcacttatccagttattgagtatcattgtgctaatgtcccaagttgcatggcaagtcattctcctcttttttgcggtgcttccaatttccatttggtatcaggcttattacatcacaacagccagggaattagccaggatggttgggattcgaaaggcaccaatcttgcaccacttctcagaatcaattgctggggctgccacaatccgctgtttcaatcaagagaaactattcttcaccaaggttaaggctctaattgacgattattctcgggtagcctttcacaattttggcaccatggaatggttgtctgtccgaatcaatttcctcttcaatttggtcttctattttgtacttgtcatcttggtgactcttccaaggtctaccattgatccaagcttggcgggtctggtagctacttatggtttgaacttgaatgtccttcaggcttgggtgatatggaatctttgcaatgttgagaacaaaatgatatcagttgagagaatattgcagttctctagcataccaagtgaagcgccattgattattcaagattgcagacctgaaccagagtggccaaaggagggaaaagttgaactacgtaaccttcatatacggtatgatcctgctgctcctatggtcctcaaatgtgtcacttgtgtctttccagcacaaaagaaaattggtgtagtaggcaggaccgggagtggaaaatctactctggtgcaagccctctttcgagtggtggagcctttggaaggatctatacttattgatggtgtagatatttccaagattggtctgcaagatttaagatctaagcttggcataattcctcaggatccaaccttgtttctaggtactgtaaggactaacttggatccactagaacaacacgaagatcaagaactctgggaggttctcagcaagtgccatcttgctgaaatagtaaggcgggatcaaagacttcttgatgcaccagtggccgagaatggagagaattggagtgttggacaaaggcagcttgtttgccttgctaggctactactgaagaaaagaagaattttggtcctagatgaggcaactgcatccattgacactgccactgacaatttaattcagaagacaattagggaagaaacaagtggatgtacagtcattacggtagcacatagaattcctacagttattgataatgatcgggttttggtccttgatgaagggacaattgtagagtatgatgaaccggctcaattgctgcagaacaattcttcttcattctcaaagggagatataacatgggttggatggttgacgaaagagacaaaaggttgtgggttcgatcctccctcctaa

SEQ ID NO: 43962 - DNA, 1143 bp, Glycine max
  Peptide Sequence Number=SeqID_160740
atgtctgagaaaccatcttcatcgttgacatctaccgtagctgctcgagaagttgatcccttgttgcaggatttgaatgaaaaaaagcagagctttaggcgcaacgtggtgtcgttagcggtggagttgaaggagctacgtagtcgcctagcttcgcaggaacaatcgtatgctaaggaaactcaaaccagacaggcacgagatttcttggaagcagagacaaatgccaagaacatggaattgcaaattggaaggttgcagaagaatttggaagaaagaaatgagcagcttcaggcgtcagcctcctctgctgagaagtatctgaaggagttggatgatcttagaacacagcttgtaacaacaagagcaactgctgatgcaagtgctgcatcagctcaatcagctcagctccaatgtttagaacttgtaaaagaattaaatgagaaaaatggttcactaagagagcatgaggatcgtgtcctgaggctaggggagcaactagacaatttacagaaggatcttcaggcaagggaatcttcacagaaacaattgaaagatgaagttttgaggattgagcacgatattatggaggctcttgcaaaagccggagagaacaagaattgtgaactgcggaaaatattggatgaggtttctcctaaaaattttgagaagatgaataagattctaggtgttaaggatgatgaaatagcaaaacttaaggatgaaattaagatcatgtctgctcactggaagctcaagactaaggaattagagtcacagttggagaaacagcggcgtgctgatcaagagctgaagaagaaagtgttgaagttagaattctgtctgcaggaagctcgttctcagacacgaaaactgcaaaggatgggtgaacgacgggacaaagctatcaaagaactgagagatcaattagctgcaaagcaacaaagagaagttgcagccgcagataagctaaaccagaatttctgggacacttctggattcaaaatggtggtctcgatgtccatgttgatcttggtggtgttgccctgctggcaaatgtcttatgtctactctggtttggatattataaaagtggctcacatgcgtcggattaaagtcaatgcgtttggaggatttgcctga

SEQ ID NO: 43963 - DNA, 261 bp, Glycine max
  Peptide Sequence Number=SeqID_160741
atgcacaccgatggctctgctagaggttgctcgggtcatagaggtgctggtggcattttttgcgatcactctagaggtgttttgggttgcttctcctcttatgttgggactcaatttatgttgtatgctgaggttgtggcggttatccttgcgttggatattgtgaaggagaaagcttggtctcatgcttggcttgagtgtgaatccaccttaatcatccaacattttaagaacccgtcgcatatcccttggagcatttga

SEQ ID NO: 43964 - DNA, 468 bp, Glycine max
  Peptide Sequence Number=SeqID_160742
atggcacaggcactggtttctgacacatataataagccatccactacattattgggagctcgcgaattgaaattctatcctaatggagacaacacattctggcttgatcctagagctcttatcggaggagcgggagggccaagcaatgctggcgacggtgctggtacagtgtgcttcttactcttcttcgatttgggagcgggagcgggaacctcagcgcttggtgctatcacgggtgtcggagttgtcggtgccaatatacggggagagcttaccggaacaggcgctggtgtcacagcaggagatgtggccaccggaggagtggttactggagctggagcagcaactttagacgaaggagatgctaccgtgggagacaaaacaggaggggttatagttgcagcattgggggatgaagctggtgaagatgaagtgggagaagctataggacaattgattttggtttaa

SEQ ID NO: 43965 - DNA, 351 bp, Glycine max
  Peptide Sequence Number=SeqID_160743
atggcaccagaggacatggagaagacaaccttggtcaccctttggggaacgttctactacaaagtaatgttctttgggcttaagaacgttggggcaacctaccaacgggctatggtatcattgttcaatgacatgatgcacaaagaaatagaggtctacgtggatgatatgattgccaaatcgaggaccgaggaggaacaccttgtcaacttacaaaagttgttcgagaggctacataaggtcaagtcaggaaagttgcttggctttattgtaagccagaaagggatacaagtggacccatacaaggtgaaagccatcctcgaaatgcccgagccacgcactgagaagtag

SEQ ID NO: 43966 - DNA, 171 bp, Glycine max
  Peptide Sequence Number=SeqID_160744
atgagcatgcaagacatcatcaaaatgaaggaggtcttacttaggacaatactttcaacaataacatttttggaacataaaaatactataggagcaaagatggacaagcctccaaagtcggatggagaggatatagagcaaggcaaagatacggagaatatactcctctga

SEQ ID NO: 43967 - DNA, 120 bp, Glycine max
  Peptide Sequence Number=SeqID_160745
atggcactcaaatttatctatcttgcgtggcaaattctacatgcaaaggcctgtcagaccctaactaagggtttagcctctcatagtcataaggggccttacactagaaaaggagcatag

SEQ ID NO: 43968 - DNA, 372 bp, Glycine max
  Peptide Sequence Number=SeqID_160746
atgcattctaaaacctcatcaatctcttccaattacccaatcatttctgccattgttgcttttgcaattgctcaatccatcaagttcttcaccacttggttgatatgcaagtttaaggaaagaagatggaatctgaagcaattagttgggtctggtggaatgccatcatctcattcagcaactgtcactgctcttgcagctgccattggattgcaggaaggctttggaggacctctttttgccactgccttggtgatgtatgatgctactggtctaagattgcaagcaggaccccaagcagaggtcattgtcggtgggatacttggacttttaacacctattggccttttaagacctgtgactaagaattga

SEQ ID NO: 43969 - DNA, 660 bp, Glycine max
  Peptide Sequence Number=SeqID_160747
atggtggccactgaaactgaaattgctaatgctgatagaaaggccattaatgattggcttcctgtcactgcctcccgaaatgccaaatggtggtactcagccttccacaacatcaccgccatggttggtgctggtgtcctcactcttccttatgccatgtctatgatgggttggtacggtccggggacagttatactactcttgtcatgggtgatcacgttgtttaccctatggcaaatggttgagatgcacgaaatgatacctgcatgttactcaaccattgcttgggtggcttccattggcaagggaaaactaccagatgtggactatagctacaaagcccacagcactgccgatggtgtattcaacttcatgttggccatgggagaggtggcattctcgtatgcaggtcacaatgtggttttggaaatccaagcaacaataccttctactcctgagaaaccttccaagaaagccatgtggaaaggagttatagttgcatatttaggagttgccttttgctatcttcctgtggccttcattggatattatatatttggcaactctgtcgacgataatatcctcatcacactagacacgcccgcttggctcattgctgcagctaacatgtttgttgttgtccatgttattggaggctag

SEQ ID NO: 43970 - DNA, 684 bp, Glycine max
  Peptide Sequence Number=SeqID_160748
atgacagcgcagggttgctattcccgaatcggagtagcacgaattacagaatcgatgataataaaaaaacaaagaaacctaagtcaaagcggtgcatgcgagaagaagaagagatggatacagaccggcggggacatggttgagggagatgccggtgctggagagggcatgctggacgacggcagtgatgcgagtggtgtcgccgtaggcggagatggaaacggggccgcagtagttcgtgcgaacgagggcggagcttatgttctgcgcgatggcgtggggatcgcatcctttcggcacgtgacagttctctatgtcccaccacaccgacgtcttcgccgtcgagtactgcgcctctgcctgcgccgtcgccgctccgcctcctccgcccatcttatctacaatttgatcaagtcaaagcgattcttaacttatcgttacggttattacaatagcaatagagtctgtggctgcctagggcttattaagaaggaaaggaaaggaactgtgtgtgatttgacgtgtttacccctcggattcggaatatggaacgaaggacgtgattggaaaaatgggaatagacttgactttttgtgcagtggacttgcccctgacggtaaggctctattcaatggacatgtgctgtgggaagctactcaagtagtcgacctattggacaagtaa

SEQ ID NO: 43971 - DNA, 687 bp, Glycine max
  Peptide Sequence Number=SeqID_160749
atgtctcctccgccattacttgctcagaaggtttctgctatagctgtaattctaaaaagatctgaaaacaagcatgggcaatatatttttgacattccaactgtggcaaatgacatgggggttacagcagtggaattaacaaatcagttatacgacctgaagttgatgggagaaataacttacgaaatgaaggacttggcctactgttataggatcattgaagtcccaacagacctgttatctctatcagcagataacacccgatggttatcagaagttgaaaattgtaaggtacgaaaaatggatgcaatgtttaatgctgcatattttgcattaaatctatgtgataatatgcaaggttgcggtggtgccaatcatacaccatgcttgcaaaggaaaatattggattacttttctggagttgataatgctgatttctgcaagaaaatcggtcaaagcagtcctttcctgcgggcagatctaaaggtctttctgcagagcaattcacatgctcgatttacaccaagagccgttgcgagggttttatatcattcattagaacaaagtgctaaacctgaacatttaatcatggattgcaggggaaggtatacgcatatagactttaaggaggtgatggaagcagcaaaggaagagcttaagaattttgttggaaaagatacactatag

SEQ ID NO: 43972 - DNA, 3501 bp, Glycine max
  Peptide Sequence Number=SeqID_160750
atgggctacccttttggccggtattggcaacggcataattgggatttgctactggcaaatgttcttgggtttcaggttgagggacaaggagtaatgaaacctgaggagaaagtttatggtgaaggaaaggtgttgaaggtttttgtctttggattgtatggagaacttgaggtgacacttcttgttggacactgcattggtcttgatagcggattgcccttgagagagaaagatgacgatcttgctttgttcagtgaaatgcagtccagagaagaagagagttttttgcttcagccatcggatgacttggaagactcattttcgtcaaagttgagagattttcctgatatcaagcttgggatatccattcccggtcgaggagaaaccagtgaattgcttaatacagatggtaacaagaatgactatgattggttattgacaccaccagacacaccactatttccttctttagatgacgaaccgccagaaataaatgttgtaagcagaggaaggccaagaagtaaacctatttccatatcaagatcatctacgacagagagaagttacaaaagcagtagggttagtgcaagtccaagtcgtttaagttcatcccctcattctgggaataatacattgcaatcgaggggaaggtcttcatcaacaccaaattctagtccaactcaagttttacgacatgctactccaacaagaagaccatctccacctccaactaagcccacgacacctgctcctagtccttccactcctactcctcggcgaatccgcactggctccagtagtcctgcattctcatcggggattaggagaacttcccctgttaagacaagccatggaaactctgcttcaccaaagataagaacatggcaaactaatattcctggtttctcttctgaagctcctctcaatctccgtacctctttggctgatcaaccagcatcatatgtgagagaccagtttagttcatgcagcaaaggttctattgtatcttctagtgatgatgatctggactctcttcagtccatcccagtgggtagtctagaccgatttggttcaagaagggatggttcattttccaacagcaaatctcattcaatttccaagaagtcagccaggatggtgtccccaagttctgctcctaaaagatcttttgattctgctatccggcaaatggatagaaaaagtcctcagaacatgttcaggccccttttatctagtgtgccaagtacaaccttatatgtcggaaaagcaaattctgtgcaacgttccctggtatctaggaattcctctgtcacaacaagcagcaatgtgagctctgatcatggtacaagttttgccccagatactgaagggagtgaccacaatcaagatgatgtggcacgtgcgactgagaagatattatacactgatatttgtgaagtatgttcctctgataaaattgatggattaaatacaagcattgggcatgagatcaatgatgaatcagctgacatcctgcacaccaaaactagaggccctgtgattgctttagatcctattgaatgtgaggcttcttttaatcatggtattgacaaagaattcaatgaaagtttagaaactttccatgtcataggtgacatttctgaaactggtggttttgagaatacaatttgttccaactgtggttgccctcttgaggccacagatcaaactgagaagaatcttagattgtgtccagaatgtagcaggaaaaccacattgttgagacatgtcatcccagaggcaaatttgcaattttccagtgacaattcagtgaattctaccaacattcctgcagaagaaaaaccatcagccgaaacagaccaactaactcttctgtctgaactgcgtcaagagactgatgtgggtaacacgaggtttccccttggtgaaccagatgctgtggaaagtcaaacttttcccagtgaatttattcaggaccgctcgcaacaaaattctctctccagttcactgatggagcgaagtaggcagatgcctgccaatcagcttgaggtggaccagtcaggggttgattacaaaaagcctgataatcattctggcgatcagcagttttatctttccaacgaccactcaaatttgaaagtggacctcttggaaggaactggcatttctttactactgaaaaggtcaagcagtagcaaagaacatgtaattcagggccggacttttactgccatgacgctatcttacaatgatctgtcttttgcaagacgcagcattaacagtattagaagctcaactgggcgtagcagttattctacctcatcatctgccgatttcagctcagcaagacattctgattttcatgtccaaaggcagtcaagtggaaggaaattggatgtagactatggatatgatgttaggatcaggcctccaagccctggttcatctttttctggaatgttaaactattcttaccatggattaggttttgctacacaacaaacttcttctggcaatacagaatgcagcatcctgaaggagatacctcaagatctactagaaatgcaagcttccgaaaatgcagtgacagatgcaattgattcttcctctatgggttcaattgttctcagggaagataatcttggatatcatgattggtgcagaacaactgatgcttggagctcagaattagtaagccaagctactggtgttcagcatggcaacaattcagtgtcatcatttccaaatcatgggagttctatttcaaatgatagtattagtgtaagcagtgtcttaaatacggaaacatcagttaaggatccagagtcatcctttgacgagaaacttgatatggagaactctaatgttgatggactgaatgctttggtaactatcaacacttctacaattgaagaatcagaaataaaagtggaaaactgttgtcagaaggatactggtgtggtggatgttgatccatcgctggtatcaaagagccccattgatgactttcaggaacattatgttccaaattcttccagtgattatcttgcagcttctgtttccgagctccatgcctccaagtactcccttggcatagataaaggaaatactagaagcctgacacttgaagaggcaacgaatactatacttttttgcagcactatcatccttgatcttgcatatcaggctgcaacgatagcaatggaaaaggagcactcagaacaattggaaggttctgagccaacggtgactatattggctaaacccaattccaatacaaaggactcacgcagccgaactgctggcaagcgtgctatgaaaccccagaaggcagcaaggtcaaagatggtggaaaccgatgtaaaatccccttccaagattgagaatgatgaaaatattgatgagtcttcgacacgcaatgttgggcttccaaacaaagtagacaacatgaagcctcttccagataagcttgaagcaaagtgtaattgcatcataatgtga

SEQ ID NO: 43973 - DNA, 336 bp, Glycine max
  Peptide Sequence Number=SeqID_160751
atgttgcggtttgaagacaagcttgattattcatatttaaagaggctttttcgaaatttatttatccgagaaggctatcaatttgactacattttttattggactatatggaagtatccacagattggtggcagtagctctaaaggacggtggaaagctatgcatgcaagaccatctgtacgaaagccagaaaaagtatcagttgggaaagagattcgagaaaaattctctggtgctgttgaagctttctcccggaggaacccaacaagtcctagtcctcgtggtgatcactccaaacataggagttttgaggaagtagcagtacacaaggatgtg

SEQ ID NO: 43974 - DNA, 500 bp, Glycine max
  Peptide Sequence Number=SeqID_160752
aagtggttcttccggaaacattccggaagagggggttcttccggaaaggtcttccggaactttggaagttcttccggaagtgcgcgtcttccggaattcttccggatgaaccacttcttccggaaagttcccggaagacgtttttcgaaagtcttccggaagaagtgttcttccggaagacgtttggttacttccggaagaacacttcttccggaaactttccggaaaaggttcttccggaacttccggaagaacccctaacgggttccactgctgaatcaatactggatagtaaaagcaatggagagttagggagactaacctcgaaggctgttcgcggagaagacggagaagaagaagaagcttggctcgtggtgtccggaagaagacgaaagcttggctcgcggtgtccggaagaagacgaaagcttggaggatcaacaggaatggaagaagaaaagaagtagcagtggtcttccgagaagaggagcgcgtttttaa

SEQ ID NO: 43975 - DNA, 2505 bp, Glycine max
  Peptide Sequence Number=SeqID_160753
atgaaactgagtccaagagaggtggagaaactaggccttcacaatgctggctaccttgctcagaaacgtcttgctcgtggtttaagactcaattatactgaagctgtggcactcattgccacgcagattatggaatttgctcgtgatggtgaaaagactgtggcacaactaatgtgcattgggaaacatctattggggaggagacaagttcttccagaggttcaacatctcttgaatgctgttcaggttgaagctacctttcctgatgggactaagctggtcacagttcatgatccaatttcctgtgagcatggagatctagggcaagcactatttggttcttttcttccagtaccttcacttgacaagtttgctgagaacaaagaagataatagaattccaggtgaaataatatatggagatggaagtctagttcttaaccctggaaagaatgcagtgattctcaaagttgtcagcaatggagaccggccaattcaggttggtagccactatcattttattgaagtaaatccctacttgacttttgatcgaaggaaagcatatggcatgcgcctcaatatagctgcaggaactgctgttcgctttgagccaggggatagtaaaagcgttaagcttgtaagaattggaggtaacaaagtcattagaggaggtaatggcattgctgatggtcaagttaatgaaaccaatcttagagaagcaatggaggctgtgtgcaaacggggatttggacataaggaagaggaagatgcaagtgaaggtattactggtgaccctgacagtccattcaccacaatcattcctcgtgaggaatatgctaacaagtacggtccaactactggtgacaaaatccgtcttggtgacactgatttgtttgctaaaattgagaaagattttgctctctatggtgatgaatgtgtttttggaggtgggaaagttttaagagatggaatgggtcagtcatgtggggatccacctgcaatctccttggatactgttataacaaatgctgtgataattgattatagtggaatcatcaaagcggatataggcattaaagatggtctcattgtttcaattggaaaagcaggaaatccagacatcatggatgatgtattttttaatatgatcattggggctaatactgaagttattgctggagaagggttgattgtaacagcaggggctatagattgtcacgtgcattatatatgccctcaattagtagatgaggccatatcaagcggcatcacaacattagtgggaggtggaaccggaccgactgctggaacacgtgccacaacttgtacaccagcaccatctcagatgaaactaatgctgcaatcaactgatgacctgcctctaaactttggtttcactggcaaaggaagtagttccaagcctgatgaactacatgacataatcaaggctggagcaatgggactgaagctgcatgaggactggggaagtactcccgctgcaatagacagttgcttgactattaacatacataccgacaccctaaatgaagctggatttgtcgaacatagcattgcagcatttaaaggaagaactattcatacttaccacagtgaaggtgcaggtggtggtcatgctccagatatcatcaaagtatgtggtatgaagaatgttctgccctcatcaacaaacccaacacgccctttaacactcaatactatagatgagcatcttgacatgttgactttctgtggcatgcagatggtctgccatcatctgaatagggaaattccagaagacttagcttttgcatgttcaaggataagagaaggaacgattgctgccgaagatattttgcatgatattggggcaattagcatcatatcttctgattctcaggctatgggtcgagttggagaggtgataagcagaacttggcaaactgccaataagatgaaggtacaacgaggaccactccagcctggtgaatccgacaatgacaacttccggatcaaacgatacattgcaaaatacactataaatccagctatagcgaatggtttttcacaatatgttggttcggtggaggtgggaaagttagctgatcttgtgatgtggaagccatctttttttggggcaaaaccagaaatggtgatcaaaggtggggtggttgcatgggctgatatgggtgacccaaatgcaagcatccccactcctgaaccggtgaagatgaggcctatgtttggaacactaggcaaggctggtggtgctttatccatagcttttgcagctgtagaccagagagtacatgctctatacggactgaacaagagggtggaagcagtaggcaatgtgaggaagctcactaaactagacatgaaacttaatgactctcttccacaaatcactgtcgacccagataactacactgttacagcagatggcgaggttctcaccagttttgcaaccacctttgttcccctttctcgaaattacttcctcttttaa

SEQ ID NO: 43976 - DNA, 375 bp, Glycine max
  Peptide Sequence Number=SeqID_160754
atgagtggctacttttgggttttggccattctgggagataaatctgttagtctaccccctccaaataaggagagtttgaccaaacatgcatttttaagaccaaatggcctttggggccaatggcttggacctagtgcagaaataaaggttcaatatcgaaggccaggaccagctaaatcgtctcatgattctggacttgatgcaactacgtatcaacacctacatatacctgtcaaaatgatggaagattttaggagattagctttggaaaacacaaggaagaactcggagacatgtggtgttcttgcagggtccctagaaagagatgttgtaatttgtgtgcttccaagttctagaaaatctcttggatggtga

SEQ ID NO: 43977 - DNA, 1566 bp, Glycine max
  Peptide Sequence Number=SeqID_160755
atgaccaatctgcaaatacaaacagaggaaccccctctgagtcaaacaccgcttctaatttcaattcagcagcaactagagaacgagaatgagggaaatcatcatcataataataactataatgagaataagaaggaccaagacgttcaagttgacggagagattgtggaggagagcctggtgcggttggagcgctttcttacgctgttagggttcaaccaggactcgccgttgagcttggtggtttcgtggagcgtgttcgcggcggtgggagttgtgacgccgctggtcgcgctttccatgtgcgagtgtccggagtgcgacaggtacgagattcaaagcttcgagatggcgatcgtggcgtttcaggcgagcctagccgccgtctccttgctctgcctctcccacaaccttcgcaagtacggtctccgccggttcctcttcgttgaccgctactccgggaagttgcattgctttcaccgcgactacgtcgctcagatttcgggatctatgcgcatgctttttctgtgggtgttgccgtgtttcattctgaagacagtgcgagaaatcattcgcattttctatgtacaacatgggtcctggtggctctcgcttgctattttatcagctttgattatatcttggacttatatgagtacaatctctctgtcagcctgcattttgtttcacttggtctgtagtttgcaagtgatccattttgatgattatgggaagctcttgcaaagggaaagtgatgttttagtttttatggaggagcacattcggttgcgctatcatctctccaagataagtcataggttcagaatctatcttcttctagagttcttggtcgtcacagcaagccaggttgtgactcttttgcaggtcactggatatggtcaaatgcttaccttcattaatggtggagattttgctgtatccacactagttcaggtggtgggcatcattatttgtctgcatgctgcgacaagaatttctcatagagctcaaaacattgtttcccttgcgagcaggtggcatgcaatgctaacatgcacatcttctgatgcaccctctcaattgagaagctctgctagtgcagggagcttggaggctgcaaaccatttaaatgcaatacaagtagactattctgaaagtgatctagagtcaatggattatgctggaatgtttacaaatacccaatggacttccaatgtgtcttcacatcacaagagacaagcttttgtgatgtatttgcagacgaatccaggaggaatcactatatttggatggacagttgaccggtctctggtcttcctggttaccaccatcaatttgattgaaagtcctccgcatgccgagccagaatgtcgcatgcacacagtagccatgcagagaagtagagaaacagtgtgtattgtccacccagggactggaccaggcacactactgttaaatgcgaggcctcttcctcaatccccagcaacacagatgtctccaaaattctattcgtcattctcattcctcagtcagcatacttatctccgtggatcttgtgacttctaa

SEQ ID NO: 43978 - DNA, 1431 bp, Glycine max
  Peptide Sequence Number=SeqID_160756
atggccatggttaaaattgttgcatatatacatattcgtgaaccggaaggggatattttaatattcatgactggacaggatgacatagagaagttggtatctaagttagaagataaggtgcgcgtatttagtcctccacctccaaattgtagacgaatcattgttgcaacaaatattgctgaaacttccttgactgttgatggtgtagtgtatgttattgactctgggtatgtgaagcaaaggcagtataatccatctagtggcatgtattctcttgatgttgttcaaattagcaaagtgcaagctaaccagcgagcaggccgagctggacggacacgtcctgggaaatgctaccgtctatatccttcccgtatttacaatgatgagtttttggacgttacagttcctgaaattcagagatcttcccttgctggcagtgttctttacttaaagtcattggacctcccagatattgacattctaaaatttgactttctggatcctccatcatctgagtccttacaagatgccttgaagcagttatttctgattgatgctattgatgaaaatggtgcaattacaagtattggacagaaaatggctgagcttcccttagaaccatcattggcaaaaactttaatggaggcaaacaattatggttgcttatatgaggctttgactgttgctgccatgttatcagctgaaactacattgctaccagggcagaggaagactgagaagaagaggaaacatactatatctaaccttcctgatggttctggattgggtgatcacattcaattgctgcagatatacgagtgctgggatcaaactgattttgacattggctggtgcaaagataatggcttgcaggtgcgagggatgttgtttgtcagagacgtccgtaagcagttatcccagataatgcagaaaatatcaaagggaccactggatgtaagggcaaatgggaaaagagaagagttcaggcaggattatcgaaatttgaggaaggctttatgtatgggctatgcgaatcagctggctgaaagaaagatgcatcacaatggttatcgaactttgggtttccaagctcaagtagtccaggtgcatccgtcatctgtgttgagtcttgatgacctggggaagttcccagactatgttgtgtaccatgaactaattgctacgccacggccgtacatgagaaatgtatgtgctgttgagatgagatgggttatacctattattaacaagctcaagagcctggatgtgtacaaattaagtggtggtgttcatcatgttgaggaggaacctgagaaaaagcttccagattttcccaagaaggatgttgaggtggctagtactgctgatgaccgtgaaagtagaatccaagctgctagagaacgatttcttgctcgtaaaggcaaaaaatga

SEQ ID NO: 43979 - DNA, 453 bp, Glycine max
  Peptide Sequence Number=SeqID_160757
atgtgggagggaggcgctcatccaagtgcaggtggacttggcggcaccgaggtggggtgcggtggcggtgagggaggcgttcgtgattgcacgaggaggaagttggaggttgagggtgagggaggagtggcattggagagggaaacatgtggctttacaggcttggtggatcttcaccacggagtggggatgggagtcgaggaagacgaagaaaatggagaccatggaaatgagaaggaagaggaaggcaacttaaagctgaaagagaaagaagaaggcacatgtcctgtccttcttatatactcaaccctttcagtagtcctcaaagctttgtcattcagcttcacttgtgcattagctcgtttctcttcagctatcctcttagtcgaagccagtttatttgcaaacctttcttgtgccaaagctttcatcctctcagctttcaccttgtaa

SEQ ID NO: 43980 - DNA, 2241 bp, Glycine max
  Peptide Sequence Number=SeqID_160758
atggcggctggcagacatggcggttaccgcgaaaacgagttcagagagcgcgagtcaaagttggaagtttccagacgcggcggattcgcgaattcgaaagaggattacgatcgtgttagcaatggtggcggtgatgttgtgaggggtggatcaagggatagggttagggtgaggcagaaggatattaaggagagggaagatgttaatggtggtggttatcgatcctcttcgagtaggagtgactctggcagcagtggccttggtcctcgccaatgtggtttctctgtcaagtcagttgatagagagcctggtgagctttccagtgagagtggttctgatgatgctactgaatcagaaccgggtgcgaaagacaccgaggttgccatgttggaagaaaccaggactcagtctccgcctgcgccggagaggaaaaggaagttttcacccatagtatgggatcaggatgacaaggaagtcaacgagtcatccagagtcaggggttccacttctgcggtgaagggggcgcttcctcctccacctccgttgccaaaggttttctgtcagttgcagtcgccgaatgttccaaatggtggagttgaaatacatcttgtcaagaacagggaaactgaggaacttcagttgaatgcagcatctaaggttaccttgccctctccttcaggtttgcattcattgcccccgaaagggaggtgggataatgatcaggaagctgaacatccagaaggtgaagattatattccaactcgcaatatatcgtcttcaagatgggcagctggagataactctcctgttgatgagggtgagatcctcaatgatgaggaaatgcccaaacgaaggaggagggtgtctcctgagttattggatggtagactaaggaacaagctattaagccctgaggaatctaaggtagaaggtattgaaagagctagggccagatcatctgaatctgaagaaagaggtgtccgtgggagaacttccagtggtgatgattttcctggtattgagtcagagaaggatgactacatggagattgatgctcaaggtggggaaagtgaaaccagtgtcagtcactcagacacggattctgaagatgaagatgatggccaggagactccagaacctcctgctcaacctcaaagagctgtcaacatgcttcagggttgtagaagtgttgatgagtttgagagacttaacaagatagatgaaggaacatacggtgttgtatatagggctagggataaaaagactggagaaattgtagcattaaagaaggtcaagatggagaaggaaaaagaaggcttcccactgacttctcttagggaaataaacattcttctttcttttcaccacccatccatagttgatgttaaagaagtagtggtaggaagtagccttgatagtattttcatggtcatggaatatatggaacatgaccttaaaggactaatggaggcaatgaagcaaccttttagccagagtgaagtgaagtgcttgatgatccagcttttagaaggtgtgaagtatcttcatgacaactgggtgcttcatagggatttaaagacttcaaacctgcttctaaataataggggtgatctaaaaatttgtgattttggcttggctcgtcagtatgggagtcctttaaagccatatacgcatctggtggttactctttggtacagggcacctgaacttcttctgggggcaaaacagtattcaacagccattgacatgtggtctttaggttgtataatggctgagctattgtctaaggagccactatttaatgggaaaacagagtttgatcaacttgacaagattttccggattcttggcacaccaaatgaaacaatttggcctgggttctccaaattacctggagtcaaggtcaattttgtcaaacaccagtacaacctcctgcgtaaaaagtttcctgccacatcattcactggatctcctgttctttctgattctggatttgatttgttgaacaagcttctaacttatgaccctgagaagcggatcactgccgaagctgctctaaatcatgagtggtttcgtgaagttcctctccccaaaagtaaagaattcatgcctacatttcctgctcaacatgctcaggacaggcgtgtgcggagaatatacaagagtccggatcctttagaggagcagcgccggaaggagttgcagcagggtgaaacagggactggtggaatttttggctaa

SEQ ID NO: 43981 - DNA, 738 bp, Glycine max
  Peptide Sequence Number=SeqID_160759
atggcttggaatggatcaggtgatggaagattttctatgaaatcagcttatgcaaaagtcagtaacacggatcagatcccagatcagccctcatgtaaaattattttccgtcattgtgctgcttgcaagaatattgaagagaccttatttcatgttttcagagattgccatggagttgtgcttgtttggcaatttttcatccgtatgaatgatggatcggacttctattcgtgcaataattggcacttgtggcttttgacaaatttgtccagagattatggggttcatgcttcatttggtggagacgaaactctatggctttccaaaatgaagtgtggactcctatggaagttattcataaatctcttaatttgtccaatgcttgctgtaaaggtagagaggtctctgcgcctcttcattcgggtgaacagaagattgcaagtaaagggagtatatcctcaacaaggtgaagttgtgctcaattgtgacggagccgtgactaatgctgcttgtagtggtgttatacgtgatcatatgggggcttacttgtgtggttttggagcttacataggatctgcttcagttttgaaggcagagcttatggctatccttttcggctttaaattggcgtggtccagaggttttcggaaaataagggtagagtctgattcccttaatgctatcaggctcattcctggacaagggagtaatttgcgtccctgttatgatattatctga

SEQ ID NO: 43982 - DNA, 912 bp, Glycine max
  Peptide Sequence Number=SeqID_160760
atggatatgccacccgccaatttcctttcccataagcctaaggctaagacaaggcatcgtccattacacgcttgtggagtctccatcttagcaattattgacattgtcataggaaaaacccaacatatcaatggaccattaggttcaacgttgaaaagggtaacaaagttagcaaaatttgccacaccccttatctacgccatgcgattccaattgctagcaattctctccatcattgatcaagcaattttagcaattgaaaaaattgtcgagagattgtttcctccttcaacccgcgtgttcgacaaagtcgatgaaattgtgctaatgatagtgtccctcccagaaaaatttgatggtgcaatgaacaagtttcctactatagtccacgaggtcccgtttttggattgggcactgacccttgtgatctcaaggttgaacagtttagtttccacgttgaaccactgggggcaggaaaattcaagggtggacgagaaaacaataggtgttgataggagttgcaatgaagggtaccttcccatggataattcctcgaatgatattaacaatgaaaatttggaaaattttcctcctataatatcagattgtgaacatgaaggggctcatgaaattgcagtgtcgagtgacgtgaaagggtcatcataccaggaagcattattggagaaagggaaagaagagaacccggatgagaaaatggagaaagagtgtgagattgagaagaagatcaatggagattgtgattgtgaagaaggaagagagaagaatgatggaaataacgaaaagagtaaggatggtattatgaaaagtcaagatggagggaatgaaagagtaaaggacggtcttctggaattgtttgagtctgcatggctcatgaaagctggtagttattag

SEQ ID NO: 43983 - DNA, 717 bp, Glycine max
  Peptide Sequence Number=SeqID_160761
atgccatgtaagccaacccacgctgagcgggcagatccgcaagctggaagacgagttgggcgtcatgctgctcgagcgcaccagccgcaaggtgctgttcacccaggcgggtctgctgctggtggagcaggcgcgtaccgtgctgcgcgaagtgaaagtattgaaggagatggccagccagcagggcgaagccatgtccgggccgctgcacatcggcctgatcccgaccgtggggccttatctgctgccgcagatcatcccgacgctgcacaaaactttcccgaaactggaaatgtacctgcacgaagcgcaaacccagcaactgctggcgcaactcgacagcggcaaattggactgcgccattctggcattggtgaaggaaaccgaggcgtttatcgaacgcgagcgcgtggcgatgccggatttggcgggagagaagctgctgatgctggaggatgggcactgcctgcgcgatcaggcgatgggcttctgcttccaggcgggcgcggacgaagatacccacttccgcgccaccagtctggaaacgctgcgcaatatggtcgcggccggcagcggcattaccctgctgccgtcactggcggtgccgccgcagcgcgaacgcgacggcgtctgctatctggattgctacaagccggaaccgaagcgcaccatcgcgttggtgtatcgccccggttccccactgcgcagccgttatga

SEQ ID NO: 43984 - DNA, 1704 bp, Glycine max
  Peptide Sequence Number=SeqID_160762
atggggcacaagtatttgtggttggtcttttgcttgtgggctttaacatgctcacttcttccttctttctcctttggactaatgagaattggtttgaagaagagagatctagatcttgatagtatcagagcagctagaatggtaagagaaaagccaagattaggcagacctgtgttgggtgcgtatgatcatgatcttggcaaaccaattgacgagggcatagtacctttgaaaaattatttggatgcacaatattatggagagattggaattggcacacccccacagaaatttaatgtcatatttgataccggtagttccaacctctgggttccatcatcaaagtgctatttttctattgcgtgctatacccatcattggtacaagtcaaagaaatccaaaacatataccaaaaatggaacatcatgtaaaataggatatggatctggatcaatatctggttttttcagtaaagatcatgttaaagttggtgatgttgttgtcaagaatcaggatttcatcgaggctacccgagaaggaagtctttcctttgtgttagctaagtttgatggattacttgggcttgggtttcaggagatctcagttgaaaatgctgtgccagtatggtacaatatggtgaagcaaaatcttgtaagcgaacaggtgttctctttttggctcaatggtgatccaaaagcgaaagatggtggtgaactaatttttggaggtattgatcctaaacacttcaaaggagatcatatttatgtcccagttactaaaaagggctactggcagattgaaatgggagatttttttattggaggtctctcaacaggtgtttgtgagggtggctgtgctgctattgtggattcaggaacatctttgcttgctggtccaactactgttgtaactgaaatcaatcatgctattggagctgaaggagttctaagtgtagaatgtaaggaagttgtttctgaatatggagaattgttatgggatctcttggtatcaggggtacgacctgatgatgtatgctcacaggttggtttatgtttcaaaagggctaaatcagagagtatacttcgattgagtaatgatttaaagatgtttgatggatgcttaataattctggctgtgagcttaaagtcaagttctgagtataatcaagtatacaatatgcagaaattttctgcaaaaataattgtcaaagaacctctattaccaaccaatttctcagggcttgatacccttcgtagcaatggaattgagatggtgaccgaaaagggacaaagagagttatcagctaaagatactgctttgtgcacttcctgtcagatgcttgtggtttggattcagaatcaactaaaacaaaagaagaccaaggagatagtattcaactatgtaaatcagctgtgcgagagcttgccaagtccaaatggagagtcagtagtagactgtaatagcatttatggattgccaaacatcacgtttactgttggagacaaacctttcaccctcacccctgagcagtatattctgaaaactggagaaggcattgcagaagtttgccttagtgggtttattgcttttgacattcctcctcctcgaggtcctctctggattcttggcgatgttttcatgagggtatatcacaccgtctttgactatgggaacctccgagttggtttcgccaaagctgcctaa

SEQ ID NO: 43985 - DNA, 1041 bp, Glycine max
  Peptide Sequence Number=SeqID_160763
atggatgttgctgaggttgaggaaaatctgtttgctgcaagtgatgccaagttacatggacagatgtgcaagactctttctataatatattgcaaagtattgtctgtatttccttctttagaagctgctaggcctaggagtaaatctggtattcaggcattatgttcattgcatgtagccttggagaaagtaaagaatgttcttcagcactgctcggagtgtagtaaactttacttggctataactggagattctgtcctcctaaaatttgagaaggctaaatgtgctcttgaagatagtcttagacgggtggaagatattgttccacaatctattgggtgtcaggttcaggagattgtgaatgaatttgcaacaatagaatttgcacttgacccatcagagaagcaagttggtgatgatttaattgcattgctccaacagggaagaaagtttaatgactctaatgacagcaatgagcttgaatcttttcaccaggctgctactagacttggaattacatcttcaagagcagctcttgctgaaagaagagctctcaagaaactcatagaaagggctcaatctgaggaagacaagcggaaggaattaattattgcatatcttttacatcttatgaggaaatactccaagttatttagaaacgagttctcagatgacaatgattctcagggttctgcaccttgttctcccgttcaaggatctatcgaggatagtgttcctggtagtcattgtcaagcctttgacagacaactttcaaaattcagttgctttaatttcaaaccaaatattagtaggacatctgggcagatgcctcttccacctgaagagttaaggtgtccaatatctctgcaactcatgtatgatcctgttatcattgcttctgggcagacttatgaaagggtttgtatagagaaatggttcagtgatgggcacaacaactgcccaaagacccagcagaaactttcacatctttgtttgactcctaattattgtgttaagggccttgtttctaagttggtgtga

SEQ ID NO: 43986 - DNA, 186 bp, Glycine max
  Peptide Sequence Number=SeqID_160764
atgactctgcttcatagtccaaaacagatacaaatacaagttgagctaagctcaaccagttacaggaataataatcacctgatgatgcgaaaaatcaaggaaggcaggctgaagaaaatgaatggaatgagtagtgatgtaagaatgtccgtcttccagttcgcacggtccaatatcagcaaataa

SEQ ID NO: 43987 - DNA, 264 bp, Glycine max
  Peptide Sequence Number=SeqID_160765
atgggaggtcataggcagaagaagtcttcttccggtttcttctctattttcaacattttctcatcaaggaagcccagaggagggtactatgatgcctctgattcggggcgcaaggtctggcctagcgattacgacaaaggtaactggggtgttgctgaacccaatattgacatgaaagctgaagctttcattgccaagtacaagaaacgtgtttcagaatctgcactctatcaacttgatcctgctgctgctgagaatgcataa

SEQ ID NO: 43988 - DNA, 306 bp, Glycine max
  Peptide Sequence Number=SeqID_160766
atgggtggtaacaggcaaaggaaatcttccaccttcaagtcagttttcaacattttcaaatctagcaataggcaaagaggaggagggcactatgatgctaattatgatgatgcaccaaagcaatggaccaaagtttggcctagtgatgaggacagaggtcgctggggggtggctgatcctgtcattgacctcagagccacagctttcattgctcaatacaagaaacgagtttctgagtcagaaattcattgccaagctcaaaacttcaatgaagataaaacctttttcaagctagatagtggttga

SEQ ID NO: 43989 - DNA, 318 bp, Glycine max
  Peptide Sequence Number=SeqID_160767
atgtttaaagaagttgatatgaatgaaaaaaatgaagaccaagctggtgtgaatgaagaacatgttgattgttcttatggatttaatacttctaagtgggctcgatcagttgcttatgaaattggatttgtcacaatgattatgaggctagacacaaatactggtacgagagaaaacacttcatttgtgttaagtgcttgtgaaaggagtggtcagtataggtgtaggaagaaagattttgtcagaagagatactggcagtaggaaatgtgggtgtccctttaagattcgtggaaaaccattggttggaggccaatga

SEQ ID NO: 43990 - DNA, 268 bp, Glycine max
  Peptide Sequence Number=SeqID_160768
tcttggtgctactgtggatggagcattttcatgcgatggagagaaaacagattcatgcaacatcttttcatcaaggaagtccaaaggagggtactctgatgcccctgattcgtggcgcagagtctatcctagcgattacgacaaaggtaactggggtgttgctgaacccaatattgacatgaaagctgaagctttcattgccaagtacaagaaacgtgtttcagaatctgcactctatcaacttgatccagctgctgagaatgcttag

SEQ ID NO: 43991 - DNA, 546 bp, Glycine max
  Peptide Sequence Number=SeqID_160769
atgactaggaagaaagtgaaacttgcctatatcaccgatgtcacggcaagaaaatccacttacaagaaaaggaagaagggtatcattaagaaggtgagtgaactcaccattctttgcggtatcccagcgtgcgctataatttccagtccttttgattctaagccagaggtttggccagatccagagagagccaaacaggtgattcagaagtatctggatgcatctgtactagatgaaagcaagaatgtcaaccaagagagcttcatcatgcaaaggattgccaaagcccaggaacaattgaagaaacatcgtcaggagaaccatgagaaggagatggccttgtccatgttccagtacatgcaaggtgaagacctgccaaataatgttgaagaactgaaagaactcaacaagctgattgagaagaatttgaaggaaattgaaaataagttggctgtcaatgtcagcagccagggtgatgtggttataccagttgctacaatcaggattttgttactacaagatgttgcccacaatttaaattcctga

SEQ ID NO: 43992 - DNA, 1500 bp, Glycine max
  Peptide Sequence Number=SeqID_160770
atgaaagcaataagtccctccttcctctgccttataactcttgtggcccttttggctggtagcattgaaagtgcaccagcaagcgtgaagccaagccattatgctgcaccattcaataggagtgtttttccttctggttttctatttggaataggctctgcagcttaccagatagaaggagcagcagcaatagacggcagaggaccaaggaagatttgggatcatagtgatggaagtctagcaattgatttttatcaccggtacaagagcgacataaagatggtgaaagaagttgggttggattcatacagattttccatctcatggtccagaatattccccaagggcaagggagcagttaacaccttgggggtcaagttctacaacgatctcattaatgagattatagcaaatggcttaaaaccatttgtcacgctgtttcattgggacctcccacaagctcttgaagatgaatatgggggatttctcaaacctgaaatagtggaggacttccgtaactatgctgacttttgcttcaagacatttggtgatcgggtgaagcactgggtaaccctaaatgaaccatatggctacagcgtgaatggctacagtggtggaagttttgcaccaggtagatgttctaactacgttggaaaatgccctactggtgattcttccaccgagccctacattgttaaccatcacttaatacttgctcatggagcagcagtcaattgctacaagaacaaataccaggctcatcagaaaggacaaattggagtcaccatagtgactttcttctttgaaccaaaatctaatagtgatgctgatcgcaaggcagcaaggcgagctctggactttatgtttggctggtttgctaatcccattacatttggtgactatcctgagagtatgagatctttagttggttctagactccccacattcaccaaagctcaatctgaaagtctcaaaggttcatatgattttcttggtataaattattacacctcaaatttcgcggaatatgctccaccaaccgccactaacaagacctatttcactgatatgctagccaaactttcttcgaccaggaaaggtgtacccattggcacaccgactcctctgagctggctctttatctatccggagggactttataagctcatgacatacataagggacaactacaataatccaccggtgtacattaccgaaaatggcgttgcggaatcaaagaatgactcacttgcaatcaatgaagcccgaaaggatggtattcgaattagataccatgatggccatctcaaatccctgcttcatgcgatcaaagatagagttaatgtgaagggctactatatatggtcattttcagatagctttgaatgggatgctggttacacagctcgatttggcatcatatatgtggattacaagaacaatttgagtagataccctaagtcctctgcgttttggctgaaaaaattccttctcaagtga

SEQ ID NO: 43993 - DNA, 732 bp, Glycine max
  Peptide Sequence Number=SeqID_160771
atgtctaaaaaagacattgaaaaacgaaaacctaaatatgcttcaactgaattttggggtggtgaaaagaaaaaatacggatctaatgaaatagaggttgttgaaggatgggaagatgacatgttcttaaaaacagtcaaaagagctgcgtttggttccataccaattgacagcgaaaagattgacgaaaaccttctacgaataattgagagtcaaagcgatcaagttaaatctgacgtacaaaatcaaattgcacaaaatgcaaatttagaaactattggattttcttctgtagaagaagcagaagttattcaagaagtggattttaatcaaccggaaccggagaaaggttttaatttttcagatatggactacccattcacaaaaggaaattggactgtacaaggacattccgtagtaagtgatactgatgatatcacaggttttgaagagagaactggacatatcgatcgagattattataagggaatcttgatctgtgaaagtatctggaaacatgcagatgctcttttaatttcaaaagctcctgaaatgttggaaatgttagaagatgtatgtgaaaatttagaattacagttagcaatgagaggtgtttgtgggcaaggtaatggtaagagtagtggttgtgatgcagatggttatggaggcacacatttacttgaaaaagctaaaacactcataaaacaagcaaccggaataaatgaaccttaa

SEQ ID NO: 43994 - DNA, 705 bp, Glycine max
  Peptide Sequence Number=SeqID_160772
atggcattacgcgtagcgcagtcaggtcttaattttattcaactcggtggtattgtaattcttattccaattattgcattttactttttgcttgattgggaaagaatgctagatagtttaagtcgccttattccacgaccttatgaagcttctactttaacgattgttcgtgaatgtcatagtgttcttggagcatttgttaaagggcaatttcttgtaatgcttttattaggcattgtttatgcggttggattacaactgattggattagaagttggtttgattatcggtatggtcgctggtcttgcaagtattattccatacctaggatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 43995 - DNA, 870 bp, Glycine max
  Peptide Sequence Number=SeqID_160773
ggctcaaagtcctccctgttggaactgcttctgagttctgagcctcatcgggtgctgttggttaaagtattgaataaagctcacgtggcccaagacatatccgtggaaggcttcgagagcattgtcaacaatattacggccaataactacctcaccttcgtcgaggaggagatacctgttgaagggcgaggacacaatagggccttacacgtgtctgtcaagtgcatgaaccacattgtggccaaggtgctcatcaacaatggttcatcactcaacgttatgctcaaaagtaccttggacaagctgcctttcaatgcagcccacctgaggccgagctcgatgatcactttccaagtgatggatatcaatccgacttatagttgtcttttgggccgaccttggattcacttagttggggtggttcctttgacactccaccaaaagttgaagttcgtggtggaagggcgtttggtcaccgtcttgggggaagaggacattctagtaagttgtccttcttctatgccgtatgttgaagctacggaggaatctttggaaacggctttccaatcctacgaggtagtaagcaatgcttctgtcgagtccctccctgtgcgacttcacatgtctgatgccttaatgatggtggcccgaaaccacagaaggttcgggcttggatataagcccatgcgcgccgatgtgagaaaaagagccctagagagaaagagcaagagcatgggccaacaacaagggtcacaagtaaaaacgaccccttcgtgtcacatcagcggaaactttgtaagcgcgggctggagatatggcgggcaagtcaccatgatccacgatgaagcccctcaagagcattcagactag

SEQ ID NO: 43996 - DNA, 366 bp, Glycine max
  Peptide Sequence Number=SeqID_160774
atgacaatgtcttcagtcaagactatcacagtcttctttatgctttcaaaagccaaattgagctgcttgacaccagttgccatgcaatccgaaaggtttttcgatgtttcggtgattcaaaggtgttttgatgataacaatgatgatgacaaaggtgatgacaaaaagctcaaagatcaatcaaagaacaaatcaagtgaatcaagaacaattcaagagttcaagaatcaagaagaattcaagactcaagaagaaagcctagaatcaagaatcaagattcaaggttcaagatctcaagaatcaagatcaagattcaagactcaagattcaagaatgaagaaaagactcaatcaagataagtattaa

SEQ ID NO: 43997 - DNA, 234 bp, Glycine max
  Peptide Sequence Number=SeqID_160775
atgacactctcacttaggaaaactaggcagcaagtgtcaaggtcaccctgtcatgcacaagtaactcccccccatggtgatcaacctgagtctcaaggaagttccaaaccgagtgacatgcccccaagtacaagtatttttcctcatgaaaaactacgagttcttactgacaaagcttgtactatttccatgcaatatgaagtatggaacatgagcatcatcaatgcactgaag

SEQ ID NO: 43998 - DNA, 183 bp, Glycine max
  Peptide Sequence Number=SeqID_160776
atggagtatgaatcacaacaaagagagaaaaggttagtctgtctggaagaaatcatgggtttaagagagcataagggtttagtctttgtgaaagcaaagctttccaagtttattttgatgatgccaaagactcaagtcaagaatcaagagtcaaacaagtttcaagaatcaagattcaagtga

SEQ ID NO: 43999 - DNA, 124 bp, Glycine max
  Peptide Sequence Number=SeqID_160777
gccatacagggctctttttaacttgcagaccagagatctgtctgaggattcaaatcctggaattatcggaacagcagcaggatggagcattagaggtgaggccaagggtgacatccaggagtag

SEQ ID NO: 44000 - DNA, 246 bp, Glycine max
  Peptide Sequence Number=SeqID_160778
atggagacacaaagcaaaccgccagtggaactggagagcttgctgtgccgtgatggactcgccatccccattggcgattttgccatgcatggggaactgccagtcaaactggcgagttccaagcacaagagggtaggcttcaggtggtacatcatgaattcagttataacagtgttgtatttcaatggaagggtatatgaagagaatgatggtgtaatatttgaaggcagtaaaaaagcgatttag

SEQ ID NO: 44001 - DNA, 603 bp, Glycine max
  Peptide Sequence Number=SeqID_160779
atggctccactttcattattgttcttcctagcattttctcttttccttctaagctccaccatcatggcacaaatcacaatttcaccatctcctttggcaccagtgatcccaccatcaccatcatcatcacaaatatctcttccaccatctcctttggcagcagtgatcccaccatcaccgtcaccatcacaaatatctcttccaccatctcctttggcaactgtgatcccaccatcaccatcgccatcacaaatatctctcccaacacctcctttggcacctgtgatcccaccgccactaccatcacaatattctcctcctcctcctcatctcccaacatctccttttgctcctccacctcttgttgtagaaacaccggttaccccgccaccaccatcacttcctactcgtccagcgtctcgttttgcacctccacctcccgttggagaagcaggaagagaaacacctgttggtggaagtggaactaaagggggaagtgggagtggtggggttcaaggtggtggtggacaaggaagtcacattgacagttatagtggtggaggtagaagaggtggtgaacactttgtaggcgttggatattaa

SEQ ID NO: 44002 - DNA, 258 bp, Glycine max
  Peptide Sequence Number=SeqID_160780
atgcatggaggacccaaaccgccagaaccagtggcgagtttggtcacaggccatggcagtgcagcagagggacgcgtcagagcaggcgaaaccgccattaccattggcggtttgccttgcacagggatcgccagcatggctggcgggttgcttcagtttgaattttttttggccctcttccattataaaagcagaagcttcgagagtgcactgcgcttccttcctttgcttccattgctttgttattcttcttcataa

SEQ ID NO: 44003 - DNA, 294 bp, Glycine max
  Peptide Sequence Number=SeqID_160781
atgtcgccattccaagtggcgatttggtcactgcatgcatgtatcgccattgacgctggcgatttgctcaaggacaccaaactcgccactggttctggcggtttgggtcctccatgcatggttttcacatgggaaaatttgtcggtgtggaaggaggaaaatttagggctttatagtgtgaacacagcatatgggattctactggagtttcatggctggatctttgagcttcaatggggtcctttaatggtgattttccaccatggagatgcagcggaagacaaaggaaaagag

SEQ ID NO: 44004 - DNA, 165 bp, Glycine max
  Peptide Sequence Number=SeqID_160782
atggaggttgaggaatggaaggtggtgacttttgtggcgaaagcggaggcgtataatgtagctccatatagagcttgtaggccttggatcttcttcatcactatagtctttcactacctgaagatcaatggtagcagaaaagagaaggaggaaagggctccataa

SEQ ID NO: 44005 - DNA, 306 bp, Glycine max
  Peptide Sequence Number=SeqID_160783
atgcatcccactacacatcttggactggaggaggaatcaacaaaggtggatgtgacccagtacaaagcaatgaatggctcactgctctatcttactgcgtctaggcctaatgtattgttcaatgtttgcttatgtgctagattccaaaaggaaccaagggaagttcacttaactacagttaaacagttcgtcaacaagaagaccataacctccaaggttttaggagtgaaggatgttctatcaagcgacactattgctaaggcaacaaggtgtcattgcaagggtagtacttaccaagaatggtag

SEQ ID NO: 44006 - DNA, 240 bp, Glycine max
  Peptide Sequence Number=SeqID_160784
atgcatcctacggatatccaatccttaactgatgatctttcatccgttagcaagttacatgaacaaatgtacttgcatgatcaagccctcgcatacccttctagtttgcatatatctagggcaattgacatcaagatggttgttgatagagtttaccctcgtttaccagtatgggatgtttccaaaaagaagggatttgagatgtattacaaggagcagatgccctcgtggcagatgaag

SEQ ID NO: 44007 - DNA, 270 bp, Glycine max
  Peptide Sequence Number=SeqID_160785
atgggggagggatgttgcacgcagccttacccttgcatatgcaaagaggctgtttccggatttgaacccatgaccaacaagtcaccaaggcacaactttaccgctacaccagggctcgccctgatgagagtagtgattataaaagagagagacagaaagaatagtcaagagagtgaaatcttgtttctcccatcttctaaggaatcaaagtgcactcgagagaagtctcactatggagaaaagtatgcactgtttatccattatttgtga

SEQ ID NO: 44008 - DNA, 579 bp, Glycine max
  Peptide Sequence Number=SeqID_160786
atgggacagaacaacttagatggtgatgaatcatgggacaaaaagttgtcccaagtagatctacacttgaagtatagatctgatggcaccattgatcaatataaggtgagattggttgcaaaggggtacaccaaattcctaggatacagacagagtcaaggtgacgatgaaactaagaagctggtccttaaggagaagctagcaacccggtttgaaataaaggagttgggtaagcttaagtacattcttgggatagaggttgcctattccaaacaaagtatctttatctcccaaaggaagtatatacttgatcttctcagagaaacagagaaatcagggtatgaacaatctaaagttccaattaaacagaaccataagatcagcagaagtgaggaggaaagcctagcagtagagaagtctcgataccaaagactgagagatacactacacatggaagtgtatacagaagcagactatgtcaggtcagttgtcaatggaagatccacctcagggtactacatgttcttgagaggaaatctagtgaaatggtggagcaagaagcaaactatagttgcttga

SEQ ID NO: 44009 - DNA, 1320 bp, Glycine max
  Peptide Sequence Number=SeqID_160787
atggatcaatcacagaatcagagaccagcgacatcaacaaccacaccctcgcgctctttccagttccacccccttcgtgtccccattttcgatctcttcaacctctacttaggactcggccgaaacagtcgccagaaacccgatgactcacttcgcgacccaccgaacaagacgcagaaacgcgtacacgccctgaatcgggagcttcctccaccaaatgagcagttcattctggattttgagcaactccagagccagtgtgctgaccaggatcaattacgttctgttacagaagcgattcttatatcgctagtagtgcagtgtagtggccatggaccaagggcagactttcttctttttgttttacggagcttatgtggtattggatgcattaactgggactcccttctgccgtcccttctttcatcagtttcttctgcagaattgcctgttggtcaactaagtcaagcagtgccaactgtttcctcatcgagcttatcacagacaggaatgctgccaccaccaagcacgattgctaattcttcaaattttcagtcttcaaatcctgcgtctcctttgacctctgttcatactattggctcgcctgcgcagtcaacgatggaaccattatcttgtgcagctatgtctcctgtcaaatcatctgatatttcctctgctggacaacaatctaaacttagaggcagtccatctgttagaactaatgatatcagtaatagtagccttcgtcagctatgttgcaagattattttaactggtcttgagttcagtttaaaaccagttacttatgctgaaatcttcaactatatgctgaattggctggtgaattgggaccagaggcaacagggaattgatgaatcagatgtaataaaatcatggaggcctgacaaggctgtaattgcatggctacacagttgtttggatgtgatttggcttttagttgatgagggaaaatgtcgggtgcccttttatgaattattacgtagtgatttgcaattcatagagaatattcctgatgatgaagcattgttcacacttatcttggagatccataggagacgagatatgatggctatgcacatgcaaatgttagaccagcatcttcattgccctacatttgggactcatcggatcctgaatcagactatacctaatgtttcaggtgaagcagtagcacacctgcgactatcaccaattacatatttaagtgtacttggagaaccattgcatggagaggtgatgaatctcatttctgtttcaagatactcattattgatgtatgagcatgcttttaaatactaa

SEQ ID NO: 44010 - DNA, 909 bp, Glycine max
  Peptide Sequence Number=SeqID_160788
atggatgaacgctcaatagggatgttttgggttgtgacctacacaatggcacaacctgcttgtgaaacagtaatgaattggttaaattctgctggagttgctgacttactaccaggagcaaatttacaacaagctgagagattaatggctacacgagaagtcagcccactgcccatgtcattgttatctggattttcaataaacttatgtgtgaagctgtcttatcaaatggaagattctctattttctgggcaggttatacccagcattgcaatggttgaaacttatactagattgttgctcttagcacctcattcactctttcgttcgcatttcaatcatttggtgcaaagaaatccttctttgttgagcaaacctggggtaacacttttagtgcttgagatattgaactaccgactacttccactttacaggtaccagggaaaaagcaaagccctgatgtatgatgtgacaaagattatttcggctataaaaggaaaacgaggagatcatcgagtattcagattagctgaaaatctgtgcctgaatcttattttctcgttgagagatttctttttggttaaaagggaagggaagggcccaacagaatttactgaaactctgaatcgagtgactgttataacacttgcaatccttattaaaactcgtgggattgctgatgctgaacacctgctttatctccaaaatatgttggaacaaataatggctactagccatcatacatggtcagaaaaaacactacatcacttcccttctgttctgcgtgaagcattgagtggtcaaactgataaaaggagccttgcaatacaaacgtggcagcaggggaaggggatagggggttgtaggaaggtaggattgaagatgagaaactctaatgtaacaaaataa

SEQ ID NO: 44011 - DNA, 264 bp, Glycine max
  Peptide Sequence Number=SeqID_160789
atgtggtggtattacggaagacgtgatgaaactggaaaacacctaagttcatttgctaaactccttttgaaatgtgacatttgtgcgcaatacacaatgcctgaattgccaaagggttgtaagagagttggttataagtgggtcttcaagactaaacgtgattctcatggcaaccttgaacgttacaaggctatgcttgcggataagggatttactcaaaaagatgacattgcttataaagagacgttttcaccggtctcatga

SEQ ID NO: 44012 - DNA, 1761 bp, Glycine max
  Peptide Sequence Number=SeqID_160790
atgacctatatcagtcatagtttccctcagcatcgacaatatctatgtgctggtgcattgatattaatgcatggccatgcagaaaacattaacagtggaaacctgggacgtgtcctgcgggaattctctcctgaagaggtgacgtctaacatttacacaatggtggatgttctgcttcatcatatgcagatagagcttcaacaaggacactcttcacaggaccttatgttaaaagcttgtgcaagcattgccttttttgtttggacaaatgagttacttcctttggatatcttgctcttggcccttattgaccgcgatgatgatccacatgctttgcgtatggtgattagtctacttgataggccagagcttcagcaaagagtaaaacacttttgtatgactcgtgggcaccctgaacattggctttactcaggaatattcaagcgggttgagctacaaaaggctcttggaaatcaccttgcatggaaagataggtatcccgtgttctttgacgatatagcggcacgattacttccagtcatccccttgattatttatagacttattgaaaatgatgcaatggatacagcagaaagactgttggccatgtattctccattgcttgcttattaccctctaagatttacatttgttcgtgatatacttgcatatttctatggtcatcttcctggaaagctcattgttcgaatcctcaatgtacttgacatcagtaagattcccttttcagagtcattcccgcaacaaataagtttgacgaatcctgtcatgtgtcctcctctggattattttacgactctgttactgggaatagtaaacaatgttattcctccattacataacaattcaaaatctggatctatgggagatgcgtcaagcaatacacttcgaactgcacaaagcaagcctccagcagtatctcagtctgggtcagcaaatgcttcagagggccaaaaggcattttaccaaattcaggatcctggcacatacactcagttggttctcgagactgcagttatcgaaatactttcccttcccatatctgcctctcagatagtacaatcacttgttcaaattgttgttaatatacaaccaaccttgatccagtccagcaatgctcttcatggtggttcaaacagtgtagggcaaggttcagtgttgccaacatcaccttcagggggaagcacagattccttaggtgcaagcagatcaactccttcagtttctggaataaatacctctaattttgcttctcgaagtggctatacatgccaacagctgtcttgcttgttaattcaagcttgtggcctcctactggctcagcttccttctgattttcactcacaactgtacttggagacaacacgtattataaaagagaactggtggcttaaggatgggacaaggtcacttggggaaatagactctgctgttggctatgctttattggatccaacatgggctgcacaggacaatacctccacagccattgttttgcctgaaaggaactctgacttgtgtaatcacacagggaatgtggtggccttgcttcattccttcttcagtaaccttccacaagaatggcttgaagggaccaatgttattatcaagcaacttcggccagtaacatcagtcgcaatgttgaggatagcattccgtgtaatgggaccactccttccaaaacttgccaatgctcatgcacttttcaacaaggtacagagaatcaccaattcccaatcttaa

SEQ ID NO: 44013 - DNA, 150 bp, Glycine max
  Peptide Sequence Number=SeqID_160791
atgtcgcatgaaggtggcataaatggtggttgtggaaagggaatcgagggttttgagcagagagggttttggggcacactttgttgcacgaagaagatcgagattgagagacatcataataattcagccatattagctaattcaaggtaa

SEQ ID NO: 44014 - DNA, 123 bp, Glycine max
  Peptide Sequence Number=SeqID_160792
atgggcaagctttgccttgctgatgggaagctagctaagaattatattcctctgtttgtacaggagcttgaagagagcaaatttgcagctcttcaaaatatgcgagaaaaaccaagttcttga

SEQ ID NO: 44015 - DNA, 471 bp, Glycine max
  Peptide Sequence Number=SeqID_160793
atggagtctgctcaagcaaagaatcaggcactaaaagaagttggagttgttgttcccacttcatttaaagcttttgaagatgaaataatggaaacatttcacaaattggttgaagaagggaacatcacacctattaaagagtttgttcctccaccaatccttgaggaccttaacacaacaattaggagtggaaaagtgcatgctccaactcacattatttccaccatctctgatgacagaggtgaggagccatgctatgttggtgtaccaatgtctaccattattgaaaatggttatggtgtgggtgatatatgtatcatgctatgctctgaccatgttccttgtgtctctggtgctcacaattctatagtaaaagcaagggttgggacctgtctcctatcttgtttcagctcctatatggagcgtgtaggccttggatcttcttcatcaatggagttctttgcttcttaa

SEQ ID NO: 44016 - DNA, 390 bp, Glycine max
  Peptide Sequence Number=SeqID_160794
atgtccattgtgggtcattcacagaaaccaagacaatgcagggtcgtccatgtagaaggacacaatggtcaagcggacatggtctggcgtggagtgatactaaaaaatttgggtaatcttaaatatccaacccaatgggtttgtcccatcaaaatgaggcacttcaagcttcatgcgatgagggttattggaaggggaaccggtgtgagattggaagggaaaccagtgtgtggcaactttctggaggagtttaacgagttttactacattaaattctgggttgttgttgttggggagaactggttggaggtaagttttgcaatgacatcctcaatacggtccatattggacttggagtgggttgagtcggccatgaaggaaactcaatga

SEQ ID NO: 44017 - DNA, 270 bp, Glycine max
  Peptide Sequence Number=SeqID_160795
atgacacccatattggtgttggatgcgtccgtttccaagacaaagggtagagagaaatttgataaaaacagtactggggttatagtgatggcatcttcaaattctcaaaggcaagttgagctgctgaagtccactcaaagtggtctcttgtcaacaatgaggacaaagctcatcgatggtgggaataggaaaatgatccttgacagtgacaacattgagggtgctatagtcgacgcaaaacctccacgtgccatcccgtttcttgactaa

SEQ ID NO: 44018 - DNA, 156 bp, Glycine max
  Peptide Sequence Number=SeqID_160796
atggccactctccgcgatggcaaggagtttacgaaagttgtcggtatcggcaatgaggttcttattctcgttgtcgcactcttcgttctcgcactgttaaattttagtgctttggtgttagttgatggttttttgtcactccaaaggctatgttag

SEQ ID NO: 44019 - DNA, 558 bp, Glycine max
  Peptide Sequence Number=SeqID_160797
atgggaccaaaatctaccctaaggctcatgagaaccctagagccttctcctgcatctctggtccaatcttcttggagtctcctagccatggctttggtgataggtcccctcattgggaggattgcatcaccacccgtaatccaacgacacttagcttcaggtgcttctccttatgaaatcacttacgggaaaaatccctttaacattccccaacatattacaggaacctcgaaaaatgatccagttgacaatatcttaagcaatcgggaagcttcttttgcagagctgaaaaagaagcttttaaaagcacgagaagttatgaagcaatttgctgactccaaacaaagagaaatcaattttaagagtggtgattggtggaaaggattacctcctgatgacactacatgggaagactgggatagcctcaaaaccccacttcaccttgttgacaaggtgtttttggatggtataggggatgataggaaacaacaacaaggctcgatagggagacaaaagaggaaaatcaaccctccaaagcacctcagagattttatgtaa

SEQ ID NO: 44020 - DNA, 393 bp, Glycine max
  Peptide Sequence Number=SeqID_160798
atggcctttacttccattgtgaaattaatatctacaggtattgtgttgacatcgcaactcagcaacacggatgttgtgttctgcaaagatgcattagccattcaaatggggagtatcaagaaaaaagcaagagtcttagctgttgttataccaggtttaacatctcaattgagtcccacaaagccatttctcgaaacagccctcggaggtgatgacggcgatgcggggagtggagctggagagctcgggcttgcgattccactagaggaggggaaagatgggagaatgggggcggaggaggaatgcggagttaggggcggtggtggcaccgggaagaagggagaagaaaaagtgaaggatgatgaagaagaagcacagtggttgagtgaatga

SEQ ID NO: 44021 - DNA, 402 bp, Glycine max
  Peptide Sequence Number=SeqID_160799
atgtattggacactaacatatcacatttcactagatggagcagcagaggcctatgattttctggaatcccacgagatgatgtcatgggctacagcttattcaagcattgttgtcaaacctcatttagctccagacatggaaacggaacaacattctccacaacaaagtccactagtggttgccaacatgcatgatgaaggactaacatcacatgctcaatcatatgaattcatgccacaacctcatcatcatcaagaagattataggtacaatttgcagttcttcagtgcaagcagagaagactttatgagaaatctcatgggtacaaatcttcgaacactggagtctccttatgcgtacttgcaaaatatgcttgtatctttgtttgcatcctttcactaa

SEQ ID NO: 44022 - DNA, 450 bp, Glycine max
  Peptide Sequence Number=SeqID_160800
atgattcttggtccaagagacaataaactcgagagagaggtttgcccagctgaagatttcacgatcaaactggatgaaaggtggtatcacagtggcaaattccaaaaattacacatgtcttgttcttatgttgttgctgcttgtaagcatgctcattatgagtacacaaactacataagtcttgtgtatatgttggaaagtgtcttcaacgtatacacaagattgtttagagaattgcacaatgaagcctatttgccaccatgtcatgcgccaatgatatgccccgacccagaaaagaaaagaagtactaaggttcgtcctgtctcctcttgtatccacaccgaaatggatatccaagaattgggtcaaccaaagttgtgttccatgtgcattccaggtcattcaaagaaaaattgtcttcactatgtaggctcaagccaacaacattga

SEQ ID NO: 44023 - DNA, 252 bp, Glycine max
  Peptide Sequence Number=SeqID_160801
atggtacttatccaatggcaaggttttccccctgaggaagccacttgggaaaagtggttcacggtgtctaatgtgttgcaccttgaggacaaggtgcatttgtcaggagaaggtattgatagcaatcagggtcgcaacccttcacctcctggggaactagaagctgaattccaccaagaggagataccagcccaagaaggtaggcccaaaaggatcaacatcagacctggatatctgaaggatttcgtgtag

SEQ ID NO: 44024 - DNA, 405 bp, Glycine max
  Peptide Sequence Number=SeqID_160802
atggcctgcctggtgaccaaaagggaatctacagccacgttcggtgaatggatgaaggtattgtacgaccattccgccaatgctaggaatttgtaccaatcagaaggacgggcatggacgaacgatcataggtactattcgaggatgcggttcatgacctttgtctggcagtcgaattggggctgtgataaatctttccaaatggcagaagggatgagcaatggcttgtttaacaaacagcttgacatcggaaagcaaagtatcccaagtgaaattggctttaatacgatgagctatttttgtgaccccgaaatggccgccgagaggtgtactatgaaactcatgcgtaatggattgaatgaaagggttgtcactgttaagccatatgctccctttatagaataa

SEQ ID NO: 44025 - DNA, 474 bp, Glycine max
  Peptide Sequence Number=SeqID_160803
atgacgaatcttgatccattgttaggtgcccacttacccaaacgaactcctttgccaatggcgcctcccaagtcatcgacttgcaggggcgcaacgagggtggcatatgaggctacccttgatggagacaccatggttgtgtttgtgaaagggtcaaatcttcagccacacaagatctcgaatccaacccggatccggtgccatttcgagctgcaaagtttccgcaaagacaatgcctttttacttaccacgagaattttttctatggctcaagaagttgtgaggtgtatgttgccacagagcataaggaataatcctaataaggctcaaggaattttggttactgtaagttatttgggtggtaatgtgaggcacccgtttcgtgttcttgtgccttctatggctagggttagtagccctagtggtggtggtagagttcagaagaggaatagaaaggatcttttgaatgtttga

SEQ ID NO: 44026 - DNA, 441 bp, Glycine max
  Peptide Sequence Number=SeqID_160804
atggccgaccataccacccgcaaaaccactacagacagactcaaggaggccatttctcagctcaccgtccatcacgactttttcgtctctcaacactctaaccttgcttccaaggggactccagatgaggaacacattatagtggctttgttctacatggatggaccagctttgagttggttccagtggatgtcctacaacgggttcatcacctcttggccagacctccttcaagcactggagtcatgctttgctccaaccttttatgatgacccaaagggtgcgctcttcaagttgtctcaatgtggctctgtcattgattacttgaaaaagtttgaacgtctcgctaatcgtatagttggcttgcctccacccttccttcccaactgcttcgtttctggcttatcgcaggaaatctgccgggaagttcaagccctctag

SEQ ID NO: 44027 - DNA, 1098 bp, Glycine max
  Peptide Sequence Number=SeqID_160805
atgaatgctggcaaaaatgccccaacaccgaggcaggcaagaccacaagaaggttcaaccatgcatagcaacgccccaatcctccatacatggaccataaaatctcactccacgtttggagcgacactggaatgtgtgaaagttaagcactttggctcgtgggacaagacgcttaaggtccatggatgggactgtgaagatatggatgagggagaacgcgaggaagaagccaaagtatctgttggaccgtgttttgctgattcaggaaaacgccgttatggcgctggcgttaagcgtttggccacagtggtttattgcagttcctttgatgggttggagaatttctgggagcgtgaccagaagggtgggttctcacacggtgttgttgagggttggggcaaagctaaagagctcaagcaaacgattgcaccgctgaattacaaccagagttcttggagaagtactttgaggaagttgaaggagaagaatggggaaatggatgagaagatcagtgattgtcttctatctaaatctttggcgcaacaactcggtttaggtttaagggtagaagacaatctcaacgacgtcgttttgcagatgggagagagccatcttcatcacccattgcatgcagcaggtcattatctcaatcctcaatacttttatggcaatccaagtcttgaaaatgatccagaagtgatggagggattgtataagtgtgttcaaaggcagaggtctaaactgcatcctagtaagagagttttggatcaacagttggtatatatcaaatataaccaatcactcaaggagcattttgattgtaaaaatgtgagagattccattgtcttgactgaggctgatgagagtaatgaatggttgttaggagaaatgaccaataaagacgaagaagctgcccaagaagatgaattagagtttgatgatttaacttggggacatgtggaagctgcaactggggttggggagcctattggtgatgaaattggaagtgaagaggaggaggatcaaatctacaatggtgcaagtgatgaagataaggaggcaatacttgaccttgcagctgaagatgatgacatttaa

SEQ ID NO: 44028 - DNA, 408 bp, Glycine max
  Peptide Sequence Number=SeqID_160806
atgaactatagcacactgatgttgcagaacgttatgcggtttaaatgctctgtgaattacccgtacaaagccctgtaccccatctttcaattttatcgatccctctttttccccgtttatgttaacaaccagaggtccaaacagaatgccttcctcttccttcatcgatctcccaccaaaacgacaagctctcactgcgcgtcgaggtggacaatcgtgaggaagatgagtcgtcgccgatctccgtcttcccaaatcaaagctgtggtggtaggtacggtggaggggggtgccgacggcggtggaagatgctacgattgtgggagtttaggaatttccccaaagattgcccgactagtgctcgttaaatttgctgttagggcgttttatgttttgcagttgctttaa

SEQ ID NO: 44029 - DNA, 174 bp, Glycine max
  Peptide Sequence Number=SeqID_160807
atgaagattttaatgttatcaagaagaatttgcttgagaaagggggagaatgtaaatcatgcaagctttgctgatgtcgagaagatatcacatgtttgtcattatcaaaaagggggagaatgtaaatgtttcactaattgggctagtggccgatcaggtggagaggttgcttga

SEQ ID NO: 44030 - DNA, 204 bp, Glycine max
  Peptide Sequence Number=SeqID_160808
atgtgttttaaagacttttgggcttctcagcttatgaaggcgtgctcagtgagcctcgctgagcacgatgtgagaagagacaatgtcctcgctaggcgagctgactgcgtgcaaagcgcgatgctctctggctcaacattctctagggttttgttttcacttagtgagtctggctccctcgctaagcggatgagccttgcttag

SEQ ID NO: 44031 - DNA, 237 bp, Glycine max
  Peptide Sequence Number=SeqID_160809
atgaagaagatccaaggccaacaagctccattcatctttgtgacgtttcggagtgaaatgtgcaaaatgttcaaaagaggggcaaaatgggcattttttggacattttccagcccttgggcccactagaagacttaaaggtgaagcaatcagtttgtctaggttgtcattcattgtgtcggacgcctggggtgctaataccttcccgatgcataaacgactcccaaaccttgattaa

SEQ ID NO: 44032 - DNA, 315 bp, Glycine max
  Peptide Sequence Number=SeqID_160810
atgtcacggttacttgaaatgaatgctaatggaaatctttgttcatcccatagaggtgccttcatcttttggttgattttaaacttctctagattgagaggaaatggaggtgggcactgcttggatgtagaggatggacatcttcacaatggagataaaggagcatctagtgttgtttcactgcttgatgatgaaggaggagagggaggagcccattccttttcaactatcttgggattagccttggttgctctggtgttgttctggttaccttggctttctcaggaacaagggatgcttgcttttgagcattag

SEQ ID NO: 44033 - DNA, 432 bp, Glycine max
  Peptide Sequence Number=SeqID_160811
atggagaatatgtttatgcaactaatggaaatatcccaagctagcttcaaagtcaatcaaaactcaattcaaaatctggaaattcaagttggcaagagtcactccatggaaaattgtcgatgggagcaagagttacaaccttacaatcaatatgaagaaaaaataatttctaatcttgaaaatttgttgatgcaactcatggaaacaactgaagctactcaacacgcaattaaaaatctagaaattcaatttggtaagctagcaaaagaagtggataaattttttgtcacaagggaagaaaactttgtagaggttgaagctcatgaggaaagtcttctagaagagcatgattcaagagaaaaagatgaagaaaaaagtgagaagagaatacaacaaccatgggagaagtgctcacaagtagaaattcaataa

SEQ ID NO: 44034 - DNA, 555 bp, Glycine max
  Peptide Sequence Number=SeqID_160812
atgggctcgaaatctaccctaaggctcatgagaaccctagggccttcccttggatctctagccaatctacttggagtcttctacccaatgcccttgcggggtaggattgcatcaccaacgtataggcctgatataatgtttagtgtttacttatgtgcaaggtttcaaaaagaaccaaggaaagtccttttatctgttattaaatgcatttttagatatcttattggaacttataaccttggtctatgctttaaaagaaggaaagattttggactcacaagctactgtgatgttgactatgctggagataagcttgaaaggaagagtaatagtggaagttgtcacttcattggtggcaacttgagaaactctgagttcttggacaacaaagccattgtgtccaaggttctaggggttattgtgactttgtcaagcaactccatcgccaaggctattggatgtctccatgaaggcaatgcctaccatgaaggttgggagaagacttttgagctctcaacaaggaaaatgcagaaaaagttgctaaccagaaaatga

SEQ ID NO: 44035 - DNA, 375 bp, Glycine max
  Peptide Sequence Number=SeqID_160813
atggctattgcattattgatagagcttttgggagaggacaatgaggacgcatttttggagacgaaacaatgtagagggagacatgttctcctatcttggttgcaagtcatttatgcagataggtgttttgaaaatacaaatcaactcaatggttatgtaactctattacagacattttcctactatcgggtagaggaaggtgaatggaaaatatacagaggaattaccatgagccactcattggacagttggcagaagattattatggtactcatggcgaaaatgatagtagaggacgaggtggcagaagagtttagggtagctagggaagacgtggacgggcttagagtttattgtaaaaacttattgacatga

SEQ ID NO: 44036 - DNA, 264 bp, Glycine max
  Peptide Sequence Number=SeqID_160814
gaaagacgtgtagttgtagatgagaagcaagagatttacaaaggtcccgaagatgttgcacctgaagatgttgtgtttagtggtggacctaaggacaaattagtccttactgaatatgtcaaacacatggcttgtcaactctgggatgacttggatttaggattacctccattgacagaatgtggttatgaaatcactgataaggaacttttatctactttttctaagaggtggcatcgtgagaccaacacacctttcatttga

SEQ ID NO: 44037 - DNA, 189 bp, Glycine max
  Peptide Sequence Number=SeqID_160815
atgattggtcgcatatcatttggctcttacttgcaggttagctcgcctgggcgagcaacccctgtacgaaaatataaaaggggtggagggggaacgttttcttcacccgaaactcttccccctcacttcaaaaaccccccaagctcacgggaactacgagaacagcagcccctaagcttccattgttga

SEQ ID NO: 44038 - DNA, 297 bp, Glycine max
  Peptide Sequence Number=SeqID_160816
atgctcaatggaacgccgcggggcttctccatgacaagcacacgttgcgttcgagtcgtatcctcgaaaaaatggagattgaggaaacctagcaagggttatggctaccattgcattatcgagtggatatgggagcaagtcagcataggacaccggaatttgggtgaattctacaggtgggttttgtggtttgatttagggatggcctttatggataactgggtggtgggtaaggagatgggttgttgttgggttggtgggaaacttggccatataggaatggcagccacagcatag

SEQ ID NO: 44039 - DNA, 483 bp, Glycine max
  Peptide Sequence Number=SeqID_160817
atgacaataactccgctcccatactcattgagagtcgacaacctcgtcatgtacatgtctctcaatccatgggggaggcacatgaaaattctccaccacaatctagtcgacttcgagccttgcctcggatatgccactgaagggcaagcagttggtgaaatgggaaagttggatcatctagagaaaaggctcagggccattaaaggaggtgaagattatgcctttgataacctagaagagttgttcctagtacccaatatcatcacccctcccaagttcaaggtgttggactttgacaagtacagggggactacttgccccgagaaccatctaaagatgtattgtcggaagatgggggcatacgcaaaagataagaaattgctgatacattccttccaaggaagtcttactgggggtagctgttacttggttggaaccttcccgagcctatgcttggaaggacctaatggttgccttcgttag

SEQ ID NO: 44040 - DNA, 1092 bp, Glycine max
  Peptide Sequence Number=SeqID_160818
atgaaagccgttggggccgagcaaccacagatggtactcattctccgccagccagtcgtcgctgaccgccttacccgcctcgacggtaaaacggcgcgggatctgcgtcagatcccgccgatcgtagacgtgaaacaccgctccctgctcgccggtattgaacaggttcagcgtcacgcggcgctgctcggccgcgacggtggcttcaacgtgcagctggtagggcaacgcgcgggaagggcgtgccaggcggcgttgatggggcaaacgctggtgggagggggatggcagcggcacctgcggcagctgttcctggcgcaggcgcaggccgtcggcggcgtggcggctggtggcgggcaggctcggcagcgcttcgccgttaggatcgacaaagttgaacgccgaggtgagatcgccgcacaccgcgcggcgccaggcgctgatgttgggttcatgcacctgaaagcgcttttccaaaaattgcagcaccgaggtgtgatcgaagacctgcgagttgacccagccgccgcggctccagggcgacagcaccagcatcggcacccgtgggccggggccgtagatgcggccgtccggcggcggttgatcctgcgaaccgggcggggccacgtgctggaagatctcggtgtcgaacggcacggtcgatttaccggcgaagctgccgtcttcgcgcagcgacggcgcggaaggcgaaggcatatggtcaaaaaagccgtcgttttcgtcgtagttgaccagcaggacggttttactccacacctccgggttgtcggtcagcgcgttgaggatctcttgggtgaaccagccgccctgcaccgggctggagggatcggggtgttccgaataggccgccggcgcgatgatccagctgacctgcggcagtttgccctgctgcacgtcggcgcggaatccggccagcatggcgtccagatcgttgccgtcggcggccggcagggtgttgccgttgcccttgtacagcggcgcggcctcgttgagcgcatcgctgtaggtcacgaaggcgttgaagtctttcggcggccgcgccggattgcccacctgaatgctggcggcgcg

SEQ ID NO: 44041 - DNA, 255 bp, Glycine max
  Peptide Sequence Number=SeqID_160819
atggtgttaaatgccagttatagtccaaagctagcctctagctcgccttggtccccaaattacttcagggtgaaggaaccagctagcctgggcgagccagttacttcaggagtaagcatcagctcgcttgggcgagttgccattgacccaagtgcccattttcctataaataggcgtgcaagggaggctgaggagaggatccaaggttcagaagtggagggaattgagagaactaagaaagaagaagaagaatga

SEQ ID NO: 44042 - DNA, 966 bp, Glycine max
  Peptide Sequence Number=SeqID_160820
atggctaacaaatacaactttgttgctgaaattactgctaaaaaaggattgctggaagatattggaaggcaaagtttattcgatccttttttcaaggttgctgaaaatggtggtatttatagaacattccaccataaatataagatttcttttcaatactctactaaggttacattggtgcaaaatgttgatgttcctgataagccatatgattttgtacctataagtgatattgttggtggtggttatgatagtgactatttattaggcaaagttcattcaatccactttttcggggttgctgaaaatggtggtatttatagagcattccaccataaatataagattgcttttcaatactctactaaggttacattggtgcaaaatgttgatgttcctgataagccatatgattttgtacctataagtgatattgttggtggtggttatgatagtggcatccaccataaatataagattgcttttcaatactctactaaggttacattggtgcaaaatgttgatgttcctgataagccatatgattttgtacatacaagtgatatggttgatggtggttatgatagtgactacttattagatgtgatggcaatgttgactggtgtgggtattcaacatgaaaatgaaagtaatggtagaaagagcaagatgaatattatccaattagaggctgatggttcatttgtgggtgaactaaatgcttttctggcatctggagaagttgacaatgttgtggccattgttaaatttgccaaagtcaagagttatcaagtggtgtacaatgcagattttgtggctaccaaggttctagcaaagaggatgcttcagaatatggattcaccatgtgtaagtttgagtcaacttagtgatggtctagttagtgcgaaggttgattttcttgatgttacacaaatgaaaaagattgaatggattaaagattgcgag

SEQ ID NO: 44043 - DNA, 315 bp, Glycine max
  Peptide Sequence Number=SeqID_160821
atggttagaggcattgtcaaaatcttgataattaacatgaactactacccaccatttccaaatccagagctcacagtaggtgtagggcaccactcggactttgaaaccattacattgtgtatatacacggtaaagaagattgggatagtttacaaaatgggaaaatgtgaaaatgacgaacaggaggcaacatgtagccatacaaaggggagtgcaaatgataacatcactacgggtactcataatagggttggcctaatcactacattagagaagctaagggagatagtgataagtaaggaggtggtgctatga

SEQ ID NO: 44044 - DNA, 939 bp, Glycine max
  Peptide Sequence Number=SeqID_160822
atgagaggcactatcaatgagtcaatctcttgctttctcataggggtggacccttgggtactagaacctatttcctttagaggactacatgccctcacctttagaggactacatgtcctcgccatcagagggctgcatgtcctcacctttagaggactacatgccttcacctttagagtactacatgtgcttgcctttaaaggactacaagtcctcgcctttagagggctacacaccctcgccttagaggactacatctcctcgccttcagagggctacacgtcctcgccttcaaagggctacatgccctcgccttcagagggctgcacgccctcgccttcaaagggctgcacgccctcgccttcaaagggctacacgtcctcacctttagaggactacacaggactacacatcctcaccttcagaggactacacgtcctcgccatcagagggctgcacgccctcgccatcagaggactacacgtcctcgccattagagggctgcacgccctcaccttcagaggactacacgtcctcgccttcagaggactacacatcctcgccttcagaggactacatgtcctcgccttcagaggactacacgtcctcaccttcagaagactacacgtcctcgcctttagagggctacacgccctcgcttttagaggactacacgtcctcgccttcagaggactacacgtcctcgccttcagaggactacatgccctcacctttagaaggctacaaatcctcaccttgaaaggacttcgcatcctcgccttcaaatggctacatgtcctcgcctttagagaactgcacgtccttgccttcagaggactatatgtcctcgccttcagtggagtacatgtcctcgccttcagagggctgcacgtcctcgcttttagagggctccacatttgcgccttcagaggactttag

SEQ ID NO: 44045 - DNA, 516 bp, Glycine max
  Peptide Sequence Number=SeqID_160823
atgaaaaatggtgggatcgaagtgggtctaaaaagaggcaaatttaatcatcctgctttgatgaataagaaaactggggcaaatgaagaaggtgaggatgagggagaaacccatgctgtgactaccattcctatacggccaagtttcccaccaacccaacaatgtcattacttagccaataacaacccttctccttacccaccacccatttatccacaaaggtcatccctaaatcaatcacaaaacccaccttccacacaatcaacaacaaaacaccaccttaagcacaaaccaaaacaccaaccaagaaatgaattttgcagcgaaaagcctgtagaattcaccccaattccggtgtccaatgctgacttgctcccatatctacttgatactgcaatggtagccataacccctgctaggtttcctcaacccctccatttttccgagggtacgactcgaacacaatgtgtgcttatcatggaggagccccggggcattccattgagcattgtatga

SEQ ID NO: 44046 - DNA, 273 bp, Glycine max
  Peptide Sequence Number=SeqID_160824
atgggtgcgaataaccataagggtatctccgcgtatcatgggtgcagaatgaccaaacttggtctctgcttgtcatcgggcccgccgcctctggatgacaaaagggtgcggataaccgtaagaatgaccaaacttggtctctgcttgtcatcgggcccgccgcctctggatgacaaaagggtgcgaataaccataaggtatctccgcgtatcatgggtgcagaatgaccaaacttggtctctgcttgtcatcgggcccgccgcctctggatga

SEQ ID NO: 44047 - DNA, 295 bp, Glycine max
  Peptide Sequence Number=SeqID_160825
atggagtggttttttcggatattgcacccattcgtcacgcggaccgaggagactgctgcgccgagacatccgcctccccttcatcataaggagttcgtcaagccacccatccccgaggtttcagtcgcgaccgatctccctacgcattcagtggttcactgcgaaggatgtcaggggatggctcaagatttaggagcgattgttgaggatttggagcgggtcatcaacctcaggatggtcactgagggcactgacttacatgacatcatgactcgttgtctgaggagagctagag

SEQ ID NO: 44048 - DNA, 312 bp, Glycine max
  Peptide Sequence Number=SeqID_160826
atgatatttgcagatttctttaaaaagctgcaagatgcagtatcagatgttaagaatgagatagcacaacatctggttaatttggaagtttctaactttagcatggctccggtcaaggttagctggtgcaaatttgaagtgactgttgactctcctaaacaaataatagtgtggaggagacctgaaaggctgacccgttttactattgttcgtaaacttgatgggattatatttccgatggggttcagcaaggaggttacagacagaaacttacaagcgggttcaaatattctgtgtgctgaaagcaggtag

SEQ ID NO: 44049 - DNA, 897 bp, Glycine max
  Peptide Sequence Number=SeqID_160827
agggttgcgtatcctcaccttcagaggactgcatgtcctctccttcagaggactacacgtgtcgccctcagagggccacacgccctcatctttagaggactacccgtcctcgccttcagagggctgcacacccccaccatcagagaactacatgtcctcgccttcagaggactacacgtgctcaccttcagagggctacacgccctcgccttcagaggactacacgtcctcgccttcagaggactacacgtcctcgccttcagagggctacacgccctcgccttcagaggactacacgccctcgcctttaaaggactacacatcctcgccttcagagggctgcacgccctcgcctttagaggactacacgtcctcaccttcagaggactacacgtcctcaccttcagaggactgcacgccctcgccttaagagggctacacgcccccgcctttagaggactacacgtcctccccttcagaggactacacgtcctcgcctttagagggttgcatgccctcaccttcagaggactacatgtcctcgccttcagagggctacacgtcctcgccttaagaggactgaacgccctcgccttcagagggatacacgcccacaccttcaaagggctgcacgccctcgtcttcagaggactacacgccctcagcgttagaggactacacgttcttacctttagaggactacacatcctcgcctttagagggttgcgtatccccaccgtcagaggactacatgtccttgccctcataggactacacgtgtcaccttcagagggccacacaccctcgactttagaggactacccgtcctcgccttctgaggacaacacgtcctccccttcagaggactacacgcccccacctttcagaggaatacat

SEQ ID NO: 44050 - DNA, 420 bp, Glycine max
  Peptide Sequence Number=SeqID_160828
aatgtgttcaccatcagaggactacacgtcctcgccttcataggactagacgtcgtcgccttcagaggactacacgtcctcgcctttagaggactagacgtcctcgccttcaaagagctacacgccctcgccttcagggagctgcacgccctcgctcgtcttcaccttaagaggactacagaggactacacatcctcgccttcaaaggactgctcgtcctcaccttcagaggactacacgttctcgccttcagacgactacttgtcttcgccttcaaaggactacacgtcctcgcctttagaggactacacgtcctcgccttcagagggctacatggcctcgccttccgaggactacacgtcctcgccttcagaggactacatgtccttgccttccgagggtgacatgccttcgccttga

SEQ ID NO: 44051 - DNA, 294 bp, Glycine max
  Peptide Sequence Number=SeqID_160829
atggtagccataagcctaactaaggttcatcacctccatttcgccgagaatacgactcgaatgcaacgtgtgcttgtcacggagaagccccggggcattcccattgagcattgtaaggccctgaagtgtaaggtgcaaggtctaattgatgcgggctggctgaaatttgaggagaattgcgtgattttcaactttcaccggaattgggtgcaagccattggtctatttgctcaagcgacctgtgaccattcaatcagagattactcgtcttgcacattggtggggctgccgtaa

SEQ ID NO: 44052 - DNA, 447 bp, Glycine max
  Peptide Sequence Number=SeqID_160830
atggtatggtcaattgctagacatcccaagtcgcttcaaactaagcatgttgatgtagacatgggggatagattagaagacatgattcccaattttgggctagagtcttttcaacaagtacatgctcctttgtatgatacattacaaaatgatttgaaaaatcctctatatccagggtgcacaaagttcgcacggttgtcagtggtgttagatttggtgttgcaaaggatgcttccaaaccaaaacacattttcgataaatcactataaggcgaagaatatattgtgtcctctgggtatcgagtatcgaaaaatgcatgcatgccctaatgattgcatattgtacaaaaatgagtttgcagaaatgcataagtgccccaagtgtgtggtatcacaatacagagtgaaggatggtgatgcaatcctaccccgcaagggcattggatag

SEQ ID NO: 44053 - DNA, 756 bp, Glycine max
  Peptide Sequence Number=SeqID_160831
aggtggcacggtgagaccagcaccttccaccttccggtaggagagttgacaatcacattggatgatgtgtcgtcactccttcatttgcccatcactggcgcattgcacagttttcatgctctttctatggaagaggccagatttttgctgacaggtttgtttgaggtgtctgccgaggaggctagagccgaggaggctagagccgaggaggctagagccgagacagcactaacacgtagggcatatgtacgactaggatgggttcgagacatttatgagacgagatgtcaggtccggcaatggattgtagcagctcatgcttatctgctgcaactggtcggttgcactctttttgctaataagagtgcaacatacgtgcatctggttcaccttgacgcttttcgggacctcgctcagagtggtggttatgcttggggagttgcggcgctgtgttggatctatgagcacttccctactgtgcaccagtgcgtgatagatgatacataccaggagacgtccccacgtgcttcccggtggttgacgtcgaagacgcacatgaacggaatcactggagcaccttacagggcacgttgtgatgctttgaccgtcacagatgtgtcctggttgccgtacacggagcatcggggggtcagggcctttgaggtgatttcatcattccagggtcagctaagatggggtcctatggtggtcacagctctaccagagagggtggtacggcagtttggttacatctag

SEQ ID NO: 44054 - DNA, 534 bp, Glycine max
  Peptide Sequence Number=SeqID_160832
atggtccagccacggctgcaggccgtcgcgcgtcaggctctcccaggtgctgaagcgcatctccgccagcaggaccgtactgagatagcgcgggcgatcctcgccgctgctgccaatctgctccagctggctggcgatctcttcaatgcaggagtgcagcgagcgcggactttcgctgcgcaggatcagcatttcgttgaccagcggcggcatcagttgctgcttaaagatggcgttgtaggcctcgcgcgccgacaccgcgcgcagcaggctgtcgaggcagtaatattcccgtaccgtgtcgggatgctgctccagcagctgctggttaacgctcagcagccgcgcggtgccgtcgctgcgctccatcagcgtgccaagccggataaaacgcagcgcatcgccgcgcagcagcgtgccggacatcgcgccgcgaaacagatgcgaacgctctttcacccagtcgaagaagctgtcggcaccggccggcgagataccgcggcggcgcgtgttgcgcatctcaatccacgtcga

SEQ ID NO: 44055 - DNA, 147 bp, Glycine max
  Peptide Sequence Number=SeqID_160833
atgtctgatatgccttttagaggcttgaaaagtgcaagaaaacgaactgcgttttctgcattttatggaaaacgcgatgaactcgctaagcgttctctgaagaactcgctaagcgcgcctaccgcgctaagcgagttcatcttttaa

SEQ ID NO: 44056 - DNA, 168 bp, Glycine max
  Peptide Sequence Number=SeqID_160834
atggcaaaacgtagcagccgcaaaaagggatacgcgcaacaacgaagatcctatcgacgatacaaatcggtggcgacagtgtggctgcaacgtccagctattccaaacaacaaaaagttgtgggatcagcttcctctaccaaggagaaggacatctagcattctataa

SEQ ID NO: 44057 - DNA, 345 bp, Glycine max
  Peptide Sequence Number=SeqID_160835
atgagccaggttgatcaacatctatcaactcaaccgcagccaagtgcacaagaactcatgcctaataataagtttacaacaaatgagatggaactaaagaccttgaaaaggaaggcttcaaatattgaccttgatttgaatctatcacttaagttaaattcaagggtcagtgctgagaaccaaggaagcatggtggtggaccatgaagttgttgatagcaatctatcactctctttgtgttctcaatcctcctcctttagcagcagcaggttgaaaaaagcacaagatcattctaaggagcaaggagaaattattagagccagtactctggatctgactatatga

SEQ ID NO: 44058 - DNA, 249 bp, Glycine max
  Peptide Sequence Number=SeqID_160836
atgagtgagatagaagaggtgcaggaacagaagaaggctgacatgaaggccatgaatgccatgaaggagaaaatgacaatgatgatagaagcaaagatgagcataaggaaaatgatggaggttaacactgctatagttgttgctgcaagtactgctactgagatggacccgattcacctgtctgatttcactcaagtgggtcatccaatctcagatgtagtaggtcaaggaggtgaggcagcgaaaaat

SEQ ID NO: 44059 - DNA, 636 bp, Glycine max
  Peptide Sequence Number=SeqID_160837
atgaaagccttcaataagctgtccgctgttttgttgctctccgccggagcattttgtcaccaggcctttgcagataacgctgtcttcacctcaatggatgacccttctacggcaaaaaaaccgtttgaaggcaccgcgtcagccggttacctggcacagaccggtaacaccaccagctcatcgctgaccgcgtcaaccagcatgacctggtatcagacctcaacggcgtacagcctgtggggtaacgccgcgaatacctcatccaacgatgagcgctcgtcggaaacctataacatcggtggccgtagccgttacaacctcaacagcgctgactacctgttcggtcaggcgagctggctgagcgaccgcctgaacggttatgattcacgcgatgttctgaccgccggttacggtcgtcagatcctcaacggtccggtgcactcgctgcgtgctgaattcggtccgggtgtacgttacgatgacttccacgatggcggccacgaaaccaaagcactgggctacggcgcgctgagctatcagtggcagctgactgacaccaccaaattcatccagggtgtgtcggtgctgagcagctttggtgaagacaccacgctgaactccgaaaccgcactgcag

SEQ ID NO: 44060 - DNA, 561 bp, Glycine max
  Peptide Sequence Number=SeqID_160838
atggaggtcatgatgagcatgaagaagataatggaagccaatgcggttgtagttgccgctaccagcgttgttgctaaggtgaacccaacacccccatttgtcctcaaccaaatgaatcctccaaccccaggtatggtaggaaaagatttaggaagtacgggcggcccacatgacgtacaaattcaaaatgaacacgccttcccaccatatggcttacctcccaactatacaccacctaatgtggcatacactcctggtgaggatgtcaataactccgctcccatactcattgtgagccggcaacctcatcatgcacatatctctcaacccatgggggagacatatgaaataccccaccataatctagccgactttgagccttgccttggatatgccactgaagagcaagcagttggtggtatactcctgcaaaacactttggagggccctcaatttcacccccaaccacaacctttgcattccacaacaggtaaaatccctcctattatggaagaaatgggaaaagttggatcacatagaggaaaggctcagggccattga

SEQ ID NO: 44061 - DNA, 264 bp, Glycine max
  Peptide Sequence Number=SeqID_160839
atggttgctaaatccgtcacaaagcactattcacagcaaaacacaaaaactgaaacaggggaagcgctgaatagaaaaactaaaacaaaacaccacactaatcaaaataacaagacactgaacaacactgacacaacactaacacaacacgaaagcataaaacaactaaatataaaacacgaatcactagctattatgaacctttggacactgctccctggcaacggcgccaaatttgatcgaggtcgtacccgaatcaaataa

SEQ ID NO: 44062 - DNA, 165 bp, Glycine max
  Peptide Sequence Number=SeqID_160840
atgtctcattttcaaagggtttttcaaaggaagtgtaaaaaatccagtaatgttcttctctgtgcggtggtccggtggcaagcaaatgatgctagtggcggtcacccgtggtcagtggtggtagaggttgggggtgttgggagagggtttagggaagaagattga

SEQ ID NO: 44063 - DNA, 462 bp, Glycine max
  Peptide Sequence Number=SeqID_160841
atgaaagcaccaaaatgtcaaaagaacaagaaggcctcatcatccagagagcaagtcttgagaagctcatccaaagcccttaaagttgataattcctcagatgaagaatctgaggaagaccctgttgaagatgaacttgccttcatctcacggaacattcgcaaaatgtggaaaaacaatggtggatccagatgtaataattccttaaaaagggtgctcaaggaaaagaaagatagatacaaaagctccataatatgttatggatgcaagaagcttggacacttcaaatctgagtgcccaggattggagaaagctcaagacaagaagaaacactacaagaccaaagacaagaaaggtttcatgagcacttgggaagatctagacaactccttgtccaaagaagatgaagaagaagccaatctatgtttgatgacagatacatcttctatagaatctgaataa

SEQ ID NO: 44064 - DNA, 459 bp, Glycine max
  Peptide Sequence Number=SeqID_160842
atggctgattccactcattccaaatctcacttggattgtatcgaggaggctattgcaaagcttacctcaaaccagctctcattaaccgcaaatcagaactccatgactactaagcttgatgagcttctacagaaaatggcattagagacacgcttcacgccttctcaatataaggatccaacaggaggaaaagttccacgacctccaccattccgctcgtggaagacacccaaaacaccacccaccttttcccttaaacgattatcacttgaggaactggcgaatcgtcgtgagaagggcttgtgtttcaattgtgatgaaaagtatcaccgtggccataaatatgcattcaaggttttccttcttatcgcgaaagaggatgatgagacgcaaacagacccatccttttcggatcctcaactcgacactccagatgaggtggtctctcctcaagtctag

SEQ ID NO: 44065 - DNA, 129 bp, Glycine max
  Peptide Sequence Number=SeqID_160843
atggttcatgttgaagaagatagagacctaaatatggttggctggactttgtggagtgtcctaagtgggaaaagtggggtccttgatatgaatttggtggagtgggaagtggtttgtctaggagactag

SEQ ID NO: 44066 - DNA, 2205 bp, Glycine max
  Peptide Sequence Number=SeqID_160844
atgaaacgcctaaaacaacggctgaaagtgtggaacaaggatcagtttgggcacactctcaagaaagtcaagaagattgaggctgacttgaacaaattggaggaggaaactagtgacagacagttagatcctcaagaagcatccaaaaggaagcaattacaagaagctctatgggtagcagctcaatctcatgaatccatccttcgacagaaggcgagatcaaggtggattagagagggggactgcaactcatggtattttcatctaatgctgaatgcaaatcgcagacataattcgttgcaaggaatcagggtggatggagattggattgaaaatccgggacaagtcaaagatgcagtacgacagttcttcttgcacagattccatgaatctgagcaattcagaccccggctgaatggaattcatttccagtccatagatacttcacaaaatgagatgttggtgggctgcttccaagaggatgaagttaagcaggctgtgtgggactgtggaagtgataaaagtccgggcccagacggactaaaattcaagtttattaaggaattttggcacctactcaaaccagatgtccttcggttcttggatgaattctatgtaaatggagtttttccaagagggtgcaacgcatcgttcctaaccttgattccgaagaaggctgatccacagttgctgaatgattatagacctatttcactaaaaggtgtaatgtacaagatagtgtccaagttgttggctaagagactgaagaaggtgatgtcattcattattgatgagagacaatctgcgttcattgcgggtagacatatgttgcacagtgtaatcatagcaaatgaggtggttgaagaggctcatagaaataagaagccatgcttgattttcaaagtggattatgagaaggcctacgattcagtatcatggaatttcctgctatacatgttgaggagaatgggattctgctccagatggatacattggattgaggggtgcttaagatctgcctctgtatcagtgttggtgaatggtagtcccacggcggagtttattccccaaagagggctcagacagggagacccactggcccctctcctgtataatattgtggctgaaggcttgaatggcctgatgcgagcagctattcagaaaaacctgtttagaggcttccaggtgggtgctaatagtgtggaaatcagcattttacaatatgctgatgacacaatattctttggcgaggcgacaatggagagtgttagggcaatcaaggtcattctaaggagctttgaactcgttgcgagtctcaaaataaattttgcaaagagtagtgttgctgcaatccgaatgcttgaccagtggagccaacaggctgcttccttcttgaattgtagtctgatgtctatcccctttgtttacttgggtatcccaattggggcaaacctaaggcgatgccagctatgggatcctattatcagcaaggtccctagcaaagtggtggacaagctggttagattacaaagacgattcttatggggtggcggagatgatcaaaataagattgcttggatcaagtgggaaacggtgtgccgctctaaggaagaagggggactgggcatcaaagatatcagaaacttcaatcttgcgctattgggaaaatggaaatggagcttattctaccacaatggagatttatgggcaaaggtgctagagtcaaaatatggaggttggaggagcttgaatgtagcatcttcggaccatactgattccatttggtggcgggacctaaaacaggccctccaccaccaacagcttgcaagtgcttttcataatggattatcgtggagggttggctgcggtgataagataaaattctgggaggataattggcttaatgatgacatatctttagtagcaaagtatccaagactatattctatttccaatcagcaaaaccaggtcatacaacaactgggagctcacacggattccgggtgggaatgggactttaggtggaggagatcattatttgatagcgaggttaccattgctgacagttttttacatgatattgagggcaagacagttcacccatgtagaaaagatgaatgggtctggagagcggagccaagtggcatatattcggctcacagcgcgtataatctgctgcagggggaaattacagaggaccagtga

SEQ ID NO: 44067 - DNA, 534 bp, Glycine max
  Peptide Sequence Number=SeqID_160845
atgtatccctggcttaattattttttaaaaaaattgttcattctcctctctctcccttcctcccgcgttctgcttcttcctcaccattttttcttcttcctcaagcttcctgaagcttttggtttccactctcccgcgtttcgcttcttcttcgtcaccttcgttcttcttcttcctcaccttagtctaggcttgtctcgaaaaagcttgacccacggtcatcatcagccgcagtgcatttgttccccatcttcatcttcttcgtcggcatttcgttgtgtgaccacgccgccatgggtgttgaccatcctagccaagttgaaagtggtgttgctgcctccgcacgtcggcattgtcgaggtaagcatcgttgcgctgagttcgtcggtgtcgtttgcaacagtggaagttacggatcaagttgatcacttgattcgtaagcttctttcggatcaacatgatgtggaaaagcttatggatcaacttgatctggaaactttgtttacacactttccggatcaagttgatccgtaa

SEQ ID NO: 44068 - DNA, 276 bp, Glycine max
  Peptide Sequence Number=SeqID_160846
atgtcagttgttatttccagacttgcaaggcatgcctcatattttgcatggttgtttgtgagtgggaaagctattgttaatgcttgttcaagcatgactccaaatgatgacaaaggtgatgacaaaaagctcaaaggtcaatcaaagaatgagttcaagatattcaagatagaatcaagaacacttcaagattcaagaggaaagttgatttcaagaatcaagattcaagagatcaagattcaagactcaagattcaagaatcaagagaaggcttaa

SEQ ID NO: 44069 - DNA, 222 bp, Glycine max
  Peptide Sequence Number=SeqID_160847
atggatctcaatgtcaaggatcgaaaccacttcagtgcattggattttagtgataatggaaatggtcaacacattattgaagtggaagctcctttgtatgataccaagcatttagaaaatggcatgttgaagggagtgacttcatcaaaatccacttcatccttcatcttcatagtgatgatgatcaaagactctttcttccttgacattggtggatgttaa

SEQ ID NO: 44070 - DNA, 216 bp, Glycine max
  Peptide Sequence Number=SeqID_160848
atgcttagcgtgagaagagacaaacgattcactgagcgagatgatgacgcattgagcgcacagatgcatggcagattctcctccagattctcccaactcgctaagtgggcattcaatcacatggcacaagtagcatacaatgcttcaaccaacagcttttcacaagatatgcagattttcaaagataggaacatgattattgagcaacacaagtga

SEQ ID NO: 44071 - DNA, 417 bp, Glycine max
  Peptide Sequence Number=SeqID_160849
atggagatagccccccgaaaagagactaaccataaaaataaaacatccctaacctcaatctggacctcaccacccaaaccagcctcattatccaacacacaagaatttgatgttgagattcttgataccccaactcctcaaccctcaccctttttaacacttccaccacaaactcctcaacattcaccaaagttggcttctacccccatgagtaagaaagaagttgatgcattggctaaggtaaagaagaagtcattggcaaagtctaggaagaaggccaagctaaacaagactcttgagcagaaggttgcatcattgcctttatggaagctttgtctatggaagagcataagaaaaagttgtttgaagatacaagattgggtgccttggcaggaaaggtttctaaagaaactctag

SEQ ID NO: 44072 - DNA, 255 bp, Glycine max
  Peptide Sequence Number=SeqID_160850
atggaaggtgctaaaccaatgaaaactcccatgcatgcttccaatcctcggagcaaaggcgaatcaagtaaactagtagatcaggcgatctacaaagattcaaatctcaaagttgttaagaggatcttacattatctagtaagtactacaaaccaaagtttgttctataagaaaaatcatgatttcaggttagcaggataccatgatgcagagtatgcaggagatagagaagaactaaaaagcacaagtgaatga

SEQ ID NO: 44073 - DNA, 354 bp, Glycine max
  Peptide Sequence Number=SeqID_160851
atggctgtgtctgatgactctgataacaattttgtgggatctacaagtgatgaagtggctctaatgtcaaaaatgttcaaagaaaggatgaagaagaaaggaaatttctatgagaagagtagtagttcaaaagacaagcaagctaacatttgtctgatggtagatacagatgagaaagttgagaagtatggtcttggactagaaataggagcatcatcttctaagtcacagtttgtctcagacaaatgtgacttttgtggaaaaggtcaaggtttaagctgggtacctggacagtggatgctcatgacacacgatgggggaaagctctatgtccctcaacctaaatccaattga

SEQ ID NO: 44074 - DNA, 462 bp, Glycine max
  Peptide Sequence Number=SeqID_160852
atggaaaaagggaatattgtgttgttctcttttgtggtgttccttccattatccatattcttcttcacacaccatatggatcctatcattgaagaagttaaatatgatgttgaagttgcttttgactccattgcgattcaagtatatgatcctccactcttttgcgcctatgtttgtttgcttgaaactgaactagccaaaacccgagaagcccttgctcaagccttgcatgattgtgctcatgctgagaaggaagctcgcaaatggttcctaattagggactactcctataagaagatgagtggttggaaacctcctcatcctccaatgccacctagtagccttattcatctgattctaattctgatgattctaatgatgagtttcttaggaaacttgatgaagaagtttacaaacaaaagggggagaaaaagtaaaagcttgaagctcgacatcatctga

SEQ ID NO: 44075 - DNA, 396 bp, Glycine max
  Peptide Sequence Number=SeqID_160853
atggggcttctcatcaagttctacactagagaaacacttcttgagtttgtaaaacctcttcatgacatactaatccagattgttgaactcagtcttttgttggatagcttcaagcttatgtttcaaaaagtgaccaaggtagccatgcaagagaattgtgaccccaacaagaaagagatgtgttttgatgataacaaagatgatgaaaaaaagcccaagacaatgatttcaagatcgagtcaagaacaattcaagaatcaagagaaatttgatttcaaaaatcaagaatcaagaatgatcaagatcaagattcaagactcaagatttgaagaatcaagaaaagactcaatcaagataagtactaaaaagtttttcaaaacaatgagtagcacatga

SEQ ID NO: 44076 - DNA, 827 bp, Glycine max
  Peptide Sequence Number=SeqID_160854
gcttttggattggagagggacgatcttgaagcaacaatcttgtttggccatcgttgattcaatggagtttgttgagtcgaaccctctcttccaaaaccccaaatccatgtcttattttgtgcttctcttccaacttggtgtgggattggcgtttggagaggtggtggtggagagtggtaatagtatggttttttctttggtgggcgtggtggtgagtggtagacataaggagggtgtgggtgtgggtgtggatgaggatgggggtgagggtgagggtacactggagggattcctaggaggaggtggtggggagtggatgctttttagtagtggggttgaagagggttggcctggctatgagcatctatatggatgtgacaagggtcatgatttggccagtgttcaaccatgggttgttggggatgtttcagatttactattcagaaaatccatgagtttgcaaacggatttcaaggtggatttcaaggataacaggcagcacaacattccaataagtcctaagattgcaaggcagcatgattttggtaaaattttagtggaatcgggctttgagaaagctattggctctaacctctgctacaaatcaaaaatcaagcaaaccttagatcaacacattgaaagtggttcactttcatcacaaatcaatagcagtgcttctcaagtggattcaccccaagctattattactagtcctggtaatgctaatccagtagctgttgttgctctagaaaataaggatctagcattcctagtcgctcaacttggttcagattcacaccaaagcaacaacaacaacaatagtgatg

SEQ ID NO: 44077 - DNA, 1347 bp, Glycine max
  Peptide Sequence Number=SeqID_160855
atggatcaacagaactgggctgccaagttgttgggatatcgatttgatattgaatataaaccaggaaatgagaatagaggggcagatgcattatccaggatgtatggggaagctgaattgcgagcgttggttcattatccaaagtgggatggagttcaggaggcaatggaggaggtccatcggaacaagaagttgctgtctatcattgcagatttgaaacagggcaaagagagtaaaccggggttagtgcataggagaggtacgttgttttatgaagggagattggtgctgtcttcaacctcgacattaatacccaagatgctaaagaagtttcacaagacccatcaaggaggccattccagattctacagaacttatagaaggatggcagccaatctgttctggtttggtatgaagaggattgtccggcagtttgtgttgggctgtgacacatgtcagaggcaaaaataccttgctgcagcaccaggagtggtggtggacaggcagtctaaatacagtcactttatccctcttaaacacccatattcagcaagggtgttggctgagatttttgcacgagaagtggtgaggctgcatggagttgttcaaactacaagggacagctctgaagatgaacacagcatatcatcctcaaatggatgggcaaacataagtgttgtctatgttcgcaaaccaccgatgctccgtaggtttttaccaggggaggttcacgtggaagcgaataggatgaagaaccaagctgacagaaagagggctgacaggcattttgaggttggggaatgggttttcttgaagcttagacctcatgggcagctgacattaggagccagaattaatcataagttagctccctgctattatgggacttacaaggtgttggcacgagttggagcagttgcatacaggcagcagttgcctgcaacaaccaagataaacccggtctttcatattttgatgttgaagaaagcagtgggtgacaataatgtggaggagacacttccatcggagctggccagtgatgatactgttagtgtggaacccgaagcaatgcaggcaaggagggtgatccagaaagggggcgaaatggttggccaagtgctcattcattggaaggttcaaggaatggaagaagcgacttgggaagaggaatttaacatcagaagtcaactccctcagctgagacttgaggacaagtctcctcttgaggaagtaggtattgatgggaatgtgggcccagatgtagagactaggcccaagatttggagagtgtatgagaggagaaactggggtgtgaagagaagaggtgaggtggcaaggcgtaactga

SEQ ID NO: 44078 - DNA, 645 bp, Glycine max
  Peptide Sequence Number=SeqID_160856
atgacgggggaagagactaccgggaagaagagggtggtgacagaatccctgggatggctaacggaatcgtcgataatgccaaagaagcaccgagccatagcgggcgttggcgcatcctcaattctcgaattgaaggccgaactgtacaagtctcaggaagattccaaaaagtctcgcgaattggcaggccccgatgccgagtaccaacgcgccaagaacaaaatcgcccccaaagacaaattctccgtcaaaaaccgcggcgtcgatgcccgcgctcacaaggacaagcttgagttgaaggcggtgagtgatggaacggcgagctatgtggcgctcgagaggaaggctgagttgtatgataagttggtgaagggagatttgtctgatgaggaggatcaagagaagtattgtgtggactttttccgtaagggaattgagcacgatgagttgccaccgctcctgcagccactgagccataatgtgttggtggaaaatgaagatggtgctgttaatgatgatgattctttgatgtttaaattgaagactattgggcctgggcgaaaggctggagctgttgacaatgctgattataagcgcaatattagaaacagaaaatacagagggaataatcccaactgcgactga

SEQ ID NO: 44079 - DNA, 1434 bp, Glycine max
  Peptide Sequence Number=SeqID_160857
atgcatctccgagcagaagagaatcattggaagctgatcgaaatgttgtccagaacaagtaggtcgaccagcggcaatggttctgctacgaagtcgccatcaactccccttggggtagatgaattccgccaatcggtgaagaaggtcgatttgccaatgttcgacggggacgaccccgtcaggtggattgttcatgctgaagtgtattttcaggtacaagagactcattctgatgtgacactcaagatggagctcctggaacactatggtggaatcagcgagggggacatttttgaacggttggccacaattcagcaagaaggatggcatcaagggccgagtgtgaagcatgcatatgcttggtgcattgtcatgatcacagatgatgaacctggccagagcaatcgaaatggagttacaggagagaaaaggaggttggtctggtttctgctcgatgggggaggaagtgagaaaggtgagacaaacatggtggttgttgaagaacaaaccaacaaggaggaggatgaggcagagtgcaatttgatgtttctcaggagcattgtggtggaggctggtcagaaaccccaaaagatgaaacttgtccaagatatgggatggcaaattgaggctactaaacctatgaatatcaaacttggagatggatatttggcaagagcgcaggggatttgcccaggagtagagttggagataggaggattgaaattcacggttgatacggttctatttgacttggaaggagttgatttgattctcggcattgcgtggttggctcccttgggcacaataatggtcgattggggtgagcaagtgctgcaattcaaagttcaggaccaatgggtcactattcagggagagaataacaagcatggagcgcaaacttccctacaaactctgttgggaaaacgcaatagttggggagtgctggaagggttcagagaggtattcatagaaccacatgggctgccgcctaaaagaagcaaggagcacgctataaatttggtaaaaagtcaaggtccggtgaatgtcaatgaattgctgcaatctagggtaattcgcccatgtcaaagtgctttctctagtccagtcattttagtcagaaacgacgattcatggagattgtgtgtcgattatcgggctcttaacaaggatcttaaatccgggtatcaccaagtgcaggttagggaaggagacgtccacaaaacagcttaccgtacccatgaagatcattacgaatacatggagctggacagcccacttgaatcacttgaaagaagtgttgcaagtgttacagcaccaccagtgaaaagtgtgcaaaagtggctcacacctaagaatgttaagggagtaagaggcttcctcgggttgactggatattataggaacttcatcaaggattatggcaaaaatggctaa

SEQ ID NO: 44080 - DNA, 123 bp, Glycine max
  Peptide Sequence Number=SeqID_160858
atggaaggattcaagcatctcgatctccagcagtgtgagaaatttaaggaatttggagcacctgagtttcatcatgactgcgcgaaggaactcgaaattcatagtgagttcaaagtctgctag

SEQ ID NO: 44081 - DNA, 1590 bp, Glycine max
  Peptide Sequence Number=SeqID_160859
atggctggccaaaatcagatttgggagcacaatttattggatgcaactacaagagtatttagtggtgatgactatgaaagaaatttaaatggatcaagcaatgctgcacctaagtctgtactgcaccactacaagcgtagtttcagtggctttgttgtgaagctaacagaggaagaagctaatagaatagctgtggtgtctgtctttcctaatggaaagaaacaactctacacgacaaagtcatgggactttattggttttccacaacatgcgcaaagatcaaacactgaaaatgacattattataggagtaattgacactggaatctggccagaattcgagagtttcaatgacaaaggattcggtccaccacctaatctcaaatctccaagagacatagacgatcatgggactcacatagcatcaacagcagctgggaatcgagttagcatggcaagcatgttaggccttggacaaggcacatcaagaggtggtgccacgttgacatgcattgctgtctacaaagcgtgttggaatgatcactgtgatgatgcagacattcttgctgcatttgatgatgcaattgcagatggggttgatatattgtcagtgtcacttggaggatccaatgatcaaaactattttggagatgcatcttccattggagcatttcatgccatgaaaaatggaatagtgacactatttgcagcagggaactctagtccatctcctgcattcatagacaatttatatccttggtcaatttcagtcgttgctagtactttagacaagatttgttggtctcccgagcaggctattggtgtcatgtctttagaatgtggggctggtgctatacaagatggtgcccaagttgaagatatgaagtgtgatgaggtttggaatgtcaaagtgttggaccagtcatctcaatttgtgcatttggaggctcttagacatacaatttggaacttcaagagaaggtggagtgataataatcaacgtccttgggtggctattgattatactagtttaattgacgttggttatgatggggcgaaagttcatcacctattccactacaagtctaaccacaaccctttgttactagagcttgatatgggaaagcctccaaattgcagaaggaaaccttttcattttcaagcaatttggatgggtcatgaggaggagacttataggaggctaaaagggattgggaggaagttgaaggataaggataataagtaccatttaaggctacaaaaagatttatgtggggagttagaggagatattgttccaagaagttttgtggtttcaaaagtcttggtgcaagtggcttaaatttggagataagaattctcattactttcattgcaccactcttttaagaaagcaatctaacttatatgctaggctattgaatgaaaagggctattgggtgcctaattcgatagatttagaagaaatggagattgagatgttagggagaaatattactgaggaggagataaagaaagttgtttatgatatgtgtagtctcaaggctttgagagatgatggtttccaagctttattgtaccaaagccaatga

SEQ ID NO: 44082 - DNA, 492 bp, Glycine max
  Peptide Sequence Number=SeqID_160860
atgtcgccaaccagaagcgtcgccatgaacaaatcctctcccacaaccactccttcaatcccaaaccctcatccgactgcgatagagacaaagaaagggacaaagaccaccgagaccgggacgatgatcgtgactgagatcgagacagagatagagaacgcgctcgagcacgagagggcacgcgatcgggatcgtgaagccaaacgccacaacagagagagggagcgcgacatgaactccctttaccaaatcccccacgaggcccacctcttcttcggccgcagattccgcgctggtatggattgccacgagcagaagaagctcattgccaagatcgagaaggatatgacggcatcgaggagaaaaagggcatcgaggaaaagcccgaggaggccgacgcccagcgccacaaagaggctgccttcgaactatacgacaccttcaacatactcatcgatcgacattggagcgagaagaagctcgaggagatga

SEQ ID NO: 44083 - DNA, 906 bp, Glycine max
  Peptide Sequence Number=SeqID_160861
atgaaaactgaggagggtgatactagttcaaaagagatgtcttatttgagttctcttttgagtacaaacttcttcgtgggtagtgacgttccatatttaagtatggaggaggatcagcgagatggtgataaaatgtccaaggacaaaagtgaagaggagaaggattttatctcttgtcctattgtgaatattctggattctgaatgtgttgtctggtgtgcaccatggaagggttctcttgtggtacatgttcttagaaagacagtggggtttaagatgttggagtataaattacaacaaggttgggcccaatatggtaaaattcgaattgtagacatgccagattattactatctggtgcaattcacatcggagaaagattatagacatgctttgtttgaggggtcatggatggtggccgatcatgaccgtgtcaagactatgatcaacactactcttaaaattgataagctaacatcaatctattctcgagaggagaaggtgactgtcaaacccactgcaacgactctggtggagaaggaaccaaaagcgcagacaaagaaggaaggcgggccaattagggctgatgtcaccaggtgggagtgggaccataactcaataagtggccaaggaaggaccaccaagggtaacacatcctcgtggaaggctaaggcccaagggggattcgtggagggtatgaaaaatatgggagtgggctctaatggtgttagggattggagagtaataaggatgaagaaaaggaaaggaaaggaagtgatgagaaacacaaaagctctcatttctatgtttgcaactcgagttcattatgatgagatggatatagttttcaatgctaataagtctgtcattatggtggttaaggcgtcttctagcaatcactactag

SEQ ID NO: 44084 - DNA, 387 bp, Glycine max
  Peptide Sequence Number=SeqID_160862
atgggtaacattaatgtggcacatttggtggtggtggtgctgttttgctttgggctgtttttgccatgcttgtgtcaaggtaactcagatgatgctaccactgatgtgtatgttgttactctgagacatgcacctgtttctcattactatggtgagttgagaagagaggttaatggcttcaaagatgctgctgctcctgggagaactcaatttaacaaaccaagaaggtatgacaatattactaagacagataagagatatgactcttatatttcccgagttcacgattctctgttgaagaaagtgttaaatggagagaaatatctgaaactatatagctaccattacctgataaatggattcgctgtgctggttacccaacagcag

SEQ ID NO: 44085 - DNA, 147 bp, Glycine max
  Peptide Sequence Number=SeqID_160863
atggtggccgaagttatggcgggggacaaggaggcggtggaggtggatatggcggaagcggaggctacattggattggtgtttggtggtggtggaaggtcgacgcacgatgggtcttgattggaggttgcgtgcacgaggaagatga

SEQ ID NO: 44086 - DNA, 360 bp, Glycine max
  Peptide Sequence Number=SeqID_160864
atggcactgtcggggccagtgacatcaacaatcatggatcatcactttaacgttgattctcttctcctcgggcaccacgagtcttgtgaagggtgtttcctcacacaccaaaacttcatcacacttattatgtgcgtggtggatggtgccaaagaagagttgcacttggtgttaatgtatacgttgtcattgttccacgtgtttggctacaatgggggagacgcaaaggttcaatttcaaagggatgctcaaggccatggaaagcatgtacatgccagtctcatcaccacttatgaggaaaaggggaatgggaaggatgagaagttggggaaagagggggaggaagaggatggtgtctag

SEQ ID NO: 44087 - DNA, 246 bp, Glycine max
  Peptide Sequence Number=SeqID_160865
atggctggaaaagctccaacagtgtttatacctgaaggtgataaatctggatggctaatgatgaatctcgatgcaggtgccatgtttcctccttattggccgaggaaatttggcattgtgttggatcttatttggcaatggagaaacttctttgtcttcaatggagcattggggtctgattgtgaaatgatgatgaaaatcaccaagctggaaaaagagcttaattatgaatgcaataagttttga

SEQ ID NO: 44088 - DNA, 345 bp, Glycine max
  Peptide Sequence Number=SeqID_160866
atgtgcactagcataaccaccctgacacagatctggatgacattactgctcggcaacatcctccccagttatcataattcaaaccttcccctgccgaagtgccaactggtatatgccatcttgacccagggccttcacagaaaaatattgcatgccaaggcaagcatagcaacagagtcaagcacagcaacaacaggaggaggtccagcagcagccagctgcagatgcaccaccgccacctctgcagcagccaccatctctggagtccacctctgctcacctgcggaggatggagctctagatccatgcatatatgcagcatgtgaccgaccagcaggcggctaa

SEQ ID NO: 44089 - DNA, 399 bp, Glycine max
  Peptide Sequence Number=SeqID_160867
atgggtggtatcaattataatcccatgcttgctataagacaattaggatatcctatgagagtggaacaaaaggatagggagcttaggggaagcagcaacggtgtcgtcggctgctatcataagtggctgaaggctaggatgcaagagataacttggctcccaaatctaaaaggtccaagtggggaagaagttgaagtccctgaggagagcgaggaagtgcaagccttgaaagcggaacttgaaaggacgcaagtggtcaaggaaaagttcaagatgatagccatcagggtcaagaaaaggtgtgatgagcttagggatgtcaaaatggccatggccgaagcgttagagcgagaaacaaagagggctcgaaaagaagaatggggccaaaacaagttctga

SEQ ID NO: 44090 - DNA, 993 bp, Glycine max
  Peptide Sequence Number=SeqID_160868
atggaggccatgaaggaccaaatgacctccatgatggaggccatgttaagtataagacaaattatggaggacaatgtagctgcagtttctgccaccagcaccgccgctgaggcggatccgacccacccatctgacataaaccaaacaacccatcctgccccaaacatggtaggtcagggaagagaagtgttgggcagcactagcggtccccacacggtgcaaaataggaatgctttcccaccatatggcttacctcccaactatacaccacccaatgtagtgcacgtgcccaacgagaatgccaaccactctgttccaattctccttgaaagccagcaaccccagttggagcatgcaccattttctcagcctatgggggaagctcgtgaagagccctgggatcatgctctgggcgagtgtgaaccataccctacatatgccactaaaggaccagccatagaagaaagtgagaagttggatctcatagaagagaggttgagggccatcaaagggattggtgattatccatttgccgacatggcaaaactatgcttagtacccgatgtcgttatccttcccaagttcaaagtgttagacttcgacaaatacaaggggacaatctgccccaagaaccacttgaaaatgtattgtcataagatgggggcatactccagagatgagaagctcttaattcactttttccaagagagtttggccgaggcggccatcacgtggtatactaacttggaagcttcacagatccgttcttggaaggatttgatgggatctggtggcccaagtagcacccccatgatggagagagaaatgataaccatgatagtagacacactgccagtgttctactatgagaagatggtgggttatatgccctttagtttcacggatttggtgtttgcgggcgagaggattgagcgcacccagctcgctaagccaaaaatcacttactctcgcttagcgagccaatctcgctaa

SEQ ID NO: 44091 - DNA, 461 bp, Glycine max
  Peptide Sequence Number=SeqID_160869
agctccttttgagcacaaaatttcgtgctcttctctccctctcccttcattcatctccttcttcctccaagctcttatccatggcctcctatggtgaagcaaaggaatccattgatgaagaagatcctaggcctacaagctccaatggagcttgcatcaaagcatctgagcgactggctcttgattttgacatgatagaaccttttcttaaaagagggcacttggttcgaccccatgttggctacaatgaaaactctgctgatcaatacttcaacttcaacaccctatcatggaggaggtatgatgaatgtatgaggcttcactgtcatcaagcaattcggagacccagcatgaccacagatcaacctccacttcctatgtttccatggaccgggtcgatgagagtgtggctcttgctcctacgtatcctcaagtgcgatgaggaactcagacctacgtag

SEQ ID NO: 44092 - DNA, 273 bp, Glycine max
  Peptide Sequence Number=SeqID_160870
atggggtcgaaccaagtgccctcttttaagaaaaggttctatcatgtcaaaatcaagagcctagaagtagccagcccatgggagctagggcagtggatggatcaagtccaacgtcaagccttccgcaagacatataggaaaatctgggatttggctatgatagaagtttctatggaagccatcgcatccctcacttacggaatggagaaggaagagagagaggagacgccacttcaaggagaagatgagtctagaagaagctcaccaccatag

SEQ ID NO: 44093 - DNA, 600 bp, Glycine max
  Peptide Sequence Number=SeqID_160871
atgggtgaaacagataaggtgcaagagtggataaaggccaacttggaggccatgaaagagcaaatggccataatgatggagggcatgatgagcatgaagaagataatgaaggtgaatgcggctatagttgccgctaccagtgccattgctgaggtggacctgactcccccatttggcctcaaccaaataaatcatccaatctcagatatgcattccttcccactgtatggtttggctcccaaccatacactgcccaatgttgcacacactcccaatgaggatgtcgacaactctgcacccatacccattgagagccaacaaccccaagctgatcatgcacatgtctttcaacccatgggggagacacatgaaattccccaccataatctaaccgacttcgagcctcacctcggatatgccattgaagagcaagcagttggtggaagaatccctcttgctatggtagagaagggaaagttggatcatatagaggaaaggcttggagccgttgaagggggtggaagttatgctttggctgacatggcgaaattgtgcttagtgcctttgcatcaccatcactccgaagttcaaggtgtctaa

SEQ ID NO: 44094 - DNA, 828 bp, Glycine max
  Peptide Sequence Number=SeqID_160872
atgttgggtcataaaatctcagctcgagggatcgaggtggaaatagcagagatttatgtcattgaaaagctaccacaagtcaatgtgaggacattaggagtttcctcggacatgcaagattctatcgtgtttaagtttgacgaagaattcttgacaacctttcagaccttgaagagtagtctaatatgtgctccgataatggtggcacttgaatggagtaaagaatttgagctcatatgtgatgtagattcaaagccaaggttgatcagatgggtccttctaattcaagagtttgatatagtgattaaagacaagaagggctttgagaatgtagtggctgaccacctctctaggttagtaaatgaagaagtaactcaagatgagcaggaaatccgggatgaatttcccaatgaatcacttctacatgtgaaagaaagaccttggttcgcggatatggccaactacaaagctgcagggatgaatgagctaagctggcatgtctcgcttagtgagttcatgagtcacaggcatatgttcttgcatttctgggtttttgatgaatgtccatgcatgggcttagcatacaatctcatgctaagcccgactgtctttcagtaccacatgcatgggcttagcacgtggtctcacgctaagccccaatatcattttgtcttttctgactcttttcatttttcatacatgagcttagcacgtagtctcgcgctaagccctagcgtctgtttgtttccatgcatgggcttagcgcatagtctcgcgccaagctccaattggttttgttttggtgctaagcgccccatggcggcttag

SEQ ID NO: 44095 - DNA, 159 bp, Glycine max
  Peptide Sequence Number=SeqID_160873
atggaaaaacctgacatgaaaaccttcaaagacaagaaaggaaagaaagtgtacatcacttgggaagataatgatatggattcatcagatattatactgggaaagcaaagatgtgtgtttgataaggctggattagaatataaacctgaaaaacaataa

SEQ ID NO: 44096 - DNA, 314 bp, Glycine max
  Peptide Sequence Number=SeqID_160874
cccgaaaggcggcggcggcacagaagacttacccggtgaagcaaattgatgtcgcactggtgaaggagttttactccaacatctttgatttgaaggatggttctttgaagcagtgcaaggtacaagggcaggccatcagattcgacccacaaacattgaatgactttctaaggactcctgtcatcattttggaggaggagcagttggccacttactcccagtacctctacacttaccctgaccaccaggccattatggccaagttgtgcacgccaggagggcagttcattctgaatgtcgagggggctctgtga

SEQ ID NO: 44097 - DNA, 195 bp, Glycine max
  Peptide Sequence Number=SeqID_160875
atgtcatttatcaataacagagtggcaagcaacaacagcttgtggaggccaccggtggtcgtgggtggtggaaaaggagtttctagggtgatctcacttagcgagctcatctcgctaagcgagaatgcacttttggcaccaagcgtgaattttcgtgctaagcgcaaacccttctcgggtcgggatttgcagtga

SEQ ID NO: 44098 - DNA, 356 bp, Glycine max
  Peptide Sequence Number=SeqID_160876
gctaagcacgcctgtgcgcctaagcctcagtgtctctctgttgaggctgagctaagcgccagcatatggcttataggaaaagaaaggcaccatctacacccacccaagttagatttgacagatcaagattcacttcccaagaggcttgggaaagatacagacattattgtgcctaggaagcttctgccagagaggaacatggcggtctactatatagagttcgatgagttcaaggaggaactcgaaagaagccactgggacgaggagttgactgactttggggatggcaacattgatgttgccattgtgaaggaattctatgccaacctctatgaccccgaggacaaatcacctaa

SEQ ID NO: 44099 - DNA, 546 bp, Glycine max
  Peptide Sequence Number=SeqID_160877
atgtctgacaaactacgccgcatcgtgctgaccggcggcccgggttcgggcaaaagcacgctcatcgaggttcttcatcgccgtggctacccgcattcgcaggaggcgggccgggcgattattcaggagcaggtgagtattggcggcaatgcgctgccgtggggcgatcgccaggctttcgccgagcggatgctggattgggaactgcgctcatggcgggaagcgacgggcgcaacatgctggttcttcgatcgcggcctgccggatatcgccggttacctgacgctgtgcgggttgccgatccccgctcccttaaccgcggcgatcggcgcttttcgctatgccgatacggtgttcatcgccccaccgtggcgagcgatctacgcgcaggacagcgagagaaaacaatctttcgccgaagccgagcagacctatcgagcgatgctggccgcctatcgccaacatggctatcagctgcaggaactgccgcgcgcctcgcccgacgagcgcgccgactttctgctcgacgcgctgggctgccgttag

SEQ ID NO: 44100 - DNA, 282 bp, Glycine max
  Peptide Sequence Number=SeqID_160878
atggagagtcatgagcatatatttcaattttcttgggtcccatatagaggatttgaagaacacctaccgagacatgcatacagagacatggagatttggtttgcatggacaagtgttgaacaaacacattttgaaattccacatcctcagtcaatgtattgtacttcttcaccagttcatcaaacttttagctggactagcgaatgtcgtacaggatgtcacgacatcacgcttcagaacatgcagattgtctttgactgtatgaacagattaaacaagtaa

SEQ ID NO: 44101 - DNA, 210 bp, Glycine max
  Peptide Sequence Number=SeqID_160879
atgggcttagcgggaaaggatgtgctaagcaccaacatcatttgttttaaagtctttggaagtgcgcttagtgcagcatcgcatctcgggctaagcgcatgttgcaaaaagatttttggtgttgcaaaaagcgctaagtgctgctgctgcgctaagccccaaatgcttactggaagttacaacttcaagttgggcttagcgcgaggctag

SEQ ID NO: 44102 - DNA, 252 bp, Glycine max
  Peptide Sequence Number=SeqID_160880
atggaaagaaaagataaggagcttagggggagcaacaacggtgtcatcggcgactatcataagtggttgaaggctaggacgcaagggataacttggctcccaaagctaaaagatctaagtgggaaggaagctgaagtcctcaaagaaagcgaagaagtgcaagccttgaaaccagagcttgaaagaatgagagtggtcaaggaaaagctcaagacgacagtcactagggtcagaaaagagtttgacgagtaa

SEQ ID NO: 44103 - DNA, 624 bp, Glycine max
  Peptide Sequence Number=SeqID_160881
atgcttatggacctgacaaagaatcacatgctaggcaaagttattgtatatatgtatataatagaatttcaaaaacgagggctgcctcatgtccatttgttgctttttttacatcctgataacaaatacccatccttagatgaaattgatcaaattatatcagcagagataccttcacagcaagatgatccagaactgtattcattagtaaaaaaccatatggttcatggtccatgtggaagtctgaatcctggatctccatgcatgaaagaaggcaagtgtagtcatttctatcctaaaatgttccatctgcatattgttttagatgctgatggttttccagtctatcgtagaagaaacaatggtaatgcaattgagaaaaatggtgttataattgataacagagtgactgctgttttgattgatgaagataatggtcaaactgagaatggtggcactcataatgatgagatcaaagaatatctagattgcagaaaacctgctgtgaaagattacacttccatcttccaggccaacatagtgttctctacgaagaccatgatgatattgatgatgtattgtctaagccaagtatctctgattcaaagtttatctcatggatga

SEQ ID NO: 44104 - DNA, 459 bp, Glycine max
  Peptide Sequence Number=SeqID_160882
atgcgtttacaaaacaacatgcaagcaacagatcaagaagaaactgcaacttttgcacagtggattatagatattggtgatggtattattggagatgaaaatgatggctatgctactattgaaattccacaagaactattaatcacagaatataatgatcctattcatagtataattagctctacatttccatatctatctcatcatcacaatgatcctgaatacttccaaaccagagcaatattagcttctacaaatgaaacagtacaacaagttaatgattatatgcttacaatgataccaggtgaacaaatggaatatctaagctctgattcagttgacaaatccgaaaccattgaaagttgtcatttccgctcactgacaactgaatttctgaattcattgacaacatctggcttacccaatcactgctcaaactcaagattggaacaccaataa

SEQ ID NO: 44105 - DNA, 351 bp, Glycine max
  Peptide Sequence Number=SeqID_160883
atgtattgtcggaagatgggggcatacacaaaagatgaggaactgttgatacatttcttccaagaaagtcttactggggtagctgttacttggtacgctaacttggagccttcccgagtccattctaggaaggacctaatggttgccttcgttaggcagtatcagtacaattttgatatgatctttcaaagaatacgcccaaaggtggagagacctggcagcccaagtggcaccctcaatgacggaaaaaaaatgaggacaatgatagtagacacattaccagtattctactatgaaaagatggtgggctacacaccttcaagctttgcagatttggtcttcgctgggtaa

SEQ ID NO: 44106 - DNA, 330 bp, Glycine max
  Peptide Sequence Number=SeqID_160884
atgcccacacgcataaccctccagttagctgatcgctccatcacaaggccatacggagtgattgaagatgttttggtgaaagttaagcaccttatatttccagctgattttgttgtcatagatatagaagaggatgctgacattcctctcattcttggccgcccattcatgtctatcgcaagctgtgataaagatctgcctgaccagaatgtctgtttgatggtgcatgtcatggaggaaaggaaacccgagaagaaggaccaatcagagctgcagatagcgttaagcgcatgccctcgcgctaagcctgggcatgcctctggaacttga

SEQ ID NO: 44107 - DNA, 297 bp, Glycine max
  Peptide Sequence Number=SeqID_160885
atggcatctaagaaaaggaaggctccttctacaccttcccaagttagatttgatcggtctaggttcacatctcaagaagcttgggagagcaacatagatgctgctattgtgaaggaattttacgcgaacctctatgaccccgaggataaatcacctaagcaagtgagggtgagaggtcacttggtgaaatttgatgaggatactttgaacacattcctgatgacccctgtaattctagaagagggggaaaatttgtgtgcctattccaggttttcactcttgaggcctgatccttag

SEQ ID NO: 44108 - DNA, 153 bp, Glycine max
  Peptide Sequence Number=SeqID_160886
atggttcagctaagtgcacatcactgtgctaagcccaacatcttcactctgtacgctaagtgcgccatacaaaattcagtttttaaaaagcaaaggcagaggcacttgggttgctacctttgcacccaaacctctgcaccttctcatctctga

SEQ ID NO: 44109 - DNA, 153 bp, Glycine max
  Peptide Sequence Number=SeqID_160887
atgggccagggtggtattcctcctatgctgggagagggtgcctgtcgaaatctccttgcccctatcactaaggaagaaatgagacgtggaattatgagcatgaagtcctttaaggctctaggtctagatggattccatgctttttttctttaa

SEQ ID NO: 44110 - DNA, 300 bp, Glycine max
  Peptide Sequence Number=SeqID_160888
atgtgcgcgaggaagtggagcactagaccttcttcaaccgaaaaagaattggatccacaaaatttgttctctagtgagaatggtgagatggcatactttatgggagggaatcagaaaaatttgaagggtgtgctttggaggggctttgcatatgtagtgaagatagacattgtagcccttataaagggtattactgaagccatggccatgtctacaaggaagctagagtctgtagatatttgccacgctccatactatatcatccacagcatgatcatgtgcctttatttcatatcatga

SEQ ID NO: 44111 - DNA, 144 bp, Glycine max
  Peptide Sequence Number=SeqID_160889
atgagtctaccagcgacaacgtatcatcaaaagacgaaaactctagatgaggcttcactgttatcaagcgagtcggaaacccagcatgactacagatcgacctccacttcctatgtctcacatagactcgggtatagggcctaa

SEQ ID NO: 44112 - DNA, 258 bp, Glycine max
  Peptide Sequence Number=SeqID_160890
atggcgatcaccgatggtcagtggtggtggaggaggagcttgcaggtgttgagggagggtttaggggaagagaaggaggaagaagatggttgttttatgctgctgaacgtatttgaaggctgcaacactcgcccaagcgagtttggctcgcctgagcaagctgatccagctccaattttttctgctttggaacctccgaaaaaattgttagaagatccaacggttaacgaatccaggatggcaattttactgaaatag

SEQ ID NO: 44113 - DNA, 330 bp, Glycine max
  Peptide Sequence Number=SeqID_160891
atgactaaattcacaaaacatggaataaatcaacaatttcagttaaaacatgagactacaaacgaaagaaagaaaaaaaaacataaaataggaacggaacttgatcgaggacgaggaacaaaccttgatcgaagacgaggagcgaagatggtagtcaaccacgcgcgagaaccacagaggtgctggaaagccttcacgacgatcgactatgacgaagagggagaaagggtagtacaaaatgaaaataacaccatagaggtgctggaaagcctatggagacaatcgactaagacgaagagggagaaaggaagcaactcagacgagggctag

SEQ ID NO: 44114 - DNA, 186 bp, Glycine max
  Peptide Sequence Number=SeqID_160892
atgcttggaggggttgatggggacccggtgttgagaggaacgaggataaagggctacgtaggagtacagtggtacttggagatatgtcgcgggggtcaggagaccttgggaacatcaggtggggtgatatttcccaaaaccaagcttgacccatcccgacccaacccgggcatagtcagtcagtga

SEQ ID NO: 44115 - DNA, 240 bp, Glycine max
  Peptide Sequence Number=SeqID_160893
atggctacactaactactgctttccttccttctaagcttaagcctcattcggggcaccaagcctatccatttacacacagaagaacaccactcaggaataaaattaaccgagcagtaatgcctgtacgggcagagagtggaggtgtcaggttgcaaggttgttcgggccagccatacactactagaaaaatgacattttatgacacagactctacgacggttattggggaaccgccttaa

SEQ ID NO: 44116 - DNA, 222 bp, Glycine max
  Peptide Sequence Number=SeqID_160894
atgcagaaagggatgtttggcagaaactcctgtgacatagcacaaacatctgatgacaaacacttcgtgtggacaatggatctatcttacaacaaggacttgactggaccacttccagaatccattggggaattgaagaagctggcaaccttcttcaagggtcctattccagacaacataggaaatatgcaggagattttatatgctgtttcttattcctaa

SEQ ID NO: 44117 - DNA, 981 bp, Glycine max
  Peptide Sequence Number=SeqID_160895
atggtgactggatgcttgactggcaaggataacttaagaagaaaatttgcacagtcattctttcttgctccacaagacaatggctattttgttctgaatgatgtttttaggtatgtagaagaccatgaaccatcagaactgcctccagttactggagatggtgatgcagctgctgttacagtaacaccagaaacaggcaagattataattcaaaatttttttatcttctctttcaaaatttattcaggagttggattcatgttgttctccttctttacagaacccagtcattttgctaattcttctgcaccagaccccacaaattctcatgtgaacaaaggtcaaactgttgctgagaatgcttatgagccatctaatcatcatgagagacacatacctattgagaatgtcgacaatgtagaaccacattttcagtcaaatggtaatgatgattctcaggccacagaattggcttcttcagctcaagagaagaagtcttatgcatctattgtgaaagtccaaaaagagggtttagttgcaactaaagtgtatgtgcaaactaatacactaaagtcagggcctaacaaaactgagaacaaggtagttgagtcagtagaatctactgaagtgtctgaagcagctttggatagtgttaacaaccctgaaagtagtgatgctcatgaggaagttgaggggcactccatttacattcgaaatttgcctttaaatgtgacggctgctcagttggaactggagtttaagaaatttgggcccatcaagccaggaggcatccaagtcagaaataataaggtgattatcaggtcaacaatgcattcaaattacccttttgctttttattcagtcctaatgaagttttgtttaaagaatgagacacataccacaccaaaaaccagagcaactactaataacaaccatttatgggtcaaagaggcaatttatatggtcaccataagaacctaa

SEQ ID NO: 44118 - DNA, 468 bp, Glycine max
  Peptide Sequence Number=SeqID_160896
atggcttctaaggaggatttgattctgttgtgggcccttcaaaccagtcatcaaattgactgggttcatcttgtccgctaccgtatgcataaggcattacatcaaattggctgggctttttttctccaacattttaacgttcctctagatgttgaaccctttgttaaggttaaacactcatttgccattggagctactattgttgcatcatttggatatcggatggatatggatggtcagtgggtgcgaaaacaagaccttccacctactactcctgatgaacgtacaccctcaccgccaccaccaagggctcccttctcttcactgctacatgatgttctaagtgaacttcgagatcttcaaacatttgtaggtgatcgttttgatgctatggattcacgtatcacgagtcttgaggatgatatgagcttcatctgtcgatgctttgatcctccgactgatccataa

SEQ ID NO: 44119 - DNA, 1506 bp, Glycine max
  Peptide Sequence Number=SeqID_160897
atggaggactcgtccggccacctgaatattcctccggccgccgcggcggcgactctccggcacgttgaccgcatgatcaactccaaccactacacctcgccttccagaacaatctactccgaccgcttcattcccagcagatctgcctcgaaattcgcgctcttcgacatcgcctggcctcccgggggcggcgacgacagctccagcgcctacaccacgctcctccgcaccgcgctcttcggccccgacatcgagccgccgcactcgccggcgatgactctccccagccggaatatcttccgttacaaaaccgagacgcgccagtccatgcactcgcactcgccgttcttgtgcgacgattcggtccccggcgttgtccacggcccggtcaaggctccgaggaaggttccgaggtcgccttttaaggttctggatgcgcctgcgctgcaagatgatttttacctgaatcttgtggattggtcttcgcataatgtgttggctgttggtctgggaaactgtgtttatctctggaatgcttgtagcagcaaggttactaaattatgtgacttggggattgatgacctcgtttgttcggttggctgggctcagcgtggtacacaccttgctgttggaactagcaatggtaaagttcagcgtcgtcgatgtgggggatcaatagctgttgttgatgctgaagccctaatgcattttgtaagctctaagcttgttttcgcaaagacgatgaaagaaacatggcaaaaagaagtgagcattgggatttgggatgcatctcgatgcaagaagataagatctatggagggtcatcggttacgggttgggaccttggcttggagttcatctcttttgtcttctggcggcagggataagaatatttatcaaagagatatccgtgcacaagaagattttgtcagtaaattgtcagggcacaaatcagaggtttgtggactgaagtggtcttatgataaccgtgagttggcatctggaggaaatgacaacagattgtttgtttggaatcaacactcaactcagcctgtcctgaagtactgtgagcatacagcagctgttaaagctattgcatggtctcctcatcttcacggacttcttgcatctgggggaggaactgcagaccgatgcatacgtttctggaatacaaccacaaactcacatttaagctgcatggacacgggaagtcaggtttgcaatcttgtctggtccaaaaatgtcaatgaactagtaagcacgcatggctattcccagaaccagataattgtttggagatacccctccatgtcaaagttggccactcttacgggtcatacctacagagttctttatcttgccatttctccggatggacagactattgtaactggagctggtgatgaaacacttaggttctggaacgtattcccttcccctaaatcacagatggttaatcaactagttacccctaccaacctcagtaaagtgatttttagtgattaa

SEQ ID NO: 44120 - DNA, 309 bp, Glycine max
  Peptide Sequence Number=SeqID_160898
atgtccaagcccgctttcatgaaaattgctcagtggcaagctggaatcattcctgttatgtaccgcagtgttaaacaatgtttgagagtaccttgggttaggagtggggggctacgattctctttccaaggaaatgggtattggttattggtgtacgtaatgaatgtgggaggtggaggagacattgctaacatgtgggtgaaggggagtggaacagaatggattagcatgagtcacaattggggggcttcttaccaggcatttgcaacattgggtggccaagaaaggtttggtcaatgctggtcatga

SEQ ID NO: 44121 - DNA, 345 bp, Glycine max
  Peptide Sequence Number=SeqID_160899
atgtggcgtgagcaaccattgtccaggtaccatgataggcatttgcttcctactatcaaatacatatccataggaattatcattttcttaggtacccaaatctttttgggtcttcttgtgttatctttaaatgccttagagttgagcttaggtcatcaatgggctaagtgtgaatccaccgctaagcgcagtttcagcgtgcttagcgtgacagaagaatctggcagggcatcaatatcaaggccacgcgctaatcgtgagatcaatgcgctaagcgcagcagttgtcttcagtcaggctcagcgcacgactgacactaagctcaaatccacttactcgcgctaa

SEQ ID NO: 44122 - DNA, 474 bp, Glycine max
  Peptide Sequence Number=SeqID_160900
gcattctattatgagggaaaggctatcatgtcaaatgaagagtttgataatctcaaggaagaactcatgtgggaaggaagcagcgttgtcatgctaagttctgatgagcaaaaattcctggaagcttcgatggcttatgtgtctggaaaaccaattatgagtgacaaagagtttgatgagttgaaactgaggctaaagctgaatatctccctccttctggtattatttactgatctcgtaactgttttccagatagaagggagtgaaattgtagctgagggtccaaggtgcagccttcgtagtagaaaggtttacagtgacctatctgttgattatttaaagatgttgctgctgaacgtcccggctactgtgattgcattaggattgttcttcttccttgatgatctgactggatttgagatcacatatctactagagtggttgccatcttgcacttcactggctaaagtctaa

SEQ ID NO: 44123 - DNA, 192 bp, Glycine max
  Peptide Sequence Number=SeqID_160901
atgcactgcacccttgacaccaatctcttcagcttctggtgttcacctcattcagttcaatggcaggcacttatgcctccgccaaaggctgtttctactttctcctatggccactgcagatcaacaaggaattcctccaagcactgcaagtatgccaccccccccccccccccccccccccaaaaattttaa

SEQ ID NO: 44124 - DNA, 611 bp, Glycine max
  Peptide Sequence Number=SeqID_160902
aagctgaagagattggtgtcaagggtgcagtgcatggacgaggtggtgttaatgtgaaggctagtttactagccgtgaacatggtgatggtggttatttggaatcaaagtggtggtagtgtaactgggaaagttcaaggtggtggtggtgattcctatatgcaatctattttgattcctaagtatatttgcattgaagtggagaggctgcagaggcatttcatttggattgatcatgagactagtatgggttggcatattgtggcttgggagatcttaactcagcccaatacgctttatgcagtatcttccacagtggattatgatacttgtcctatctgttttgaggagcctgaaatggatttgcatctcttaagggactgtgggcagtctaggcatgtgaggcaagatcttctactcgagtttcctatggagcaaactggtccagttcgctgtcaatgcggatttatgcagatggaccttatgtggggtgcatcagtccgcttacccagccctacttctctcctcaagtggagacctccacctagtggggtttgggcgatcttggcagctttggagcatgcttggagtttgaggcatctttgtgtctag

SEQ ID NO: 44125 - DNA, 231 bp, Glycine max
  Peptide Sequence Number=SeqID_160903
atgtatgtgagagatattccaagagaacttcattgccaaatgctctctcaaaaaaactcctgggcaaacacttgcaaatccattaagagtttctccatggacttcaattatttttacaaagggagtgaaaaatctcaagtttgtcatcatcaaaaagggggagattgtagaagcaagcttcatgatgatgaaccaagcaattttgatgatgccaaaagcccaagtgattga

SEQ ID NO: 44126 - DNA, 882 bp, Glycine max
  Peptide Sequence Number=SeqID_160904
atggtggttggttaccgccacattgattgtgctcaaatctatggcaatgagaaagagattggctctatgttgaagaagctgtttgaggagggtgtagtgaagcgtgaggatttgtggattacatctaaactatggaatactgatcatgctccagaagacgtaccactggcattggacaggaccttgaaagatttgcagcttgattatgtagatttgtatctttttatttatgacatactcagttgtaaaccgatcaacctgcctttccagatccactggccgacttcaatgaagaaaggatcagttggctttaatcctgaaaatcttgtgcaaccaaacatacctaacacatggaaggcaatggaagcactctatgactccggcaaggctcgggctataggtgtaagcaatttttccaccaagaagctggcagatttgctggcaattgctcgtgttcctcctgctgtcaaccaggtggagtgtcatccttcatggcagcaggacaagctgcaggctttctgcaattccaaaggagtccacctcactggatattcacctttgggttcccctggaacaacctattttaaaagtgatgtccttaagcacccaattataaatatggttgcggagaaactaggcaagactcctgcacaagtagctcttcgctggggactgcaaatgggccatagtgttcttcccaagagtactaacgaaacacggataaaggaaaattttgatgtttctggctggtctatacctgaggacttccttgctaaattttctgagattcaacaggcaagattactcaggggtaccacatttgtccatgaaacttacggtgcctacaaatctgtcgaggaattatgggatggtgaaatctaa

SEQ ID NO: 44127 - DNA, 366 bp, Glycine max
  Peptide Sequence Number=SeqID_160905
atggaatggaagaaaaagaaagtctacagtcacactctttctggggacgcgggagattttatagtgtttgtttctggcacgtgttcggtgatacagaagaaggcagagtggaacctaagtactattcaagaccttttggtccaacaagatcatgatcgggcgttagaagatgaaaggtcggcttctataaatgaaaccaagtgtgagcacgatttggttagctcttgctctcgagataaaacccatgttaaaggccttgtaggagaaactcaagaatatttatgtgtcaaagttgctaaccaatcgcttttgtttgaagatggagttgtattaactcaaaatggagatgggaggacatctctataa

SEQ ID NO: 44128 - DNA, 486 bp, Glycine max
  Peptide Sequence Number=SeqID_160906
atgaaacctagacaactttctgatgctatacatgaagaagttggtgcaatctgtcttggacaaactggcaaacccaaaagggaagatggggctatgctgtccacatctgatgtaatgccaattcagagacaaggggaaacagcttcagttgctgagattgatgatacattgcatgaaaatgagcctgatttccagttcacaaggcagaggagtgatggacagagcctctgtgaactgctgctcagttttgtctataaatttcaacatcttcctttatttttaaacttcattcctattttggtgtgttggacactactcggacatgactcttgtcgaatactccttgaactcatgttaggaagccctccatggtgttgcaactacaaaatcattttttggggtcagacacctctccaacatggcttggacacgggccaagagaatgagccaacacctactcctggctggacacttatcagacactga

SEQ ID NO: 44129 - DNA, 270 bp, Glycine max
  Peptide Sequence Number=SeqID_160907
atgttgctagagatagttgatacaactatgccagtgtttgatggagcttcccctatctccatggaggagtacaatcttgtcaaaaatagagatcgtcgcatcattaaacactatgtccattatgggtttgaagagttggcttcttttgcacttctaactagtgttggaaatccttctacctttcaagaggctatgaacaaccgggagaaagatagatggatgggtgttatggtggaggagatggagtctttacagaagaatcaaatatag

SEQ ID NO: 44130 - DNA, 1258 bp, Glycine max
  Peptide Sequence Number=SeqID_160908
atggattctttctttttcattgctttcacttttgtgttgagcttccacattcattttgctcatggaaatgaactgaattctgccacaagcagttcaaaaacatatattatccatgtgacggggccacagggtaagacacttgctcaatccgaagatttagagagctggtatcgttcattcatgccacctactattatgagctctgaggaacagccacgaatgatttattcataccggaatgtgatgagtggttttgctgcaagactcactgaagaagagctgagatcagtgcaaaagaagaatggctttatttctgcgcatcccgaaaggatgctgcatcgtcaaaccacacataccccacaatttttggggttgcagcaagacatgggattttggaaggaatcaaacttcggaaagggagtaattgttggggtggtggactctggaatcgagcctgatcatccttcattcagtgatgcaggaatgccaccaccaccactcaaatggaaagggagatgcgaacttaatgcaacattttgtaacaacaaactaattggagcaagatctttcaacctggctgcgacggcaatgaaaggagcagattcaccaattgatgaggatggacatgggacgcacacatcaagcacagctgccggtgcttttgttgatcatgcagaagtactaggaaatgccaaaggaacagcagctgggattgccccttacgctcacctggcaatgtacagagtatgctttggagaagactgcgctgagagtgatatattggcggcattggatgcagctgtggaggatggcgtggatgtaatatcaatatccctcggcctaagtgagccacctccatttttcaatgatagcattgcaataggtgcatttgcagcaatgcagaagggaatctttgtaagttgtgcagcaggaaactctggccctttccatggctccttagttaacggagccccttgggtcctcacagttggagcaagcaatattgacagaagcattgcagcaacagcgaagctgggaaatgggcaagaatttgatggggaatctgttttccagccttctgatttttctccaacattgctacccttggcatatgctggaaagaatggcaaacaagaagctgcattttgtgctaatgggtccttgaatgattgtgatttcagaggcaaggttgttttgtgtgagagaggaggaggtataggaagaattgccaaaggagaggaagtaaaaagagtaggtg

SEQ ID NO: 44131 - DNA, 810 bp, Glycine max
  Peptide Sequence Number=SeqID_160909
atgcacgcatatctatcgaacctcgttaaatctcttgtgtttgcatatgtatgtgtgatttctctcataccctttagaatatcgattgttattgctaacaactggcgagttaaggatttgttggaacaacaaggtcttctgaaggcactgcgcaaatcacaacctaataatacaaagactttgggttgtaaggaattgcaagaaagggttgtggcaatcatacgcttgtgtttggcaaatgaggttctctatcatgtgatggagttgaagtctccaggggagggttcaaatctccaacaacacgtgaatgcctttaatcagatgatcaatgatctggaaaggcatgatgtaaaggtggaggacgaggataaggcatatattctgatattttctttgccttattcttatgaacatttggtggcaaccttaacgtacacgaaagactcaatcagtctggagccagagttgaagaaatctagtgaagggacatctcgctcagcatatgtggcaaagactaatgattcatactactacattgaaggagatgtctattacaatgggggagatgttctttttggttcatccacacaacggactgtaggaaacatttacagattgttggggagcacagttataggccgagttgcatttgttgagtctgataatgatgttactaaattttggcacttgcgtttaggtcatcttagtgatcatgggatgacaaatcttcataagcgaggacttttgaaaggagttcagagttgcaagttagacttgtgtgagaactatgtgcttgggaaacatatctga

SEQ ID NO: 44132 - DNA, 303 bp, Glycine max
  Peptide Sequence Number=SeqID_160910
atgaaagaggacttgaagaaattaagagatatgaataaagatagcgtcaactcccaaactaatgtagtaaaaagtgttgaagatgaagatgatgtgtttttggcaacaaatgatgaggttgctaaaacaaaatgggtgatggattttgctacctcaaagcacatttgcatggggagcgtgagaatgaaactccatgatgacgctattcaaactttctcaaatgtgaggtttgtaccttttgctattgtcaatatgatttctatgggggagatgacatcacaagggtacaagtatgttggttaa

SEQ ID NO: 44133 - DNA, 2095 bp, Glycine max
  Peptide Sequence Number=SeqID_160911
cagaaagcttctgctgaacatggatgctttccttttcattgttttcactttcgtgttgagcttccaaactcattttgctcaaggaagtgaactacctcgtaccacaagcagttcaaaaacatatattatccatgtgaaggggccacaggataagtcactagatcaaacagaagatttggagagctggtaccattcattcatgccacctactattatgagctctgaggaacagcctcgaatgatttattcatacctcaatgtgatgagtggttttgctgcaagactcactgaagaagagttgatagctgtggaaaaaaaggatggcttcatttctgctcgtcccgaaaggatactgcatcgccaaaccacaaataccccacaatttttggggctgcagaaacaaacgggattgtggaaagaatcaaactttggaaaggggataataattggggtgttggatactggaatcacgcctggtcatccttcatttagcgatgcaggaatgtccccgccaccaccgaaatggaaagggagatgcgaaattaatgtgacagcttgcaacaacaaactaattggagtaaggactttcaaccacgtcgcgaagttgattaaaggagcagaggcagccattgacgattttggacatgggactcacacagcaagcacagctgctggtgcttttgttgatcatgcagaagtactaggaaatgctgaaggcacagcatcagggattgccccttatgctcacctggcaatttacagggtatgctctaaagtctgtcgagagagtgatatattggctgcattggatgcagctgtggaggatggagtagatgtattatcaatatccctcggctcgaaaagggcaaagccttttttcgatcatggcattgctataggcacatttgcagcaatgcagaagggaatttttgtaagttgtgctgcaggaaacgatggccctctccctggttccgtaattaacggagcgccttggatcctcacagttggagcaagcaatatcaacagaagcattgcagcaacagcaaagctaggaaacgggcaagaatttgatggtgaatctattttccagccttctgatttttctccaacattgctacccttggcatatgctggaatgaatggcaaacaagaagatgcattttgtggtaatggatccttgaacgatattgatttcagaggcaaggttgttttgtgtgagaaaggaggaggcatagaaaaaattgccaaaggaaaggaagtaaagagagctggtggtgcagccatgattctcatgaacgatgaaaagagtggctttagtctcaatattgatgtacatgttcttcccacaacacatgtaagctatgatgctggacttaagattaaagcctatatatactccaccgcaacacctacagctaccattttattcaagggaactataattggaaactccttagctcctgttgttacatccttctctggaagaggtcccagcttgccaagtcctggtattttgaaaccagacatcataggaccaggcttgaacatcctagctgcctggccattccccctgaataacaatactgcttcaaaatccactttcaacattatgtctggcacatcaatgtcatgcccacatcttagtggcgtagctgctttgctcaaaagctctcatcctcactggtcaccagctgccataaaatctgccataatgacttctgcagacataatcagtcatgaacggaaacacattgttggtgaaacacttcaacctgcagatgtctttgccacaggttcaggttacgtgaatccatcaagagcaaatgatcctgggttagtttatgatatcaagcctgatgattatataccttatctgtgtggtttaggctataaggatacagaagttgagatcattgcaggtagaacaattaagtgctctgagacttcaagcattcgcgaaggagagctcaattatccctcattttctgttgtgcttgattccccgcagacattcacaaggactgtgacaaatgtgggtgaggctaactcatcttatgttgtcacggttagtgcaccagatggggttgatgtgaag

SEQ ID NO: 44134 - DNA, 753 bp, Glycine max
  Peptide Sequence Number=SeqID_160912
atggacacactgttgaagattattgaaaaaatattggctatccaaataatttttcatcgaatagaggaagaggaggctgaacttttcatggtaatggtagaggctcaaatgcttacagaagcagcaaagtgtgcaattattgtggtttcactgaccacactgagacagagtgcttcaagaaacatggatatccaccaagacatcgtttacataaggcgcctggaaatctccaccaagaagatgattggtacagttgatgttgaaactgattccccttctcctacacctttacctcctcaacctgaacctatatttgttgaccaaccatatactgaaaccaccttctttgaacattcccttcgtaggtctgatagagttcgaaccagacccatcaaatacaatgactatcaaaccaatttcactaataatccaggcaccaaacatcctatttcctccgtgatttcctataataagctctcttcccattatcacagctttattcttaatgtctccactaattttgagcctaagtcttatactgaagcttgtaaacatgattcatgggttcgagctatgcatgatgaaatttttgctttagaaaggaatcatacatgggtgcttactgatttacctcagaataaaaatgtgattggttgcaaatgggtgtacaagatcaaacataatgtgaatggctctattgaacggtataaggctcgcttggttactaagggctatacccaaattgaaggctag

SEQ ID NO: 44135 - DNA, 336 bp, Glycine max
  Peptide Sequence Number=SeqID_160913
atggtcaaggcctcggatccgaagaagatggaggaggcggaggtcaaggttgaaattggtggggtccagcaccatcgaaacagcgaactagtgtcggtggaggatctcgatatagggtggggccgcctctggtacaccatttgggaagtggaactcgccacgcgcgggtttgcggaagggaatgttattagggaaagaggctacaccgttgtgtacagaggagttctgcacgatgcttccgtcgtggctgtcaagaatcttctcaacaacaaaaaatctatccagttgaatcttgccaaatccaatacaatcctaggatacgaaaaggagagttga

SEQ ID NO: 44136 - DNA, 321 bp, Glycine max
  Peptide Sequence Number=SeqID_160914
atggtgaggaaagcgttgccaaccggtgataatcttggaaggaggaacattgaaggtcaagaatcgggttgcaattgtcctttctgctgggggattgaagagtctctcgatcagatattgctatgttgtgctagcatatcattggtaaaaaggagcaagactacactggcatactgtgtggtgactagaggtcgttttacactaattgtgcaggaaaccaactcagatcttagggaagggagtacattaagcgggggaaggatagtaaggggtggacaattttactatagcggaaaaatagagactattaattggagataa

SEQ ID NO: 44137 - DNA, 1032 bp, Glycine max
  Peptide Sequence Number=SeqID_160915
ttttgtgttagtgctatgggaaggcaaccctgctgtgacaaacttggggtgaagaaaggtccatggactgctgaggaagacaagaagctcatcaaattcattctcaccaatggccagtgctgttggcgtgccgtgccaaagcttgctggcctcaggcgctgtggcaagagttgtcgccttcgttggacgaattatcttcgcccagacttgaagagagggctcctcacagaggcagaggagcaacttgttattgatctccatgcccgtcttggcaacagggccagggccttgaaggtcaaggcaggaaaggaaggtgcaaagggaggttgtggtcgccgttggcgacccagggtcccttttgagcactacaagaaaaccctccatgtcaaccaccgcgccgtcgagaaggcgatgttcgctgtcatcttcgatgtcaccgaagccgtcggaacctcaatcgccgccacaaccaaccccacgtggtccaagattgctgccaggttacctggaagaacggacaatgagattaaaaatcactggaacacccatatcaagaaaaaactccttaagatgggtatcgatccagttactcacgaacctctcaataaacaagctgcagcatcttctcaggatagttcatcctcccctgcagagcatttgccacaacctggaaataaccttgatgatcaggtaaaggaaactaatggggttcttctcaactcggaggagaattcaagttcatcacaagctgaaaattcttctggggatgattcacttttgctagaaagcatttgcagtgatgactctctgttaaacagcatgtggctggatgaaactcctcttgtggaagcattatgggacacaacacctaacctagagaacactaacaataacatgagtttgttaccatcttgggaggaaaattgcgcttggttattggactgtcaagactttggtattcatgattttgggtttaacgagatagaggcaaatgcactgcaaactgtaggaatgaaagaagaggggcattag

SEQ ID NO: 44138 - DNA, 222 bp, Glycine max
  Peptide Sequence Number=SeqID_160916
atgttgggtgtacgagaaaacacaggctacaggaagaaattcccatataagtgtttgggagttgctacgtgcacccagcattattgctggggcacccagcaaacagtgaagtggcgaaactgcccttcagcaattattcttccggaagaagggtcttccggaaagtttccggaaataatttttccggaaagtttccggaagaaccttcttccggaagaataa

SEQ ID NO: 44139 - DNA, 780 bp, Glycine max
  Peptide Sequence Number=SeqID_160917
atggagaggaacgaaaatgggaaacagagagttgaaaaacaatgggaaagagagaggggtcacaagtattgtaaacaaaacaagaagcgaccgtgtttgagccaaagaattatggatgacaaagctatcatcccaatttgggggagaagaaacatgttaaatgagctttatgtggaaggggtatgggaggatgatccttataggctgaaagatgaagtgttcaagttttatgatgagagattcaaggaggtagaggaggaaagacctcgattagatggtgggactttacgaggtacattaatgagtttcatgcctatgggatcattccaaggggttgcaattggtcctttatatctctcattacaaaagtggacattcccccgcacttgggtgaatataggcctatctcccttatgggttgcatgtataaagcaaagtgcattcttgagcgggagatcccttttacatagtgctcttatggcaaatgaggttgtgaagaaggcaaagaggagaaggaaaagttgtatgatattcaaggtagattatgaaaaggtctatgtctttgtgaattggaacattttgttctacatgcttggaaggttaggattcaatagcaaatggattatttgggtgaaagaatgccttgagagtaattttgtatctatcttggtgaatagaagtccgacaaaggagttcaaaatcttaaaggaattgaggcaacgagatccaattgcagtatttttgttcaatgtggtaatgaaagggtgggtggtctcatga

SEQ ID NO: 44140 - DNA, 210 bp, Glycine max
  Peptide Sequence Number=SeqID_160918
atgtttggtggtactggctactctgatacctatatttataagcgttcacagctggtaggggtgtcaaaccaggccaagccttgcgggctagtccagcccgttctccaaaaaagctgggctggattgaaatttgagacccgtaaaccatttaggcccgtcccgtttagcctgcaaatctggcggaccacaggcaaccaactcgcggactag

SEQ ID NO: 44141 - DNA, 144 bp, Glycine max
  Peptide Sequence Number=SeqID_160919
atgtcggaggtgctagcgaaacctttggggactaccacacgctgcggttctggtgggagtcgtgagagagaaagggaagaaacccaaagcattaaaagtggtgaaatccgaagcgttggagagttgaaatccgaagcggcataa

SEQ ID NO: 44142 - DNA, 415 bp, Glycine max
  Peptide Sequence Number=SeqID_160920
atggagaagcttgctaccttggttttgatttgctgtttatttacggcacttctattcctctctttaccagtgatgtctcaagaagttgaagatgagagcgattttagtcacgacgaaaagagcgagaatggaccatctcgttggggagacatacaccccaaatggagtttgtgcaacaatggatccatgcagtcgcctattgatctattgaatgagagggttcaaataggatcccatctagggaggcttcagatgaactaccaaccctctaatgccactatcaagaataggggccatgatattaagctagaatgggttgctggctcaggctatcttcaaactaatgaaactaagtacgtactcaaacaatgtcattggcattctccctctgagcacacaatagatatggcaaaag

SEQ ID NO: 44143 - DNA, 711 bp, Glycine max
  Peptide Sequence Number=SeqID_160921
atggccattgatttctggtccaataagaagacatttggatatgcacctcctaactttgtatcttgcaactcccattttatttgtgtggataaaaatatctctttcagtaggaatctccattccgaaaggttttcgaggcacaccctatttcagaatggtcatcctggaagtactaaccctagcccattaagggagttatcaattatgggtgagtttacaattcagattagcaacgaccttgttaatcaacttgttgatgatgcggtcccgaagaaaaaaaccagaaagactagacggaaggtggcaagagagactgaaaagccccaatctaatgaaactataaagcctgatagtgcagttactccagggtggcctgtgcagtcccctttatttctacctgcaacattgcctgtacaaccggtccattcagagttagaaggtattcagtctgtgcttcaggaaagtgagagggttttggaaagattgcagaagcaagaggagaatatgttgcaggaagtaacccaaaaggcaaaggatcttcatgataaagagtataagcttcctaacccaaagcctgagccttgcatggccgagagacttgcgaccttatcatgttacaaggaacatatcaaggaccccttgaagtgtgccagtcttgttaccggttttgctgattgcctgcgtaggtttggccgtttaggtgacaagtaa

SEQ ID NO: 44144 - DNA, 1473 bp, Glycine max
  Peptide Sequence Number=SeqID_160922
atggcgtacgctgaactttctgccgctcgcgaggaccgcctcaaggccgccttggccaaacatgttgcagctcaacgccgcctcgaatccacactggatgcccttcttctaaaactgcctctaagaaccaaccaccactacccttcttcctccgtgcagtcaccactgccacctccgtcacccatgccgactccacctctacttcccacactcatacagtcgcgccccacacccttgccggcttttcatctttccaatctcggtcacgttagtgccgctattcccatttccgaccacctcttcagtgttgtccttagttatggccatgcaatagctccgcatgacaagcatggagaaaatagggacatcacgctatttaagcggggacctggattctttgggactatcatggtctcacgcaagtgcctacccgctgtctttgcactatggacaggtgctaaaactagtgcgtttctccaggacaaaccttgggatcccggtattacgtttggaagccatgcgttgcagccccaacaccttgaggacaaggccctggaccctggtcctcgaaaccagtttctaagttgcagactagtaacatttggtgctttcgttgagagcccatggctgtcttccatgactgccatacctgcttcaactactgcaacccacaccactcgccaaacggagctcaaatatcgccttggccaaacttaccaactcaacctcgccactgacgtcgacaccttggccaccaccatcgacaaccttcttcagcgactaggccctcgcaatcccattccacatttttcatcttccatccctgcgaaggcaccgatatcagccatcatcatatcaactccgcgactcatgctgtctccgccacccacgccaactccgccgcccatgccgcctccaacgtccatgtcgattgcgcctccatgtcctacacccgtgcaaccatttactgcacccttgccgactccacttcccatgcctgctgcctacctccccgatctccaacacactcgcgccactgtttcatgcaacaagctcttcggtactgttgcttcgtatggtcgtgcaacaactcctaatgacaaagctctcgaagggagaaatatgacgttgtttgagataggaactaaataccatggacataccatggttgcatgcaagcaccaaccaactatgtttgcattatggacggctgctgacccagaggagtcccgccggaatagaccttgggattctggtattgattttggaagccattatttgaagcccaacaccttaaggacaaggtgttttagatgggctcgggaatgttacgaagagcaccaagggtctgcaggaagcaagttatatgcggaccaaaagaaaagccacaactccagcttacttaaaagactaagtgcaacagggatagcagaggctcatgcagcatgcaccgtacgtgaaggaagcgcgtag

SEQ ID NO: 44145 - DNA, 303 bp, Glycine max
  Peptide Sequence Number=SeqID_160923
atgctaaagatactacaggccataccaaattctggaacgagttggcaagtacccgttgggactctacctctactgatcccaaactggaaggtcttagttcagtgggaaggcctatcaactgatgacacttcgtgggaagagtgggataagtttaaagccacttatcaccttgaggataaggtgtttttggatggcattgggaatgttaagaagaaaaagatgcagcaaaatctcaccacaggtccgaatgagagaccaaagaggaagatcatcccaccaagacacctcagagattttgtctaa

SEQ ID NO: 44146 - DNA, 828 bp, Glycine max
  Peptide Sequence Number=SeqID_160924
atgtttgtattgaacaaagatcaactcttcaaaccaacattttctgctagcaaagagaggatgttggggaagcaagcgattttctttcaccaaagagcataccatgctaacctcagaatgcttgtccttcgaaccatcatgcctgaggctattaaagacataatctctgagatcgaatccattgcccaaagttgcctcaaatcatgggaaggaaaatattctatccttaatgcatgcacttcgcacacaaggagagcaaggaaagagcttgcacagatcttggctcaaataatctcgacaaggaggaacatgaagcaagatcgcaatgacttgttgggattgttcatgagtgaaaaagcaggacccactgatgagcaaataatagataacatcattggtgtcatttttgcagctcgtgacacagctgccactgtacttacgtggattgttaagtaccttggtgaaaacccccatatcctagaagcagtaacagagtccataataaggggcaaggaagaaaatggagaacaaatcggtctaaattggtcagacataaaaaatgtgcttatgacatccagggtcatacaggagactctaagaatagcatcaattttgtcttttacttccagagaagctatagaggatgttgaaatccaagggtatctcataccagaagggtggaaagtattaccactttttagaaacatccaccataggcctgacaacttcaaagagccagagaagtttgatccttcaagatttgaggttcctccaaaacccaatacctttatgcatttggcaatgggatccatggatgtccggcaatga

SEQ ID NO: 44147 - DNA, 201 bp, Glycine max
  Peptide Sequence Number=SeqID_160925
atggtagagcagaaggaatcacaagaattttggaagaggaaaattgcaacagacctggattcaatgcctttggtaaatgccacgagtcatctcatggtaatattacgtatagaaacaccacgtaggcaaaatttgacaagtgcggagtgcctcaaattagagtctatctttggaggcaacatggcagagcatagagcttaa

SEQ ID NO: 44148 - DNA, 501 bp, Glycine max
  Peptide Sequence Number=SeqID_160926
atgatgaaatgggtcaacctgggaagttccattgaggaagggtcgaaaggtctacaattttgggcttggaaggaaggaagatttgggattttaaggggtgccaaagtaatgcattttaatggaagaagtatctctacaagaaacaagctcgtttgccaggggcggattccctgggaaaagaacaaaaagccctgggaaatggacgtttgccagggattttgccaggggctgaatccctgggaaaaacgcccatcgcaaatcagtttgccagggatttcatccctggcaaaaaaacgaggggctggtcctggcaaaatccctggcaaaatccctgtcaaaatccctgtcttagcccctgtcttctcactgacgcatctgcacacttttctgacgcgctgctgtactgacacaagtcaaatcatacagtgccaggggttttgccaggggcaaacccctgtgaaacgggatatattttttttaaaaaaaaaatttaataaataa

SEQ ID NO: 44149 - DNA, 1749 bp, Glycine max
  Peptide Sequence Number=SeqID_160927
gttgaggagcatgtcatatttgcgaagttccccgaagacttctttcaggtccgccacatgttggggtatgctttgagagttgacgaccacgtcatccacatataccttaacgtttcgtccgatctaatgtttaaagactcattccatcagtcattggatgaatcctggtctagttatatccaaaataggcttccaggaagcttagcacttggaacccagacgttccatcgactagcctatcgatgttgggcagaggcaagtttgtggcagattatgtcgggatggattcctggcatgtcagatggatctgacaagttttttaatgggttttgggcctctgtcggaggtgtcgtcttgcggatctatgtcaaactcactgtccaagttgggttggtagacggatatggtgctactttcaggctctctacacaacactcttatgcttacttttggtcagccttaacggttacaatctccattgtcagtgtagggaatttcattttcaaatgtggcatggagactatggttccaagctcgttaagtgtccttttgccgactaagacaaagtataatgaccctggacaccatgaagttcgttatgatgatggagacaaccaaagggtcatcttccttgatggggttgatccccttgaagtccctatccgtgaaagtgataggagggagacttcggttgtcgctcacgccgttgttattagtgtctttatctgccttgatcttcggctcttcttttgtctgcttcttggttcctgtgctacttttttttatgtcctctgggtcttgctcttgcttggtgactgtctggggtgtgtaatgctcgtacctgggccctttggagagaggctggtgcttgtctggcatatgcctcttgtccgacttgtgcaagtcggccttgatgtttgctttgtgcttttcgagcttatgtccgactgtctacgaacttgccggggcatagtgcgggagcttggaatgcaatgctaccttggggttaagatatcagatctagacgactgtatgcccaaatctgtccatgaattttctgagggactcgtcgtctgcttgttacagactggccaaggcgaccgaggtcatgcagtgagacatgctggtggcgtactgtgcattgaatcattcgacgagggtgttgaagctgtctatggacctaagtgggagtccaccataccaggggggtctcgcgttagaggtcagaccgaggttgacgtggttgagtggggtcccgaactccacacatcggcttggaaaggggttgttgtagcatttgctgataattctcggcttataggtaatagtcgagagcttatagataatgttagagataaacatttgcttatagataaaagtcctacaccaaggaagttcttgtcggaatctgagttgttgttggggtttgaatgcgcttctgggttgaaggttgtacgcccctggctcaagttgagtgcgaggcaaagcaagaagataatgaggcctgcaacctttggggtgatactccttttgatgttgagcgtatcaatgtgcatgggcagagacaagaagaccttcaaggatcaaatgaatgtaaggaacgagaagtttccaaaccatgaaaatgaaaaccacaacccgggttttgcgtatggtggacgcagtgtgaataatcatcattacatccccaggcaggacttcaacaacaatgatggtgctgataaaattgggaatggaagtggatattga

SEQ ID NO: 44150 - DNA, 2815 bp, Glycine max
  Peptide Sequence Number=SeqID_160928
ttggatgtatgatagaacgtttccgggaagaacaggactaaaaccgcattttgtgcaaggagttgaaggatttatttcatgggcatgggcacaagaaatttgtacaacagagggaggaattagatgtccgtgtctgaaatgtaagtgcagatatataattgccgaccctggacatgtgaaccaacacttaaagagagttggttttatgcctgattattggatttggatttataacggcgaaaagtttcaaaattttggggtagaggtcaatgcacaagcttctactagccatggtggaacaaatgtggaatataacgaagaagaaggcaacagagaacaattcaacatgatggatgatatggttgcagatgctttaggggttgaattgtcttacggtgatgatgttgaagatgatcaagaggaacaactcccgaatgagaaggcgcaaagattttaccaattgttgagtgaatgtaatacaccattgtatgaagggtcttcgcactctaagctatctatgtgtgtgtggcttttagctcataagtcgaattatggtagtcctgatgctggtgtggatgatgttacgaagatgttgaaggccgcgactctgtttaaagataatctgccagctagttattatgatgcccagaggttggtgatgaagttgggattagcagttaaaaagattgattgttgcagaaatggatgcatgctgttttatgacaatgagtttgggattaatgatggagcattggaggaatgtaaattttgtcaaagtccgaggtacagtgttcgcaagcagaaacgagtagcggttaagtccatgttttacttgccaataataccaagattgcaaagaatgtttgcctcgatgaaaactgctagtcaaatgacatggcatcattcgaatggaattctcggagtgatgcgacacccttctgatggtgaagcgtggaaacactttgatcgagtacatcctgattttgcagcagatccacggaatgtaagacttggattatgctctgacggtttcactccatatatacaagcttcagcaaaaccatattcttgttggccagtcgttgtaaccccgtacaatctccctcctgagatgtgcatgacaaaaccctacatgtttttgagttgcattgtaccaggaccagataaccccaaagcaggcatagacgtgtttctacaacctttaattgatgatttgaagaggttgtgggttggagaatggacatatgatatttcaagaaaacaaaattttcgaatgagagcagctttgatgtggaccattaacgactttcccgcatatggcatgttgtctggttggagtactcatggtagatttgcatgtccacattgtatggaacatacaaaggcatttactttggataatggagggaagagttcgtggtttgactctcatcgtaggtttttgcctcataatcacccgtttagaagaagtaggaatggcttcaagaaggatgagagagtattagatgggccgccccctaagattacatcagaagaagtgtggttaagagtttgtgattatccaaaagtcactgattttggccaaactgtcccaatacccggatacggagttgaccacaactggactaaaaagagtgtattttgggacctcccctattggaaagataacttgctcagacataatcttgatgtaatgcacattgagaagaatgtttttgacaatatatttaacacagtgatggatgtcaaaggcaaaacaaaagacaatgaaaaggcaagaaaagacttagaattgtattgtaaaagaagggacttggagttgaaacctcaaccgaacgggaagttgttgaaaccgaaggccatatatagcctaactgcccaagaagccaaattagtgtgtaaatggttgaaagatttgagaatgcctgacggatattcttccaacttagctaggcgtaattttcacatcagagctgctgcccgtctctccgacatgcttagaaatgctcgggttcgttatgagaggaagagaacgaggccgcattggattggggagccgttgatggcgcagttggtggattactgggccagtgccgactttaaggagaagtctgagaaggcgaagaagaatcgggcatcggagaagggaggctgcattcatactggaggttgtataagcaatgcagagcatgcccgcagattggccaagaagcttggaagggagccatatataaatgagctccataagcaaacacatacatacagttctggtcagtttgtcgacgatcgctccaggatatgccaggaggaatatgatagacagcttgcagaggcgctctcccgtggttgctcggttgatgaggcgttgtcacttcgcacttggactaaagttgccggtgacaagtcaaagggcaggttatatggtgccggcaacttagcaggcaactaccgcaagggcattgctgcaactctgaagtttaccctgaatgctggagaagggtcttcgaggcaacccgagctcactcctgaaatgagggaaatgatacagaagttgactcaggagcagcttgcggttcaaatggcaagccaagagcagcttgtgcagcaactgcttcaaaaacaacaagattactttcaggagcagttgtcacaatttaggcaagctcaaggctggcctacaagagagcagcagggtacagggacctcccagcgtaatgcccaaaatgtgagagcgccgatcttagatgataatcatgacccgtatgaggtgtatggtgaaaacgaggaggatgtcgagaccgaggaggaggattga

SEQ ID NO: 44151 - DNA, 381 bp, Glycine max
  Peptide Sequence Number=SeqID_160929
atgaggtttggggcaattgcattcgttttgatgctagcattttgctgttgtacgggttcagatagatggagaaacatagaggtcaaaatgcatggaaaaaacaaacaagttagcagcgagaataatgatcatcattcaatccctcttaaagactatggtaaacctggctcaggccaccatgacgttactgcagcagatgataacaatgatcatcattacatccctcgcaaggattttggtaccattgcgtccataatagtaattataaggaagatcgtacttgttatggccaacctggcggaggaattaaagttaatcccgggcccgggcattgataatttactcacaagaatcatgccaagcatcctggcgacgaattga

SEQ ID NO: 44152 - DNA, 1104 bp, Glycine max
  Peptide Sequence Number=SeqID_160930
atggacgagctgagtgagggagccaagggctacatccagttggaagaaatgtccaaattcaagaataaagttcgacaaaccggacataagctcgaaaagcacaaagcaaacatcaaggccgacttgcacaagtcggacaagaggcatatgccagacaagcaccagcctctctccaaagggcccaggtacgagcattacacacccctaacaaaaaattgcaccacaattttggaggaagctttcaacctagaggtacccatctggctaccccagacaaaacctcccaggccggggtcagacacaaccaaatactatagatatcatcggggtattggtcataataccaaagactgttgggctctgaaggacaagatagaaaaacttatacagacagtcaccaagcaagagcaagacccagaggacataaaaaaaagtagcacaggaaccaagaagcagacaaaagaagagccgaagatcaaggcagataaagacactaataacaacggcgtgagcgacaacctccacaagaatgagaacccgcccaacaaatcagaggacagttccactgatatcctctactggaaaaccttcaagagagtcgaggtctaccccgacactgtccaccctcatgtcggtctactcttcgtgtgcgagagagttgacactagaggctatgtggacttgatgaccaccttcggtcagggaaagctctccaagagctttaacattagatatctactagttaatgcagacacattatactttgtcttagtcggcaaaaggacacttaacgagcttggaaccatagtctccatgccacatttgaaaatgaaattccctacactgacaatggagattgtaaccgttaaggctgaccaaaagcactcaagtaatgatcgtgaacgaatggtctcaaatttgagccctgaccgtctaccaacccaacttggacactacaactcaaacctaaacccgggcagtgcacgtagctcagtaaggacctcaccagtcacgagcactggtgcatcatcgacatgttacgcagaaatgtggatttatttgccttacatccatctgacatgccaggaatccatcccgacataa

SEQ ID NO: 44153 - DNA, 672 bp, Glycine max
  Peptide Sequence Number=SeqID_160931
atgaagacatggcctaaagatacggagagtttactctggaagagcaaaaggggacacgtggaaattagaggaagaggttattacctgggtggaagaatggtagaaaccctctctagagatgacttggcctccagattgtcgctgacaactgatgctgcttcagtggaacctcttcttctttcagattcatttatcactataatggatactaatgactactgtgcaattcctcaacaacttagagatcaactgggtgaaaggtatcctgaggcaaggcgtgcatatttaaaaacagggggagattttccttttctttcaaaaacagggggagattttccttttctttcaagaccggatgaagataacttgcatcttcagttgcaccttaggcgtgttgatgtggaagctcggccagatttggttcacaacgtacctaaaggtgatattggaggaagccctggcaaagaaaataacagagatggctctgacaagtcacataaggatgataaaggagggtcagaaaatccacctgctaaatatgagataaatcctactagcccagaaagctcgggatccggtaatttagacaagcagacactcgatagttcagaacgtttccatttggatcatgaactcaccttatatgcctttcctggtggattcacaaggtaa

SEQ ID NO: 44154 - DNA, 1290 bp, Glycine max
  Peptide Sequence Number=SeqID_160932
atgtcgcaggtgaatgagcaccaccacgcaccctcaacgccagggaagttgaagccagaaaaatccccatacaaccaccgcctccgaatccactcctcactctccaagctcacactctggtcctccttcttcctcgcattcatcctcttcctcttcattctgtctccgccgtcgccctccgcctctccccgccgctccctcggcgactcctggggcggtccccactgggagaagcgcgtggccaagtccgcccgccgctcctccccctccagcctctccgtcctcgtcaccggcgccgccggcttcgttggctcccacgtctccctctccctcaagcgccgcggcgacggcgtcctcggcatcgacaacttcaaccgctactacgaccccgccctcaagcgcgcccgccaacgcctcctcgaccgcgccggcgtcttcgtcgtcgacgccgacctcaacgatgccgccctcctccgcaagctcttcgacgtcgtccccttcacccacgtcatgcacctcgccgcccaggccggcgtccgctacgccatgcaaaaccctcaatcctacatccacagcaacatcgccgccttcatcaaccttctagaagcttccaaatccgctaaccctcaaccctccatcgtctgggcctcttccagctccgtctacggcctcaattccaaagtccccttctccgaaaaggaccgtacggatcaacccgcgagcctctacgccgccacaaagaaagcaggggaagaaatcgctcacagctataaccacatctacgggctctccattaccgggcttcgcttcttcactgtttacgggccctggggcaggcccgacatggcgtacttcttcttcacgaaggacattctcaaggggaagcagattgcgatattcgaatctcccgatgggggaaccgtggcgagggatttcacctacattgacgacattgtgaaggggtgtttgggggctttggataccgcgaagaagagtactgggagtggggggaagaagaaagggcctgcgcaatttagggtttttaatttggggaatacttcccctgtgcctgtgactgagcttgtggcgattctggagaagcttcttaaggtgaaggccaagaagaaggtgcttccaatgcctacaaatggagatgtgaagttcactcatgctaatattagtttggctcacagggaccttgggtacaggcccaccactgatttggagactgggctcaggaagtttgtgaagtggtaccttgaattttactccaagaagacctcttggtga

SEQ ID NO: 44155 - DNA, 390 bp, Glycine max
  Peptide Sequence Number=SeqID_160933
atggctgagaggacggttttgcattttcttgccacacttgtgcacttatttgattggacaataccccaaggagaaaagttagagagtattggtacagtcacagcacagcactggttcttgcattgtgtatcatcatttccatggcatggctctacttcctcaaactcaccaacaacactcagaagaggcttccctatcttcggaaaccttctatctcttgacccggaccttcttcacacttacttcgccggcctgacccagatccacggcccaattctgaagctccgactcgggagcaagctaacgtcaccgggcatggttctcgaggtgctcaaagagaccgacaccgttttcgccagccacgacgtcacagccgccgctccgacatag

SEQ ID NO: 44156 - DNA, 603 bp, Glycine max
  Peptide Sequence Number=SeqID_160934
atggtttttgaatccagacacgcacatataaaggagatgcaagattacgtgtacaacctgaaagagtattggaagagtcacagcacaacattggttcttgcattgtgtatcatcatttccacggcatggctctgcttcctcaaactcaccaacaacactcaaaagaggcttccatcaggcccatcgggcctccctatcttcgggaaccttctatctcttgaccaagaccttcttcacacttactttgtcggcctggcccagattcatagcccaattctgaagctccgactcgggagcaagctaacgtcaccggctatggctctcgaggtgctcaaagagatcgacaccattttcgctagccacaacgtcacaaccgccgaaagggccgcgatctacaacggcttcgacatagcgtggaccccgtactggccgagtggcggatgctgcggaaggtgttttttgacggtgataaatgtgataacgaataagatgtggggagggccagtggaaggggcggagagggagagcatgtggggcggagttcagggagctagtgacggagatgacgcagcttttgggaagccgaacgtgtcagatttttag

SEQ ID NO: 44157 - DNA, 177 bp, Glycine max
  Peptide Sequence Number=SeqID_160935
atgttgagagcaacaaggaaggagaacacgttggattatcatgatgtttcggatacaaaaaggaacaaagatgcaacatctagttcaaagtcgcccaacccctatgttaaaattcatgataaggggaaaatgttgatgatgaaggtattcatcatgctactgagtatggaaaggtga

SEQ ID NO: 44158 - DNA, 357 bp, Glycine max
  Peptide Sequence Number=SeqID_160936
atggcaatggtgcccaaggtgcgaagccccttgttcaaagagcttctagttgcaaccatatcaaatgcagattttgctttacctgtggggtgcttagatacaaaaggaaacgaagaaaaagcatctagttcaaactcgcctaactcctctgttgcaattcacgataaggggaaaacgattgatgaagttgctcaagggaagacatcaatctatgaggaccaatctggtctaaagtcttggcttggtgaaagtcacaaccatggaaatgatgatatgggtgttgttgaagaagattttgacattgagggacaaaatatttgcaccatatgccttgacacaaggaatagtggactatga

SEQ ID NO: 44159 - DNA, 558 bp, Glycine max
  Peptide Sequence Number=SeqID_160937
atgttaagagtcccaagcagttgcccagggccaattcggccagcccaacgggccaagttgggttttagagtggtggagtgtgcagaagagcgtcgcagtcgcaaccctaatcagaagaagcgcagcttcaagcgagtgacagccaccagccatgggtctaagggtatatcctcttctgctttgccctacaaaaggacacctcctagctggctcaagatctcttcgcaagatgtcgaagaaaatatctgcaagtttgcgaagaaaggtttgaccccgtctcagattggtgtcattctcagagattctcacggtattgctcaggtcaatagcgtcactggcagcaaaatccttcgcatcctcaaagctcacggacttgcgcctgaaattccagaggacctgtaccatttgattaagaaggcagtttcaattaggaagcatcttgagaggaacaggaaggacaaggactccaagttcaggttgattcttgttgagagcagaatccaccgacttgctcgctattacaagaagactaagaagctcccaccagtctggaagtag

SEQ ID NO: 44160 - DNA, 1470 bp, Glycine max
  Peptide Sequence Number=SeqID_160938
atggagagtttactctggaagagcaaaaagggacacgtggaaattagagagaggaagaggttattaccctgggtggaagaatggtggggtcagaaacggttttatagagtgtgctgcctggaagggaagggttaccgtgtcatatctgttgacatacctcgtgtatggaataatactgagtggattcaagcatttgaaaagttcttggatgctattgatgtacaccattgccataaggcgcaatggtgtgtttatatggcagaatttttgccttccaccatgttctgccatctgtcattgataacactgtccattgtgcaccatataattttgttgggagctgtaacatgttacaactttggaatttggatattatgtgagatgtccatacacatgtatcctaaggagggaatggttcctagacatttccaaggatttatttttgaagccaagttcttttgcaatatatttgaagacccagcatgtgagcctaaatatatttcaatcccacctatacaggctagcctgcttaccaagttgaagatacatctttatggtacgtcacttggtggtttcctagcacaactctttgctcagcaacgtcctagaagagttcgatcgttagttctatcaaacacatttttggagacacggagtttctctgctgcaatgccatgggcacccattgttagttggactccttcttttttgctgaagcgatatgtcttaacaggaattcgtgatggtccccatgaaccatttattgcagattcagtggactttgttgtttctcaggtagaaaccctctctagagaagacttggcctccagattgtcgctgacaactgatgctgcttcagtgggacctcttcttctttcagattcatttatcactataatggatactaatgactactgtgcaattcctcaacaacttaaagatcaactgggtgaaaggtatcctgaggcaaggcgtgcatatttaaaaacagggggagattttccttttctttcaagaccggatgaagttaacttgcatcttcagttgcaccttaggcgtgttggtgtggaagctcggccagatttggttcacaacgtacctaaaggtgatattggaggaagccatagcaaagaaaataaccaagatgactctgacaagtctcataaggatgatagaggagggtcagaaaatccacctgctaaatatgagataaatcctacttgcccagaaagctcgggatccggtaatttagacaagcagcccctcgatagttcaaaacgttgccatttggatcatgagctcaccttatatgcctttcctggtggattcacaagggaaaagcgcattgtgcctccaggaactcctttacatttcgtgtgggaatatattgttcttttttgtcttcttcgtcacgtcagttgtctatacattatatggaactattctttggaatttaggcaagttgtgtaa

SEQ ID NO: 44161 - DNA, 2052 bp, Glycine max
  Peptide Sequence Number=SeqID_160939
atgagtttccttcatctcttctttcatctctttttgttggttgcatttattccacagatagttcatggaaatgcagaactaagagctctgatggacttgaaatcttctttggacccaaaagacaagctccttggttcgtggaccagtgatggtgatccatgcagtggttcgttcttaggagttgtgtgcaacgagcacaacaaagtggctaatatatcattgccaggaagaggtctttctggccgtgtctctcctgctgtggctgaactcaaatgcttgtcaggtttatacttgcattacaacctgctctctggggacataccaggagagattgcaaatcttaaagaattgctcgatctttatctcaactttaataatctatctggaaccattccttctgatatcgggaacatgactagcctccaagtgctgcagttaggctataaccagctagaggggaccatacctgaggaactgggttcattgaagcagcttaatgttatttctttgcaacataacaaattaactggtgaaattcctcaaagcttgggtcacttggagaagctaaggaagctatatttgagctataacaacttcagtggcacaattcctgtaaaactagctgatgttgcaaacttggaagttctagatattcaaaacaatcatctttcaggaactattccttctgcattgcagagattaagggaaggattccaaggtgcaaacaaccgagatctatgtggagatgacttttctgctttgaaaacttgcaacaaagatagaatatttggcgttagtcagattagtgccccaaatatatccatatacagaaatcctccaataacattcccgaagcctgtaaatgcccacttgcattgtaaccagacccattgctcaaagtcaagaagctttcttcttcttgtcattgcagcaagtgttacaactactgttatcacattaataagttctggaattttcatatttgtcagataccggcgccaaaggcagaaggttaggaacccatcagattattctgaaggccaacatagtccttaccagcctaaagagttctacagaagttcatctccacttgttaatcttgagcattattatactggttgggattcattggctgatggtcataatgagagtggattatcccttgaatatttgaaccgttttagatttaatattgatgagattgaatcagcatcagggcacctttctgaggccaatttattgagtaagagcaaattctcagctgtctataaaggaattcttagagacggttctcttgtggctattaggagtattagtgtgacttgctgcaaagccgaggaaggtgaatttttgaagggtttgagcctgttaacctcactgagacatgaaaatattgttaagatgagaggcttctgttgctcaaggagtagaggtgaatggttttttgtctgtgactttgccactaggggtaatctgtctcaatatcttgacaaggaagatggaagtgcccatgtaattgaatggtccaagagagtttctattatcaggggcattgcaaaaggtattggttatttgcacagcaatgaagcaagcaagcctacaatagtacaccaaaacatttcagtagaaaaagttattctagaccatgaatttaaccccttgatcacagatgccggcctccctaagcttcttgcagatgatgttgtcttctcagctcttaaagcaagtgctgccatgggatatctagctcccgaataccttaccactggacgctttactgagaagagtgacatatatgcatttggggttattgttcttcaagttctatccggaaaggtattgatggggggtacaatccgggtggcagttgaagctttcagatttgaagattttgttgacacaaatctgaagggagattattctaaatctgaagccgcaattctttcaaagcttgcaattcagtgcactcttgaagtgccagagcaaagaccaaccatggtggaggtgattcaagagctgaccatgcttcctaatccttcacattcttcataa

SEQ ID NO: 44162 - DNA, 351 bp, Glycine max
  Peptide Sequence Number=SeqID_160940
atgtacattgacaaaggagatgatggtccagggtggtcaacaacttggaaagctttattgtgggcacatcttcacaatagtgagcacgcatattgcatgataaaacactttattgtcttggtggaacctgatcatggatttggtttcgaaggaggacttttcagcaaccttttcacagcacatccccttttccagattgatgcaaactttgggcaaggccaatctttattctcactaacacttgtggaagcaatgccttccaaggttattttgatgatgcccaagaatcaagagttaagcaaattccaaagattcaagaatctagtttcaagaatcaagattcaagaataa

SEQ ID NO: 44163 - DNA, 588 bp, Glycine max
  Peptide Sequence Number=SeqID_160941
atgggtggtggcgaggacaaagatgatggggtggaagatggagtcggtggagggcaaccatcctatgggatgttctcccgggttgaaaagcatatgaatttggtgaggacgaagatgatagggtggaagatggagtcgtctgtgtctactggcatcacaatggacatagaatctttaatctccgattctcaacattaccctctcttgaaccaaattgacaatgcgtgccacgacatgagctccttggaagacaattcaaacgcggatggttttggttttgggcttggagaaggagttgtagttagttttgtctttgggggatttgatgaagaacttgagcttggagacctacttgcatttcacattgaggacgacattgcggagggtgaggagggaggagcaacgggagtaggagccggtggtgaccttctggtaggtgaggacccagaggtcgaagcagcggaggaagctggagaggtttgtgatggcatggttggggtggtagaagttattgatccacatctgacagcaaagggaggcaccgtgttcttcgaagggggtggcagaggagaagcggcgaggggttga

SEQ ID NO: 44164 - DNA, 1776 bp, Glycine max
  Peptide Sequence Number=SeqID_160942
atggcgtggagaaaagggtgtgaggaagtggctaattcgaagcctctgttcctcacgatctacactgttgtcatcattggaatcgtggtttcctccttcttcgtcttctctgctatatactcaaccaaccctccttctgctcaatcttctgcatggctctcttccatttcgagtgatgaaactcgtgttacagatcagacactaaaggtttctcggtcagcagcggtgcttattgtgcccactccttccccaggatcacaaaatgaatggccaacgtctatatgggatgatccaccacccaataaaaagatgccacctttggaggatttcaggctgaccaagaaactggttcagcaaagggtgaaggataatgctgtaatagtgacctttggtaactatgcattcatggattttattctgacgtgggttaaacaattgagagatctgggggtttctaatttccttgttggtgcaatggataccaaattagtggaggcactctattggaaagggataccagtttttgacatgggcagccatatgagcacagtagatgttggctgggggtctccgacatttcataaaatggggagagaaaaagttattctgatagactcaatactgccttttggtttcgagctgttgatgtgtgatactgacatggtttggttgaagaacccacttccgtatcttgctcgttatccagaagcagatgttttaacttcaagtgatcaagttataccaacggttgttgatgatagtttggaaaattggcctgaagttagtggcgcatacaacataggaattttccattggagacctacagagtctgcaaaaaaattggcaaagcaatggaaagaaatgctcctagctgatgaccagatatgggatcagaatgggtttaatgatattgttcacagacagttaggtccttctgttgatgatgaaagtgggcttgtttttgcttttgatggaaaactgaagctggggattttgcctgcaagtatcttctgtagtggacatacatatttcgtccaggctatgtaccagcaactaaggttggagccatatgcagtgcacacaacatttcaatatggaggcactgaaggaaagcgccatcgattgcgagaagccatgctgttccttgatccaccagaatactataatcctccggggggtttcttgtcatttaagccacatattccaaaaaacttgttgctaagtggggagcataatgttgaatcacattttactcttgttaattatcaaattaaacagattagggcagcacttgcaattgcttcccttttggacagaacgctggctaaagaggcaagcacgcaaaagaactcggatgaaggtgaaactgcaggattagggtcatccgagttggtcggcctcattgccatcagggcggctggaacagaaatccgatgcaccgtcaagcgcgggaaacagaaacccgaaggcatcaaaagggggaaacatcaaaccaacatggaatggcccctaaccttggtcactggtcagaaaggtcactggaggacagcggaagtcgccaggaaagttataaatgttgccggaaaaggagcagctagtagaagggtccaccagaatgcgaaaaacaaaggaaagaagtttgccagaaaaggtacagtgagtataaaggtccaccggggacaatgggtgcctggtgggggacaatttttgttattccctcaacctagctctagataccatgtgaaaatgagagaaactgagggatatttggactga

SEQ ID NO: 44165 - DNA, 405 bp, Glycine max
  Peptide Sequence Number=SeqID_160943
atggagtggttttataggatatctcacccattcatgagtctaccaaagcttggggagcctcctatacatccacccgtggtgcatgatgatacatatattataccgaatccacctgtgttgctcgttcgctcagcatttatgccacaacaacctacacctgcaactgttgatgtagacatgcctcgacatgcaatggctgcttgccaaaaggtagcagaaagcttggaacacataatcaacatgaggatggtcactgctagaactgatgcatacactttaactgagcactgcctaagattagccagagtgtcactgagcaaggaaatgtttatgttcgctcaagacgaaggagggatacacaggacagagatggtggtggatgacaatgatgatagttgggattga

SEQ ID NO: 44166 - DNA, 213 bp, Glycine max
  Peptide Sequence Number=SeqID_160944
atggggcacagagaatggtcagttagagtagtcttacaacagtatgcacagttaaagtggtcaagagtagtacctgaactcgacgaacggctccaactctgcacgtgtctccgttcaaacaactccaactacggttacgccgtcgagattcagagagggagtgggccggcgagattgagaaaggggccagggttgtgcgccggcgaggcttag

SEQ ID NO: 44167 - DNA, 180 bp, Glycine max
  Peptide Sequence Number=SeqID_160945
atggatattaggagatacatgagcgtggaaggagaagacgagcctagcacaaccacaaaggaaaagacacacgaagaagacaatggagagaacgaccctctatttgtgcataggagaacaccccatggagaagacgatggagtgaagaatgtttgtgtggaggagaagacactaacgtga

SEQ ID NO: 44168 - DNA, 840 bp, Glycine max
  Peptide Sequence Number=SeqID_160946
atggttagaactagaggtttgggtcgtgccttaggtaaggttataagcaaagccttggggagagaggatgatcatcattcagatgatgtcccccagcggcgaaggcctacagcatcggcacgtaggcaacgggaagctgcccctattgtcgagcatgagcctgtggtagctgcagatgaccctgttatagctgcagatgtacatgcacctggtgcagacactggtgatgatgctgagggatttccaggtgggccacgtgacccatcagtgcttaccgagtatgctaaccatgttgcagttagcatatggaatggagagaaatttggtaggcctgctcatgaaattgagggtctagttgctgccataagactaagttctttgatcgcgtgttcagtaaacactagcaatcggggacttatattcgcgtttgtggagaagtggcacaggaaaactagcagtttccatcttcccgtgggagaggttagcatcaccttggatgatgtgacatctctgcttcatcttccaattgttggtgccttccataccttcgagcctctgcatgtcaacgaggatgtgttgatgttggttgagttactagaggtatccgaagaggtagtcagggccgagacaacacagtgtcatggaccatactgttggatatatgagcactttccatcagttgcggagtgtatggctgatccggactacgatgaggtgtcaccacgtgcatctacgatgggggcccgttgccgtcaggcactgaccagagagggtcatgcgccagttcagatacgtccagagtattcctacagaggctgtcgattcatgggtgtcatttga

SEQ ID NO: 44169 - DNA, 849 bp, Glycine max
  Peptide Sequence Number=SeqID_160947
atgacagggaaagcattgttaacagtgagacagagagacaagaataacatttgtgaagaaaaacaagcagagaaaaatcggagttatccgaatctaacaaccacttattcacaatcacagacagagaaaaaccaatcggaggagaatgaaactagtttggtccccagagacagcatccaaagcatacatcgaaacagttcaatctgtaagcataagcacgctctttgtgttttctacggcattatttcgtttatttattgtcggattttccgggaatcgggggtggcggagctagtgtcggcaatggcggcggggtggaacgcgcagctgattgtggaaacgtggtcggaggggggagtgatggcgacgagcgtggggttggccgtggcgaggacgcacacgggagggaggcacgtgtgcgtggtgccggacgagaggtcgagatcgaagtacgcggagagaatgggggaggcggggatgtcggcggagatagtggtgggggaggcggaggaggtgatggaggggttggccggcgggatagacgtcatggtggtggattccacgcgcgtgaacttctcgagagtgctgaggctcgcgaagctgagtaacaaaggtgcagttttgataagcaagaacgtgaactccgccaccaatagtgctacttccggtttcagatggcggagcgtgctggaagaagggtcgcgtcgtgttgttcgttcggtgtatctaccagtggggaaggggcttgagatagcacacgtgtcggccattgggggaggctcggctgctaagaaatggttcaagcatgttgaccaacaatcaggggaggtgcacgttattagacgatga

SEQ ID NO: 44170 - DNA, 828 bp, Glycine max
  Peptide Sequence Number=SeqID_160948
atggttaggatcagaggattgcgtcgggctttaggtagagccttaggtagacatgttagtggtgatgagaaagaagcccctcagcgttgccgacaacatcagcacgtagacaatgggcagttgcaactccagagtttgggcaggagagaacgtattgagttgaagtttacctctcatgggaggaaggtggagaaatttggaaggcctacacctaagattgaaggcataatggttgttacaggattaagttctttgattacatgttcgttggagacaagtgacacggggcttttatttgcttttgcggagaggtggcacaaggaaactagcagcttccatctatctgtaggagagctaactataaccctcaaagatgtggtatcctcattacatctacccatcataagtgcattccaaacctttgatacaattgatgtagaggaggttgttgacttcttagttgagttgcttaaagttagtagacaagacacaaaagatgagattgagaaatgtagaggggcatatgttcgccttgcctggctacgagacgcttatcatagcaaatgtgacgcaagacaatggaccctagcagctggagcatattattgcatctatcttggatctatgagcatttccatacaattgcatccattattgcagtcttacaggatatatcactttcttgtagaattgttatttgtatcttttaatatgtgcaatcttggatctacaagcatttccctacaattgcatccattattgcaaatgaggattaccatgagaggaaaccatgtgcttgttgctggaagtgcgggaaggcattactag

SEQ ID NO: 44171 - DNA, 711 bp, Glycine max
  Peptide Sequence Number=SeqID_160949
atgagtaccggcaccactagaatgctagtgaaggagatgttgcaactctcttcttccacacttcacttctcttctgcgtttcgcgccctttctcctcctttgccattctcgattcaattgcgacgctcgcgccgccctgcaattcgatgcgcttcctcagactccgacaaagtatcgtctcggctgtcgcaggttcagcaccttcttcaacaggccgaacaccgtgctctctccgccgaccagggcccacctcctaaaatcaccttagatcatgttacggtgagctttgccagaagtggaggacctgggggtcagaatgtcaataaaggaggctctttagttgtctttgtttgtgctgattgggcagtgaacactaaggtggacatgcgcttcaacgttaaaaatgcatattggttaagtgacagggtcagggagaagattttgcaaacggagaaaaaccgtattaacaaggatggggagcttgtgatttcttcaaccaaaactagaacgcagaaggataacattgaggatgctttggcaaagcttcaggaaatcattgatgcagcatctcatgtcccaccacctccctcagaagatcaaaagaagaaaattgcaaagatggctgccataggagaacagaaacgcctcaaaagcaagaaggtgctttcagataagaaggcgttcaggagaagtaaaaatagctgggactaa

SEQ ID NO: 44172 - DNA, 756 bp, Glycine max
  Peptide Sequence Number=SeqID_160950
atgtctggaaggaaacccttgtacaggaaggcctttgttttctttagttcacctattgccagagaattggttatggaaattaaaaaagatgcacaggtgttgcctcgtataggtgctctgagagagatgaacttggagtattttaccatagacagtcagggcttcattacaaacaatgagagagctttagtggagctatttggggatgaggagaataatcgtaaagctgttgcatgtttaaatgtgatggctactcggattgctacagtttttgcttcattaagagaatttccttttgtccgctttcgtgctgccaagtccctagatgcaaccacaatgactaccttccatgatcttattcctacaaaacttgctgctggtgtctgggactgtcttatgaaatataaaaaaactgtacctaatttccctcagactgagtcctgcgagttgctcatcattgatagaactattgatcagattgctcctgtgatacatgaatggacatatgatgccatgtgccgtgatttgttgaatatggagggaaataaatatgttcatgaggttcctagcaagactggtggtccacctgagcgaaaagaggttcttttggaggatcatgatcctatatggcttgaacttcgtcatgcacatattgcagatggttatctcttccatttacaacttaagcaacatgatcctttgggtattgatggccttgccaatgccaggctagtgaacggctgcatgagaagatga

SEQ ID NO: 44173 - DNA, 159 bp, Glycine max
  Peptide Sequence Number=SeqID_160951
atgtataatagagatggcaacaaactaatatttgttgccaaccttaatgaggatcatgagccaaactatgagcttcttccattggctagaggagatttttctttggatcaagaggctgagattccaattgagattccaaaaaggatgaatattgaatag

SEQ ID NO: 44174 - DNA, 951 bp, Glycine max
  Peptide Sequence Number=SeqID_160952
atggtggaatggattatgataatgagtttcatatgtgtacaaatgatgagcttctttgtccagattgcaggaaaaattaacagaatcattagggagtcaggacttcgggaacttgggaagctagagcaagatcttgtttttggagatgcagggatgaaagatgtgatcaaatttttgactacatacgaagatacaagtcgtgaaaataagttgcgcttgttaatgattcttgcgtccatatatcctgagaaatttgagggtgaaaagggtctgaatttaatgaaggtagcaaagttgacagatgaggatacaattgccataaataatttgagaatgcttgggggagaacctgataccaaaaagacttcgacgagttcttttgctcttaaatttgatatgcacaaggtaaagaaaaagcgtgcagcaaggaaagatcgttctggtgaagaggagacatggcagttatcacgtttttatcccataatagagagcctcatatgtggtgactggatgatcattattcaggaactcatcgaaaaagttagcaaaaatgaattatcaaaactggactatccttgtctaaatgacccaagtccaactttccacggtacaccttatgctggaccagtaactcaaaatcctcctgctcattcaatgagatcaaggcgtacaccaacttgggctcgacctagaggctctgatgatggatattcaagcgattcggtgctaaaacacgcatccagtgatttcaagaaaatggggcaaagaatatttatattcattgttggtggagcgaccagatctgagcttaggatatgccacaagcttactggcaagctgaagagggaagttatactaggctcgtcaagtattgatgatcctgcacaatatatcacgaaattgaagatgctgacagcacaggaactttcattggatgatctccagatatga

SEQ ID NO: 44175 - DNA, 363 bp, Glycine max
  Peptide Sequence Number=SeqID_160953
atgaccacctacatcaatcatcattgcgaaaaacagatatcaatatgtgacattatcaaaatgatctctgcatatggattacatgggagaggtgaggaggctattattacgtattacaaaatgcttcaacaagggttcaaaccagacatgataacagtggttggtgttctttctgcttatagcaaggcaggattggtagatgaaggcattagtatatacaagtcactcatgactaagtataaaataaaaccaacagttgaaatttgtgcttgtgttgtggatatgctaggtcgatcagcccagcttgatcaagccttggaattcatcaaagaaatgcctttagatcctagtccaattgtttga

SEQ ID NO: 44176 - DNA, 627 bp, Glycine max
  Peptide Sequence Number=SeqID_160954
atgactgaaaactataaatcaaacaacaataactgtaaatcaaacaacaataacaacaataactttaaacaaaagcagcagaaacatgatgatattattcagtctattgcagctggaaataaacagcctcttgttccacatctggaatttgaatattctgatgttgggattcatgaagacctgtataaacttgttcattattcatgtgaagagttattctctaattctacctcacacataattctagcataccttcctcaatttggatattgggttgatcaaccaagagttgctgaagtgcaccaagatcatcgtcactgcaatgaggttaatgcaaaagctcataaaggtatccaagttggtttaaaggaagttaaggtttcacacctttacttcactgatgattcagatctcttcttggaggagtataatgatccctttgtgaatgttttacttctgattatactaagtcatgaagactgtttatgtttaacgataagtttgattaagagaggaccagcaggtttgaatggtgataacaaaattcttttacaagctcctgcggctgcttctcaaggttacaggcttatagcaccctctcttttactttatcacacgcatatatag

SEQ ID NO: 44177 - DNA, 222 bp, Glycine max
  Peptide Sequence Number=SeqID_160955
atgctgaaagggttacaagttgtggccagaggggtgctaggccatgtcgaaggagtgcataggtcatgtcaaaggagttccaggtttaggctaaaccacgtcgaaagggacttaggtcatgccaaaggagttccaagttcaggccaaaagagtactaggttatgtcaaaaggatcttaagtcatgcctaagagattctaggttgtggttgaatgagtattag

SEQ ID NO: 44178 - DNA, 2268 bp, Glycine max
  Peptide Sequence Number=SeqID_160956
atggcggcgacgaacgccggcttggcggcggcggactcggcctccgccgacgaggcggcggcgaagacggcgcagaagcgctacgaggggcttctgatggttcgaaacaaagcgataaaaggaaaaggcgcatggtactggacacacttagaacccttgctggttcacaacaccgaaacggggctccccaaagcggtgaaactccgttgcaccctctgcgacgccgttttctccgcctccaacccttcccgcaccgcctccgagcacctcaagcgcggcacgtgccccaatttcaactccgccgccaaacccatttcttctgtttcccctgttctccttccttcttccacttctcctcctccttcagcttctcccttcaaccaccgcaagagaaccaccacttccccttcagcttcgggttcaggctcgggttctctctaccacgcaccctctcggttcgggtcaggtttgattcctcagcagcagcatttgatgctatctggtgggaaagatgatttgggagctttagctatgttggaggacagtgtgaagaagctcaagagtcccaaaacttctcctgggctcgctttgagtaaggcccaaatcgacagcgcgattgagtttctcggcgattgggtctacgagtcttgcggcgccgtctctttctcgagcttggagcatccaaagttccgagcttttctcgcgcaggttggtttgccggcggtttttccgagggagttcaccggtacgaggttggatgcgaggttcgaggaggctaaggttgagtcggaggcgaggattagggacgcgatgttctttcagattgcgtctgatgggtggaagtggaagagggagagggagagttattatgaggatgattctaattctaattcggggttggtgaatttgagcgtgaatctaccgaatgggaccagtttgtacagaagggcgttgtttgttactgcttctgcgccttcaaagtatgcggaggaggttatgtgggagacaatcactagcatttgtgggaatctcgtgcaacagtgtgttgggatagttgcggacaggttcaaggccaaggccttgaaaaatctcgagaatcagaatcattggatggttaatctcacttgtcagtatcagggcttcaacactttgatcaaggacttcgccaaggagctccctttgttcaggaccgtcgttcagaattgtctcaagctcgccaatttgttcaattacacctctcaggtgaggaacagtttccacaagtaccagctgcaggagtatggccacacctggctgctccgggtgccggctcacgagttcgagtttgggcccgtgtgtgctatgatggaggacacactgagctccgtccgcgccttgcagctggtgctcatggatgagcctttcaagatggtggccattgaggaccagggcgcgagggaggtcggagacatgattcgcgatgtggggttttggaatgacttggaggctgtccatggtttggttaaattggtgaaggacatggctcaggagattgaggcagagaggcctctggttgggcaatgccttcccctttgggatgagttgagggcaaaagttaaagattggtgctctaagttccacattgcagaaggggttgtggataagcttgttgagaaaaggttcaagaagaattaccatcctgcttgggctgctgcttacattcttgacccgctttacttagtgagggacactagtgggaagtaccttccgccgtttaagtacttgacaccagaacaggagaaggatgtcgataggctcataactagactcgttgcaagagatgaagcgcatattgctctgatggagctcatgaagtggaggacagaagggcttgacccggtttacgctcaagctgttcagatgaaggagagggatccggtcaccgggaagatgaggattgtcaatccacagagcagtaggcttgtgtgggaaacttatttgactgaattcaagtccttggggaaagttgcagtgaggctaatattccttcacgcaacctcgtgtggcttcaaatgcaattggtcattgtggagatgggtttgtgcacaaggccaccattccagaactgcactcaacaaggtgcagaagttgatatttattgcagctcattccaaacttgagagaagggatttttccagtgatcaagataaggatgcagagctgtttaccttggcaaatggtgaggatgatgtgttaaacgacgttcttgttgatacatcctcagtgtaa

SEQ ID NO: 44179 - DNA, 450 bp, Glycine max
  Peptide Sequence Number=SeqID_160957
atggatctttctggtgtttgctgtctcaacaatatacagcaatatagagaactagtccaggttgatgcaaaactgagagtcaaactgatttctataaaggatttaccagaggccactctttctttcccattgataaacaccagcatactcccctctctcctttctcccctttatgagaagtttgctcatcattctttagttcctgcattgtatgactttcccaggagtatcacaaaatatattccattttatggtggcgctgagtatcacgattaccatcattatgttggaagacaaagccaaagcaattttgcttcagttttcacatactgtgattacatctatggaactgacaagggatataggtatcagaaaaaaatacttcagaagttgaaggaagagttggcaaatggtgttgagcagaacggaggatcatacaagactgactga

SEQ ID NO: 44180 - DNA, 747 bp, Glycine max
  Peptide Sequence Number=SeqID_160958
atgcaggaactaaagaatgatgagcaaacttctcataaaggggagaaaggagagaggggagtatgctggtgtttatcaatgggaaagaaagagtggcctctggtgagaaaaagcgagcaagggactgttagagatcgaaagaaccatggcaggcccgagaaaggagggaatcccgaggatcaagatctcggcccagtgggcatagggcgccgcaaatccaatgggagcatggtactcatggtgcacgcggtgaatcttctcgtaaccccaatcgttgtgcagaaaccggtggatccagtaattggtgtaatcctctacgagaaagtagaccagaagctgcgacaggatctccctccacgacggataagagatgagttggagggggccgacgacgaggaagaacatgcgcatgacgtctttgtagcacttgaaggtttcggcgagggacaaacggactttaggttggatcttgtgggaagcgacgaaggagaagcgcttgagttcgaggaagacgagggggagggggacgagggagaagacgaggaagaggaacagaatgttgtggcagtagaggaagtaatcagacttggaggcggagtagttgaaccagagggtttccgcggaggtgaggggacagggaagcggtgtgtgatttttgcggacgtggtggatgctgcgctggatgcttgtctgttgccacaaatatttgcgggaattttcaaaatgcataactgcccttatttatag

SEQ ID NO: 44181 - DNA, 162 bp, Glycine max
  Peptide Sequence Number=SeqID_160959
atggaggcgatagatccatggacgttggaatctcttgtatcgaaagtgtacttggcgagtgagttcatgtatgagggccaaacaatgggtctcacagtgttggagtggtacaaggtattagagcatgttggtgacaatggagcttattttcataattcttaa

SEQ ID NO: 44182 - DNA, 558 bp, Glycine max
  Peptide Sequence Number=SeqID_160960
aaaaagaaaggaattgaacttaaagcctcatcttctattcaagaagaaagtgacaaagaggacttgaatgaaatagaagaagatgatgatttcagtttcttcgtaaagagatttaataagtttctagggaacaaaggaaatcaaacaagaataaacttcaattcaaagaaaagaggagaagattcatctttttttccaaagttctatgaatgtaatcaacctggacatctaagagttgattgccttagtttcaagagaagaatgaaaaaatctgattggaaaaccttcaaagataagaaagcaaagaaaacttacatcacttgggaagataatgatatggattcatccggagactcagaaaatgaaatcgtgaatctaagtctcatggccaaaaactatgaaagcgaagaagatgattttttgaagaaaagttggtacattgatagcggatggtctaaacacataacgggagatgcatcaaagtttactcatatttctcctaagaatagtggacatgtgacaacaacaaaggtaaaattcttggagttggaaaaatag

SEQ ID NO: 44183 - DNA, 658 bp, Glycine max
  Peptide Sequence Number=SeqID_160961
atgagtttgacagaaaatgccactagctgctgcatggcacctgatgaacatataatgacaggtcatcactcttgtaagcttagaaaccaagtggatgttatttgcctgcgagtatcatcagacagcaacatgaagttttggcattcgctatctgttgaagacaaaagctatgctgttaattcatttcatctttttgctaatgtgttggtagctttttggttgttcctggtggcaagctcttactttctcttgagcaaaaatgtcaatctttctggcggttgtagaggaaaacgtgcagagaaagtttcttcatctgtcagaactatctcagatgcaaccacagagaatgatgcaactgctgcaaatgatacgtttagctgttctgagagtttttcgtccaataatagctggggtgagctatgcaccaagtgtgatgcttactatgagatttcagattttgataaggcaagttacatgcattctttactcagtcttgaaggtgaagattctgagtggctcgcagattcaatgccttgtgaactttcatatgagaacccttcaactcctcttagcagctacaagtgtgatgcttaccatgagatttcagatttcgagcaaggaagttacatgcattctttactcagtcttgatgatgaag

SEQ ID NO: 44184 - DNA, 459 bp, Glycine max
  Peptide Sequence Number=SeqID_160962
atgaatatcttgacagcacacgatcaagggtgggaacaagatttaagtccttacaatcaatataaagaagaaagaactcctaatcttgaaagtgtgtttgaggaattcagggcataccatgctagctcaaaagccaatcaaaattcaatgaaaaatcatgaaattcattttggcaagagctactcaatagaaaactatcaagggagaccagagttacaaccttactatcaaaatgaagcagaaagaggttccaatctggataaattgttgatgcaattcaaggaaaaaactaaatcaactcaacaagcactccaaagtgtagaaatccagacaagaaaatactttgtagaggttgaagctcaagaggaaagccctgtaaaagagcatgagtcaagagaaaaagatgaggaacaagcacaacaacaaggggtgaagtactcaacagtagaaaaccaataa

SEQ ID NO: 44185 - DNA, 2133 bp, Glycine max
  Peptide Sequence Number=SeqID_160963
atgatttcggggagcaaaaggaaacgcagcctaggggataatctcgactgtgttcgagaggctgctaggctgaaagaaactccaggcgaaaaagattcagatgaaatggacacaagtgatgatggatccgtggatcgtatctcacaatttcctgatcatgtcatccatcacattctatcacaccttcgtaacgtgaacgatgcaatccgaaccagtgttttgtccaagagatggagagaactgtggtattcttattctgttttgatttttgatgaaagaaagtttgctgcaaaaattggacatgaagatagcagtaataagggaatgatgtttagagattatgtatctaattctcttcttaccagcaatgcaaaaaatttgcaaatacggaaattggtgttgcacatgacctcctttgacttattagaagatgccccatgtctggaactttggctaaatattgctatctacagaaacatcaaagaactagatctccatgttggcatcaagaatggcgagtgctatactttaccacaaactgtcttttcatccaaaacattgactggcataaggttaagtggttgcaaactgggaacttgcaataatataaagcttccttatctgcagaagctttatctgcgcaaaattcccttggttgagaactttattcaaaatcttatttcctgctgtcattcagttgaggatttaagaatcataaagtgctcaggtttgaagcatttgcatgtttcaaatctcattcgactcaaaagggctgagatccaccactgcattcaactgaagaaggttgagatcagtgctcctaatcttgacacattttggtattgtggcaagaaaacaagtccctgtaaagttagtttggaggggtgcacatctctgaaaaggttgacattggagcatccccaagtgactcgtgatttttgtgaaaatcagttctccaattttcccttacttgaaaaattggatttaagtatgtccaataataagagtagattcattattatttcaaatcctcatcttgagaaattcactttgaaaggatgcaagaaactgggtattgttttagtagaggctcctaatcttttgtcttttgagtgcaagggtgagactatgccctgggttgagattcaccctttcggactcacacaggccaagctttcttttgtacctaaatctgaacctagagttgttggatatggtgacaagatttggattaggatgaaatcattcattcaaaagttcaatcgtgaacgatttaaattggttctctattctaataagagtattgttattcatgaagatttgaacaacgtcatattgcctccagtgcctgacctcggctgtgaaattatcaattcatcagcatgcattgatgatgctttgaatagtttgttacggaaattgcacccagtgactctatctataatttctcccaccgacagtaaattccccaagcaaaatattattaccgctggaagccttcttgaactgcttttgccattaactggaaaaatgacaattgcagatgtcaactttgaagacctaaatgatgtaaagtttgaagacatcgaagaaggaaaaagtaggaagaggagcataatattgggaccatggggaggcaatggtggaaatagctgggatgatggaaccttcacaggggtgagagaaatcaaactagtttatggtcattgtatagactcaatccaggtggtttatgataggaatggcaagcctttaacagctaaaaaacatggaggagttggaggtaacaaaacagctgagattaagctgcaattcccagatgagttcttggtcagtgtgagtggccactactgtccagttgttcgtggaggcacccccgtcattctatcattgacattcaagagcaaccgcaaaacctttggaccctatggagttgaagaagggactccattcactttttcaatagatggaggctgtgttgtgggttttaaggggcgaagtgattggtatttggatgcaattgctttcactttgtgtaatacacgatcaaagtcgctgcttcagaaggttcagaggggcttgttctggttaacaagcactgctccaaaatcttcatcctccaaggatggctag

SEQ ID NO: 44186 - DNA, 189 bp, Glycine max
  Peptide Sequence Number=SeqID_160964
atggtgagaataagtcccacatcgctaaatagagatgttttgaaaacctttataacagttcaagttctaaatgaaagtccccgggccacgactgcagagatgcagactcggaaacgggttaacttcgagcttggactagtctcgctcctttggggcgaggggctgagacgcgtgtggagccttcgctag

SEQ ID NO: 44187 - DNA, 1338 bp, Glycine max
  Peptide Sequence Number=SeqID_160965
atggatggtctaagttgggatgcctcatcacaacttgttgctaacacaccggtcttgtggagcactcagtctcaagaccttgaaggagactatcatcattccatgccccacctaagttcaagtgttctgaataatcaaacaggctatgcatatcccagttctgaaaaggcgaggggcatggttcagttatccactatgtctgagataatgagtatgatgccaaacacaaatctgccacaaagaattacagcaaccatgcctgtgaaatcaggagcagctggagccagttgggaagaggctttaatatcccaatcatgcccatccctttcggtgaatatgaaccaaactagcaattatgtagcagatctcaacaaggcccaccagcaacaacaacagcttatcaatggcacacaaaacggcaaggctactacctgctctcttgatcagtcaattgattgcttgctttcagcgactaataatagcaacacagacgcgtctgtcgaagatgatgggatttcgatgattctctctgactgcagaaacctatggaataacttcagttatggcagtgcagcttcctctggtgaatctgatagcaatgcttccattaatgctagaaacagtgacatgcggtatccatcagtcagtgagctggatgaatcagtgtctcaaagtttctctgatcaatatctcagtcaaggaagagtgatagattctgaagttatttgcacaaaaaggagcagtagttcatgcttcagcattgctcagaattcttctgccactgaaggtggtttcaggcttatctcagagacttcaccaaagtccaagagacccagatggattcataagcatcctggttcatcaaatatcaacttccagcagccaaattcatctgtgacaccttcctttgaagaacctgatcctgaggtcatagcacaaatgaaggaaatgatatatagggctgcagcttttaggccagtgaacttgggccttgaagcggtggaaaagccaaaaaggaagaatgttaggatatcaactgatccacagacagtggctgccaggcaaagaagggagagaataagtgagaggattagggttttgcagaagattgtgcctggtggaagcaagatggacactgcatcaatgcttgatgaagcagcaaactacctcaagtttctcagatcacaagtcaaagcactggaaaatctaggcaataagcttgacacaatgaattgtcctcccactaacatagacttctctttcaacccttcttttcccatacaaacacatttccccatccaaaaccctagcagccacatccaatattccaagggttga

SEQ ID NO: 44188 - DNA, 276 bp, Glycine max
  Peptide Sequence Number=SeqID_160966
atgcattacacttctcaccattgtaaacttaatgcagatcccaatcgcccaggaatgcacatgaagttgattaagttccttctaaatcttagggcacctcgcatagtgtatgtctcttgtaatcctgccacatgtgcacgcgaccttgattatctttgtcatggtgtggtggaacagaatataaaaggatgttacaagttaataagcctacagccagttgacatgttcccacacacacctcatattgagtgcgtttgccttctggagcttcagtaa

SEQ ID NO: 44189 - DNA, 1518 bp, Glycine max
  Peptide Sequence Number=SeqID_160967
atgggttttttcttcaaatgggtcaacttgtttgtcttttttcatttccttgctgcaacacccatcttctcagattcctcctccagctcaaatgcattcgtcaccaccaagttcctagatttagccaaggatcctctggtatttgattggatgattggtatcaggaggaagattcatgagaatccagaactgggttatgaggaatttgagaccagtaagctgataagaactgaattggataaactgggcatctcatataaatacccagttgcagtcactggtgttgttggcttcatagggactggactccctccttttgttgcattaagagctgacatggatgctcttcctctgcaggaaatggtggagtgggagcacaagagtaaagtacctggaaagatgcatgcatgcggtcatgatgctcatgttgccatgcttctcggtgctgcaaagatcctcaaacggcatgaaaatgagatacgaggaactgttgttcttgtttttcaaccagcagaagaaggaggtggaggggctaagaaaattttagatgctggagtcttggaaaatatctctgccatatttggattgcatattgtacctacctatcctattggtgaagtggcctcaaggtcgggtcccatatttgctggaagcggcttctttgaagcaacaataaatggcaggggaggccatgcagctatccctcagcactctatagatccaatattggctgcttccaatgtgattgttagcttacagcatattgtttctcgtgaggttgatcctctggactcccagaatattgcacaggttgtgactgtaggaaagtttcaaggaggtggtgctttcaatgttattccagactctgtcacaattggtggcaccttccgagctttttcaaaagaaagcttcatgcaactgagacagcggattgagcaggttatcactggtcaagccgctgtgcagagatgcaatgcaacggtcaactttcttgatgatgagaaacctttctccccccctacagtaaacaacggggacttgcatgggtactttgaaagtgttgctgggagtttgcttggcgtgaataatgtcaaggagatgcaaccattgatgggatctgaggactttgcattctatcaagaggtttttccgggatacttcttcctccttggaatggataatgcctctaatgaacatcttgaatctccacactctccatatttcaaaatcaatgaagatgcacttccttatggagctgcacttcatgactcagataggatgaataatcattcgtttgagagatcaagcaatgcatttgcttcgagtcttatttcagcatcatccctactcaccttccccgttcatgaaacagacaaacaactacttatagcagcatgtttggatacaattctcaataggatgtcacctgaattttccaaagctgtaaatattataactccaacatccgcgccgaaactcagcattcgattgcaggggcagagtgaagccgcgaaatga

SEQ ID NO: 44190 - DNA, 252 bp, Glycine max
  Peptide Sequence Number=SeqID_160968
atgtcgcaacctaccattcgacgggagggcgatgcagggctcgcgggtgcgttttccaagaaaggaaaatgcgcggagtcgccaccaacatttattcgaggaaaacgtcagaaaaaaccgaaaaggtgtggtctacgaactttaagtgtgaaaggttcgggagttgtatttacgcgtggggaagggtgtttcctttgctcctacgtattcctcaattgtgataaggaaatcagacctacgcagttcttttaa

SEQ ID NO: 44191 - DNA, 1299 bp, Glycine max
  Peptide Sequence Number=SeqID_160969
atgcattctttacttagtcttgaagatgaagactctgagtggctatcagattcgaagccttatcgatgttcatccgagaacccttcaacctctatcagctacaagtgtgatgcttctgagatttcagatttggacaaagcaagttacatacattctttactcattcttgaagatgaaaactctgagtggctctcagactcgaagctttttggaggttcaatatccgagaacccttcaactcctattagctacaagtttgatgcttcttctgagatttcagatttttccaaagcaagttacatgcattctttactcagtcttgaacatgaagactctgagtggctctcaaattcgaagccatttggatgttcatccgagagcatttcaactcctcttagctacaagtgtcatgcttcttctgtgatttcagatttttccaaagcaagttgcatgcattctttactcagtcttgaagatgaggactcagcagagtggctctcagattcgaagtcttttggatggtcatctgagaacccttcaactcctcttagctccaagtgtgatgctttttctgatatttcagatttggacaaatcaagttacatgcatccctcaatcagtattgaagatgaaaactctgactggctctcagtttccaagtcttatggattttcatctgagaattcaactcctcttagctacaagtttgatgcttataactatgagatttcagatttggacaaagcaagttacttgcattccctactcattcttgaagatgaagactctgagtggctctcagattcgagtagttggagtattgtggttcctccttcagtctctactagttcctcattcactggagtaaactgtggcaactcagaagaagagttcagtgctgatgaaccacttttttggccatttgaagggaaactcaattggaattctgaggaaccgtggacttcattttgtagctccccgagaagaaggtttgactctagatcaacgacatcaaggataaaggggtgtaataataaacagaaaggcaatgaggctctatgcattgtgaactatgaaacttcaaggttaagcatgtggcctaaaagttcagaaaagatagtacctctagtatgtgaggatttctattcaaacaaggaccaccttttgggaaaggagtattctgctttgtgtcaagagcttactattgaggcattggtggggctaaaggaatttgatggacatgaagggcttgattcggaattcgatcaagtttttctgatggaccaatatctccaataa

SEQ ID NO: 44192 - DNA, 336 bp, Glycine max
  Peptide Sequence Number=SeqID_160970
atggtagctttagaagaaataacgaacatgcagtggaaaaaaaagcacatggagagggaaaacgaagcacattcatggagtttggagataaaaatcgaagctttttgcgataaaaatgcacatggagagggaaaacgaagcacattcatggagtttggagataaaaatgatagctttaaaagaaacaatgaacatgctgtgaaaaaaatcgacaaaaaagcacatagagaggaaaaacgaagcataacctttgagtttttcgttcggcatctccgtcattttcgtccggcatttggagaacaacagcaccaaggcatcgtcttcgaacgatggtag

SEQ ID NO: 44193 - DNA, 531 bp, Glycine max
  Peptide Sequence Number=SeqID_160971
atggattctgaagctgaagcactagaacatatgaagaaaagagatagaggccatcaaagtgtgtcattggagaataagacaggagattcaactgtggtgaagatgagtgagaaaaataataatgctgatgccgacgactgcatgattcttgatgaccatgaaggagaagagcattattgtggcaaaggaacaaatgcgaggagtgtttcttttttgccaagaagccaagagaagataggagattcggctaaagttgtgatagaacaagacatgaagggaggagagcataaatatgggtttaacaacaataaacgtgagaagccagagaaggtaagggtggtggatgatgaaactggcgacaaacatgagctgtatgaagtcctaaggatgccatctagaacaaaaaaccgatgctttaagttttttactgagggcaggaggggtattataaacatcattttctacatctaccagacaccaaatccaatgcatgttaatacactcaatactttgactatcccagcctattag

SEQ ID NO: 44194 - DNA, 1215 bp, Glycine max
  Peptide Sequence Number=SeqID_160972
atgcgtgcaccagcattacttgcgcagtgcttacctggcctagtgcctcatgatcgtggaagtctcagcatatcgtccgttcctgagaaagattttcatctcccatcaccagcagtagagattctcccttccaagacagttcacactgaaaaagataatggggagaatatagatcattttaagggtttagttagtgttgccgatattgttggattcagtggttcagagacaatatccttaaaacctgatggttatctgaaatcctggactagttccattgatcttgttagtgttcttaagcatgagattcgtgatggacaactgaccttcagaggaaaaagagtacttgagctcagttgcaactatggacttcctggaattttcgcttgcttgaaggcaagtggtttgttgtcattgcttgaattacactgtcttcttggtgtgaccaccaaaagtttcaatatttcttttggggtaatattgcaagcagacaatcaaggagcttctgtggtgcattttcaagatcagagtgcagaaactgtcagatgcacaactataccaaatgttcttgctaatctcaagcaagctcgtgataggcagagtcgacagccagagtctcctcttactccttcaagacagactctggcaccatcagttaacttttatgccggggactgggaagaattaccttctgtgctgtctattgcgaaaagtgatggatatgaagtgatgcctggaatgagtttgagcttttctgaggaagattttatggatgggtgtagtagtcaagatggtagcatcattggacacgaatctcactcaaggcggtctaggaagctctcaggaagtcgagcatgggaaagaggtagtgaggcagatcaaggagagggtggctatgatattattttgatgacagagattccatactctgttacctctttgaagaagctgtatgcacttattaagaagtgcttgaggcctccatatggggtggtatatctagctcctactaagaggcactatgttggcttcagtaatggcgtacgacagctgagaagtctggtagatgaggagggcatttttggagctcatttagtcaaggatttggctgacagggatgtctggaagttctttcacaataataatggaggtctgaatttgaatgctcagtttacgtgcatcatcagcatgaagctgcctcatttagttgagtaa

SEQ ID NO: 44195 - DNA, 963 bp, Glycine max
  Peptide Sequence Number=SeqID_160973
atgaagaagttgttatcaagtggaatcatattagtgggacacagtttacataatgatctacgtgtgctgaagcttgatcatgttagagtgattgacacttcttatatcttccaatccttggatggatctattcacaagagaccttctttgaatagcttatgtcaggcaattagggaaaagggtgctccacataattgtctagatgatgcaaaagcagctatggaccttgttcttgcgaagatcaaacatggagttgataaggaatttccaattgcattagttcaagagcatgttccagaaagtgagctggcaaagcttcttcttcacaagataccaaacactgtaaacattgaaacgttgcataaaattcttcctggcaatttcaaaattgaactgaagccttccaggaaaggtcaaggagcaaattattccgcctttgcaatttttagaagtccaccagaggcagatggggcctatgaaaatgtccaaggaagccaattaaagttgtatatcactgaagcatatttagttactgtgggattgctgatctatctcacacttgtgatgtacattactttatgtcaggatacatatggacatccccagaagcttgtaacattccgtctaagtacaggcttatctgtcaatctctttgttcggaaaatggtaactgaagaacccaatgaccagactccatctaagagggctttacaaattaatgaggcagttgatgtttcaaagaaagcaaagatggatccaaaaattgaagaggatgcctctgcaggctttggcaagggtgacactgatgcccattcgaaagaaattgaagcactcaatcaacaattgaagcaaagtgaaatggtgattgaatcattgaggaaacagttgacacaaaaagattttgaaatatccatgctgcataaaatgatatcctctaaaaagaaaaagaaacaaacagtgtag

SEQ ID NO: 44196 - DNA, 483 bp, Glycine max
  Peptide Sequence Number=SeqID_160974
atggaatctgggtctagcgaaggagaagaggtgcagcaacgcgtgccgttgagggagagagtggagtggtcagatgttactccggttcctcaaaacgacggccctaaccctgtcgttccgatccagtacactgaagagttttccgaagttatggattactttcgcgccgtttacctcaccgatgaacgctcccctcgcgccctcgctctcacagccgaagccgttcaattcaactccggcaactacactgtatctctctctctctctctcacaatcaaaaccgttttatcgcatttatatcttcctctgccacaaatcactgttaggtgtcaagtgtggcatttccgacggttgttacttgagtcgctaaaagtcgacttgaacgatgaactggagtttgtggagcgtatggccgctggaaattctaaaaattatcagatgtggtgtgatgctctgctctgctctttcttccatactttgtaa

SEQ ID NO: 44197 - DNA, 177 bp, Glycine max
  Peptide Sequence Number=SeqID_160975
atggcacaacctccaccccgtgagaggactcaaagggaaatggttgcacctgatttcacctacgaaagcttgtgcatccaatactcaaaaggatcaaagggttgtaagtcaaatggattgtccctagtcatacactacattcagcatgcacaactagttgccttcttatgcaagtaa

SEQ ID NO: 44198 - DNA, 558 bp, Glycine max
  Peptide Sequence Number=SeqID_160976
atggagacaccaagactatgtcctcctcttgctcagattgagttcccatactatgatgagataatggttccagatgatttgatagaggaagagactgaacctgaacatagtggaagtcagccagatcgcaaaacatcaatttcagccaactaccccgatgttctaaatgttaatcaactcttggattcggttttggaaactgcacggcaagttgcaagtttctccacttcctcaactcctttaccttatgaccaaatgaagaatcagtgcgaggcacttgtaacagggaaacaacagaagatgtcagtcattcagagtttcaagcatcaacaggagagtaaggccataattctttcaagtgaaaatgaagtaaacgtttcctctctacctgctaaggcactggaatattcaaatggtgatttgaagttagtgactcagcagcaatttcaagcacaggatcaagcacgccaccaatctcatgaatctgggcagcaacactctttgagactaccaccttcgagcccgtatgataaattcttgaaagcagcgggatgctaa

SEQ ID NO: 44199 - DNA, 2022 bp, Glycine max
  Peptide Sequence Number=SeqID_160977
atgcaagtttgttctctggaactcatggcttcatcatcagatgtgtgtcccactgaggatgctcttaaggcattcctagaatacttggttgatccagtgctgccagctaaaccttctacaccagataaccccccttcaccgtctcaacagcacttagttgcaaaacaggttcattctgttgtgttactatacaactactatcacagaaaacaatatccagagcttgcatttctgccctttgttgaattttgcaagttagctttggttctgagaccaactttatcagtgcatatgaaatctatgctgaagcctgatgaaactgagcttgtggagcagttgtcattaacagaagacaagatcttgaatgcatgtaatatatgtacatgcttggatgcatcaaaaaatgttcctgatgtagagggatggccaatttcaaaagtttccgtccttttaatcgacagtaagaaggagaactgtttcttgctttttagttacatcactgagggagtatggtcagtggttgaaaaagatgtggataccttcagccaaagttctgaaattacaagtggagccatacaaacatacaaaaagagaagagtcataaaaaagcctacaaaaaaagaattaaattctgaggaagatggaattttgcaaattggatactcccctgtaaaggaagctgcaggtattaataaaactgatattacgtcttttgaaagctacactgtgtattctcagagcaaagtgaagacagcttcacgcttttatataatgaagtgctcccagttgatcaacaaggaatttattcaacctatcaaatctttgattgaaaggttgcgaggtccattgatcaataggagttctagctgttggacagtcacctcagttgttgagtacttccatgtgcttccttattctgaaataatctcagagtggatttctagagaaacattctcaaatagtttgcaaggttcaaggctggcagagaaaaacacgatgatgggctgccctgaagtgaaaaaatcatatataagtagtgagggcatgtctattggcctcgatattaagccaagcattgatgctattgaagcacttaatcagaacgagaacaatggaagctgtgcagttacatgttctgcttctatcaaggattcccagaatgtgtatgtggacaacactttagcttctccatctaaaaataaagaagaatgccagcatattgccaatactttacaagttaatgaagatcaagaaatagaaaatccatttgtacaacattactcaaatcgatctaaaaaccctatcaaggctgagtatggtggttctacaagaatgctcatcactgagggtggaaccaaagatcaatcaaagggaaagattttgtcaaagactgcaaaagcctcttttgaaaatgatcccacagaagaatgtgtcttgattgcatataatcccatctctgatcttgaaaagttccaaactatagcatcaaagggaaagacattgtcaaagactgccgaagcctcttttgaaaatgatcccatagaagaacgtgccttgattgcatatcatcccatctctgatcttgaaaagtttcaaactattgcttcaaaaggaaaggcattgtcacagattgccaaagcctcttctgaaaatgattccatagaagaatgtgccttgattgcaaataatcccaactctgatcttgaaaagctccaaattatagcttcaaagggaatgacattgtcacagactgccaaagcctcttttgaaaatgattcaataaaagagtgtgccttgattacaaataatctcaactctgatcttgaaaagctccaaattcttatagcttcaaagggaaagtcattgtcacagactgcactcaatgctcttatgcaaaagaggaatgcactggtaaaacctgttcattgctttttctactggcaagaatgtttatatccattttcacggttcctgttatttgctatgctaggacacatagaacatatacacttggttatctag

SEQ ID NO: 44200 - DNA, 150 bp, Glycine max
  Peptide Sequence Number=SeqID_160978
atgaatcggctcaaagttgtagtaactagtgaggcccctgcacattgggaaatggttcttcaaggaattcgccaaatgaggagttctgcagatgaacaccaaccggttgcacgtgagaaagccgctgatactgtaccttctaaggtctaa

SEQ ID NO: 44201 - DNA, 543 bp, Glycine max
  Peptide Sequence Number=SeqID_160979
atgaatttaagtgagagcactgaagccaccccctttcatcatttgcttgaactccttgaaatcgaccatgccgtctccatcaacatcaaccttggatatcatgttcttgcagtcttggacggttctgccctgcttcaagccgagggaggacaggacggtcctcaactcgtcgacggtgatgaagccgtcggcgttctggtcgaagacgttgaaggcctccctcatgtcctcctcctcgtcgcgctcgtccatgatggtctggtagagctccccgaactcgtcgatgtcgacgcagccatcgccgttgacgtcaatcctctcgatcatttggccgagctccttgtcaggaatgaagatgccaagattctccagcgagtcgttcagctccttcttcgttattcttccgtcgccgttgcggtcgaacatctggaacacgcgcttcagctcgttggggggggaggaagggacgcaccttcttggggaccagacagaggaggaatgagtgtacgaggttgtaaagaaggaaaatcctatgcaaaatag

SEQ ID NO: 44202 - DNA, 459 bp, Glycine max
  Peptide Sequence Number=SeqID_160980
atgacagacaaagtgtcacgtcatctctccaatgtgactccatggatcactactgtaggcactggcacactggatcgtgacttcctcgcatatgtggcactcaagaatggattcaacttctccggcgtttcgctttaccacggtaacgctttgccaaattcccatttgcctttggtttatgcagggaatggttcaaaaaggctcgatgatgaaatccaccagagcattagggatggtgtcaacactgtcgctaacgacgaggagctagtggcgaatgctcatttattactagggtaccgtagttgggtagaaaagccgatgatgctattaagaagtatttggtttccaatgcgaaatcaacaactaagattatgttccagggaacaaaggtggggattcagccatcaccggtggttgttgcgtttaactcaagaggttgcatgtcgtggcttgacttga

SEQ ID NO: 44203 - DNA, 1737 bp, Glycine max
  Peptide Sequence Number=SeqID_160981
atgggggttatgtccaggcgggttgtccccgtctgtggtaacctctgtgtattttgtccttctcttcgtgcaagatcaaggcaaccagtgaaacggtacaagaagttcattgctgatatattcccccgtaatcaggctgctgagcctaatgataggaaaattggaaagctatgtgagtatgcttctaagaatccattgagaattccaaagattactgacaacttggagcaaagatgttacaaggatttgcgtaatgaaaactatggttcagttaaagtggtcttgtgtatatacaggaaattgttatcgacatgtaaggagcagatgccactgtttgccaatagtttattagggatcattcggactcttctagaacaaactcgagcagatgaaatgcagatcttaggttgcaacactcttgtagaatttatagatagccagagcgctcaaaccatatgggatcagcataggcttcaaagaacattcaaaccgaatatagttatccccaagacctacactccgaagagtccgtcaggacctctccctcctgattcagtgattttggagaatttcaaggatctccaatccaaatccaatcttgccaaagtagagaaactgaattcacaatctcagagtcagttggtccaaggatttcccgaaaaaggagctgagacagagcctaagttggacactaaagatcctgcttattggtcaaaggtttgcttgtataatattgccaaattggcaaaggaagctacaactgtgcggcgtgtcctcgaactgctttttcataattttgatagtgaaaaccactggtcttctgaaaagggagttgcttcttgtgttttgatgtatttgcagtcccttctagcagaatcaggagataactcccatcttctgttgtccagtttggtcaagcacttggatcataagaatgttgctaagaagcctatccttcagattgatattattaacaccaccatgcagcttgcacaaaatgtgaagcagcaggcttcagttgcaataattggtgcaatatctgacctcattaaacatttaaggaaatgtctgcaaaatttatctgaagcatccagcaatggaaatgatgcatataggttgaatgctgaacttcagtcttccttagaaatgtgtatattacaactttcaaagaaggttggggatataggaccaattcttgatttgatggctgtggcactggagaatatcccaattactaccatcatagcaagatcaacaatcactgctgctttccctgatgccttgtttcatcaattgctcctggccatggctcatcctgactgtgaaacacaaattggagcacatagtgtcttctccatggtgcttatgccatccatgttttctccttggttagaccacaaaacaaagattgctcagaaggcacagaatgacagcttctccactcagcatgaaactttttctggagctgaaaacttgaatgggaaactggaagaaggaaaggcaatagccagtgtcaatgggaagaaatatgtgattcatccatatcatcgctacagctttagtccgaagctaactgatggaaaagatgatcgaagttcactcaggctgagcagtcaccaagtgagtcttttgctttcttcaatctgggttcaggcaacatctgtggaaaatggccctgcaaattatgaggcaatggcacacacctatagcattgctttattattttctcgttccaag

SEQ ID NO: 44204 - DNA, 417 bp, Glycine max
  Peptide Sequence Number=SeqID_160982
atggcttcatcatcagagcaggaatttgtcactcactaccgtgctcttgttaatcgcttcccaagatcgcatggtttttgggactctgaagtggcatctcgtgtcggggagaagctagagtttcgcctcagagaaatcggcgtcaccaacgttcaattcgaccctcacgagaaacagtctcttcctgaaatctcattctcaaacttgcgactcttctctcacgtcgatgaccctcttcttcaagaaacaccgtctgagctcgtgaaacatcaattggatgtgggcgtagggaaatacgtagaactgcaccagccagtcaagaaccatcgttatccatcatgtggtggaggtgcttgttggcacagagggcctggatcatgtcttacaccgttgactgaatactgtggtcgagtgtga

SEQ ID NO: 44205 - DNA, 780 bp, Glycine max
  Peptide Sequence Number=SeqID_160983
atggatcaccaatctggccagggatttgattcagatgatagtgaccttgatatgcaagcagaaattagtgacaaacacgagaaggtagatgaattttcaaaaaacttagaaatatgtggaggtgaagatgaaatgtttgttgaacaacctgtagcagacatttcaactgatatagaagctgtagaaccattcataggcatggagttcaattcaagagaggaagccagagaattctacattgcctatggtaggaggatagggtttacagtacgaatacaccataaccgtcgttcacgagtaaataaccaggttattggtcaagattttgtctgttctaaagaaggctttcgtgcaaaaaagtatttacacaggaaagatagagtgctgcctcctccaccagccactcgggaaggttgtcaggccatgataaggctggctttgcgggatagagggaagtgggttgtcaccaaatttgtgaaggagcatactcataaactaatgagtcccagtaaagttccatgtcgaggatctgggaagcacttggttagtgaggatgagaaggataaaagaatccgtgagctgtcacttgagttgtacaatgaaagacaaaagtgtaaacgacgttgtgctgcatatgaagagcagttaaatgtgattttaaatgatttagaaaagcacacagaacatatctctaaaaaggttgctgctgtagtaagaagcataagagagattgaggaggaaaaatcagattcggatggtgggcaattagagccatcatag

SEQ ID NO: 44206 - DNA, 1308 bp, Glycine max
  Peptide Sequence Number=SeqID_160984
atgtataagggagcttcaaagaagagaaagttgcctgtaagaaactctaatgtttatttatgcaatacaagaagcaagacagtgcaaaattttacttcttcactaaaagcaactactcaagctccttctcgttgttttgagttttatgtcaggtcagatgagggaattggcctttgtattgatttaaattcatccccatcagattggactaacaggtacagaaatgaggtacgtgtgagtgagaaagtgtgtaggaagaaagaatctaggagtctttggcaggatctcagttgttcaggagggagttctacacaaggaaaaagttcatttatatggaatacaaagtctggccactttgatgattgtaatggaccaaccagatatgccccaagcttgaaattggtaaaagatgttacagggcttgatcaacagaataaaggtggctgcccttcaatatatgattcattaactccatgtgccatgactgtacatgtggaaaaaaatgtaaatgaaaatcaatccactgatagcaacaacagtcccatagacccagcacaacatgcaccacctgaagttagttatggtgcaccaaacaattatatttctggtgctgaatcttgcgctaaagatgtatctaagaaaatccttgattcaattactactgatattgcattcattaaatcaatatgtggttctgttggcaattcacagtcaggcctcaacacattagggcatgaaaattcaaagcatgataacgaaatttctgaagattgtgctatgctaaatggtttttgccctgtcaaccctggtatgatatgtccaggagctttgttaagtagttctttggagctacaagtttcagaagttttaagtgatcctaagaattgttcagacatggaacaaggtggactaatttactcaagcgagattgatttggatactgatgggaagaatctcccatcactaactgaagaatggtttccgaaccctttctacttcttgaagatgccagtttattattcaaattggaagtgggcaaaattgttaatggaaggaagagttcagagtaattactcctctcagaaacatttttcaaaatgttcccaatttgatgacccacatacgaagtctggcctagagtgtggtgatcaggagtctaaaatgaaacttcacaaaaagaggaaacacatatactctgaggttcaaagttccagtgataaacctgttggaatgttcttacgaagcatgaagaaagctttgacagtacagcccagaagatccatgaggctaatctccaaggtgctttaa

SEQ ID NO: 44207 - DNA, 1730 bp, Glycine max
  Peptide Sequence Number=SeqID_160985
atgggacaagcaccgtccacgccggtttcgtcgccggacctgagtcgccgggaaatttttaacaccggccacgctgatttctccgacgaatccatcgtcggcggccgcgactacaccgccgacattcccgacgagtgcctcgccggaattttccagtttttaagctccgtcgatcggaaaacttgctccgccgtgtgccggcggtggctgcgcgtcgacggcgaaaaccgacagcgcctctccctgaacgcgaaggcgagcctggttgacttcgttccgtcgctcttctcgcggtttgactcggtcacgaagcttgccctgcggtgcgaccgcaagtccgcgagcgtaaacgacgacgctttggtcttgatctcgctgcggtgcaggaatctggtgcggctgaagctgcgcgggtgcagggaagtcacggagctcggaatggccggcgtcgcgaaaaactgcacgaatctgaagaagctctcgtgcggctcgtgcgcgttcggcgcaaagggcgtttacgctttcgttaacaactccaccgttctcgaagaggtttccatcaagaggcttcgaggggttgaaaacggtaacggtgacggcgcggaatcggtgcctctttccgttacttcctcttcttcgttgaaatcgatttgcctcaaggagctcgttaacggccacagtttcgcgccgttaataattaactcgaagaagcttgaaacgctcaagttgattcggtgttcaggggattgggatgtgactctggaaagtgttggaaagttgaattccgggttggttgagattcatttagagaaggttcaggttagcgatgtgggacttttgggggtttccaagtgtttaaagttggagtctttgcaccttgtgaaagcacccgagtgttccgatgtgggactctgccaagttgcggagaggtgcaagatgatgaagaagcttcacatcgatgggtggaggactaacaggattggggattctggcttgatggctgtggccaaacactgtcctaacttgcaggagcttgtgctgattgctatgtttcctacctctttgagtttgactgcgattgtttctagttgtcagggtttggagaggtttgcactttgtgggatttgtacggttggggatgcagagattgagggcattgtggcaaagtgtggggcgcttaggaagctttgcattaaggggtgccccgtgtcgaatgctgggattgcggctttcgcttcggggtgtcctaatttggttaagctcaaggtgaggaagtgcagaagggttaacggtgaagttgtggagtggctgcgtgagaagaggagtcctctcgtgcttagtattgatttcagtactgaagttgaggctttggatggaagtggtagtgatgttgggcctcaggaaagtagcacagcgtttcctccgatcgacacgacacaagtgtccttggttgatgatgctctttcaagcagtaatagcagcagcagcagcaacaacaacaacaacagattgtctatgttgaggaacaagtttggatttttggctggtaggaatttgatgccatgtgccttcagaaggtgggcaaacattgatgatatctccatgatccaactcggagcactgagtctagagctcaacggcgaagatgaaagcatccgcgatggtgggttgcatgtggagccgatggacgaggaaggagagtgcggagggagagaaatgagagggtggag

SEQ ID NO: 44208 - DNA, 1123 bp, Glycine max
  Peptide Sequence Number=SeqID_160986
tccacaaggtttggggctgtggattgtggagttcgagttttacgcctctttgtcggttgtgcttgtgttcaccaacacttgcatagcagagcctcagaattgtgctctttgcttacccttcttttacttcctctcttctcttcactctgtacagagacagacactgcacacatttatggccagcgtcggtgatagaaaggaatcagaatggatggataggataatatcagaaggagccatcccacttcttgaaccagataattgttcaaatggttgggctacccctcctggtgatgcattcatggttagaggccctgagtattttacaacaagggttaaggttccagctggtgattatatgctcaaacctctcggttttgattggattaaaagttcagtgaaaattggggagatattaaaggatccaaatagtcgagttaggaaggccattgataacgagtttccagaaggtgataaaccctttgtgtgggccttcaatcttcaagtcccaaccaaggataactatagtgccattgcatattttacaaccaaagagtcagttcttgaggattcgctaatggacaagttcttgaagggtgacaatgcattcagaaactcaaggcttaagctgattgccaacattgtaaaaggtccttggattgtcagaaaagctgttggagagcaggctatttgcataattgggcgtgccctttcctgtaaatattgcacgggggagaatttcatagaagtagatattgatatagggtcttccatggttgcaagtgcaatcgttcatttggcatttggttacatttcaactttgactgttgacttggcttttcttattgagagccaagctgaatcagagcttccagaaaaaatattaggcgctttcagattttctgaccttgatcctgcttcagctagaacaattgagctatcaactgttgtgagttgtgacaatgcacaaacatctttacctactagattgtggaagtcaattggacagggcttttcccatattcttcattcaggtcctctagaagatggctctacttctggttcagaacatactaacgatgtagatcacaaagataatccaactgacatcacgaactggtga

SEQ ID NO: 44209 - DNA, 405 bp, Glycine max
  Peptide Sequence Number=SeqID_160987
atgtggttctcatcatttcttagtccttttctaatgcgccactccaaagtacgtcccaatgcaccttctgatgatcaatcatcccaactaacacacaatccgcaacttgatcatggagggtggtctaggcgtggtcgtgaattttgtgaggcaagaagagcgtttttgaacagttaccatttgagtttggaaagaaaaaacaatgttagcttcaaggaaaagttgaagaagtcagtgaaagaggttaatgaagcagcaatgggagttgttttgggcatgcgtcgtggggtgtccaagagaagggttggcatcaaggtttttagggtcaaaatgtcttcacactcgatggttcttgttaccttaagatgttttatcccatggttgaacaaaagtaaggttatataa

SEQ ID NO: 44210 - DNA, 1626 bp, Glycine max
  Peptide Sequence Number=SeqID_160988
atgaaaattcagtgtgacgtgtgtgagagagctccagcaacagtgatttgttgcgcggatgaggctgctttgtgtgccaaatgtgacgttgaagttcatgctgcaaacaagcttgcaagcaagcaccaaagacttcttcttcaatgtctatcaagcaagcttcccacatgtgacatttgccaagattgtgatgaaccaattcattcagccggaagcctttccgcgaaccaccagcgcttccttgctactggtatccgagtggcctcgagttctaattgcaccaaagacaatgaaaaaagtcactcggagcctcctaataggagtgcacaacaagtttctgcgaaaattcctcctcagcaagtgcctagcttcacatcctcttgggctgttgatgacttattggaactaacaggctttgaatcacctgagaaaaaggaatctctgcagtttggagagctggaatggcttacagatgtgggtattttcggcgaacaatttgctcaggaagccttggctgcagctgaagtacctcagcttcccgaaactcataacagtagcagtgttgcttcatacaaaacctccaaatcctacatgtcccacaaaaagcctaggattgaagtcctaaatgatgatgatgatgatgagtattttactgcgaagttcttggcgtggtctgaggctttagttattgagaaaaatcattttttctattgggatgaccaacttctttgctctccatcagacgacactcttgcccttcttgaaataaaacgtgccattgatcccaactcagtcaccccatcttcctatctcaatagctgggacttcacagtggatccatgtgaaatcacaggctcacaattcctaggaatattgtgcaacttgccccttgataactcctctagtagagtaactgaagttgatctcgatggcattggtcgtgaaggtttcttaacaccagccatagggaacctcacagagctaacagtactcaacctcaacaacaacaaatttcggggtccaatcccagaaaccattgccaaactaagaaaactaacaagacttaccatgtcactaaactttttcactggggccattccccaaggaatcactcaactcaaaaatcttcaatatatagatgtgtcaggtaacaggctctcaggcctaatccccactagcatcactggattgagaagcttaacatatttgagtttatcaaacaatggatttgctggcagaattccaaacctcacagggttgtggcaacttaacacactagacctcagtgttaaccagttctatggggatcttccaaaccttccagtgagtttgagaaacatgtattttcaccataatatccctaagggactactcatacacctcaaatggttagttgtgagtgataacagactctcaggtgccatcagtggtgatgttctttccttaagaaatgttgttcatctaaatgtttctttcaaccgcttcacagtattggagcaaatgttattctctgccacgggggacaaagaccatctacagaatgtgttggccagcacaacgtatgacattggtcgaataatcactgcttctatgctttttggttacaccttactccttaggaaatga

SEQ ID NO: 44211 - DNA, 936 bp, Glycine max
  Peptide Sequence Number=SeqID_160989
atggaagcagcgtcagagttagaccaaggtatgaaggtgttggattcgtgtttagcgaatatcaattggcgcctcaaaccttcttccaagcgtcgcttacaattagatgttctcgctctcattacaagaatgagagcggttgtaatggtagactacggtggaatcatgcctcagctccagcaccacctctcttccctcctccaactcgcactaagggattccccctctattttcgagcacatacgagttatggttatacaagacatgatttacttaatacacataaccgaaattgcgcactttgtcagatcaagcttcaactctcaacaacatccgttgctctttgttgaccttgaacatcaaccccctaagatgataacacaaattgaggaaagccaattagcaatgcagctagtatccattcagaggttgtttttgacagtattctcacccgaggaacctaaatctgcggatgatcctaaagccaacgccaacgccaacgccgcgtgccagagctcttcctctccttctgctcactgcattgatctcagtaactgcatggacaacactgacatcactgtgccaaccttgaatggatggcttctaggctacccggtggtgtatctctttggcaaggaccatatttctgatgccatttatcatctttcgaccaaatatcttcatatttttcaagtgtttgtctgcaggaacagtactctcaagaaagggactcaagctgaagagctgttaagtttttcagtgccttacgatctaagcatgagagggagtaatgaacaatgggcagaggcttttctggctcacatgcaggcaaagtgggaaaggtgtgcaagtgcttggaagtcgttaaagatggaggttctacctgtcagaatagagctgaatcccaccaagtacagggcgtactttaaagaatag

SEQ ID NO: 44212 - DNA, 951 bp, Glycine max
  Peptide Sequence Number=SeqID_160990
atggagatggaagcgctaaatattctgcttcctcctgacatttgcaatatgattgctcctaaggagagttcagaggatgttcctatttggaagggatctaaggatgatagcttctcattaaaggaagcttatctttatctagccaagaagatcgatgataataggaatatgaacagtgatcatttcaaactcctcaggaagtggaagggccctcagaaagttcccatatcaaaagcccaggcccgtgttcacttcaggacttgttgcgaacaattggcgaaaccagaaaagttgactttggttgtaagtgtccaacgaggcattgacatgcaagtggagtttgggattgatgcctccattaatggtgagacagtaggaaatgctactatagtgcagattaatagcagcacagctgatggaaacaaagtgggctgcagttcttttaatcctgcttataaacaaggtcatgatgataatataactcaagattcttctggaggggacacaatcccatcaggaattcctgcagtatcggttgcgtcagttgatgagccctatgtgggccaggagtttgaatctgaagctgcagcacatgcattctataatgcatatgctaaacgtgttggattcatcatacgtgtaagtaagctctcacgatcaaggcgtgatggaactgctattggacgggctcttgtttgcaacagagaaggttacagaatgcccgacaaacgtgaaaagattgtaaggcaaagggcggagacaagggttggttgcagggcaatgattttggtgaggaaagtaagttctggtaaatgggttattacaaagtttataatggaacacacacatcctttgacacctggaaaaggtagaagagattgcatttatgagcaatatccgactcttgaacttgcgtttgcaaaaggaactactcagcgtaaggtgcattga

SEQ ID NO: 44213 - DNA, 132 bp, Glycine max
  Peptide Sequence Number=SeqID_160991
atggagaacgatggtgcagaaagattaggacatgatactgttgaagacagaaaaggaagtgattggatgaggattgagagctggtggggttgcgaagataaggatttggatattacatatcagtttctgtaa

SEQ ID NO: 44214 - DNA, 234 bp, Glycine max
  Peptide Sequence Number=SeqID_160992
atggcttgggatgagttgaaggcaattactgatggcatgatggctccttgggctatggcaggatacttcaattttgttttgtttaatcaatcttcaactgcttgttggttatggggttttgtggccattctttcagctggaataggggtaatactcatgagagttttggccaatgctagctggcaggaagtctttatttcaatcagaattacactctcaaagctctgggcttaa

SEQ ID NO: 44215 - DNA, 2709 bp, Glycine max
  Peptide Sequence Number=SeqID_160993
atgaacctatgtccagttttatttgggactctatttgaggttgtggttttttcatgcttgtggttgcaagtttcaagccttggttccatgtcttccattgccgtctcttatggcgacaaagggtcagtattttgtggcttgaaatcggatggatctcacactgtgacctgttatggaataaactcagccataatttatggaacgccaacgcattttccattccttggtctaactgctggtgatggttttgtgtgtggacttctaatgagttctaaccaaccttattgctggggtagcagtggccatgttgaaatgggtgtgccacagcctatggttaagggagctcagtacctagagatcagtgctggggactatcacgtttgtggattgaggaaacctttgactggaagacacaggaacacttctttggttgactgttggggctacaacatgaccaacaactatgtgtttgacgggcaggttcaatcaatctcagcaggttctcaattcaactgtggtttgttttctcagaataggactgtgttctgttggggggatgagactagtagccaagttatttacatgatcccccaaggcataaggtttcagaagatctctgctggagggtaccatgtgtgtggaatcttagaaggggtcaattctagagctgtttgttgggggaggagcatgttggatttgggggaagaactttcaatttcattgacacgttcaggacaaggtaatgttgaattggctccaaatgatcccatgctttctgtggtgggggggaagttccatgcatgtggcattaggagccatgatcgtggagtggtttgttggggatatagtttcaaagcaggcaccccagttcctagtgggattaaggcctttgagattggtgctgggaattatttcacctgtggaatacttgttgagaaatctcttatgcctgtttgttggggtgttggcttccctacctctctccctttgcctgtttcaccaagaatgtgtaggtctgctccatgtgctccaggttactatgaaacccaacaaaatggtctttgcaagtccccagattctcacatttgcatgccatgcagtgctgcttgtcctcctgagatgtatcagagaagtggatgcaatttgaaatctgacatactgtgtgaatataattgttctctttgttcctcacctgaatgcctgtccaattgctcctcttcctattccaacgctgcctctggcaagagaagtgaaagattctggtctatgcagcttccagtgcttattgctgagatagcctttgctgttttcttagttagcattgtgtctataactgttgttttgtatgttcgctacaagctaagagattgtcagtgttcggggccaaaggtgaagaaactaaaagggagctcttcaaaccaaaaggaccagaaatgcaagatccgaccggacttggaggagttcaagattaggagggcacagatgttctcctatgaggagcttgaaagggcaactagtggattcaaagaagagtccatagcggggaagggaagtttttcttgtgtgttcaaaggggttctcaaagatggtactgttgttgctgttaaaagggccatagtgtctcccaacatgcagaagaattccaaggagtttcacaccgagcttgacttgctctctaggttgaaccatgcacacttgctcaatctactaggctactgtgaagaaggtggagagaggctccttgtttatgagtacatggctcatggttctttgcatcaacacctgcatggcaacaaggtgatgcaagagcaaatggattgggtgagaagggtaacaattgcagtacaagcagctcgcggaatcgaatatttgcatggatatgcttgtccacccgtgattcacagagacattaagtcttcaaacatcctcattgatgaagaacacaatgctagagtggctgattttggtttgtcactacttggtcctgcagatagtagctccccactagctgaactaccagctgggactcttggctatcttgatcctgaatactacaggcttcattatcttaccacaaagtctgatgtgtacagctttggtgttctacttttggagattttaagtggtagaaaagccattgacatgcaatttgaagaagggaacatagttcaatgggcagtgcctttgatcaagtcaggagatatagctgcaattttggacccaactttgaaacctcctcctgatcttgatgccttgagaaggatagctaatgttgcttgtaaaagtgtgagaatgagaggtaaggataggccttcaatggacaaagtgacaacagtgttggaaagagcacttgctcagttaatggggagcccttgtattgagcagccaattttgcccactgaggtggttttgggaagtaacagattgcacaagaaatcatcttcaaacaggtcagcctcagaaagcactgatgtggaggatcagaggtttgagtttagagcgccatcatggatcactttccccagtgtcacttcttctcaaagaagatcaggctcggaggccgatgtcgagggaaaaaatgcagaagggaggaatttgagcaatgttggaggtggtggtggtggtggaggtgatgttttgagaagtcttgatgaagagattggtcttgcctctcctcgagagagattgttcttgcaacacaacttctaa

SEQ ID NO: 44216 - DNA, 2166 bp, Glycine max
  Peptide Sequence Number=SeqID_160994
atggagaagataaaaataaaactactcatgaaggatgaaacctttctccaacacccttttgttcttgctgttgttctggttttaggccttgttatgatggacccttttcatctgggtccagtggctgagcatgaattcagacccgtgaagcatagcattgcaccataccaccaagtcatgaaaaattggcctagggacaacatgagcagattagcacttcatgggaaatcagaattcaagaatcaagtctttggaccagagtcactcgagttcgataacatgggtcgtggcccctacactggtttagcggatggacgcgttgttcggtggatgggggagcaacatggttgggaaacatttgcagttgtcacatctaattggacggagaagctttgctttaggggcaatgattcgaccactgagaagcaatggaagcatgagaaaacatgtgggcgtcccctaggcctaagatttgacaaagagagtggagatctatacatagcagacgcatactatggacttcttgtggttggacctaatgggggactcgctacatcgttggcaacccatgttgaaggaaagcccattctcttcgcaaatgatcttgacattcataagaacggatccatcttcttcacagacaccagcaaaagatacaacagagttgcacatttttttatattattggaaggagaagctaccggcaggctcctcagatatgatcctccaactaaaacaacccatgttgtattggatggtcttgtttttcctaacggagtgcaattctctaaagaccactccttccttctctacactgaaaccaccaattgcaggctaatgaagctctggatagagggtcctaaaagtggaactgtggaacttttagctgaccttccggggtttccagacaacgtaagaataaacgaaaaggggcaattctgggtggcaatagactgttgtcgcactccagcacaagaagttcttagtcataatccatggttgaggaacatttacttccgtttgcccataagaatgagcttgttagctagagcgatggggatgaaaatgtacactgtgatttcacttctggacgacaagggagaggttttggaagttcttgaagatcaacagggtcaggtcatgaagctggtcagcgaagtcagagaggagcaagggaagctttggattggaactccacgcgccaattctagggttccgacttctcagagcttctgcaccgcgtcctccgacagggactcaatcgagtacgacgtcgtcatcgtcggcgcaggtcccgccggcttatcggcggcgatacggctcaagcaaatgtgccgcgaacgaaacgccgatttgtccgtctgtgtcctcgagaaaggtgccgaagtcggtgctcacattctttctggaaacgtttttgaacctcgcgcgctaaatgagcttcttccgcagtggaaggagcaagaggctccgatcactactcctgtttcttctgataagttttggtttctgaccaaaggtcgcgcaatttcgcttccgtctcctttcaacaacaaaggcaactatgtaataagtctaagtcagttagtacgttggttgggagcaaaagctgaagagctaggagtggaaatatacccaggatttgctgcgagtgaggtattgtatgatgcaaacaacaaagttatcggtatcggaactaatgatatgggaatttcaaaagatggttcaaagaaggagaattttcaacatggcgtcgagatcaaaggccgcataacactcctggctgagggatgtcgaggatcattgtcagagaaaataatgaaaaagtacaacctaagagagaagggaggttctgaacatcagacatatgctttgggaattaaagaggtttgggaaattgatgagaaaaagcatcaacctggtgctgtaatccacacattgggatggcccttggatcataaaacatacggaggatcttttctgtatcacatgaaagataaacaaatatctataggccttgtggttgctttaaactatcagaaccctttcatgaatccttatgaggaattccagaaactaaagcatcatcctgcaattaaatcatttctggaaggtggaacagttatccagtatggagctcgcactttaaatgaaggtggttttcag

SEQ ID NO: 44217 - DNA, 792 bp, Glycine max
  Peptide Sequence Number=SeqID_160995
atggataaagacaaatctctaggtttgccacctccgtctggacgttattctggttactcgtccaccggaagtgttttcaacgtgaaatctgaaccgtccccgtcgtcgtcaaccacgttgtatccgccattggctccgggaactaccagttccgagtctagccattttggacatggattgtccacggattctagtggttttagtcatgatattagcagaatgcctgataatcccccgagaaatagaggtcataggcgtgctcattcggagattctcactttaccggatgatattagtttcgacagtgaccttggtgttgttggaggtggtgatggtccttccttctccgatgatgccgaggaggacttgctgtccatgtaccttgatatggataagttcaattcatcgtcggcaacgtccacgtttcaaatggttgagccgtctaatgctgtgggagcatcggcttcaacaccggcgtcaggggcacccacctcttctaccgagaatgttgttattgggactaatgaaaggcccagagttagacaccagcatagtcaatccatggacggctcaaccaccatcaagcctgagatgctggtttcaggttcagaagacatgtctgcggctgattccaaaaaagcaatgtcagctgccaagcttgctgaacttgccttgattgaccccaaacgtgcaaaaaggcaatatgctagttgtaaatgtcatgtcatgtttatcactattctcaatccgttgcatatttattacctcatttctagttcatgctgcttttga

SEQ ID NO: 44218 - DNA, 455 bp, Glycine max
  Peptide Sequence Number=SeqID_160996
tttttcctggaggagcaattattggatgttcagctggcttcatgaatgtgccaaagataaagggaactcacacggcaatgaaatcaggaatgcttgcagctgaagttacatttggtgcacttaatgaaggtctagatatggatatgtattgggatgctttgagaaattcatggatttgggaagaattgcataaatctcggaactaccgaccagcctttgaatacgggcttattccaggactggccttaagtggtctggaacattacatattcaaggggaggcacccagttactttgaagcatggtaaacctgatcatgaggctatgaatgctgccaaatcacattctccaattcactatccaaaggctgacggtgtcttgtcctttgatgtgcctacctccctgcacaggttttggaacacttactcccttctgttgcttactgttgagagttga

SEQ ID NO: 44219 - DNA, 237 bp, Glycine max
  Peptide Sequence Number=SeqID_160997
atggcagtgcagcgtcaacgtccgacaattgcaagaaagtcacgaatgatggggagaaagggtcgaacacttatggggaagagaatgaaagtggacccaacccaatccttacttctacataacttgcaaggattgccgatctcacgttttcgcatgatagatcacaatcccactacaatccttgccaccaacgatcccaggtccgatccagcacagaagcccgacattggcgcataa

SEQ ID NO: 44220 - DNA, 390 bp, Glycine max
  Peptide Sequence Number=SeqID_160998
atggcgaggcttacggatcaacttgatccttacgatttacggatcaccctcatacacactcatcactgtgaaaaaagcgcatggacaattttggtccttgtgaagagcttggatttatatgggaagttggatggtcacgaagggtgtgtgaatgcagtggagtttaactccactggtgaccttctggtctcaggttctgatgaccgacaagttatgttttggaattgggcatccaaaactagattgtttgcatacccttctggccacacagacaacatattccagacaaagattattccattcaccgatgactgccgaattgtaacttctgccggtgatggccagccccaaaatagcaggctccaattccccgtgcttcctcttttttag

SEQ ID NO: 44221 - DNA, 426 bp, Glycine max
  Peptide Sequence Number=SeqID_160999
atgctctcctacaacctaagacaaggtagatggagatatgactttacaggctcaaggtttagttcaatcaatcaaaaacaagctcaacataggtgcaagggattcatcattcatgaactggaggtgaggaggaagcatcctaggctggttgaggagtgtcctgagctgctgcgggccatggatcccaatgctctgcactactgccatatttgctgcataatctgtatctacagtgccatcctcctcatcagagacctctacccttggtgtagtaactggagaagtcctcggggtggtctaggatcttcttcatcaatggattcctttgcttcttggaagatgaatgaaaatggaatggagaaggaagagagagaggagacgccacttcaaggagaagatgagtctagaagaagctcaccaccatag

SEQ ID NO: 44222 - DNA, 207 bp, Glycine max
  Peptide Sequence Number=SeqID_161000
atgtcgcgaaaccttacagattgcacaacaatcccttctttgactctggaatgttgcagaactttatggatcgtgcaacaatgtttcctttcgacttccggcatgtcgcggaacttcgcggattgcctaatgatgggtgccaagttcctccaagcagtcatgcgaaggtcgcatcccagcaaacagatggtccccggacaaaattag

SEQ ID NO: 44223 - DNA, 243 bp, Glycine max
  Peptide Sequence Number=SeqID_161001
atgctgacatctccgaaaagggtgcagatgaccacattggcctctgcttgtcaatcgaacttggggtctccgaatgacgaggtgtggataaccgaaaggtgtctccgcatgctaccagactcttgggtcatgatagcaaaaggtggggtggtcgacaaaagcgagacttttgctcctacgtatcctccatttgtgatgaggaactcagacctacgtagttctttcttttgtgagactaaatag

SEQ ID NO: 44224 - DNA, 192 bp, Glycine max
  Peptide Sequence Number=SeqID_161002
atgggcactttgattaaattgggttattcaacgggcctggtgaaagttaaaaagccacctaaaaagcagggatcatgtgatgtaatgaagtactcagcactacttcagttaactatggtgttcgacaaaatatttcagttaagggttgcatcttctgacagtgttaatgggggtgtggttgttactaagtga

SEQ ID NO: 44225 - DNA, 788 bp, Glycine max
  Peptide Sequence Number=SeqID_161003
ctgttacatggacacctgaacttattgcaagtttaacttctttactccctgcaacaacgcaatcatcaaccacgggtggcccaatggcagtggctggtccctctattgtgaagccatcttttccttctgttgcacctaatgatggaaatcaatctcatttgtggaaacaagctcagcaaatccctgatccttctagtcatcctcctcaacaatttgggagtattcataatgttcaatatcaaccttatccacctgcatcttctactgaccaccctgctcaagtggtctctggcagttcttgtttccaagataccaattccagtctccagcagccagttgctgtttcgtctacacccatgactaatttcatcttacctcctcaaaatggacaggtagctgtgtcccctcaagtcagtcaacagtatcaggtggaagtcccccatggcactgagaaagactatggagttgttcagggaacagatgcctctgttttatatagttctaaggcgttccaacaacctaataattttatttcctcatccaatcaagttgccaatgctgcatcacagcaacaatctgtgatgccctttacagtggacaaagataattcagtgcccacaaatcagcaacctcaacctgctttatttggagttggccagggagtgtcagaattggaggctgataagaaccagaggtaccagtcaacactacagtttgctgccaaccttctccagcagatacaacaacagcaaacacaaggagggcatgggccaggaaatcaacaataa

SEQ ID NO: 44226 - DNA, 1896 bp, Glycine max
  Peptide Sequence Number=SeqID_161004
atgccgcctccttcgaaatccgtggaaggcgaggagtggggaacccccaccaacaacctctgggtcgggaatctgccgacggaggtcacagattccgatctcatggaactattcgctccgtacggttctctggactcactcatctcctactcctcgcgcaccttcgctttcgtcttgttcaggcgcatcgaagacgctaaggcagcgaaatccaacttgcaaggcgcgttgctgcgcgggtttcaaatcagaatcgagtttgccagaccggcaaagccgtgcaaacaattgtgggtgggtggttttagtcccactgttgcaagggaagatttggaagcggaatttcgcaaattcggtaagattgaggattttaagttctttatagaccgcggcactgcgtgtgttgagtttctcaatctggatgctgctgctcgggcgatgaaagtcatgaacgggaagcggttaggtggacgccagatttgtgtagatttccttcgatcacaatctacgagaagagattttttggttgatcatgggcagtttcaggctagaccacagcatttacaaccttcaattgggaggaataatcaacccagtaaaatcttgtggataggttttcctccttcctttcaaattgatgaacaaatgctccacaatgccatgattttatttggtgaaattgagaaaatcaagagttttccttctagacattattcatttgttgaatttagaagcattgatgaagctcggcgtgccaaagagggtcttcaaggacggctttttaatgatcctcaaataacaattatgtattcaagcagtgagctggcacctggaaaagattaccctggcttttatcctggaggtaaaggccccatacctgatggattaggtaatgagcatccatttcgaccgctacaaacagatgtatttggtcataatcgtcctatggttccaaataattttcctggacaattgccacctggacataatgtcccaatgcgaccttttggttctcaaggtcttgaacctcttatctctggtcctgattttaatgagatgggtccaagctggaaaaggccatctcctcctgccccaggaatgcttccttctcctgtgcctggtattaggcctcctacaagatccacctccggtgcatgggatctacttgacataaaccaatttcagagagattctaaacgtttgaggatagatgatgctttgttcattggtgatgctccatttcctttaaggaatatagatgatcgtggattaggagtagaacagccatttgcaattgattcagttattgatggaggtggttctggtccaaagagtcaccttggtccagtcggcactaggatcacatctggagtacctggttctgtccaacctgatattgatcatatatggcgtggaattattgcaaaagggggaactcctgtttgtcgtgctagatgtgtgcctattgggaaagggatagtgactgagattcctgatattgtagattgtgctgccaggactggattggatatgctaacaaaacactatgctgatgcaattggttttgacattgttttctttctccctgatagcgaagaggattttgcttcatacactgaattcctttgctacctcaaagcaaaaaatcgtgctggtgttgccaagtttgttgataacaccactttatttttggtaccaccttctgatttcttgaccaaggttttgaaagtcacaggacctgaacgcttatatggtgtggttcttaaatttccattagttccaagtagcacatctatgcaacaaccaatgcatttgccttctccctctactcagtatatgcaacggattcctccttcacaagctgaatatggttcaatattggtaaaggaggaacag

SEQ ID NO: 44227 - DNA, 155 bp, Glycine max
  Peptide Sequence Number=SeqID_161005
atggcgatacaggctgatactgtcattgacactgacgatacgagcttacatggacaccaaatcgctggtcccattggtgatacgagccacgtggagtgcttgccgcaagtccaattggcgagagaggttgcgcaaatttcattggcgatacaagg

SEQ ID NO: 44228 - DNA, 246 bp, Glycine max
  Peptide Sequence Number=SeqID_161006
atggagcaagatagggagcaaggaattgagggaggtatcaactatgataataaagaaactgaggatactaatgaaaataattctgaaggggcggctcaaggacttgagaggcctaaagcaaattttgtggaagcaatgccttccaagattattttgatgatgccaaagaatcaaaagtcaaacaagtttcaagaatcaagatcaagattcaagaataatcaagatcaagattcaagattcaagtaa

SEQ ID NO: 44229 - DNA, 1023 bp, Glycine max
  Peptide Sequence Number=SeqID_161007
gccaacacactgtatgaagagatggttgagaaactaagggccagtggtttagaacaacttgcaaggcagcaggtggatggtatagttcgccgaagtgaagaaggtgctgaattcttttttgattcaaacatcccttccacatgtaaatacaggcttcgtgcacatgaaggtggttgtgcttccatgttgtttgagtacaattccagtaaattgattactgggggacaggatcggttagttaaaatgtgggatgcaaatacaggatccttaagttctactcttcatggctgccttggctcagtattggatctcacaatcacccacgataatcaatctgtcattgctgcaagcagctcaaacaacttgtatgtatgggatgtcaactcaggtcgtgtccgtcatacccttactggccacactgataaagtttgtgctgttgatgtcagcaagatttcaagtcgtcatgttgtcagtgctgcctatgatcgtaccataaaagtttgggacttagtgaaaggttactgcacaaacacagtaatttttcgcagcaactgcaattctctttccttcagcatggatggtcaaaccatattttctgggcatgttgatggtaaccttcggctatgggacattcaaactggaaagttacttagtgaggttgctgcccattcacttgcagtcacgtcactatccctttcccgaaatggaaatgttgtactgaccagtggaagggacaatttacacaatttgtttgatgtgcgatctctggaagtttgtggcacattaaaagccatgggaaacagagtggcttctaattggagtcgctcctgtatcagcccagatgacaatcatgttgctgctgggtctgctgatggatctgtctatatttggtcaatatctaaaggtgatatagtcagtactctgaaggaacacacttcctctgttctgtgttgtaggtggagcggaattgcaaaacccctagcttcagctgataagaatgggattgtttgcgtctggacataa

SEQ ID NO: 44230 - DNA, 531 bp, Glycine max
  Peptide Sequence Number=SeqID_161008
atggagtatccaaatatcatgattcttttaattacatatatatcctctaattttagagaagttaaatattatccaagtgactatgcagaaaaaatgttaatatttttgcttaccgcattggccttgatcctttacatcagtgacagcacctttcttcctccaatctacggaagaaggaaccctgtcaacgttctgatacatgaaagtaccattcccacgtggcgtgcctctgaacattctgtgatgattaaccttggagccagcatagatgctcctgaattcatggttggtcatgtcagcgaacctgttcaacttcagcttgtaaggcttgtccattttattggaactgtggacatgcatcacgttgcctttgaacacgttgaagcggttgtgcttctcatcgaggcttcgagaaaccgtgtggtggctcctccatctctcgtacaaatcccacaacccttcctcggattccaggtccttttcattgaactcaaagctctcagcaactctcagaaccaaagcaaaggatag

SEQ ID NO: 44231 - DNA, 945 bp, Glycine max
  Peptide Sequence Number=SeqID_161009
atgtctgcggacagccttcttggtttcttgattctctcatgcatgcaacctagatatgattactctggttatgggcagtcatcaggaaaggtaattactctacttttctttctgggtttatttgattcttttgatcccagcacgccacttatagatatcattgcacagccaagtgagaataatacttatgctgacattgaagctgcatataagtatcttgaagagaactatggtactaagcaggaagacataatcctttatggtcaatcagttggaagtggtcctactttggatcttgccactcgtttaccccgactaagggctgttgttctccacagtcctatactatcaggattgagagtcatgtaccctgtgaaacggacatattggtttgacatttacaagaacattgacaaaattccattggtgaagtgtccagtgctgataattcatggtaccgatgatgaggttgtcgattgctctcatggcaagcatttgtgggaactttgtaaagagaagtatgaacctttatggctcaaaggagggaaccactgtaatctggaactttatccagaataccttcgacatctcagaaaattcatatcgataatagaaaagtcaccatcacaatggcaaactttgtggagaagcataggtggagttgaagaagccagaagaagtgttgattgttttgaagctccaaggatgagtgcagatctaagggacaaaccaaggaaaagcactgataaacaagaacaactgaaatttcaagggcataagttgagtaatgttgaaacagtagagaaatcaaggatctcttttgaccatgtggcaggatcacaaagaaacaaagagaaccacgataaatcccggaaaagtgttgatgttcattttgggaggacgaggaagagccttgactggctggataaaattcgagctcgctga

SEQ ID NO: 44232 - DNA, 569 bp, Glycine max
  Peptide Sequence Number=SeqID_161010
gatgttttcactgctgctattggacgactagagcaccctggacgtgtccgtgctgctggagccggtgtcaccatcaagcattacttcggatcggctccacggacgtcccgcaactcttcctcgctgcctcctgaagaattgcagcagctgctgacccagcaaattagggaccagctagaggagtcgatcacagaaaaagaaactaagacgggtgactcagataggtgcggcttgtacattgaagcagatcctgcatgcctggtaggtgtggaggaggttaaagatccaaatgctccagttcctatacccactgatgagacagctgtgtctccggcaaaaccacctcaaaagccagattcggaggttacatgggatgccaccgtgtttggggtctttaatccagatttcccgctctacataaagcacgaagacctctctgaaatcgcacacggtggtcaatgtctcagcatatcagtgttacagttgtggattctgcatctgactgaaacaagtatgcgagcggggaattccgatatctatggattcctcgagccacagtccattcagag

SEQ ID NO: 44233 - DNA, 327 bp, Glycine max
  Peptide Sequence Number=SeqID_161011
atgaagagttggatgcagaattcaaaacgcgatgtctaccttggagcctacccaaatgggctagacaactaccttaaaggaataattaaaagtgctttgaaaggacttgatgatactccacaacctaaatccaagtgtaatagacaaaaaggaagcattgagtgtggctattacatgattcattggatgtccactataatcttaggaagttttaggaataactgggaaacgtattttaatgatgttagacaattggaagcagagagattgaagatgtttcgcatccagtgggcaaagtattatctgaacgttagaaatcaaacttag

SEQ ID NO: 44234 - DNA, 498 bp, Glycine max
  Peptide Sequence Number=SeqID_161012
atgaccggaaggctgcttgccggttcattggctcttgaaagccgcatccttcactatcttattgtgcatattttacttccaagatctttaaaccttgcacaggtttctgaagaagatcttattgtcatgtgggcttttcataccggccgacaaattgattgggcacacttagtccgatatcgcatgcataaggcattgcgattaaatgctccttcaccatatccacatctagtcactcttttccttcaacactttaacatccctcttgattctgaaccttatgttccaatcaagagatccttcttaatcggtgctgctagtattttggacaggtttgatggacttcaaacctatgttggtgaaaggtttgatgctttggaacaacaagtggacatgcgattcgacgagatggactcaaggatcaccaaggttgaaggagatgtcacttacatccgcacatgctttgatctaccaccaccaccaccaccatcatcttag

SEQ ID NO: 44235 - DNA, 282 bp, Glycine max
  Peptide Sequence Number=SeqID_161013
ccgaagcaaattcatgagattaaagacttcctcctcactgcaaggaggaaggatgcacgctctgtgaaaatcaagcggagcaaggatgtagtgaagttcaaggtccgttgctccaagtacctgtacactctgtgtgtgtttgattctgagaaggctgataagttgaagcaatcacttcctccagctgaattgcataaatggtttaagcgtgcaggatgtgtgattcttactgctgttgatgaagatcaagttttgctttggattttggggattcatatttag

SEQ ID NO: 44236 - DNA, 372 bp, Glycine max
  Peptide Sequence Number=SeqID_161014
atgtctgatttgagaattgagacagaatggcaaaaggctcgatggaggcttgacaaaatattttatctgtttttgttgtgtattaactatttaccggaactggactcctatgcttattgcttgatgactgaagcgtgtagggatagatgctcttcgttccaagtcaagtcaaataacaaatttcataatcccagatcatcagttactttctctcttcgaacggcagaagcctgggtatctatatatccatctgtgatccagatctctcctgcaaaggagacccctcaagcctctctgcaacagttttatgagaatccttcgatatatctcacagttaagaaaaaagtgtttctctctctcaagttcatctga

SEQ ID NO: 44237 - DNA, 768 bp, Glycine max
  Peptide Sequence Number=SeqID_161015
atgaataaacaagttataaagttttatctcatgacacaagctgatttggtgaggaagagtaagaggaaaatgttagagttagtttgtaggggttgcagagtcagagggaagaaagagacatacttgttgaaggtcaataagaaagggaacgtgcgtctcctcaactttggcagcgatggagaggcaagcgacggcagcgagctgaaccatccatggcttgtcattctgaaagcggaagctgaagagaaaacggtcaaagtagttgaccgaaagaacagcggtgagagcagagaaagagtaatgggagttgactttgagcatccactccacggcttcccggcgagcaaagtccaaggcagggttggtttggagacagcagcgatgtcaactcttgttcgtccgaaaacatgtcgctttggagcaagaaaggaggggacgcaggggaggagttgtttaggaaatgaccgtagtcctcctctgcttcggagcagtatagggtgtccaaaagggatttccggttggtgtggtcatgatggtggtaagccatcttggatgtgggactttattggagtgtggaatgccacgatggagccattctctgaacccgcaagaggaaggagtgaccctgtgttatttattcaaatgtttctttggctccagacccggatgaaacatgggccatgcaccataattactccacacgtgacacttgtactctacaatttaatggatccctctttcatcccttcatctcaaacatcgtgttag

SEQ ID NO: 44238 - DNA, 294 bp, Glycine max
  Peptide Sequence Number=SeqID_161016
atggttgcaacagagcagcggaccgtaggagtaggactgaatcagagctacgagagagcgatagagaggcatttctactactacctcttttgtaggctcgacctccgagaaatgaggttgggtggagtgggggcagataaagagaaagaaaaaatgggtagctatagctacatccacatagtgcaagcagttgagacagaatcagaatcagtgatggtggtgaaaggtgaatgtagatatcgtggtggttgtggattctggaagctaagttcgtggtttccagcacaccactaa

SEQ ID NO: 44239 - DNA, 1674 bp, Glycine max
  Peptide Sequence Number=SeqID_161017
atggcactttttatatgcacacaaggaagagccagtgaaacttgttgcaggtcttggggagaatttccagcacgtttcatctctcagattatacagttaaagatggtcatagtcaatggcaccaacgggctagtatctttagtagtgattttagttttgattttcccagaagttgcatcacaagcactctcacccagtgattctgttgcagataatgtgtcagtagccattagccaaccggataatactattagagtggaccctttagatcatttccaaaaatacagaggaggatttaacatcaccaacaagcattattggagttctgtgatcttcactggagtatttggatatgcaattggggtgctctgcattttttgtggaatcgtatatgaaacttttttggtaatatccacggtttgccacaaaaatgacagaggaagaaggatgaagaaggtctttccttgtaattacaagagttgtgatctttcactaattcttttgactatattgctcaccatttttactatagctgcaactgggctagttcttgctgggagtgcaaggttccattctgaagcaaaaaattcagttaatattataatcaagacagcgaatgaggcatcagaaacaatacacaacacaacaggagcgttaaaagacatggaaagtaacttcatggaagccaataacaaagctgaggcttctgtaaaccttgactctacaactgatagacttgatgatgcatctgcaaacattgaaaagcaagctaggaagaatagacgtcttattaacaagagcttgaaactagtgtttgtaattaccacggtgattataagcttgaacttggctgctgtaataactttgtcagtttctggaatactgaggttacagcgggcactatacctgcttattgtattatgctggttgatgacagtgatatgctggctattctttggagcctatttcttcttggaaaaattttctggtgatgtatgcacagctcttggcagctttcaagaaaatccctataaaaacagcctaagctcaatcctcccttgtgatgaattgctctcggcaaaatcagttctatctgatgttagtgctgggatctacgaccttgttaataaggtgaatgcaaacatatcagccatgcaggcaacatcagctgtgaatcttgttcaagtttgcaaccccttctcagctccacccaagtatttataccagccagagaactgccctgctaacactatacgaattggagatatcccaaaggttttgaagcctttttcttgttcaaatacgattgatggaacctgtgacaatggatatttaatacctgggagtgaatacatgagagttgaggcttacacaagttcaattcaggacctactgaacgtgtatccaagtatggaaaacttgttggaatgccaagtggtgaaagaagcattctctcaagtccttgtcaaccactgcaagcctttgaagaaatatgctaagatggtatggctaggattgctgtttcttgcagtgatcatggtgttgttggttgtgctatggactataaaagctcgtcacgagcaccgttatcatctttcagatggttctgtggagcctcattgtgcaccaacaaaagccttggaatcaggaatagctaaagagattgagatttga

SEQ ID NO: 44240 - DNA, 837 bp, Glycine max
  Peptide Sequence Number=SeqID_161018
atggaaaacagaggtagtgatgacgatgaaaatggtaatgggtgtccgtgtccgtttttctccaaccttctcaaagatgacgcaacgcacccatcttcttcacactcactatcacaaccaaacgattctttggaaggagtgccaccctatcccttatacaagcgcttttcttcagctctgttgaagtgtatggattctgaaacattttgtaggacaggcgccaatttagccatgaccgatgaatttgaagattcttccatgcagcagaagcgtaatgagtggcacagattgattgtggagaaggggtttgaaatagagaatattttgaagagtgtttcctttgaattccatgtccaagagcctttcttttcacagctaaatgatggcctaaaaacaattgaagggaggtgtgccactgggaaatacaataggatcaaatcaggaaatctaattctctttaataagtcggtggtgtttgaagttcagggagtaagacggtatcctacattctttgccatgttggaggcagaaagccttggaaaagttcttcctggagttgaaagtagtgaagaaggtgaactaatacttaaggaattgagctatgagggtgttcaaagccttctaggtctcatgcataccacagggacaattcctaatgcacttcctccaccaatatcaactctattagcatcatttaattttccatgcaatccaaatgaaaatggcttgactgatggagctcgtgcattggccaagcatgcttgtaggagtagcagtggttattggggttctctgaatggaaatggtttgtcttcacatggaatctgttgcctataa

SEQ ID NO: 44241 - DNA, 594 bp, Glycine max
  Peptide Sequence Number=SeqID_161019
atgttttggaatagacagaatattgtaagtgttaaattttctaaccaggaagaagctagcatggcgtgttgtttcctcatttttggcttgttaaataggggatggtttagcatcttggctgaaagggtttctgatcctgcagtaaagtcatctaacttcactgctcgatccaatgtctccccatatgctccaccaatgattacaatggacaatgatgatggcatctcttatacagcaattggaggtcccaccggtgacctattagagcaaaatgcacaggccttgaatcaaatctccacaaatctttccgctttccagtgtatgatgttgttagatgctttggaagccatatttgagagtggggtttcttcaataacttatctgaaagcaacaaaacaaagggaaagtagatgtgaacaagtacaggagaacatcaatcttttctgccaaactagagataacatccttaaaattatgaacgagttgaatgactcgccagaggtgatgaagcaaatgccacctcttcctgtgaaggtgaatgaagagctagccagttccatacttccaagaacaaatctcccaccacaatcatga

SEQ ID NO: 44242 - DNA, 1215 bp, Glycine max
  Peptide Sequence Number=SeqID_161020
atgggcggcgttgcagcggtaaccattgacgacatccccgacaactgcttggcttgcattttccagttatttccccccgccgaccagaagaagttgtccctcgtttgtcgccgctggctcaaggttgaaggacatacccatcaccgtctctgcctcacccttccttactcatcagtccttgcatctattttttctcgtttcgactccgtcaccgacctcactctccaatgccctaatctcatgagcatgtgcgacggaaatctagtcgtcatttcagacctctgccctaatctcattcgcctccaaatcaccaagtgctcctatctctcctacgctggcttggaggtcttagccaggagttgcgagcgtttaaaaagtttctcttgtacatcttgcacttttggacccaactccattgacgcacttatacatcattgcactactctcgaacaactctccatcgagtattctactgtcacaacccacggagctcaattcctaaatttctatcctttgattcgcgccaagaatttgactactgtgaagattgttcagtgctctgttgaggagtactgggatatgttttttcattcgttggcgagccaggttacgagcttgctggaagtccacctcgatgggtgcggagttagcgataatggtttgagagcgatttcaaaattaccaaatttagaaactctgcatctggtgaagacccataagtgcacccacgcaggactggttgcagttgcggagggatgcaacaagagtttaagaaaactttgtattaatgtgtcagattggaagggcaccaacaaaataggtgacaaaggtttgatagcgtttgctaagtgttgtagtaatcttcaagaattggttctcattggtatgaatccaagcaaagcgagtttgaaaattttggcatccaattgccagagtctagagcatttggggttgtggggaagcaataagtttggcgacactgagatatgctgcattgctggaaaatgtgtggcgttgaaggaactccacatcgagcgttgcccacgtgtttatgatcgtgacatcaagacgttggctgctaagtgtcccaatttggtgagagtgaaggttttcgaatgtaaatgggtcactgaaagggatgagtacgtgcgctaccaccgccgtttagtacatgtgacttgcaagccacgtactgcatgtcgatcacccttgtag

SEQ ID NO: 44243 - DNA, 774 bp, Glycine max
  Peptide Sequence Number=SeqID_161021
atgggtaccaacagatcttctaaggccacgatcttcatcctgttcttcacggtcttggcagtgtcatcggcgttggacctgtcgataatctcgtatgacagaagccacgcggacaagtcagggtggaggagcgacgaggagcacaatgctggaaaccggacatacaaggttggactgaaccggttcgctgatcgcagcagaatgatgaccaggccaagtagccgttacgctccgcgcgtgagtgacaacttgtcggaatctgttgattggaggaaagaaggcgctgttgtccgagtcaaaacccaatcagaatgcgaacagtcaatgcaggatgtagtggtggacttgcgggactatgccttagagttcattatcaacaatggtggcattgacaccgaagaggattacccctttcaaggtgctgttggtatttgtgatcaatataagataaatgcagttgatggttacgaacgtgttcctgcctatgatgaattagccttgaaaaaggcggtagcaaatcaaccaggtatattcacaggaaaatgtggcacgtcaatagaccatggtgttacagctgttgggtacggaacagaaaatggaattgattattggattgttaagaattcatggggtgagaattggggtgaggcaggttatgtaagaatggaacgtaatacagcagaagacactgcaggaaagtgtggaattgcgattctgacattatatcccataaagagtggccaaaatccctcaaaccctgataactccagctaa

SEQ ID NO: 44244 - DNA, 1581 bp, Glycine max
  Peptide Sequence Number=SeqID_161022
atggcgattgatccacacttattactgttcctgcttctggccccgtcaaacgcacattgctccaaactccaacgccgtcatcttcctccctttgttttcaccgacgcaaccgccctcctcgtcttcaaactaaaagccgacgttaacaaccaccttgacttctcccccctcacgcgcggcctccgcttctgcgcgtggcatggcgtggaatgcaacggccccaaagtgctgcgtctcgttctccaaaacttagatctcggaggcgcgtgggctcccaaaacactcacgcgtctcgaccagctccgagtcctcagcttgcagaacaactcactcaccggacccattccagacctcaccggcctcttcaatctcaaaagtctcttccttgataacaaccacttcaccgcctctctccctccctcactcttctctctccaccgtctccgaaacttggatttctctcacaacaacttctccggacctattcccaccgccttcaccaccctagaccgcctccacagcctccttttaagcttcaactccttcaacggttcaatccccccgtttaaccaatcctctctcaaaatcttccgagcctccgccaacaacctctccggcgcggttcccgtgacgccgacggtcttccgttttccgccttcttccttcgcgttaaaccctcaactctgcggcgaaatcatccgcgtacaatgccgtcccgcacagcctttcttcggacccgtggcgccgcctacggctgcgctcggccagaacgcgcaggttcacggcgtcaacggaattatccggcagccgtacgagaagaagcgccacgaccggagggcgctgattattgggttctcggccgggatattcgttctggtttgctcgctggcgtgcttggcggcggcggtgaggaagcagaggagtcggagcaagaaggacgagaggacggggatgatggcggctgatgcggcggcgagggaggagggcgcggcggttatgcggatggagatggaggagaaagtaaagagagcggaggtggcgaagagtgggggtgaggcgcaggtgtacacgctggagcagctgatgaaaggttcagcggagctattagggagaggggcaaggccattgcattggacatcgtgcttaaaaatagcagaggacgtagcacaaggtctggccttcatccaccaggcatggagattggtccatggcaatctcaagtcctccaatgttcttcttggaccggattttgaggcatgcattactgattactgcctttctgtgttgactcacccatccatattcgatgaagatggggactcagcagcatacagagctccagaaactcgcaaccccaatcatcacccaacccacaaatccgatgtttatgcggatgacaatgagaacgaagataaccgaatgtacatgcttcttcaggtggctacaacttgtagcttgacctcacctgagcagaggccaactatgtggcaggtcttgaagatgttgcaggaaatcaaagagattgtactgttggaggatagtagtcaattagacctacgcagtagtaatgccataccttaa

SEQ ID NO: 44245 - DNA, 2879 bp, Glycine max
  Peptide Sequence Number=SeqID_161023
cattgtcggagaagaacaacaacactctctccgtttcacaccttctttctcgtgcaagcaaattcttctttgattcactctctccctctctctgcgcctctctgttactacgctgcttccacatggaagcaggggaagattgctgcgtcaaggtcgcagttcatgtacggccactcatcgccgacgagaagcttcaaggatgcaaagactgcgtcaccatcgtttcagggaagccgcaggtacaaattggtgcccactcctttacatttgatcatgtctatggaagcaccggttctccctcaagttccatgtttgaagaatgcgttgctccccttattgatggtttgtttcaaggatataatgctactgttctcgcatatggtcagacaggttctgggaaaacgtacaccatgggaactggctttaaagatggttgtcaaacaggaatagtaccccaagttatgaatgttttgtttagcaaaattgggaccctaaagcaccagattgattttcagttgcatgtttcctttattgagattctaaaagaagaagtaagagacttgctggatacctcctccatgagtaaaccagaaactgcaaacggacatgcaggaaaaatgacctctcctgggaagccaccaatacaaattcgtgagacatcaaatggtgtcatcacccttgcaggatctactgaagttagtgtagcaacactaaaagaaatggctgcttgcttggagcagggatcattgagcagagcaactgggagcacaaatatgaacaaccaatctagttctattacttattcttcttcttttatgtgtccaactagtcgatctcacgccatctttaccatcacactagagcaaatgcgcaagctcaatattcctggtgacagctgttcaaatgataccatgaatgaagagtatctttgtgccaagttgcacttagtagatcttgctggatcagaacgagctaaaagaacaggttcagatggtctgcgttttaaggaaggagttcacattaacaaaggcctcctagcacttggtaatgttattagtgcacttggtgacgaaaagaagcgaaaggaaggtgttcatgttccatatagggatagtaaacttacaaggcttttgcaggattcactaggaggtaacagcagaactgtcatgatagcctgcataagtcctgctgatattaatgctgaggaaacccttaacactttgaagtatgcaaatcgtgcacgcaacatccaaaataagcctgttatcaatagagaccccatgtccaatgagatgctaaaaatgcgacaacaactagagtatttgcaggcagaactttgtgctcgtgctggcggctcttctgaggaagttcaggtccttaaggaaagaattacttggcttgaagctgctaatgaagatctttgccgtgaacttcatgaataccgtagtagatgccctattgtagaacaaagtgaaagggaagcttatgatggtagcacatacattgtgaagactgatgcagttaagaggagcttacctatcacagaagctgaatatccaatgagtgaaactgtgggtgattctagggaaatggaagaagtagcaaaagagtgggagcacacacttctccagaatagtatggatagagagttacatgaattgaataaacgcttgcagcagaaagagtctgagatgaagctttttggaatatctgatgctgaagtactcaagcagcactttggaagaaagataatggaattagaggatgagaagagagtagtgcagagagagagagattgtcttttggctgaagttgaaaatcttgctgccaatactgatggacaaacacagaaattagaggatatccatgcccaaaaattgaaaacacttgaagcacagattctggatctgaagaagaagcaagagagtcaggtccaacttctgaagcaaaagcaaaaaagtgatgaagcagcaaagagactgcaagatgaaatacagtgtataaaagcccaaaaggttcaactgcagcaaaggataaaacaagaagccgaacagtttcggcagtggaaagcgtctagagagaaagagctgttgcaagttcttcagagaaaaactgaagaagctgcaatggccaccaagaggttaaaggagttgctagaagcacgtaaaacttccagccgagaaactttagttacaatgaatggaagtggagcaaatggtcagggcaatgagaagtctttacagcggtggcttgatcatgaactagaagtcatggtaaaagagcatgaagtccgttttgagtatgagaaacagagccaagtgcgagctgcccttgcagaggaattagccatgctgaagcaagtaaatgagtttgctgcaaagggtctcagtcctccaagaaagaatggatttgccagggcatcctccatgtcaccaaatgcaagaatggccaaaatagcttcacttgaaaacatgctgagcatatcatctaattcacttgtggcaatggcttctcaactttccgaggcagaagaaagagaacgagccttctcaaatcgtggacgctggaatcagctgcgctctatgggagaagccaagaatttgcttcaatatatgtttaattctgttgcagatgctagtatgagttcctatgttaacaataggtgccaactctgggagaacgacatggagatcagagaaatgaaagatcaagtcaaagaacttgtcggtctcttacggcaaagcgagatgaagagaaaagaagttgagaaggagctaaaagtgagagagcaagctgttggaaccacattggctacaccaccatctgtaagattattgttacttggtgaagcattatatgccaagaagcctatgatttag

SEQ ID NO: 44246 - DNA, 1017 bp, Glycine max
  Peptide Sequence Number=SeqID_161024
atgggaagagttatgtgtgtggccttcccgctagtagctcttgtagtggtgagcatgtgttatggaatggcagatgcagaggtgaaaacacaaaatttgcgctggcattattacaaggtcaccaatacatgccgtgatgcagaggagtatgtccggcaccaagtgaacctgttttggaagaatgacagaagcattacggcaaagctcctccgcttggtttatgctgactgttttgtcactggatgtgatgcatcaattctgcttgacgaaggagcaaatccggagaaaaaagcagcacaaaaccgggggcttggaggatttgcagccattgacaagatcaaaactgttctggaatcacgatgccctggaattgtctcatgtgctgatatactccacctggccaccagggatgctgttaaactggcaggtggaccaggttacccagttttaacaggtaggaaggatggcatgaaatcagatgctgcatcagtagacctgccatcaccatccgtcttgcagcagaaagtcctggaatatttcaaatccaggaacttgaatgaagtagacatgaccactcttttaggagcacacacgatgggccgaacacattgtagctttattgttgaccggctctataactacaatggttccggaaaaccggacccgagcatgagtgctacttttctagagtcattgagaaaactttgtccgccaagaaagaaaggacaagcagaccctctggtatacctaaacccagaatcaggatcaagttacaacttcacagaatcatactacggaaggatcctatcccacgaaactgtcctgggagttgatcaacaattactatatagtgatgacactaaacagatctccgaggagttcgccgttggatttgaagattttcggaaatcttttgctacatcaatgtacaagatggggaattacagggttctaacaggaaaccaaggagagatacgccgatattgccgatacacaaataagggcaacccaaattag

SEQ ID NO: 44247 - DNA, 207 bp, Glycine max
  Peptide Sequence Number=SeqID_161025
atgaaggtgaatcttccaagaagtttcatagttctaaagaaaaagggaaacacaatgttgtatattgttcacaaaggcggtggaacgaggttagaacttcacgttaaagacttagaagaggccaaagtggtcgaaggttgtgaggaaaagggcgttgggacagaaggaggtgcatgtgaaaacaatggagatggtggcaacaagtag

SEQ ID NO: 44248 - DNA, 1813 bp, Glycine max
  Peptide Sequence Number=SeqID_161026
atgtattgtggcgaggaagagaagcaatggacttgtggaaaagctggggctgccaatttgcgaaaagtgagttccatcgtgcgcgacattggggatccttgcctttcgcagtcgcctgtaaaggtaaacagaatgcttaagtcagacaaatggcaaaccatgtctgatagtgaaggaaaggtgtttggttttcggaaggcactaaaattgatcgtgttagggtttaggatgctgcatgctcatgaatttggtgcacctggtcatgttttattggacaataatgattgtggcatgggtgtagatccatcaataagacccgaagtttgggagtttttactaggttgttattcgctgagcagcactgctgagtatcgaagaaggttgagagcagctaggagggagcattatagtgacctgattaaacaatgccaaacaatgcattcaagtgtaggaactggttcattggcatatgttgttggatccaaagtaatggatatgaggacttcatccaaagatggacggaaatcacaagctaaaatagaaggatcaacttatgataataatgttgaagtagggaaatgttatgataggagcattatttgtacagaggtagaaaattcaagccattgggaaagctccaataatggggttgacctagttagcttgagagtaagtgctgataatgcagcatgtgattcttctggtaaaaaaaactccagttccccaaagtcagggggagaagaagaggaatcagaccgtgtaactgaatgtagttttgattttcctcctttatcggtcactaatctgtttgagaagagtggtaaagataaaaattcaggcacagagcatggggataaacttcctgcaccagaacaatcaagatttgaagttgacagtatgcatagctttcaaattaataacaatgtagagttagttattgaatcgaattgccaacaacctcttgctaccttaaatcccatggactctgaaattggaattgcttcacctgatgaggaagaaccagaacttctgtctgagaatcaagtttatgaagcgcagatggtaaatcaactgaaaatatcagatgttccacagccagcaatgataagatccccaatttctcaaggatggcctgtcaatgaagagagagtatcagaatggctttggaccttgcataggatagttgttgatgttgtgaggactgatagtcatcttgaattctatgaggacaagagaaatttagctaggatgtcagatattcttgctgtctatgcatgggttgatccttcaacggggtattgccaaggtatgagcgatttgctgtctccctttgttgtaatctttgaggataatgcagatgcattttggtgttttgagatgcttttaaggagaatgagagaaaattttcaaatggaaggcccaactagagtgatgaatcagttgcgagcattatggcatattcttgaactgttagacaaagaaatgtttgcccacctgtcaaaaattggtgctgaaagccttcattttgcatttcgtatgttgctagttctctttcgaagagagttgtctttcaatgaggctctttcaatgtgggagatgatgtgggcagctgactttgatgaattcatggcttatgatttagaagagaactgtctggaagcattggagttacatcttcctagagactcaagcaatggtatgagagaagaaattgcagatagtgatggtggtagtgtgaagaatgcaattcttgttttaaaccgccagaagatcattcgggaaactcattcttttgatgatatgataaaggcag

SEQ ID NO: 44249 - DNA, 2043 bp, Glycine max
  Peptide Sequence Number=SeqID_161027
atgggtgcactcttcaattacttatttacgaagaaaattgaaggtagtaatgataaatgtatttattttggctttctgcagcttgtaaatttaaggactgtcaagactctcagatgtcttccccagagtctttcaaacaacaaaaaagctactttgaccgagatagttgatgtgttacgatctgtctgtcatgcacatagattaccactggcactgacatggattccctgtggttacactgagtgctcaagaggtgaagcttcaagaatacgaattaaagggggtcattcaacttctagtgaaaaaagcgtactgtgtcttgaagaatctgcttgctacataactgatagagcaatggcaggatttatccgtgcatgcatggaacatcatcttgaggaagggaaaggtatagctgggaaagctcttcaatcaaatcatcctttcttctatcctgatgtgaaaacatatgatattagtgaatatccacttgtccatcatgcacgcaagtataatttgaatgctgcagttgcaattaggctaaggagtacttatactaatgatgatgattacatattggaattctttctgcctgtcaatatgagagggagttcagagcagcaacttttattagacaacctctcgggtacgatgcagagaatttgtagtagtttgaggacagtttcagaaaccgaattatcaggaatagaaagctcaccagtggggcttggaaagaaaaatgcccccagtttttttcctttgtcaagtagaaactctgacataccattaataaatggtgactgtgattctgtccagaagatgtcattgaaggcaacaactaacctaaaggacaacgaaattgagccttctcctaaccaggaaagaaatggatcaaaaagacaggtccagaaaaatagaagtacatcggagaagaatgttagcttgagtgttctccaacaatacttttctggtagtctgaaggacgctgcaaaaaagattggtgtttgcccaacaactctgaaaaggatatgcaggcaacatggaattccaaggtggccatcccgcaagattaataaagtcaatcgatcattgaagaagatacagactgtgcttgactctgtccagggcatggaaggagggttgaagtttgatccttctatgggggcgtttgtggcaggagggtcaatcatccaggaaattgatgcacctaaaagtactataaaagaccccgtgcctgttactcaagatgcattctcagtaccacccgcaccttgtagtgaaggtgagaatttttcaattaagttggagggaaaattgaagaaaaccaatgtttcttcagttgattacagtgaagattcaaaatctatggcaatcaatgatgggtcgtgccagatggcaagcctttgcaccaaggtgcaggattgtcctgaacaagcttgcttgggttctgttcttgcaaaagaacatgataaacgaattctgaacaagggtggtttgagtgtagaaaaatttaaacacaatattgttggccagagttcaaaatctttgattgctgatgagatggacattggtgtagatggggatgatggagttgttgaacgtaaccaccctacttcctcaagcttgacagactcatctaatggctctggctcaatgatgcatagcagttcatcaggctctcggagctttgagaaccaggatcagtccaaagtcaaatcaaccatcattgattgtgggtcgaaactaattgtcaaagctacctatagagaagacaccattcgtttcaagtttgatccatctgaaggttgtttcagactatatgaagaagttgcagcaagattcaaactacaaaatgggttatttcagctcaaatatctagatgatgaagaggaatgggtgatgttggtgaatgatgctgatttgcaagagtgtatagaaatattggatgatattggcacacgtagcgtcaggtttcttgttcgtgatatgccttccgttttaagcagttctggcagtagcaatagctacttgggaggcagctcatag

SEQ ID NO: 44250 - DNA, 355 bp, Glycine max
  Peptide Sequence Number=SeqID_161028
atgacttcccttaacaagatcgagtccatcgccatgctcctccactccctcgcctacctacctcatgctgcccaatgccgcctccgctcctatcacctcatcctctaccttgggtctgtcaaccgcgccatcgactctgcccttgtcactaacctcaacctccgcctcgtccacgttgacacctcacatgtcgagaagatcacaaacactgtcatggtgacaacgcacggtgatgaagttggtggtggttgtcacacatgcattgacctggatgaagaagatgaatggggtcaggaggaggaggaggggagggaggcagtggagagcgatggcggtgttggacaacgcaagggag

SEQ ID NO: 44251 - DNA, 972 bp, Glycine max
  Peptide Sequence Number=SeqID_161029
atggcctttcaagcctcaccgtttgaagtatatgacactagaatatcgaatagtcctccaccaaaaccttgggaacaagcgggttcctcttctggtccagcacctttcaaacctccgtcagctggcaacacaagtgatgtagttgaggcttcagggactgcaaaacctggggaaattgtttctagttctgataggagtgcagctgtcaacaggaatactcttgggaggcctgttccctccaggccatgggagcagaattatggaaacagcacctatggaggatatggttctacaatgaattataattctgggtatggatctggaatgtatggatcttcttatggtggactaggaggtggaatgtatggatcttcatatggtggggggatgtatggtaacagtatgtacaggggaggatatggtggcctgcatgggtcatccgggatgtacggaggtggaatgtataacagtgccttagggggtccaattggtggttatggcatgggtggtggtccttatggagatcaagatccgaacgatccgttcggtgcccctccttctcctcctggattttggatttccgtcctacgtgtgttaggagtgcttatgagccatgtgagacaatacactatgatatcaggggtaatgctaatgcaaggtgtggttaacttttttggtcgaatatcaatactcatagaccagaacacacaggctttccatttgttcatgactgcacttctccagctgtttgaccgctctggaatgttgtatggagagctagctagatttgtgttgcggttgcttgggattagaacgaagtccaagaaggtttacccgccaggtccaaatggacagccgctgcttggacctggaccacacaatccttccggaaatgtaaactacattgaggcaccaaaggctgctccaagtggttcttgggacaacgtttggggaaatgacgccaatcaatga

SEQ ID NO: 44252 - DNA, 144 bp, Glycine max
  Peptide Sequence Number=SeqID_161030
atggcggacaaggctatgcagatatacgcatccatgattggccttcttcttcttcttcccccgataagttcactttcaccatatcgttcagatatctacaaacatgacctcgtggaaactctcaaacaagactgtcttcactat

SEQ ID NO: 44253 - DNA, 627 bp, Glycine max
  Peptide Sequence Number=SeqID_161031
atgaatttgcaacaagctgggcagtctaaatcctccaatggatatggccgccgaaaatctgaaagagaaggggcaactaaatcggagaataagatcttgtctgggaaattaaatgccaacagattggcaaatgcaggcgcagtgactggcagtaaaggtggcagttatgagagcccttcacatgaccgattagtatatgtaacaacatgtcttattgggcaccaagtggaagtccaggtgaaaaatggatccatatactctggaatatttcatgcaacaaacacagacaaagattttggaatcattttgaaaatggcttgcttaacaaaggatggttctttacgaggacagaaatctggcacagaatttgtcagcaagcccctttcaaagattttaattatacctgccaaagaccttgtccaagttacagcacaggatgttgctattaccagggatggcttagctaatgagtatcaccatgatatgcatcaggaaatcatggttgattcattgatatctcagtctcgtcacgttgatctagggcgagaattaaaaccctgggtacctgatgaagacgatccacaatgccctgaactggaaaacatatttgacggccattgggaatag

SEQ ID NO: 44254 - DNA, 2305 bp, Glycine max
  Peptide Sequence Number=SeqID_161032
gggatgggatcagtttgaaacaaatgaggcattgtttggtgtaaaaagcacattcaatgaggacctttatacaacaaagcttgaaaaagggcctcagacaagagaattggaaaggcaagctttaagaatagcaagagaaattgagggtgaggaaacccaagatcttcatcttgcagaggaaagaggccttcacttacatgaagactttgatattgatgaagaaactagattctcttcagtctataggggtaaacgtgttgatgatagtggatttgatgagggcgtactgtttgattcacacaattctgaaacttttggtggggaaacttttggtggtgtgtttggttcggtcgttaagaggccaggtgaaataagtggtggaaaaggaaatgatggagctcaaacattggcaaattcctcctccgtggacataagcataaatgattattttttcgataaactgagtgagagtgagagagaaaatgaaaaagataaagctgatattattgctcagaaagaaaaactcaatgagttagatacaacagaggatcacacactatcatctcagtcaaatactggtgtggatttaagccgctctggttcttctgatcatgcgaagcagttagcatctgaactccctgccaaaagctactcgacatcggatggggaaagcaggattcaggagaactcgaatagtaatcaacatggagacaatggtattaccaaggaagaaaatctgattcaagctgaggatgttcaactgtcaaaatctgaggattcacagggaccactctacatgaataaggatggctctgataaaggggtattatctcctaatgccagctcttatgccccttcatctcatacttcatcaaaaactcatgagaagatgggatcacatggagatttggtcgatggttcagcatcgggcaaagctaatggggaaacgaaatctgtaaattcacggggaacacaatctgggtcagatttggttggaagcattccagcatcttctgctcttggtttatctccaagttcatcagttggttcactgtcttctgaaaaatcaactctgaatcccaatgcaaaggaattcaagcttaaccctaatgcaaagagttttattccatcgcctgctcggcctcccactccagtgtctgatggttccttctattttccaactaatgtaactactgtaccaagtatgccaggcatgcccatgggtattggaattggacctacttttgctagtccacaaccggtcatatataatcctcaggtagcacaaatgccgtctcaaggatattttcatccgaatgcaccccagtatggacagcttcttggtcatcccaggcaagctttatacatgccgagttacatgcctgtaggccttgagccagagtggaaaacaatgaattgcttatgtgagaaagactctggtctattttcttctcattcaacagctccctatgttcttggatgcccatcatgggcgacttctgaatttgaagtccaacgatcatctatgtccagaagtttgagctcaaaagtggatgttcttccacaacaatgccacaatagcaagacatttaattttcaattccaagaacaggatgcatcttcaaccaaatccactgatcaatcttatccagaagttggtacggtacaatccggtcaaatttctgtccagcatagttctactgattcaacacttatcagaaatgaggggaagagtatgggatgtgtcatcaggtcatttatggggagtcaggatttccctttccctcctccactactggatcacagaccaatacttgcgcatattgcatgtcactatgctgatccatgctatagtggcctagtggctgctgcatatagtccacagtctaagccagtggaaactgctcctgttcgaattcctcttcaattggattttgcagaagaacctatatacgtgaattcaaagcagtaccatgctattctgaggcgaagacagtatcgagcaaaactcgaagcgcttaacaaacccatcaaggatcggaaaccgtatcttcacgagtcccgccatcaacatgcactgaagagagctagaggcgctggtggacgctttctcaatacaaaaaaacaattacaatcaaatcatacacctgggaatattgcagaatcaaaaatgcatcacattgaaaactatagagatggtgctgatgtctcatatgcatttaacagtgatgcaagaaacatgcagaatgatgcagctgataagggtggtggcaccactcagcaacctctatttgtctacatgtga

SEQ ID NO: 44255 - DNA, 1222 bp, Glycine max
  Peptide Sequence Number=SeqID_161033
tcgcgatgctcttagctctctcttatttccatcgatggatgcagaaacggtagatctactcaatctctatccaacaggacaagacccactttcccttattcctccatctctttcaatttccctgcacgggcaggaatttgaggggaagcgaaaacaaaatcagattttgattagtggggggttcgagaaagtggcgaaaatgaacttgggtgcagccgaggaagaagaatcggctgcacaagttcgtgttcctgcggaaatcgattggcacaaactcgataaatccaagtttttctgcctcggtgcagcccttttctctggggtttccgcgaccctttaccctgttgttgtgttgaaaacgcgtcaacaagtttttccgtctcaaatttcttgcatcaaaaccgcgttttcattgattagacttgagggtttaagggcactgtatagagggtttggtacttctttgatgggtacaatccctgctagggctttgtacatggctgcacttgagatcaccaagagtagcgtaggcactgctacccttaagtttggggtagctgaacctactgctgccactgttgccaatggtgctgctgggttaagtgcagccatggtagctcagcttgtgtggaccccagttgatgttgtgagtcagaggttgatggttcaaggtgtctctaattcttctaagtcatcaaatcaatatatgaatggaattgatgcctttaggaaaattcttaagaaagatggtgctaaggggttgtataggggttttgggatatcaattttgacctatgcaccttccaatgctgtttggtgggcttcatattctgtggcacagagaatggtttggggtggggttgggtggtgcttgtgcaagaaaggttgtggtggtgagggtgaattgaggcctgattctaagacagtgatggctgttcagggagtgagtgcagcaatggctggtggcatgtctgctttgattactatgccattggataccatcaagacaaggcttcaggtgttggatggggatgagaacaggcgtcgtggacctacagttatgcagacagtgaggaagttggttagggagggtggttggatggcttgttatagagggttgggacctagatgggcttcaatgtcaatgtctgcgacaactatgatcactacatatgagttccttaaacgactttccatgaaaaatcaagaggttttgacttga

SEQ ID NO: 44256 - DNA, 372 bp, Glycine max
  Peptide Sequence Number=SeqID_161034
atgagaattactagtctcaaattaccacaaacaccagcgaaaccagagctacatgccatgtacagaggtttacaatttgcttggtccaaagaatacaaaggacaatatagtggggcactggggctgcgacaagcaagaccaagaagcctttcaagtttcaaccatcaccacgacgaatcccttgggaacaccctttccacagtagttgagaagcaagctcaagttcactgttacattgaggttgatgcccaacacattagctttgagagcagtgcaaaggcacacagcagcttcaagatcagcgagaccctgaatgaggttgcagcatggggtctttggtggcttcccaagttgcacgttgatcaaacctaa

SEQ ID NO: 44257 - DNA, 927 bp, Glycine max
  Peptide Sequence Number=SeqID_161035
atgcctgacgcttccaaccctatgccaccgatttcaacctttgtcaagctgctgcctgatgtctcaaaaattgaggtcttcactggccaaaacttttgttgttggcaggaacacgttcatatcttgttggacgtgcatgtagttgtcttcgctttttccactcccaaacctgatgtcgttgatgatgccagtcaacttcaacaatgggttcaagccaataaggaatccaaagagatatcggactctctcatactcaaatacactgtagaagacatggtcagacaaagattcatcatcgccaactactaccgttggatcatgaatgaagaaaaagacatcaaggtacaaatcaacgaataccacaatctactagaagacctaaagactaaaaacatttctctacctgaccagttcgtttatgaactcctgatcacccacaaacatacatcactgtcagaccttatcacccacattatcattgaagatacaaataggaaggaaagtgttgcagcaaggaccaaagcaatgtatgccaaggcaaacacggtacaacaagacaaaccatttcataagaggtatgccgacaaaattgatcacaataccaagaataagtacaaatataacaacccacgtgttgctccttctaatctcatcccacgtgctcctacttctaatttctttcaagaaaaatggagcttgttttgtttgtgggaagccaggacatttttctcctcagtgcaggcatgccaggccctagctaggggattagccactcatggttatgagggctttacaatgagaggaggggtgaaagaaagaaagggagtaaatgaaacccctaggagagggggttctgtggtggtctgctctgtcccttggactgactctttatttatagctgctgaagtgggctttgggccttcgtag

SEQ ID NO: 44258 - DNA, 1806 bp, Glycine max
  Peptide Sequence Number=SeqID_161036
atgaagcatgaaaagtttacgcaagaagatgtagttaaagcttggcttgctgaagaggctacattgagtttggcagaggtaaaaaggaagaaaaccaaggcagcaatggagtcagctgaaatgtcaaaatgcctagcagaaatgaagagccataaaggaaaacaaactgaaataagagccatgcatgaggaagaagacagaaataaagcattaaatgcaagtgcacataacaaaattttatttaaaagatacaacattaaagaaattgaagttgcaactaattactttgacaatgccctcaaaatcggtgaaggtggttatgggcctgtttttaaaggagtgcttgatcacactgatgttgcaatcaaggccctcaaaccagacatatcccaaggggaaaggcagtttcaacaagaggttaatgttttgagcactataaaacatccaaacatggttcaacttctaggtgcctgtccagagtacggatgccttgtatatgagtacattgaaaatggtagcttagaagatcgcctcttccaaaaagataacactccaacaattccatggaaagttcgattcaaaatagcatcagaaattgccactggccttcttttccttcaccagacaaagcctgagccggttgtgcatcgtgatctcaagccagcaaacattttgttggaccgcaactatgtgagcaagatcactgatgtgggtttggcaaggctagttccccctagtgtagccaacaaaaccactcaataccacaagacaactgcagccggtacattttgctacattgacccagaatatcaacaaactggactattgggtgtaaaatcagacatatattcattaggtgtaatgctgctacaaattatcaccggaaaacctcccatgggtgtcgcacaccttgttgaggaggctatagacaagggtaaactcctagaggtgcttgatccaaatgtcaaagattggccacttgaagagactttatcatatgctaggttggctttaaagtgttgtgagatgagaaaacgggatagaccagaccttagttctgtcattttgccagagctgaatcgactccgaaatctcggagaagtagccatttacactgatattgtacccgccaaacagggaaagtttgaccaaattgccaatttgatggaacaatgttccaagagcgtgcacgatatcccctgcacccgctacgttgctgatcaaaaccaggttaaagtaacggaaaccgtttattgtgaacctgatcccaccatgcttcctacatgtcaccccgcggaagccgacaggtacgatgccggcgcggtattcggcgattttaaggaacatgggcatggcgaggtcgaagtgagggcgaggagggttgcaccagccgccattgtcgtttggaagagcgtagttagggggaccgaagttgttggcggtgatgaagatggaaggcttgccggagtgacaccacaccactgcttgtcgtttgcgcatttgatctcaaagcacgctccgcagctcagcccgctgttcaagagtgccgtgctcaacgctccactctgtaccctgattccaaatagtgtgcttaattccaattttgaatactcgaactcatatgaagttcccgaagaagaagcaatgacgttcgccgtcaaatcccaaggctcaaccctggacaggcggtggaaactaccaagctggagtacggtaggggcagagggaatttccggtggagcggtgaaatgtatagagattgaaaagaacaccaacgacgaaagcactatgctgggccgatactga

SEQ ID NO: 44259 - DNA, 798 bp, Glycine max
  Peptide Sequence Number=SeqID_161037
atcgtagctaaggagttagtcctgcatggcattgacgtttcaaatgcgctaactgattacatcattgacaactctatcaacaatctcgttgttggcgcttcccgctggaatgcttttataaggaaatttaaagacgtagatgtgccaacaagcttagtcaggtctgtgccagagtcttgcacagtgcatgttatatcaaaaggaaaagttcagaatattcgacgtgcagatcattctcaaaatattagtaacgcactatcaaaatctttgaaaggtatcaggggaagttttcggtctgatgaagatttaaacagaaaatcggtcaagtatggacataggcaaggctcaaacaatgatggggtatcttcggtgacatcacgtatgaccaatggagagactacctctccaaaactatcaaatgaaagttgctcctcacaaaattcatccaaccgaagttccgtcacgggtgacacttcaaagctgcttggttatcaattgattgagacgtcacatgaaaaccaagatgtagtcgaaaattcaggcagttacacttataggagcaaatcttgtaaaatatcccaactttcctctaacacctactttgaaaattgcattgaacagtttggttgttttgttttgcttttagttccaatattaaatgttgcattggccttgggattttttgcacatttttcattcataagtggattattaaagcttggttatcttacagcagagcttggaaatagaaaaaaggaacctaaaactagaacaggagagaaagacaaagaagtgtaa

SEQ ID NO: 44260 - DNA, 357 bp, Glycine max
  Peptide Sequence Number=SeqID_161038
atgaccgtcaaggttgtgggcatgggtaatggtgatgaacttatggtttcactgagaaataggtgtcgtcatagtgacaaaacacctttgtctcctccatacattgctggtttcaaattggtgagggacaacattctaaagtatcgctcaatgataacgtcctccataagcgttggtgccctgtggtgtcaactcgagttggcaaaacctggcgacgcctacaagatgactttggtggcttgtagagaagatgagtaccctttcctacacccttcccatgatggagtgggttgcttgatacaggttacagagttttggatgacgccacttccaaagagggaagataagttagggtag

SEQ ID NO: 44261 - DNA, 120 bp, Glycine max
  Peptide Sequence Number=SeqID_161039
atggaggatacctgggagtctgtcacaaggagatcatcggagtttattttgacggggatcaacactgacatcagactggctccaacttttgggatccatagggtagggagggtaccctag

SEQ ID NO: 44262 - DNA, 348 bp, Glycine max
  Peptide Sequence Number=SeqID_161040
atgaaggcccaagtggagaaggatgaaggcccaaataatccttgtggcgtctaccctgacttatcttccttcactggaagtggcgtctacccagacttatcttccttcactggaagtggcgtctacccggacttatcttccttcaccggaagtggcgtctacccagacttatcttccttcaccggaagtggcgtctaccctaacttatcttccctctttggaagtggcgtcaaccaaaaactctacagcctgtatcaaacgatccaccccgtaagattcacatcatctggtatgagagcttcggctcttgatacaggttctatcctatcctattatttttctttgtaa

SEQ ID NO: 44263 - DNA, 929 bp, Glycine max
  Peptide Sequence Number=SeqID_161041
ggctacacgccctcgccttcagagggctacacgccctcgccatcaaaggactacacgtcctcgccatcagagggctacacgtcctcgcctccagagggctacacgccctcaccttcagaggactacgcatcctcacctacagaggactagacgtcctcgcctttagagggctgcacgtcttcaccatcagaggactacacgtcctcgccatcagaggactacacgtcctcgccatcagagggctgcacgcccttgccttcagagggctacatgtcctcaccttcatagggctacacgccctcacctttggaggactacatgtcctcgccttcatagggctacacgcccataccttcagaggactgcacgtcctcacctctagaggactacacgtcctcgccttgaggactccacgtcctcaccttcagaggactgcacgagtacacgtcctcgccattagagggctacacgtcctctccttcatagggctacatgccctcaactttagaagactagacttcctcgccttcagaggactagacgtcctcgccttcagagggctgcaagccgttgccttcggagggctacatgccctcaccttcagaggactacgcgtcctcaccttcagaggactagacgtcctcgccttcagagggctgcacgccctcggcttcaaagggctgcacgcccttgccttcatagggctacacaccctcacctttagaggactacgcgtcctcgacttcgtagggttacatgccctcacctttagaggactacaggtcctcgccatcaaaggactacacgtcctttccaacagagggctgcacatccttaccttcaaaggactacacgtcctcgcattcagaggactacatgtcctcaccatcagagggctgcacgccccgttcaaccctcctgatatctga

SEQ ID NO: 44264 - DNA, 222 bp, Glycine max
  Peptide Sequence Number=SeqID_161042
atgcaagagaagactaggtccatgaagtgctttaaatgtcttgggagaggacacattacttatcaatgccccacaaagaaaaacatgattatgaggggccaagacatttatagtagccaagatgaggttactacttcaacttcttctagtgaaagtgaagaagcaaaaggggaagaatctagtgaagaaatctacccccaaggagaaggacaacctttaatg

SEQ ID NO: 44265 - DNA, 726 bp, Glycine max
  misc_feature (18)..(18): n is a, c, g, or t
  Peptide Sequence Number=SeqID_161043
atgcagcaacaaagaccnatcgctttgaagccagacgttgagtttgatcagaccaatgccatgttcttttacttcaaagacatgtatgaaaattcacatcttgcgtcgacatcagagtacgacaatgaagacacctccaatcacatgcatatggtgccaatcttgcgtcttgtaaagatctacaaattcaatgattggcagatgtgcttcttaaggcaagaaggagacaacggattttatcagcgtctcattcatgatatccctcttattcgcacttgcttcattttcaacttacatcagtaccctaaagccgccatgcaaagagttattgtcaaggcctggacaaggcatcctattctcaaaaaacatttgttctctcctgatcagaatccttgggttccatgccaaggaatggttgctgaactacaaagcaacaataggagaagctcgaatttcaggtgttgtttggcaacttacaagctcatcttggacctcagtactccacgagaaataactactttgatagcctttgctccaacgggtgtgtctgaagaaaggattcaagaaatgttgcaccttcaacaggctagccgggaagaaacaatggaaaaaaggttcctttttgaacgcatggagaccaatccagtgatagaaaacacattggaagctttgctcaaatccataaatgattatgtgttgttcaatatgaacatgcttatgcaatag

SEQ ID NO: 44266 - DNA, 156 bp, Glycine max
  Peptide Sequence Number=SeqID_161044
atgataagagagaaaggaagtgataatcaactctcagaggatggaggtggaggattggatgatggtgactttggtggtgaaggcggaggcctaggcataggatttgcagtggatgtagatgcaggaattatagctgaaggtggtgaaggtggttga

SEQ ID NO: 44267 - DNA, 513 bp, Glycine max
  Peptide Sequence Number=SeqID_161045
atggagggagggggagttgcttgtgcacgacggggtgacctcgacacttgctgcctagttttcctaagtgtgaatgtcacatggacacgctcaggctatttcctgatgaatggttccatattgcatttgagggttgaggtaagagtcaaggaaccaactaaggaagagttcataacaaaacacaactctcccccaaaacaaattccaatgttatcacgtcggcttggcggctccaacaaaagacttccctccaagtcacctactgctgcccatctactcccacgaacgaaagttcgagatcatcacaggcaccaatcacatggtacaaaaattgcaaagggggagattgtagaagcaagcttcatgatgatgaaccaagcaattttgatgatgccaaaagcccaagtgattgattcaagacttcaagatcaagcatcaagaatccaatccaagattcaagattcaagattcaagagaagaaatctagaagcaacaagtcaagacttcatatag

SEQ ID NO: 44268 - DNA, 211 bp, Glycine max
  Peptide Sequence Number=SeqID_161046
tgcccgtgttagcacaaaggaaagttgtgtagtgaaggttagtgtctcgaaggttctagatgaggatgcatcagttccttttctcacttcagaggatttacatagacatcaaaagaaaccgattgaacctgttgatacatcgaatccaattgatgatcccttagttgatttggttaaggttccctttgacctatacctgcatccttattag

SEQ ID NO: 44269 - DNA, 606 bp, Glycine max
  Peptide Sequence Number=SeqID_161047
atgtccttgccatcagaggactgcacatcctcacctgcagagggctgcacgccctcgcctttagagggctacgcgtcctcattttcagtgtgttccatatccacacctgaggagaatataaggtcctttgcccttagatgcttaaccgagacttgcgctcccggaaaaggggccagtagtttccttttatcagttcctaggccaccccctgatattggagggcgaccaactgtgcgagcacatccagaaagggaggctatcacgcatctacaacattctgcccagcgaccacaatgccaatctccccctacagatgtatcagttggcctgtgccgtcatgacatagggatcgcgcccacaagacgcctagtggacccgaagaagtccaacagggccctggggtttccagctctggttacgggcctctgtcagtcctacaaggtgcccgtcccccagcgaggtcatcgtgacatagggatcgcgcccacaaagacacccagtggacccggagaagtccaacagggccctggggtttccagctctggttacgggtctctgtcagtcctacagggtgcccgtccccccggcaaggtcacgtcatcatga

SEQ ID NO: 44270 - DNA, 240 bp, Glycine max
  Peptide Sequence Number=SeqID_161048
atgtctcagagtttcgatatgattggagttgttgatgataacaaagaaacatttaagcttggagttcaggttgtggacctgtggtttgaccaggagcgtgaaaaatccagccaccttgaaatggtgttgatggatggaaagggtttatgctctattttgatgttgtgccagagggatagaatccatgtcatggttaagaaagaggatcagtcctatccaaatttattttttgttctttaa

SEQ ID NO: 44271 - DNA, 486 bp, Glycine max
  Peptide Sequence Number=SeqID_161049
atgatactggttagccgtatccaagttcattgtggaggagccatgttttcaaagtgttcttctctcttgtctcttcccgaattcatcactgttacaaacccaccaacgttttccaatcctgcacccaaattcatccctagaagaagaagctccacaagaccctttcatctcacactcgccaaagcagagggaaaccttgactcagattcaccctcaacttcctcttcttctccttctccttttgccactgaccaaacggttttcgtgactggcgaggatgttccattggagggtgtcatccagttcgagaaacccacctcttctcctccttttgaaaaatgggggcgtgtggctcttctagctggtgcggatgtgttggccttgtttgtgtttgcgacgattggaagatacagtcatggactttctgttttggaccttgagactctgcgcactgcagatccttttatagcggagtttgaggtttga

SEQ ID NO: 44272 - DNA, 426 bp, Glycine max
  Peptide Sequence Number=SeqID_161050
atggagaagatgaatatgcacaaaaaaaagggacccctaagggtacatagatcacattcaaatcttaaaaacaaaactaaccaacggtcgcgcgaagaaaaccgaacaaggaatattgtagggattgatcacggtcgcgattcggaaaaggggcactttggggcacttgcagctcgcccaggtgagctaagccttaggcctgaagtcatgagcttgcccagccagatgctggctttggagagctggggcctagaaaatgcaaggaaaagacccttttgcactccttccttggtatcttttgttttccgaatcgaaacaccgagtggttcatcgctttgcaatgtaacttacgtccaatgtcgtaaatcgactagcaagaatcagaagatcaacgaacaatggtccccggacgaaattagggtctga

SEQ ID NO: 44273 - DNA, 99 bp, Glycine max
  Peptide Sequence Number=SeqID_161051
atgaatggtctctacaagggtgtagttgctactaccaagtcatgggctgttgggatccctcttattggtttaattgcggccatcttgatagaattttag

SEQ ID NO: 44274 - DNA, 1035 bp, Glycine max
  Peptide Sequence Number=SeqID_161052
atggggttagaccaagcgccatcttttaaaaagaggttctatcatgtcaaagtcaagaatctagagctagctagcttgtgtaaactggggcagcggatagatcaagttcaacatcaggcttttagcaaggtatatgggaagatttggaatctggtgatgatagaagtgtccattgaagccttcacatctctcacccaatactacgaccaatcactcagatgcttcacctttggggactttcagttagcaccaaccatagaagagttcgaagggatcttaagatgcccgctagggggaaggaagccatgccttttttccggattctatccttctatggcaagaatagaaataatggtcaagatctcggaacaagagctagaccgagtgaagcaaaataggaatggggtggcagggataccaaggaagtgcttagaggaaaaggcggaagctctggccagccaagaagagtgggcaacattcaccgacgtattagctctgctagtttttgggacgatactattcctgaatatagatgggttggtggatctagcggtaattgatgcctttcttgcttatcatcacaacaaggaaagcccagtcatcgctgttttagcggatgtgtatgatacgttcaacttgagatgcaagaagagtagtgcaagaattgtctgttgtacgccttctctttatgtagatatgtctgtcccctacaaggtcatcgcatgtgatccggaaaggagaattcgtaaagcatggaatagagtggaaaggaaaaataaggagcttaggggaagtagcaatggtgtcataggcagctattacaaatggttgaagtctagaacgcaagcgataacttggctcccaaagctaaaagttcttagtgggaaaaaggttgaaattcctgaagagagtgaagaagtgcaagctttgaaagcggagctcgaaacgacaagagtggtgaaggagaagctaaaggtggcagtcactagggtcaggaaagaatgtgatgatctgaaagatatcaacataaccacg

SEQ ID NO: 44275 - DNA, 180 bp, Glycine max
  Peptide Sequence Number=SeqID_161053
atggatggttatgtagcaattgctgataagttggagaggctattgaacttgaggatcctgaccgaaggaatagaagtctatactgttgctgaagaatgtctgagcatcgcaagaagctacattggtcaaccaactataggtcacagatcgaggcgtagacggcgtacggacggtcattga

SEQ ID NO: 44276 - DNA, 363 bp, Glycine max
  Peptide Sequence Number=SeqID_161054
atgactcctacttatgatgccctactatattacaatgggaggtggaacatgtcacaccaacgtgactttgtgagttactcgttcactggaaaaaatccaaaaatatttgacattccttcgggatgtaacatcaatggactggaggatgtgatcaagcaaccaggtcattctgggtattcagaaaatgttatcaaatttgaaataattgagctaaaaactaacgatgacgtattgaaggtcttagtacagtctaactactggaaacaatttggcctaatagaaattttagctatttttagtaaaccggtaatcaaaatggaagacgacatgtctcaatcgcaacatgattcaatgcaaaactag

SEQ ID NO: 44277 - DNA, 146 bp, Glycine max
  Peptide Sequence Number=SeqID_161055
actgatgttgatggaaatgggtcaattgactatcttgaattcatttcggctacaatgcataggcacaaacttgaaggtgataaacatctttacaaagcattccagtattttgataaggactatagtgggcgagttttgcaagactg

SEQ ID NO: 44278 - DNA, 756 bp, Glycine max
  Peptide Sequence Number=SeqID_161056
atggagaaaaagttaccaatacaaccagttgctcagatgtcaagtaacaaggacattattactttgaaggatcttcatactgaagagttgcctcagtacatacatatgaatcagaatgagttttgcatacgaaggcataagaagcagaaggaggaggatattgctatatgtgaatgcaaatatgatgctgatgaccctgacaatgcatgtggggatagctgcctgaatgtattaaccagcactgaatgcacccctggttattgcccttgtggtgtcttatgcaaaaatcagaaatttcagaaatgtgaatatgcaaaaacaaagttgtttaaaactgaaggccgtggatggggtcttttggctgatgaggatattaaggcaggacaatttgtcattgaatactgtggagaagtaatatcatggaaagaagccaaacgtagatcccaggcttatgaaaatcaaggtcttaaagatgcatttattatttgccttaatgcatctgaatctattgatgcaaccaggaaaggaagccttgctagatttataaatcattcctgtcaaccgaactgtgagacgagaaaatggaatgtgttgggggaaataagagtcggaatatttgcaaaacatgatattcctattggaaatgaattagcttatgattataattttgaatggtttggtggtgccaaggttcgttgcctctgtggtgcactcaaatgttctggattccttggagcaaaatctcgtggttttcaa

SEQ ID NO: 44279 - DNA, 792 bp, Glycine max
  Peptide Sequence Number=SeqID_161057
atgagcaggaggatacttatctatgggaagatgatgatgacaggaatctggccaccaatgtattcagttgagaaaattcctgtatatgattctgcagaggatgaaccggtgtcaaattttaatggacaaaccgaaccctctttggatgttatggttaaagctgaacaattattggagtccactgctttccatgttcagccccttgattcagttcagatgaaagatttagatgtgaagaagattaaaactgatgtagcagatgagcatatgaacttgtactaccaggatggtgaacagaccctttcacgaaagaatgcaatatcacgtatccgaagtaatactgcaggcagaaactatcttcttggacctaggtccatgtctaccaaaagatcaaggtcatataatggcgttaggtttaaaaatctcacagagaagaaaatcgatgctaagtttgctgctgccctcctagcattcaaggaagcacaagaggagattttaaattgtgagctctcctccatgcagaaaataaaggacgatgctacatctgctcttgattccttatacgatgaaatacggcctgccattgaagagcacgagagggatagccaagacagtgtatccaccactgtagcagagaagtggatacaggcttgctgcctgaaattgaaggcggagtttgacctttactcatcaattgtcaaaaatgttgcttgcactgcgcaaagggcacctggccaaggaaaacctactgaagttgataacgaaaacgaaattaagctcttgacaggttga

SEQ ID NO: 44280 - DNA, 414 bp, Glycine max
  Peptide Sequence Number=SeqID_161058
atgttgctgcgcggggtgtatgctgacctcccgcgagcacccgcctcgtggttggttgaaatctgggttcatggccgacttcgccgtgataaaatggtggatgagccacgctcgagaccaatcacgtgcgagccggtcagttctggacccatcgacgaccctttgcgtgcacgcacgctcccaacgagacctcagtctggagaagcgtcctcagtggcggaccgggcccaagtcccctggaagggggcgccagagagggtgagagccccgtcgtgcccggaccctgtcgcaccacgaggcgctgtcggcgagtcgggttgtttgggaatgcagccccaatcgggcggtaaattccgtccaaggctaaatactggcgagagaccgatagcgaacaagtaccgcgagggaagatga

SEQ ID NO: 44281 - DNA, 663 bp, Glycine max
  Peptide Sequence Number=SeqID_161059
atgacgtctccacgagcatatcaacagcccgggcttgggccaccatcgcaatccgcgtcggtcaatgtcccgagtcgatcggcggaccggctctcaccgttccacatccgaccgggacacatcgccggcccccatccgcttccctcccgacaatttcaagcactctttgactctcttttcaaagtccttttcatcttccctcgcggtacttgttcgctatcggtctctcgccagtatttagccttggacggaatttaccgcccgattggggctgcattcccaaacaacccgactcgccgacagcgcctcgtggtgcgacagggtccgggcacgacggggctctcaccctctctggcgcccccttccaggggacttgggcccggtccgccactgaggacgcttctccagactacaattcggacgccgagggcgaccgattttcatggcaggcgtgccctcggcctaatggcttcgggcgcaacttgcgttcaaagactcgatggttcacgggattctgcaattcacaccaagtatcgcatttcgctacgttcttcatcgatgcaagagccgagatatccgttgccgagagtcattgtatgtaaatgttgtgtcgtgacgactcccgcgggacaccgtctccgggcccccgggagtcgcacttaa

SEQ ID NO: 44282 - DNA, 234 bp, Glycine max
  Peptide Sequence Number=SeqID_161060
atgaaagtcaaacacatgcgttatgcaacaaatactctggactcaagcctacatgcaatgtggtaccatttttcagtgaaaaacctcgtcgggcgcctaggagtacatgacaggacatgcctcacaatgggcaagtcaggcttacaggagcactcaaaccggatgacccccaaggcctacactctgaagagtccgtcagtgcctctccctcctgattcagtgcgcctcaagtga

SEQ ID NO: 44283 - DNA, 276 bp, Glycine max
  Peptide Sequence Number=SeqID_161061
atgtcttttggtttcatgttagtgttggcaaagaggttgtcgagggcaccgaacctgacttgtttagcttcttccttagcggaggccatgaagggatgcgagggattgtttgggctttgtagaaaattagtgtttgagggttttggtgcaccgtcaaaaacaccgcatgtcgtggatctcgatggcaacaaagatgaggattccgacaaaggtgatggtagagatgagggagaggaggaaggagaagcaaaagaaaatggaatgggaggaatatag

SEQ ID NO: 44284 - DNA, 258 bp, Glycine max
  Peptide Sequence Number=SeqID_161062
atggaagacattttaaagatggaatatctttttaagaggttggctaagtgtcttgacagcacacgatcaagggagttacacccttacaatcaatatgaagaagaaagaactcctaaccttgaaggtgtgttcacggaattcatggcatatcatgctagctctaaagtccaccaaaactcaatgcaaaataaggaaattcatgttggcaagagctactccatggaaaattatctgtgggagcaacagttacaaacctag

SEQ ID NO: 44285 - DNA, 126 bp, Glycine max
  Peptide Sequence Number=SeqID_161063
atgccttttgaaggacttagagaaaggcttcgagcaaaatcagttcacgaaggagacaattttgaaatcatgaaagccataagcataatgtcaggcaaaacaattcctttcaatttcatgtcataa

SEQ ID NO: 44286 - DNA, 297 bp, Glycine max
  Peptide Sequence Number=SeqID_161064
atgccaatttcgaacaacaacaacaaccaagagacaacaaacaataatgagttctgcaacaagagcaaaagtctccttgtaatctatacctgttcattgtgtgaagcttttggaaacaggagaatgaccaacaaggagaggaatcatgatccatgtgtggttgtcttcaaaagcttggatttcatattgcatagcaataacccatttgggatttgtacaagcttcctcccaggatgtaggctcaacctaaagggaaatattatgagcaaacttctcataagatgtagccagttgtga

SEQ ID NO: 44287 - DNA, 471 bp, Glycine max
  Peptide Sequence Number=SeqID_161065
atgtctgtattgtgtattacctcttttgccctgcatttagcaggacctcctattaaacgcagaaagcgacatagaagaaagaatttgcacaatcaagaacaatgcgtaatgagaggtgtctacttcaaaaatatgaagtggcaggcagcaataaaggtagacaagaaacagatccacctagggactgtcgggtcacaagaagaagctgctcacttatacgacagggctgctttcatgtgtgggagagagcccaattttgagcttcctgaggatgaaaagcgggaactgagcaaatttaaatgggatgaattcttggccatgactcgacaggcaatcacacgcaaaaaacacaagagaaggcttagtcccggaccagataatggtcatgatattcttccactgcccaaagatgattgggacagtaagcaaggagtgattgaagatgcagagcaggaaacaccagtgtcttga

SEQ ID NO: 44288 - DNA, 168 bp, Glycine max
  Peptide Sequence Number=SeqID_161066
atgggggcatgcctttggacaaggtttgagaaggttctggaggccataaaagaagttgaaggattgaggattaaggtgtttcaagatgagtttagcattggaaggagtggtgagaatggaaacatggtggtcgtgaaagacgaaagcttggcccagattaatgagtag

SEQ ID NO: 44289 - DNA, 486 bp, Glycine max
  Peptide Sequence Number=SeqID_161067
atgtgtcatctcttgttctcagttacaacaacccaagtagatgtaccctctacttgtaccacaaaggatgtaccctccaatgtgttaagacaaagttctcaggcgggaaagggaagaatcaaaagaattcttagactgtgtcgttttgaattctttgaaaagggagaagggagacacaaaagaattcaggcggttagtccttcgttcttttggaaaagggagaagagagacacaaaaagaattcaagcgaacaaggtttggaaaccaagctcttatccatggcctcctatggtggatgtgaaagagattatgggttggaaacgaattgagaatggtttgagaaaggtgactaaggatgaaggaggatcactcaaaaaacgagttcaggaaatgaaggagaaagcacataaagttgttcaagagggtggatcctcttatgacactgttagtatccttgttcaaacacttaaacaaatcaaagtttaa

SEQ ID NO: 44290 - DNA, 201 bp, Glycine max
  Peptide Sequence Number=SeqID_161068
atgtaccttctcttgttctcaattacaacaacccaagtagatgtaccctctacttgtaccacaaagtatgtaccctccaatgtgttaagacaaagaattctcaggcggtttcctttgaatctttgtaaagggaaaacaaaagatatctcaggcgaattttcacttgcagaagaacaaggtttggaaaaacagaaaacttag

SEQ ID NO: 44291 - DNA, 423 bp, Glycine max
  Peptide Sequence Number=SeqID_161069
atggatcggaatggtgagtcaaccaagaggacaatgcggtatagtcttgtaaaaaattctaatccctacatgaagcaaaagaaagatggccatggcacaaagaccaacatggggaataacatagttatagcaacaaatagtgggacaggtaatgctactttgtatcggtactacaaacaatgtgttgatgataataaacctgacatgttggttgtgttggaaacgagagtggatccaaggaaattgaggcacactttctctatattgggttatgatggtgtagattttgtggatggtcagggttttgctggaaggattattgttgcttggagaactcatatatggtgcaggtggtttttgacggttgatggaagttatttctttttaaaaactgccgttgatggaagttttagtaacttccat

SEQ ID NO: 44292 - DNA, 363 bp, Glycine max
  Peptide Sequence Number=SeqID_161070
atggctggtacgttctttcttttgaaaaagcaaaatagtttagagattatgagcagtgagaaagaaatgactccgaacagagttgtgaactggccattcaggactctgtatcattattttggggactccacactacccatcgagtactatgatgccaaagttcttcatgctagtgaagatagaataggaaaaatggtgagagtagaccagaataccctaactcaggaaagggggaagtttggtatgtggagggatgtcctgacaaaggaaaaccaaacacatggcaaggaaagcaccaccatcaagggaatggggatcaacaaacaaacagaggagcagtataggcctttcgaaggactttga

SEQ ID NO: 44293 - DNA, 285 bp, Glycine max
  Peptide Sequence Number=SeqID_161071
atgtggggtatagatgtgatcggagccatagaacccaaggtgtcaaacgaacatcgcttcatcttgttcgtcattgactacttcaccaaatgggttgaagcggcctcgtatgccaacgtgacgaggaactatagaagcaaagtttcatggagaatcaaagatgatgacaaaggtgatgacaaaaagctcaaagatcaatcaaagaacaactcaagtgaatcaagaacaattcaagagttcaagataagaatcaagaagaattcaagactcaagaagaaagtttag

SEQ ID NO: 44294 - DNA, 618 bp, Glycine max
  Peptide Sequence Number=SeqID_161072
atggtaagagctcctttctatgacaaaaatggactcaagaaaggtgcatggagtagagaagaagatgagaagttaacagcttatgttaagagacatggtcactctaattggcgtcaactccccaagtttgcaggtttagcaaggtgtgggaaaagttgcagacttcgttggttgaattacttgagaccaaatctaaaacacgggaactacaccctagaggaagaaaaaataatcatcaaattacaccaagaatttggaaataaatggtccttgattgctgaaaagcttcctggaagaacagacaatgaggtcaagaactattggcatggccatcttaagaagataaaaagcaatgagatcactacatcaaagttgaagtccaagccaggctatagtattgaaaaagctcattggccatgtccagggaaagtacctcagaaggagacaactattcccttacctctattgtttcactatcaaccatggatagttccttatcaaaagaagaatctgttcctccattggtatcttacgaagaattcagcagcgatttttggactgaaccattcctcacagaagatacgtttactaatgagatatgtagtggtgaaggcatag

SEQ ID NO: 44295 - DNA, 180 bp, Glycine max
  Peptide Sequence Number=SeqID_161073
tggaacccttcgctgcttggttgggtgtactaacggaacgacaaaagggtagtggggcattttccaaaatcacaggtcaaattttcttggttgctttgcttaatttgcatgttggatgcaaggctaagaatgcctttttcgctggagttataacaatcatagaagttgctcatgagaaag

SEQ ID NO: 44296 - DNA, 1902 bp, Glycine max
  Peptide Sequence Number=SeqID_161074
atggagctgagggacaaggaggatgccaataagttggatgttaagtgggaaatgcaacctgccgtcagtagagcaggaggactgatatgcctatggaatgaaagctctttcagattggataggaaggtgtgtgggcaaggattcatctatctagagggcatatgggtcccagatgctcatagaatggctatagttaacatatatgcaccatgtgatatgatccagaagaggaatttgtggggtcaaatcactcaattgaaagctctaaacccagacgtgttgtggtgtatacttggagattttaacaacattcaaacagcaaaggagagagtagggttgagccaacgtagggtaaatgatgccactatggacgagttcaatgaatggatagagaacattcaggttgaagaggtgccttgtgcggggagaaaattcacctggtataagccaaatggaacagcaaaaagcagacttgatagatttcttgtcactgctgattggttgagcaaaatggcaaggttccacacagtttattctggaaagaaatttcttggatcattgtccgggtggttcaagaatcttggtcgaataatcaggcagaaattagtaaatattgagaaggagttaaacaaaatagaagctgaaggagatgtgagacagctatctgctcaagtacttatgtgcaggaaaaatcttcaggaggagttatggtcagcagctcaatctttcgagtccttgttaaggcagaaggcacgatcacgatggatcaaagagggggacattaactcaaggttctttcatagatttgcaaacccaaaatgcaaatccagcaccttgagaggagtgtttgtaaatgatgtatgggttgatgaacctgggagggtgaaggcggaaacgtacctgttttttaagaacagatttcaagaggttgaatgggtgagacccaaactagatggggtcagattcaaagaaattgggcagcagcataacatcagactgtcgggcccattcagtgaaaatgaagttaaggaggcgaccgatatgcttcgattcatggatgagttctatgtacatggatctttcccgaacgggtgcaatgcatccttcgtaacccttgtacctaagggggtgatgccactattaattgatgagacgcaatcagcatttatagagggtagacatttgctgcaaagtactatcattgcaaatgaagtgatccatgaagcaaagacaaggaataagccatgcttggttttcaaagtagattatgaaaaggcctacgactcagtatcttgggagtttgtattgtatatgttgaagaggttgggtttttgtgggaaatggatatcctggattgaaggctgcctaaagcctacttctatttccatattggttaatggtagccctacatctgagttcatcccccaaagaggcctaggacaaggtgatcctttagctccatttctgtttaacattgttgtggaaggattaaatggactagtgaaagaagcaatggataaaaacctgtatcaaggtttcaaagtgggcagaaatgaagtcaatatcagcatactgcagtatgcagatgacacacttttccttgggaaagcatccatggaaaatgtgagagccatcaaggtgtctgctgctagctatctaaattgcgagctactgaccataccttttttatacctgggtattctgataggggccaaccctaggggttctgagctgtgggatcctattgtcaagaaatgggccgagcaaaagaagatagcgtgggtgaaatgggagtcagtatgtctaccaaaggagaaaggaggaatgggaattaaggatcttaggaagttcaactatgctcttcttgaggcagtagagtatcagcttagtggaaggatataa

SEQ ID NO: 44297 - DNA, 417 bp, Glycine max
  Peptide Sequence Number=SeqID_161075
atggatcccggaaagcttagactactaagcgcaacgggggcggtaaatctgccgcaggtagatttgcagacagtgcgcttaagcatcggcggtggtggtccatggtggatccattctcgcagttttgacacggacgtacttaaggctgacgggctgatcctcgtcgatttctgggctgaatggtgtggtccttgcaaaatgatcgctccgattctggatgaaatcgctgacgaatatcagggcaaactgaccgttgccaaactgaacatcgaccagaacccgggcaccgcaccaaaatacggtatccgtggcatcccgaccctgctgctgttcaaaaacggcgaagtggcggcgaccaaagtgggcgcgctgtccaaaggtcaactgaaagagttcctggacgctaacctggcgtaa

SEQ ID NO: 44298 - DNA, 555 bp, Glycine max
  Peptide Sequence Number=SeqID_161076
atggcaactctgaattctcctttggcccatgatgaagtgcaaaatgatctctttgacatgaaaccttggaaggcccctggtcctaatgggtgggtagtagttgacaaagtggaatttgttaaccaattcaaaccaatttcgctttgtaacatagattacaaagttctctttgaggtggttgtgaataggctaaaacctctaatgtcttctctcatctctccatttcaaatggattttattctgaagagaagcattcgcgagaatgtggtagtggcacaagagcttctacatagcataagaaggatgcaagttgttgacaaaaatcagtgggttcctatgagattgggaaggctgccatggagcaagttcaatatatatgatgcaagttttgagtttatttggctagatgtcgggtcaaatgtactcagattagaagacaaattgttcatcaaagtggctttgctgaagttcaatcatcgggaaaatacttgggaatccctttccaaggaaaatctcctaggcaaatggattagcagtatttggtggatagagtag

SEQ ID NO: 44299 - DNA, 346 bp, Glycine max
  Peptide Sequence Number=SeqID_161077
ggttcctctcggtgtggggtttcaatggagaacaacgatggtttgtggtggctaatggtggctgtgggtgatggagaaagtgcttggaactttagaattggctttggaagaaagaaagaagaagaaatgatgtttttcctaagctacatgaaagcaaaggctgaaaccaaatttcgggaagatccaacgattaacgaaggctgggcagcgtttttaccgaggcaattcatacctagtacttttgcttatctttggctttggacttggtcgcctactggtcaaccacaagtcgtaggcaatgctccagcttttgtagatgagctgaggggccttggaggtggcggcg

SEQ ID NO: 44300 - DNA, 555 bp, Glycine max
  Peptide Sequence Number=SeqID_161078
atgaaaatccccaatcccgcgaagggtgagaagcagaggctccgcatccgtgaagaacgcgatgcccccaggcctccaagaagcgccaccttctacacctacctcatcaccacgctcatcaacctccttgaatacggtggcgccggttctgagttcgccgtcaagaggcgattccgtgacgtggtggcactctcgaaacagctggcagaggcgtaccgcgggttcttcatcccggagcggctggacaagagcatgatggagagccaggtgatgcagaagcaggagttcgtggggcaacggcgcgtggcgctggagaagtacctcaggaagctggcggcgcactcggtgatcgggcggagtgaggagctcaggctgtttctcgaggccaaggggcggcttccgctggccaaaaccacttacgttgcatcacggatgctcgatggcaccgtgagactgccaaggcaactgtttagtggagaggcggagttgggagagatggctcagctggccaagggcaggagggacttgctcaagattttcaaggagttgaagtag

SEQ ID NO: 44301 - DNA, 159 bp, Glycine max
  Peptide Sequence Number=SeqID_161079
atgagttgcactcatttttcttactcgggtgagcttcatttcagaacggagatttatcaaagcacaaggcacttggaaatgaatggttggcaaaaggaacttgcccaattgccaagtcttatagagctcttttcggccaccgagtggagtgaagcttaa

SEQ ID NO: 44302 - DNA, 201 bp, Glycine max
  Peptide Sequence Number=SeqID_161080
atgtttctcagcaggttttgtgtttcactggttttgccttcagtgtttgttagttcactatggctcattttgggtaatgagcttaaccatgtgcttattcacattaacagaatcattgagaagtatcgtcaatgctgcttcaacatgtctcagactggcaacgtaactgaacatcaatcggagcagtgcttataccagtag

SEQ ID NO: 44303 - DNA, 201 bp, Glycine max
  Peptide Sequence Number=SeqID_161081
atggcggaaaatcttcacgaaattacccatggaaacgttttggacgcgttacggaagctcctcggaaaatgggggaggagcttgccacccagctcgcccaggcgagctaggttgcttcctccagaagcaaccgccttctggaggaacatcctggaaagcccggggggcctggttgctattttcaccccccctgtttactaa

SEQ ID NO: 44304 - DNA, 504 bp, Glycine max
  Peptide Sequence Number=SeqID_161082
atgaagtactattttgagcaatttggtgagatcttggaggctgttgtcatctctaacaaagccattggaagatctaaaggctatggatatgttacttttcgtgaaccagaagctgccatgagagcttgtatggatcctgctcctgtaatcgactgtaggagagctaactacaaccttgcttctttgggtgtccagagatctaggccttcaaccgcaaaacatgttttcataagaacaaattacaatgggaacataaacatgcttcaaagagaagtgagcacaaagagcacgtacgcagaagcacaaagttacaatgaagacatgaagcttacctcgaacccaacaccgacaatggcagcgagactcaactattcaatggcagcgacaatgggtctcaggtcaccacgagttccccaatccttgcaccagaaaccaaaaaaggtccttaggttaaccaaaggttccagaaatagacctagctattcaatagaacaacacaggtag

SEQ ID NO: 44305 - DNA, 1272 bp, Glycine max
  Peptide Sequence Number=SeqID_161083
atggagaaggccacaccgtctgatccccgacccgctccaattattgaagacattaaacaggataacttcggaaaggtagaaataaccttcaataggagaaattccttctcatcaaggatagaagcctctaggtctgaatatgagtcagccagaaggtctttttcggttagaacccgttcaatcccagtaggactaaccagatctgagttacataaccagttccctactgtaaacctccaaggactagataccacttctagcataccaagaacgacctacaaccaagatcaggaggacgaccaaaacattgataaggaaacccttaggaaagatttttattctccggcgaatgagcctcaaaggagatggtttttccagaattacaagggtacaaacagaaaacaaatccaagacaagttctacgaatttgtcgaaagggtcaaagttaatgtccttttctttgattggttccatgcttacaccatcaaaaaagatatagattacccatggaagcaagacatcataggtgatccatcaacaaaccttataaccaactggcaagcaaactacaccaataaatatttacaaattttaggagaaaccattaaaactaaggtagttcctaagcaaaaatcggttgaagaaacctctccaagtattcccattgaaaaaccactgttcaaacctttcaaagttagtgagaaagctaagcgaaagattagagaacttaggaaaactaaatccttagttgaaggagtaggtgacaatcatagtgaattactaaacaagattggtagtttacttaaggtcatttcggaaactccccaaacctcggaaaatacttccaaaatggtaacaagaagtacctccaaattaattaatgttattaatgaagatagtgaccaaaactcagataacacaactgagataggatcagtgtcagaaaagaatataaatccaattaattccaaacattggaaaacaccttccaaattatattatcaacgtccaactgcccctgaccttctattagaagaaagaggagaaaacaatttcaagagttttagtgcaaacaacatctacgaatggaacatagatgcacaaacggagtataatatcatgaatacactccaacatatgaccatggtggctacggcttaccaaacctccctcgaatgttcagaagagaccattatagacatcttggtggcaagattttctggacaactgaaaggatggtgggataattatctcactaatgaggagaaataa

SEQ ID NO: 44306 - DNA, 777 bp, Glycine max
  Peptide Sequence Number=SeqID_161084
ggtggacccttgggtactagtaccctcaccttcagagggctacacgccctcaccttcaaaggctacacgccttcaccttcagagggctacacgccttcactttcagaggcctacacgccctcaccttcagagggctgcacactctcctttagaggactacacatcctcaccttcaatgggctagacgtcctcaccttcagagagctagacgtcctgaccttaagaggactacacgtcctccacttcagagggctacacgtcctcaccttcagagggctacacgtcctcacctttagagggctagacgtcctcacctttagagggctacatgtcctcaccttcagaggactgcacaccctcgccttcataggactacatgcccctactttcaaaggactacacgtcctcaccttcagaggactacacgtcctcaccttgagagggctacatgccatcaccttcagaggactacacatcctaaccttcagagggctacacatcctcaccttcaaaggactgcacgtcctccacttcagaaaactgcacgtgctccccttcagagggctacacgtcctcaccttcagagcgctacacgtcctcacctttagagggctacatgtcctcaccttcagaggacagcatgccctcgccttcagaggactgcacgtcctcgtcttcagagggctgcttgccctcgcctttagagggctaatcgcccttgccttcagagggctgcacgtcctcccctttagagggctacatgtccttaccttctga

SEQ ID NO: 44307 - DNA, 531 bp, Glycine max
  Peptide Sequence Number=SeqID_161085
atggcagaggaattaagcagtatgatgaaggtggcgattaagaagaatatgtttaagggattcttcgaacttgtctctgcgctcaaagttaacttctacaaaagctcgtttggagctattggtcttgatagggacactcttgaagactttgcggagttgttaaattgtagattgatgacctttcacttcacttatttgggcttatcggtgggtgctaatcctaggaaggaacaaatgggggatatgtttgatgagttggagaaatatttgcaacaaaagaaagaagggtggattaggtatacaaaaatcttggtttatcgaatgtgtctcttattgctaagtggaaataatggaaacttttcactaatgagggaatggtgtattggtgatggtagcttgacaaggttttgggaggatagttggttaggagaggaaagcattgcctctcaatttcctagtgagtatttaggtggcggagatgttggttcaaatgggaaaatcaacagcttgctatattggagtgctagatag

SEQ ID NO: 44308 - DNA, 147 bp, Glycine max
  Peptide Sequence Number=SeqID_161086
atggaaaatagagtcaatgactgtggagaagaaaaagaaggaggaggtggtgttagtgggtcaccggatgtactgtggcggcgttgtcctacagtggtggttgtggaggataagccctttctcttctttgatggttctgccatttga

SEQ ID NO: 44309 - DNA, 360 bp, Glycine max
  Peptide Sequence Number=SeqID_161087
atgttgttatggttgtccgttcgtgttcttcttctgtctatgctcgtgttacggttgtctgttcgtgttcttgtttcggtcgtggttgttgttgttccggtgttcttctgccgttcacttcttttgttggtggtggttccggttgttggtgattttgaaaatcacattgctttgagagtgtggaatggagaggaacgtcctgagttgaagtcatcttcccatggaaggaagatggttaagttcgggaggcctgcctcagagattgaaggccttgtggtggccagtggactaagtcctttgatcacttgttccctagatacgggcgatcggggactaatgtctgctcttgtggaacgctga

SEQ ID NO: 44310 - DNA, 261 bp, Glycine max
  Peptide Sequence Number=SeqID_161088
atgtcggagctagatgagtcctttgcacagatgaaaataaaagatattgttaagtctactgctgcgtccaatcagaaccatctttcgtccaactcactattgttggagcttgtcaatgaaatagctcctcccaacgtaaaggcagacaaccgccaaaagtcttcatttgggttagcaactcctctgacctacattgcaaaaacaacctttgtagactcagattggttggttcgaccggttgacccgagaaccaacccctaa

SEQ ID NO: 44311 - DNA, 336 bp, Glycine max
  Peptide Sequence Number=SeqID_161089
atggaggagttgattaacaaaacacaattctctccccaaataatcctaacgtcatcacgtcggctcggcggctctacagaagaatctcacttcttgtcctctactgctgtcattctgctcccacgaacgaaggttcgcgatcatcacatgtaccaaccacacggtacaaaaattgcgaggggaaatagcctaagcgtgtgcacacgacgctctcacttaggaaaactaggcagtaaatgtcgaggtcaccctgttgtgcatagacaactcccccccacggtgatcagcctgagtctcaaaggagttccaaaccgagtgacataccccctagtacaa

SEQ ID NO: 44312 - DNA, 621 bp, Glycine max
  Peptide Sequence Number=SeqID_161090
atgtgtgaggactttaagatccagcacagcaattctacgccttacaggcccaagatgaatgaggcagtggaggcggccaacaagaacgttaagaagattattcagaagatgaccgtgtcatataaggattggcacgaaatgctccctttcacgctgcatgactactggacctcggtatgcacgttaaccggggcaacatcgttttcattggtgtacggaatggaagtcgtgctaccatttgaggtagaagtcccttctttaaggatcctggtggagttcgagttgaaagaatcggagtgggcccaagtgcgcttcgatcaactcaatcttatagagggcaagcggctgacagctatgagccatgggcgtctgtaccagagacgggtaaagaacgcttttgacaagaaggtgcgctcgcggaagttcagcgagggagacctggtgttgaagaaggtatcccaagccctaaaggataataggggaaagtgggctccaaactatgaaggcccattcattgtaaagaaatccttctccggaggaaccctagtgctcgccaacatggatgacacagaattgccttcacctgtgaacgccgatgtcgtcaatcgatactatgcttaa

SEQ ID NO: 44313 - DNA, 273 bp, Glycine max
  Peptide Sequence Number=SeqID_161091
atgtacaaagataattggacccaaccgtggcccatgggctcagaaatctaccctaaggctcatgagaaccctagggccttctcttgcatctttggcccaatcttcttagagtcttctaatgcccttagggggctaccaagggacgacttgcccaaaaatcatttgaagatgtattgttggaaaatgggggcatactcgagggatgacaaattactcatgcacttcttccaagacagcttggccagagccacatctgctcgtggaaagacttga

SEQ ID NO: 44314 - DNA, 1635 bp, Glycine max
  Peptide Sequence Number=SeqID_161092
atggcaccggagggcatggagaagactatgttcgtcaccttgtgggggacattctgttataaggtgatgtcctttgggctcaaaaacactggggcaacctatcaatgggcgatggtggctttgttccatgatataatgcacagagagattgatgtctacgtggacgacatgattgccaagtccaaaaccgaagaggaacatctcgccaacttgcagaagttgttcgagagattatggaagtacaagttaaggttgaaccccgccaagtgtactttcgaggtcatgtcaagaaaattgttgggcttcgtcgtaagtcaaaaggggatagaggtcaaccccgagaaagtaaaagcaatccttgagatgtcggagccgcataccgagaaacaagtccgagctacctgcaagccgctcttcaagctcttgtgcaaggatcagtccgttcaccagaacaatgactgtcaggaggcatttggaaggatcaaacaatgcctcatgaaccccccggtacttatgccaccggtggccgggagacctttttttctctacatgatagttttggatgattcgatggggtgcatgctggggcagcacgatgatttcagaaagagagaacgggccatctattacttgagtaagaagttcacggcctatgaaatgaactactacctgttggaaagaacgtgttacgccttggtatgggcgtcccatcgtctgagacagtacatgctgagccataccacctggctggtatccaagatggacccagtcaagtacatcttcaagaagcctgctctcacagggcagatcgcttggtggcaggtgttgctatccgagtttgacatcgtctatgtcagccagaaggcaataaagggaagttccttggcagactatctggcccaacaacccctcaatgattaccagcccatgcatcctaagttcccgaataaggacatcatggccttgttcaaggaaaatctagaagataaggacaaggacaaatgggtcgtgtggttcgacggagcatctaacgccctaggccacagggttggagcggccttggtctctcctgaaaatcaatgcatacccttcacggctagactgggttttgactgcaccaacaacacggccgaatatgaggcatgctccctcgagatccaagcagccattgacttcaacgtcaagtcgctcaaggtgtacggagactccactttagtgattcaccagctgaaaggagaatgggagactagggatcataagttgataccctaccaatcttacattaagaagttggttgagttctttgatgatgtctctttccatcatgctcctcgagaggaaaatcaaatgaccgatgcacttgccactttggcgttgattttccagctggctttgcatggagacttgttgtgcattgagttcagatgtcacggcaagtccacacattgctatctaatagaagaagagcaagatggtaaaccttggtatttcgacatcaagcgatgcattgaaagcaaggagtacccaccagaggcttccgacaacgacaagaggatgttaaggaggttggcggctggtttcttcttgagtgggagcgtgctatacaaaagaaaccatgaaatggttttactctaa

SEQ ID NO: 44315 - DNA, 1335 bp, Glycine max
  Peptide Sequence Number=SeqID_161093
atggaagtatgcccccaaagctcgtgcgagaggaaaggagagaccaccgacatcgattcactctcggcaaaagtaaccaacatcaccaggttgagtggcatgacccatagcggtcgcatctttgcggcacccaacttactagcacaacccgcaaataccaagggaaaagctaaggaggttgaagaatcagccaacaatgcaacccccgctccggaggaggacatcccggcagggaggttggccgagaagaaggaagggtccaacagaaaagagcctcaccgggcattgttggtcaaagtgctaaatgaggcccaggtggcccaagacatctccgtggaaggtttcgaggggatagttagcaacattaccgccaataactatcttaccttcacggaggaggagattcctgccgaagggcgggggcacaatagggctctacacgtctccttcaagtgcatggaccatgttatggccaaagtcctcattgacaatagctcaagcttgaatgtgatgcccaagagcatgttggagaagctgtttttcaaagcctctcacttgaggctaagctccatggcagttcgagcattcgatgggcgtcgtaggaaggtgaggggagagattgatctcccgatccagataggcccccacacttgtcaggggcttttggtcatcatttcaggagaggaggaccttcttgtaagctgcccatcctctatgccatttgttgaagccgcggaggaatctctagaaacaaccttccaatcctttgaggtggcgattaatgccaccgtagaatccctcccaatgtgtcctcacatctatggtgtctcgcgtcatgctagggcacggttacgagcccgacatgggcttgggaaagaacaaccacggcagggccagcttggtaaacatcagggagaactatggaagtctaggccacaagtgagggaggcccctccttgtcacctcaatgagagcgtcgttagtgcaggcctgaggcgcgaagaggaagttgccatggtgcacgatgaattcccgtggggacatcccgactgggtgcaaccatgccctccaggatttcagctagggaactggcgagtcctagaacagcctaaggttttctcggacccagccgtggattttgaacgagaggcagatcggatagaggaggaggaggacgatgcggggttttccccggagctagaaaggatggtaaaagtgggtacatgcatggccacctccatccacgataagttggtgactttactgcgagacaaccaagatatcttcgcttggtcttaccaagacatgcctggcttgaatgttgacattgtctag

SEQ ID NO: 44316 - DNA, 519 bp, Glycine max
  Peptide Sequence Number=SeqID_161094
atggcaccggaggacatggagaagactacgttcatcaccttgtgggggacattttgttataaggtgatgtcctttgggctcaaaaacactggggcaacctatcaatgggcgatggtagctttgttccatgatatgatgcacagagagattgaagtctatgtggatgacatgatcgccaagtccaaaaccaaagaggaacatctcgttaacttgtggaagttgttcgagagattacggaagtacaagttaaggttgaaccccaccaagtgtacttttagggtcaagtcaggaaaattgttgggcttcatcgtaagtcaaaaggggatagaggttgaccccgagaaagtaaaagccatccttgagatgccagagccgcataccgagaagcaagtccaaggttcatatcacaactcacggctacctgcgagccgctcttcaagctcttacacaaggatcaatccattcgttggaacgatgactttcaagaggcatttgaaaggatcaaacagtgcctcatga

SEQ ID NO: 44317 - DNA, 1930 bp, Glycine max
  Peptide Sequence Number=SeqID_161095
cttgcttctacaccatggagcagtggccgtgaatgttgttgaggcagacgtggatctcatcgttgggaacaaagaggatacatgcttaatggatccagtcaatgaccgaaacaaggatgaacaacatgtctgcatgcaatccggagacgaggaaacccccaagaaaccaaagcccttggtgatacatttcactcgggctactacaccccgacaacaccaaggcactcctatggcgtcaggcagtggacctgccccctttccctacaaaagcagaaaggcaatcccatggagcggccacgtctttgtggcacctgacttgccagcacggcccgctaataccaagggaaaagcgaaggagatcgaagaactggccagcgatgcaacccccacttcggaggaggatattctggcagggaggtttgccaagaagaaagaagggtccgacagaaaggaggctagcgagttcctccgcataatccaacaaagcgagttcaagataattgaacagctcaacaaaaccccagctagggtctccctcttagaattgctcatgagctctgagcctcaccgggcattgttggttaaggtattaaacgaggcccaggtggcccaagaaatctctgtggaaggtttcaaggggatagtcagcaacatcactgctaataactaccttaccttcacggaggaggagattcctgccgaaggatgggggtacaatggggctcttcacatcaccgtcaagtgcatggaccatgttatggccaaggtcctcatcgacaatggctcaagtctgaatgtgatgcccaagagtactttggagaagctgccattcaacgcctctcatttaaggccaagctttatggtagttctagcattcgacgggagtcgtcgggaggtgatgggggagatttatctcccagtccagataggaccccacacttgtcaggtcacctttcaagtgatggatataaaccccgggcttttggtcatcatttcgggagaggaggaccttcttgtaagttgtccttcctgtatgccctatgtcgaagtaacggaggaatctctggaaatgaccttccaatccttcgaggtggtaagtaatgccttcgtagaatccctcctgacgtgtcctcacatgtccaacacgacaatcatggtggctcacatcatgctagggcatggttacgagcccggcacgggcttagggaagaagaatgacggcaaggccagcttggtgaatgtcaaagagaactacggaaggttcaagttaggatacaaacctgcgcgggccggcataaggaaaagtggccgggagaggagaaactggggcactggcacgcagtcaaagatgcaagtgagggaggcccctccttgtcacctcaatgtgagcttctttagcacaggcttgaggcgcgaagaggaagtctccatggtacacgatgaacccctgcaagagcatcctgactgggtgcaaccatgtattccggagtttcaattggggaactggcgagtcatggaacgacctgaggcagatcagatggaggaggaggaaggtgattcggggttttccccagagctagaaaggatggtcgcccaagaagaccgagcattaaagccacaccaagaagaaacaaaaatcgtaaatctaggtgttggcaacgaaaggaaagaggtacaagtgggtacaggcatggccacctctatccatgataagttggtaactttacagcaagactaccaagatatcttcgcttggtcataccaagacatgcctggcttaaacgatgacattgtgaagcataagttacccttgaatcctggatgctccccggtgaaacaaaagctgaaaaggatgaggcccgaaatgtccttaaagattaaggatgaagtaaagaagcaattcaatgttggcttcttagctgtggcttga

SEQ ID NO: 44318 - DNA, 204 bp, Glycine max
  Peptide Sequence Number=SeqID_161096
atgaaggaaggattggaggcttcattctctaccgaatctttaagttcaattttgaagatcccgctccgattaaactgttcttctccatgcagtggttcgacagcaagcaaagacggctcgtggcggtcaccgctgatcaatggaggtggaggaggagcctgcaacactcgcccaagcgaaatttggctcgcctgggcgagctga

SEQ ID NO: 44319 - DNA, 204 bp, Glycine max
  Peptide Sequence Number=SeqID_161097
atgatttacgacgttaactctccccttttccgatccttcctcagccagaagggaggctcctccgataagagtttctgtgtattacctatgcttctccatacttgcccttcaaataagaaaataagaaagaacacagacacacttagacatgctctgtgggacagcttgtcgtgtttcggaagaggaacttttggtggtaaatga

SEQ ID NO: 44320 - DNA, 429 bp, Glycine max
  Peptide Sequence Number=SeqID_161098
atggatgaagtttcacttgcgacattggttaagcttcgtactccttggtcttggaacatgctaggtgtacccaacaatgttgctgaaaacgcgctggccctttgttttcttccccacctttttgccttctttcttcttgtcttcgtttcttcttccttcgtgcctgtcatctgccattgttgcgttgctgcgaagcttccatggtgtcgttgttgtgtttctgccgttgagggtagaagacctgaaaatcgcctaaaaagggcaaagagcaaccgttccatactatcggaagaagttcttccgatagcttctgcgaaagaagcttctccggaagaaggttcttccggtagaacaaaagattcttccggagaagctactaaaagaaggttcttccgatataacaaaacgttctaccggaagaaggaataa

SEQ ID NO: 44321 - DNA, 405 bp, Glycine max
  Peptide Sequence Number=SeqID_161099
atgggcggcccctattgtgtgcaaattcaaaacaagcacgccttcccgccatatggcttgcctcccaactatacaccacccaatgtggcatacactcccaatgaggatgtcaataactctgctctcatactcattgagagccgacaacctcatcatgtacatgtctctcaacccatgggggagacacatgaaattccccaccataatctagccgagttcgagctttgtctcggatatgccactaaagggcaagcagttggtgatatacccctgcaaaacactttggagggctctcaatatcacccacaaccacacctcttgcattccacagcgggtaaaatctctcttattatgaaagaaatgggagaagttggatcatctagaggaaaagctcagggtcgttga

SEQ ID NO: 44322 - DNA, 1119 bp, Glycine max
  Peptide Sequence Number=SeqID_161100
cagcaggagcaactgattgcgtcgccgctcggacagctggcccaccatgccgaagtcgataaagccgacgcggtcaccgctcagcgccatgacgttgccggggtggggatcggcgtgatacagccgatgctccagtaccatgctcataaaggcgcgggcgccgcgttgcgccagcagtgggccgtcaaagcccgctgccgccagctgctgagggcgcggggaagaccattgccaatagattttcggcacgacgacgtcaggttgacgcgcaaacatcccggcgacgcggtcgcagttatgcccttcgtgggtcaaatccagttcatgattgagcgccgtcgccagcgctctgaccatctgccgcggccgatagcgcgccagcgcggggctctgctgctccacggtttccgccagcgaggccagcagccgcagatcggcgtggatggttttcgccaggccgggccgcagcactttgaccacgacctgttcgccgctgtgcaggcgtgcgcggtagatttgcgccatcgacgccgccgccagcggcgtacgatcgaattcggcgaacagccgctcgggttcgccgcccaggtcggcaacgatctgcggcgccagcgtttcccatggcaacaccgctgcctggctgtgcagacgatccagttcgtcggtccaggccggatccagcaggtcggaacgcgtggccaggatctgaccgaatttgacgaaggtagggcccagtgcctcgagcgcttcgcgcagccgctcaggcagggtttgtgcgtcctgttgggcggattcagcgcgggcgccgcgcagcaaagcccccaggcccagcagacgcagaacgtcttgcaggccataacgaatcagaacggagcagcaacggcacctcgctgcgctgcgccatgcggttgcggtaggcttccacgttatccggcagcgcaacgccggcgacgatcgacaatgagcgcagcagcgggaacaggtggatatcgtcctcggacagttcgccgttcaccgcgtcggcggaggcgatcagcggcgacagcgtttgcaggtcggcttccagttcggcgatcagatcggcactgttggcgagatgctcggcaaaatcgccgatag

SEQ ID NO: 44323 - DNA, 1287 bp, Glycine max
  Peptide Sequence Number=SeqID_161101
atggctcttcactgtggtactttctgcttctggactgtggcttctcaccctccaagttctgtcaagttgagtcaacccactataaaagcttcctccttttcttcccctcttgcccctccacttgtcaaattgaatgtcagaggaaaggcttttcctggtgatgggacacctgaaacaaaagaatcacctcttgtggtttgttttggtgaaatgctcattgattttgtcccaactgttaatggcctttctttggctgaagcacctgcttttaaaaaggctgcaggaggtgcccctgctaatgttgcagtaggcatatccagattaggaggttcatcagcttttattggaaaggtgtgtgggtttggatggtttctaggcttaattgttcatggcaaagggaggtggagattctgtttagaggttgctacgggcagtgtattcaagtggggtggttttgacttttctattctgtgtaatgtgctggaggttggtgaggatgaatttggatatatgcttgccaatatactcaaggaaaataatgtaaacaatgaagggatgcgttttgaccctggtgcacgaactgctttagcatttgttacattgaggagtgatggagagcgagagttcatgttttatcgtaatcccagtgctgatatgctgctccaagaagatgaacttgatttggacctaatcagaaaggccaagatcttccattatggttctataagtcttataacagaaccatgcaaatcagcacacatagctgcagcaaaagctgcaaaagatgctggtgtagttctgtcttatgaccctaacctgaggcttcctttatggccttctgcggatagtgcaagagaaggaattctgagtatatgggagactgcagatatcattaagataagtgaagaagagatttcttttcttacaaaaggtgagaacccatatgatgatgctgttgttcataaactattccatccaagcctcaagctactcctagttactgaaggtgcagagggttgcagatattacaccaaggagttcagtggtagggtcaaggggttaaaggtggatgctgttgacaccactggtgctggtgatgcatttgtggctggaatattatcacaattagctgtggatctttcaatacttcagaacgaggacgagttgagagattctctcaagtttgctaatgtatgtggtgcattgactgtgaccgagagaggtgcaataccagctttgcccaccaaggaagctgttctgaatgccatgcttaagcccgtatcctag

SEQ ID NO: 44324 - DNA, 213 bp, Glycine max
  Peptide Sequence Number=SeqID_161102
atggagcaagtttcaagtcaatcaaggaggaggaggcactctcacttgaagcaagctttgatgagtaagagatcaaagaagctatttgggattgtgatagtcttaaaagtccgagcccggatggatgactttttgaggttcatttccaaattccgtgctcatggaatgctccctagaggtactaatgcttctttcattgctcttgtcccttaa

SEQ ID NO: 44325 - DNA, 894 bp, Glycine max
  Peptide Sequence Number=SeqID_161103
atggatggtataatagatgatagacaaagtgtcttctttggagatagattcctcttccaaagcactttggtggcaaatgagactattgaggaagctaaaagaaagaagaaagaatgcctttttttaaaagttgattacaacaaaacctttgatttagtaatgggctttggtgaaaaatggaatggttggattaaatcttgtttgtcaactagcttcatcttgatgttagtgaatgaaagttcaattttgaagttcaagatgcaaagaggtcttagacaagggacctactatccctcctttttgtttaacattgtagcggatgacctttgtggtataatgggaaaggctattgcaacactttctaatgtccttactatcaaaaatatgttgagaagctttgaactcatttcgggtcttaaagtcaactatcacaaaagcttctttggtgctatcggggtggaggattatgtattagaggagtttaccacaatcatgaattataagatcactaaattgccatttgtataccttggcattcccattggagccaatccaaggaaagagaaaacttggaggccaattgttgacaaagttctacacgaagacttactctcaaagctcgaaaatgttggcataaagctacctcaagatgtgtggttatggcatcagggtcccaatggagctttcactacaaattcagcatattggattgagacaattgagcatgtttttttcctctgccactctgcgttccagatatggagcgaatgctaccattggttggacgagtgcaccgtgatgcccaactccgtggatattcatttccttaagcatcggggctctacttcatcaaaaacaactggtcacatgagatgggtactatgggcaccagtg

SEQ ID NO: 44326 - DNA, 1410 bp, Glycine max
  Peptide Sequence Number=SeqID_161104
atgtgggagtatgctttggcatgtgttggtgttgttccttgtggcggcaataacgaccttaacggtcaaaggaagacaactttggagcacaacaaggcgtggttgctggcggattctggagccgaattggcgagtgctgaccctcgatcggttcactcgtctttcaggttcagcttctgttctcaggttgaggttgagtccttcaacatgagctattctgcttctgctgccgctgctgcaacctttttgatggtgaatttggactatgagtctcaagtgagggagttgaaatggaggagaatacagtcactggagaaaagcctgtctccggtggccaacactttgatcaggttcagctatgatgaaattctgtctgctactcgcaatttctccaaagagagagtgttggggagaggtgccttgagctgtgtatttagaggaagagttgggatttggaggactgctgttgctattaaaaggttggataaggaagacaaggagtgtgccaaggcgttttgtagagaattgatgattgctagttctctgaatgacacaaatgttgttcctcttgtggggttttgtattgactcggaggagggtttgtttttggtgtacaagtatgtgtcaggaggaagcttagagcatcacttacatgggaggaagaagggtgtgaagggtagttcaccacttccatggtctgtgaggtacgaagttgcaattgggattgcagaagctgtggcttatctgcataatggaacagaaagatgtgttgttcatagagacataaagccttcaaacattctgctttcctctaagaagattcccaagttatgtgattttgggctagcttcatggacttctgcaccttcagtccctttcctttgcaaaactgtgaaaggaacatttggttatttggctcctgagtattttgaacatgggaaagtatcagataagactgatgtttatgctttgggagttgttctattggagctcttaactggccgcaatccaattgaagcaaaacgaccccctggagaggaaaacttagtagtatgggcaaaacccttgctgagaaaaggaaaaggagccattgaggagttgcttgatcctcaagtcaagtacaattcgagttacacagatcaaatggttcgaatgattgatgcagcttctgtctgtgttacaagtgaagaatctaggaggcctagcataggtgagattgttgcaatattgaaaggtgaagtagagcatgttctctctagaagaaggaaatctggttattttggcaatggatatatgattgataattaccctaagttacaagaaacaaataatgagatgaaaagtcacttggctttagctatgctaggagttccagagtgtgaggatgatgattttgtctattgtcgttga

SEQ ID NO: 44327 - DNA, 155 bp, Glycine max
  Peptide Sequence Number=SeqID_161105
cactcaaggcccttggatcagtcacagcagaagaggtgcaaaggatgatggaagagattgacaccgacggagatggctacatttcatatgcagaattcacagaattcgccaaagccaaccgtggcctactcagagatgttgccaagattttttaa

SEQ ID NO: 44328 - DNA, 216 bp, Glycine max
  Peptide Sequence Number=SeqID_161106
atgccttattataagatatcaaattccaagagtggtcatggctccattccatgtctgatttcaagtattcatgaggtcactcaatccctcggcttgcataagggattgaaaggtggtgcagctgtatgtttttggagtggagagcaagcggtgaagatgatgaacttacgcgaccgtattttgctggggtttatctacgtgcataccaatctgtag

SEQ ID NO: 44329 - DNA, 563 bp, Glycine max
  Peptide Sequence Number=SeqID_161107
atgctgggcccccttcacctgctgatcatttgcgtcaagttttctaccgtatgggtttgaatgacaaggaaattgttgcattatctggtgcacacacactggggcggtctagaccagatcgcagtggttggggaaagcctgaaactaaatatacggacatcaaagaaaaaagggatgaagatctattggtattgccaactgatgctgctctttttgaagacccatcctttaaggtatatgctgagaaatatgctgaagatcaggaagcattctttaaagattatgctgaagcccatgctaaacttagcaacctaggagccaaatttgatcctctagagggcattgtgatagatgattctccaaatgcagggggagagaagtttgtagcagccaagtactccactggaaagagtgagctgtctgactctatgaagcagaagatacgggctgaatatgaagcaattggtggaagcccagataagcctctacagtcaaactattttctaaatatcatgattgttattgctgttttggcatttttgacatcactgcttggaaactag

SEQ ID NO: 44330 - DNA, 159 bp, Glycine max
  Peptide Sequence Number=SeqID_161108
atggaaaaaattgctcaagtgaaaggcgtgagttttgatgagtgtatgtgtgagattcgaggaattaatttctggcaagcattagaggagctggttagagacgacaaaggatgctgtgcctttaaagaattagtggtggcgggtactgagaaagtttag

SEQ ID NO: 44331 - DNA, 555 bp, Glycine max
  Peptide Sequence Number=SeqID_161109
atggcagagcgtgtgttactcctcactccatctcagtctcatcactctccaaccacaatggctgtcttgggcggcgccgcctccgctcgcatcattccctccgtctcactctccacctcttctcgctccttcttctccttatcatcctcttccaaactcaaatgcttgcgctcctctcctcgcatttcgcacctctttctcaatcagcaaagagcggaggttcgcgtttcgagtggaggatacggaacggtatcggcgccgaagtccgttgcgtctgatcctgatcagttgaagagcgctagagaagacatcaaggagcttctcaactccaagttctgccatcctattctcgtaatacttggtggtgtgaaacctcttccacttagagtggtgcaaagcacctgtgcagcactggatacttgcaagttgcaaatagcaacaaatggcccgagtttgctggttgtgttgctgtctttcacttttgctgaaccaaccgtatcagaagcttgtaaagaggctgttaagtatcaattgattgtcaattctgacttctga

SEQ ID NO: 44332 - DNA, 264 bp, Glycine max
  Peptide Sequence Number=SeqID_161110
atggctaacttcctggcaggattcattgggaatgaccaaaccacctcaaattggtggagcctcgacattgacagcgcatccaacgtgaaggggagtagggaaaaaatcatcctcgaaggccctgacaatgtcactctagagcaagccctcaagctcaacttcaaggcctcaaataatcaggctgagtatgaggcacttattgcaggtctaaaactagcaagagaagtcgaggccaagaagctacgatgctacacaaactcatag

SEQ ID NO: 44333 - DNA, 105 bp, Glycine max
  Peptide Sequence Number=SeqID_161111
atggagtatgctgctggtgaagtagatagagatataggagtagggtactcctggcttgggttgactcaggattggcgatgtgacaatggtcttcttgaaggctaa

SEQ ID NO: 44334 - DNA, 384 bp, Glycine max
  Peptide Sequence Number=SeqID_161112
atgggatcaaatgagcagatgcaaaaaatggaaagttcaaaattcagaagcttagaaggagcattttttttaatagtaattcgttatgagggcgagccctggtgcagcgataaaagttgtgccttggtgacttgttggtcatgggttcgaatccggaaacagtctctttgcatatgcaagggtaaggctgcgtacaatatccctcccccataccttcgcatagcgaagagcctctgggcaatgggagggtggaaagagcaaagctatcagctaaaaaatggaacccaatgccacttggtggaaacaatgggcttacagatcccagttttctttaaattctcggccactccaatcatacacttaaaggagacgtcttcctcttaa

SEQ ID NO: 44335 - DNA, 735 bp, Glycine max
  Peptide Sequence Number=SeqID_161113
atggcgcagacgacccatcccatggacatcgacgaccacacttacaccgccagtcctgacaagggcaaaagtgtcgtcttcgccggaaaccctcccgccgccggcaaggccattccgtgggtcgaaaaataccgccctcagtccctcgacgacgtcgctgctcaccgtgacattgtcgatacaattgataggctaaccactgagaacagattgccccatcttctgttgtatggccctcctggcacgggcaaaacatcaacgattcttgctgtggcacgcaaactgtatggttcacagtaccaaaatatgattttggagctcaatgcatccgatgatagaggaattgatgtcgtgcgccagcagattcaagattttgctagcactcagagcttatcatttggtgttaagtcctctgtaaaattggtattgttagatgaagcagatgccatgacaaaggatgcccaatttgcgctacgtagagtgattgagaaatatacaaaaagcactaggtttgcacttatctgtaatcatgtaaacaagattattcccgcacttcaatcaagatgcactcggtttcggtttgcccctcttgatgctgtccatgtcactgaaagactgaaacatgttattaaggccgaagggcttgatgttgaggacagtggcttagcagcttttgttcggcttagcaatggtgatatgagaaaggctttgaatattcttcaggtagtatgctga

SEQ ID NO: 44336 - DNA, 264 bp, Glycine max
  Peptide Sequence Number=SeqID_161114
atggcccttagacttgtcaagtctagtgtgcaaggccctgaggattactctgttggctacctctgcctggtcgttggtctaaggatgttcaacaaaggtgacgagtcaagggcatttgccttgagtgttggtgatgcaagctccattggagcttgtaggcctaggatcttcttcatcaatggattcctttgcttcttggaagataaatggcagcggaatggagaaggaagagagagaggagacaccacttcaaagagaagatga

SEQ ID NO: 44337 - DNA, 165 bp, Glycine max
  Peptide Sequence Number=SeqID_161115
atggccgtcggaaagaacaagaggatttctaaggccaagaaggttggcaagaagaaggccgctgatccttttaccaagaaggattggtacgatatcaaggccccttctgtgttccaggtcaagaatgttggcaagaccctcgtcactcgtactcagggcaccaag

SEQ ID NO: 44338 - DNA, 552 bp, Glycine max
  Peptide Sequence Number=SeqID_161116
atggatggtgaggggaaacagtcttccaaaaaaaacccttacgttgaactagaagaggttgactttgattttattctagcaaagggcatgcaagaacaagagagagagttcacaatgctttcaactattgaaagtgaaagtgatgaatatttaagtgactcctctattgataatgatgataatggtgaaagaagtaatgacgatggcgatgaagacatggaaatggaagaagatgagattgatctagatgaattatcttatgaagaattgatggagttggaagagtttataggagaagaaacaagagggttatcagcaaatgaaatctctttgtgcttgtacccttatacttgccaatgtgctgaaagcaaaagtggcattgatcgttgtgtgatttgtcaggttgaatatgaagaaggtgaagcgctggtggcacttcaatgtgagcacccttatcattcagattgcataagcaagtggcttcaaattaagaaggtttgtccaatttgtagcaatgaagtgtcaactcccaacatgacttcgaatccttag

SEQ ID NO: 44339 - DNA, 531 bp, Glycine max
  Peptide Sequence Number=SeqID_161117
atgtcttgcgaccgagactattatagtctcttttgccttccagagacatgcgagtctgttggcaagcagagacaaattatggttatctgcccccttttcgaagactccaatgtccttcgaccgagactattacaggctcttttgccttccagagacaatcgagttcgttggcaagcgaagacaaattatggtcatccgcttttattgtttttaagactattgcagtctcctttgccttccagacacaagcaagtttcgctgattgggctttcgctagtggtcgattgggtgggttttgtgacgtttcagaaggaagtgtgcaaaatactcaaaatgggggcaaaatggtcactatggggaccttttccagcccctgggcccactataaagcttaggggtgaagcaaccagctcgcctgggcgagctaggttgcttctggaggaaacaagcagcttgtcggggcgagctgctgttgcacaatccgtaaagttccgtaacattccagaagccgaagagggtatggttgtgtaa

SEQ ID NO: 44340 - DNA, 663 bp, Glycine max
  Peptide Sequence Number=SeqID_161118
atgggcaacgtcattgaaacgtttgcttcgggcttaggaaatgctattggcaaactcttcaattctccaattgaatatctttccggaaagtcttgcagctcagtgtgtggaccaacatgggatctcatttgctatatcgagaatttttgtgttgccaatctcctcaagctagccatggtatttatgctattgtacattgtttccatgtttgggagtattcttgtactttcttgtgtgttatgctacacaagctcaagagaagaagacgaagaagaagaagaagaagaagaagaagaagaagaagaagaagaagaagaagaagaagaagaagaagaagaagaagaagaagaagaagaagaagaagaagaagaagaaggagcgtctgcaaaaacaagcaggtcaatttcgcgtagaaggagagactataaaggctcccatttaaggaggtctttgcagcctaggaaacatcatgctcgagttgaaattagtagagatcttagatataaaagaaatcatagtcatggagatcccagttacacaagcattgccactaagcatggcaattacataggcacattccatgacatcaaggtaactcgtacatctaagtttgcaaaaggtataactaaaaggaaaagagttcttccaaggcagagaaggtag

SEQ ID NO: 44341 - DNA, 315 bp, Glycine max
  Peptide Sequence Number=SeqID_161119
atggcgaaggtggcagatgaccataatttgtctccatgtaccaacagacttgattgtctctggaaggcaaggggagtggatgaccataatttgtcttcgcgtgtcaacaaacttgattgtctttcgaaggcaaggggagcggatgaccataatttgtctttgcgtgccaacggacttgattgtctctggatggtgaaggtggcagataaccataatttctcttcgcgtgccaacggacttgattgtctctggaaggcaaggggagcggatgaccataatttctctccacatgccaacaaactcgcttgtctctag

SEQ ID NO: 44342 - DNA, 621 bp, Glycine max
  Peptide Sequence Number=SeqID_161120
actgcttcggatggactaaaacatcgagtgtttgaggtctcattggctgatcttcaaggtgatgaggaccatgcattcaagaagattcgtttgagagccgaggatgttcaagggaagaatgttttgaccaacttctggggaatgagtttcacaactgacaagttgaggtcattggtgcgaaaatggcaaactttaattgaagctcatgctgatgtgaagaccactgataattatactttgaggatgttctgcattgggtttactaagaggcgtagtaaccaggtgaagagaacctgttatgcacaatcgagccaagttaaacagattcgcaggaagatgacagagataatggtcaaccagacaacatcctgtgatttgaaagaagtggtccgcaagctcatccctgagatgattggaaaagagattgagaaggcaacatctagtatctatcctctacagaatgtgttcattcgtaaagttaagatcctgaaagctccaaagtttgatcttgggaaactgatggagattcatggggattactcagaagatgttggtgtaaaggtggacagacctgtggacgaaacaatgcctgagggagccactgaagtagttggagcttga

SEQ ID NO: 44343 - DNA, 681 bp, Glycine max
  Peptide Sequence Number=SeqID_161121
atgtggggaaagaacatagggaaagaatcgttctcctctggtaacttcgatgcttttcgaaagaaagatgtcgatcttcgagtacaacgggagtgccctagtggctatggtggggaagaactgcttcgccatcgcgagcgatcggagactcggtgttcagccccagaccaccgccaccgatttccagaggatttccaaaatccacgacaagctgttcatcggcctctcggcctcgccaccgacgcccagaccctctaccagcgcctccttttcggccacaaattgtatcagctccgcgaagagagggacatgaagccccaaacttttgccagcctcgtctccgctattctctacgagaataggtttggtccatacttttgccagcctgtaattgctggactaggagatgatgacaagccattcatttgcacaatggatgccattggagcaaaggaacttgcaaaagattttgcagtggctggcactgcatccgagtctctttatggtgcttgtgagtcaatgtttaagcctgacatggaaccagaggaattgtttgagatgatttcccaagcactgctatcatctgtagatcgtgattgtttaagtggctggggtggacacatttatgttgtcaccccaaccgaagtaaaggaaaggatactgaaaggaagaatggactaa

SEQ ID NO: 44344 - DNA, 837 bp, Glycine max
  Peptide Sequence Number=SeqID_161122
atgggtggtggaaagcggaacacggtggagacattcttcttagccactctcattctctggctcgcttccctttgtttccagattttcttcaacaaacgttgggagcttctctctgttatcgcgggttgtttcttctatcagacatctaactgcctcatccgattcttcttctccacccataaagaccctctcttcgttaacacctctgtctctcttctccactctctcttcacctccgcttcagtgatcttcatcttgttcagagagttatgtaatgggcctagtggaatgtttgaccactcaaagttggttgaagatgcttggccctgggcatttgaagcgttgagcttttcatgtggctactttgcatatgatcagtgggatatgcttcgttaccgcttatataatggttggatcccatctatccttgtgcatcatctggttctccttatttgcttcactcttgctttgtatcgaaatgttaccatcaactaccttattctcactcttatctgtgagctgcattccatctttcttcatgtgagaaaagtcagacgaatggccggtgttcgggatgcaaagagcattcttgttaggttagagtggtttctgaattgggtcaccttctttgtggcaagatctgcacctcacattctcatcacagccaagctcatcaaggatgctcacaaatttgaaaagggtatggagctgccactggctctgtgtggcatggctgggatgaatttgctcaacattggtcttggcattgatctccttaaagcttttaagagagagaggaagtcccagctgggtaatcttcatcaccaccgtgaatga

SEQ ID NO: 44345 - DNA, 147 bp, Glycine max
  Peptide Sequence Number=SeqID_161123
atgttggaacattttcatcgtattctaactcaagctttgcaaagttcaccatggctcgtggggtcgaggaagctatatcctagtgttaggatgacagaggacgaagtaggaacaaatgtagggtccatgacaaatgccaggaattaa

SEQ ID NO: 44346 - DNA, 1035 bp, Glycine max
  Peptide Sequence Number=SeqID_161124
atggagttcctttatagaacaggtggtgatggtcctcttgttgcttttggtgcatctgatggtgtcattagagttctatcaatgatgacatggaagcttgtgcgaaggtacactggaggtcataaggggtctatctcttgcttgatgtcattcatggctgcttctggtgaggctcttctggtttcgggtgctagtgatggattgctcataatttggagtgctgaccacggacaggattcacgtgaacttgtacccaagctgagtttaaaagcacatgatggaggggttgtggcagttgagttgtcaaaggtgatgggaggtgctcctcagctaatcacaattggtgctgataagacattagccatatgggacaccgtctcctttaaggtgtattgtatggttgcacatactttgcagcctcatcttgtagctgttggaaccaacattggtgttattatctgtgagtttgatgctagatctcttccacctgttgctcctctaccaaccccatcagacagtaaagagcattctgccatatttgtaattgaaagggaattaaagctattaaattttcggttaaacaattctgcaaatccatctcttggaaataacagctccttgtcagaaacaggaagacccaagggagatttttttgaaccattacctatcaagcaggggaagaagcacataagtactcctgttccacatgattcgcattcagttctttctgtcagcagttcaggaaagtatctagcaattgtttggccagatattccttatttctctgtctacaaggttagtgattggtcaattgttgactctggaagtgcaagacttctcgcttgggatacttgtcgtgacagatttgctatattggaattagcattaccgcctagaattcctatagttcccaagggtagttcatcaaaaagagcgaaagaagctgttgcggcacaagtagcagccgcagctactgctgctgcttccacaacttcctatacattttttggctttgtcactagtggactcttttag

SEQ ID NO: 44347 - DNA, 354 bp, Glycine max
  Peptide Sequence Number=SeqID_161125
atggcctcgatcaaagggcttcccacaaaccctaagagaataaaggtgattcctgagtggcccacccaaccaacaccactcattgagttggtgaggaaccatgttcccttatgggaaaatgcccatgaaaggggttttcagaccttaccctactccaacatgccaaacaccactaatatacatgttattattctttttacaaatgttgagggaagaagctccgagtttcaagaacctctagatttgaggtcaaatccttttcaagggggagggaatgatgcaatcctaccccccaagggcaatggattgaagactccaagaagattgagccaaagaagtaggagaaggccctag

SEQ ID NO: 44348 - DNA, 288 bp, Glycine max
  Peptide Sequence Number=SeqID_161126
atgcagatccatggatataggatgtcactttgggctgaacatacggtgctattgaagagtgcttcttacaaccagagagccttgaatgcattagaaggagatgacaaggcatcagctcaaatgatgcccaagtacccggtagaagtcgatcgaaagggtaagattccacaccttctagagcttggtatcaatgcagtagagttgctgtctgtctttgagtttgatgagttggatttccagaggcgtccaaatcccagagatcacatggtaactttatatctcgattaa

SEQ ID NO: 44349 - DNA, 654 bp, Glycine max
  Peptide Sequence Number=SeqID_161127
atgctcagttcttcttcttcggcttcgtttttgaggcagttaagtgcaaaaaaggaggcttggaaagagagaagatataatagtagtggtggtgattggggagtgagctttggagggtgtgagacaagtgtgaatctaatggaagggtttaacatgatgcaggggaatgtggggaggaagagggtgatggtggtggttgatgacacttcgcattccaagcatgcaatgttatgggcactcactcatgttgctaacaagggtgattccttgactctgcttcacgttgtgcctcctcacaaggctcctgaatcttcttgctccacttatcttgttaattatcttgggtctctttgcaaagattgcaagccaggggtggaagtggaagcgctcgtaatccaagggccaaaactggcaactgtaatgagccaagtaaagaagctggaggtctctgtcctggtactgggccaaaagaagccatcttctctttttagctgtctttgtggaagcaacggaagcagtagtacagaggagtttgtggagttctgcatcaataaagcagagtgcttgacaattggagtgaggaagagaagccagggcacgaatggataccttatcagcactaggtggcagaagaacttctggcttttggcttag

SEQ ID NO: 44350 - DNA, 882 bp, Glycine max
  Peptide Sequence Number=SeqID_161128
atggaagagagcttcgttttccagtggagcgtcatcagatctctcttgtccatccttcagtggtgggcgttcaatgtcaccgtcatcatcgtcaacaagtggatcttccagaaattggatttcaagtttcccctatcagtttcctgtgtccactttatctgttcatccattggagcttatgtggtaattaagttgctgaagcttaaaccactgataactgttgaccctgaagatcgctggagaagaatctttccaatgtcatttgtgttctgtattaacatagttctggggaatgtgagcctacgatacattccagtttcttttatgcagacaataaaatcattcacacctgccaccacagttgttttgcaatggctagtgtggaggaagtattttgactggcgtatttgggcttctcttgtacctattgttggagggattcttctcacatctgtaacagagcttagttttaatatgtttggattctgtgctgccttatttggctgtttggctacatctacaaagactattcttgcagaatctcttctgcatggatacaaatttgacaggcttttagctaagcggtatgccttagcatgtatggaagcatttctgaccagtatccattatgacaccaagtttacaacgatgtttcttgagttactttgtatttgtttgcttcaaaagaaacagaaaaatgttgtcactggcaaactgatggaaatgcctaatcaagtggccaagaatcatcgatttcggagggaaaatgaatttaggaaggatccgatcccaagtgacattgaatcagttgggggtataagcgctgctatttcagcagttggtgttggaggactgaatgccagtcgaaaggcgcatctatga

SEQ ID NO: 44351 - DNA, 468 bp, Glycine max
  Peptide Sequence Number=SeqID_161129
atgcaacttataggttattcagatgctgattgggcaggctgtatggattctagaaaatccatatctggatattgtttcttcataggcaaatctttagtgtcatggcgtgctaaaaagcaagcaactgtgtccagatcatcttcagaagcagagtacagggctctgtcttcagctgcttatttgagagttcagcttaccagaactccaactctttactgtgacaaccaaagcgcagtccacattgcctcaaatccggtttttcacgaacgcacaaaacacttggaaattgattgccatcttgtgcgagagaagcttttgaagggcactctaaagctactaccagtttcaacaagtgatcaagtggcagattttctcaccaaagcattggcaccacccaaatttcatgattttgtctccaagcttagcatgatcaacatctaccatgataagcttgagggagggtgttga

SEQ ID NO: 44352 - DNA, 3222 bp, Glycine max
  Peptide Sequence Number=SeqID_161130
atggacgccaccgtcactcagctcagtccctcctgcaatgcagccgagccgccgcgccgcattgttcgccggcggctggtccagacgacgctctttcctcacaagccaccagagcccgtcgaaaagaacgacaaagaggacgaacgccatgaggattactccgacgctgagaatcacaagaagaggaagaagcccaaggctaaaaccactcctcgaaaaaaagcttccaagaatgccacgccaaagaaaaatgcatcggctaatgggactaacaagggttcaacttcgcggcaggtgttggctgattacgatccggttaatgcaacggagcatgatttgtttttagaagcgaaattggctgctgaggcggggaagaaagttcaggacatggctgattcaggaagtaatttatcgacaacaaagagtgaggaagaaaggactacctgtggtcctattcatgtatttgaaaatactcaggatgataccccatcccttgactggagaaactgggcgtttttggagaatactaccactatgaattatggtccagaaattttaaattcatctgttttggagggttctgttgaatccttgaattttgataagcttcgtagttccttggatccatcaggtgtttcaatttctcagaatgccttatcttcagatagactttgtatacatccagaaaatctagaagaagtatcaccatcagactcagcttcactagcagagaaaacatgtcctccgacatgtgaagatgccaaacaggacttggaggtggatgaatccgttactacaacagtgcaagctggcatttttagaaagtcagatactgaaccaccaagtagatttcttcaagaaagtatgagatcttattaccgtagttgtgtagataaggcagagaacagcttatggacatacaaatacaagccaacaaaggctgttgaggtatgtggtaatgatgaatcagtgaacttcttgcgtgattggctacatctttggcatgaaagacgttataaaagcaggaaggatatctctgacatggataaaagtgacatgcgagatgttgatgatgattataaatgctcttgtagcgactacgattcagaagatataaatgaggaggattccctgcagaatgttcttttaattacaggaccaattgggcttaatgcatcagattgtagaaatggaactgctgtcaggaattattttggagatactcttggttcacttgggtttaaaagggcatcagaaatcacttcaagttcacagaagaaaactacaaagttgtccccggcttcggctttgcaaagtggtaaagctgctgatgaggtgaatgatggggtgaatgaactgataaccatatctgatgatgaagctcatatccccagtggatcatcacagaagttacttggcaaaaacaatgtagttgcatcatgtgataaagtgcaaactttaattctaattgaggatgtagacatcctttctcctgaagaccgtggatgtattgctgccatacaacagattgctgagactgcaaaggggccaattatattgaccagtaatagtgtgaatcctggcctgccaggtaattttgacgtgctccatgtttcattcatgttgccatcgccacaggagttgctttgccatttgtacactgtttgtctcactgaaggagtcaacatccatcctcttttactggagaagtttatacattcttgtgatggagatatccgaaaatccattatgcatcttcagttctggtttcagagtaaaagatttcaaaaagatgtaatgacacaaacatgttatggctcacttccatttgatcttgagcttggccatcagatactaccaaagataatgccctgggatttcccctcagagatatccgaactaattgagaatgaaatcgccaaattaacaaatataatggaagaaaactctagagggttagttacagaagagcttcttcccataaatgagcagcaaaatgatttaaatgtgcagtgtatggaggctgattatatagaggccaagaaggtggagatgattaagagaaatgggtctttgacagattacagtgagcttgaaattcaatataatgctatttctgagttttccaattcttctggttccccacttacatcttctcggcataatggtcgaaggaaacttgtagttatgtcctctgattctgaggatgaggattcaaataatgggtatcctgtagacacacatgaagaagctaatacaagacaatcgatgaaagaaaataatggatatccctctgaacttcaattaaatggaaactaccctagtacatcagttcgcaagctgctttgttccgaattggagcattcagaggaggaacattttaaatattcagaaacaactgatgatacatacgtaaatgaaacatgtaaatcattagatgtatcctgtgtgccagaatcaacttttgttcctgagactgaaattgaaaatggaacggagtcaatgtatgaagcagtgtcttctggccccctttttggtcctcaggaagtttctgtttataatgagttgaaaccattcactttcagtgttcctaggcacttaacaaaactgtcacaaaatctagatttgttggatactgaaatttcagatcattcttgtaaaggagttcaacaagatgttctagatgaacatatggaaacaattgttaatgtgatggatgagtgcagtcgtgtggatttcaaactaaagccaacgtgtttgcaatctaattcatttgctgagacagaaaagatacaaaagttgtggggagatcttcttgagtgtcgaatggatttaagacagcatgctacctcagaacagctaggtgcttttcaagttgttagacttgctagtggactgaacaatctaatttcagaagctgacttatttcatgaacgtgatattatggaaccttcagcgttcctttccggtgaaaccacatctattcggtatcatgaacaaataatgacgtccaccattgctgaacatgggttttgcttttacgctaagcttatagcagatgaagcatcaaagttgggttgtgcaaattgtgttgatattacttctgagatgttggcttccaccattaaattaactggacaggatctcgcgagaagcaaagttatctatactggaaagcaagtagagtggaacagcccaataaataatacgcagaagaggtag

SEQ ID NO: 44353 - DNA, 614 bp, Glycine max
  Peptide Sequence Number=SeqID_161131
atgtacagtagtttagcttccgtcatgggactccccacaagtatgcggtttactaaggaaattaaaagtaggaatgatttggattctggagagggacaaagatgtccagcgaagcaagtgaaacttttcccctcttccgtgagaacagaacaacctcagaaaaccctaaacccctccaacccattcccacattgtactaccctgttagttagtcaagtagcttcactcactctttctatttccagaatgccaaatccaaatccaaagcaccttttccacgccactctcttcctctcgatacttctccaggcgctgtctaaatccacgattgagccatgctcgaactccgactcatgcaacgcgcttctgggatacaccctctacacggacctcaaagtctccgaagtggcgtcgctcttccaaatcgaccccatcgcgcttctcaccgcgaacgccatcgacatctcttaccccgacgtggagcaccacattcttccctcgaagctcttcctcaaagtccccatctcctgctcctgcgtcgacggcattcgcaaatccgtcgctactcactacaagacccgccctccgagagcctctcctccatcgccgacgcc

SEQ ID NO: 44354 - DNA, 879 bp, Glycine max
  Peptide Sequence Number=SeqID_161132
atgccttctgcttcttccaaactctacgcagatgacgtgagcctcctcgttgtaacgctagacaccaaccctttcttctggagcactttccccttccccttcgccgagttcctctcccaagtactcgcttttctcaactcgatcttgctccttggccagctcaaccaggtgatcgtcatcgccaccggatgcaactcttgcggctacatttacgattccacttccgataagaaccatggctccaccaccggtacaatgcccgcgctttattccaatttacttcacaatctcgatgagtttctcgctagggaccgccaattagatgccgacgcggctcacgcaccgggaaccgttccttcttcgctgttatcaggctccttgtccatggcgctttgttggttatcagatatacagagagcttttcgttcgggaccaatgcctcctcagcctcgggttcctatagattcttgttatattggttcaaacaattctgcattcctccagcaggcttcatacataactggtggaatatattacaagcctccccaattggacgggctttatcaatatctttcaacagtgtttgcaactgatttgcattctcgtgcatttttacggcttcctaaatctgtgggtgtggattttcgtgcctcaaattttgagacctgcacctcgataaactgtatgaattatgcaggtgtttctgccataagcaaacaattgacatgggctatgtgtgttctgtatgcttatccatattctgtgagcaccatgataagtgttcaacctgtggccatatctttggcggaaataattattagtcagactttacttatctctcagttgaactccagattagtcagggtccttttcccctga

SEQ ID NO: 44355 - DNA, 546 bp, Glycine max
  Peptide Sequence Number=SeqID_161133
atggcagaagacagcgaagggacggcaaagaaggaggagattttagagtctcagattgaaaccgctatgcgctctcgcgtttctctcttcaaggaacaatctgactccttgacgttcgagggtgttcgtcgattgctcgagaaagacctgggattggaggagtatgctttggatgtgcataagagatttatcaagcaatgcttgctcaagtgcttagaaggggttggagatgatgatggggcaaagatatcagggaaagaaggggaaaaaggtacaagtacacaagagtcagaagaaccaaaagaagaatgtgaagcaaaagatgcgaaggatctttgccctgaagatgaggagaaaatggaagactctccagtcttaggtcttcttaaagaacaaaaaagggctaaacttgaaaccaaggatgataaaggcaatggaaccaaagtagttccaattgaggccctaattaagaaagctgttagaaaaagatcttcgtacatcaaggctaatgcagagtatgctgctgattttttcaattatttataa

SEQ ID NO: 44356 - DNA, 1050 bp, Glycine max
  Peptide Sequence Number=SeqID_161134
atgccatcgacatctcttaccccgacgtggagcaccacattctcccctcgaagctcttcctcaaagtccccatctcctgctcctgcgtcgacaatattcgcaaattcgtcgctactcaatataagacccgcccctccgacacccttcgacatcgccgacgccgtctacgctggcctcgtctcctccaaccagctccacgaggctaactccatttccgacccttcaattcttgatgtgggccaaaacctcgttgttcctctcccttgcacctgcttcaacggctctgataactctctccccgcgatttacctctcttatgttgttcgcctcgttaataccctcactgctgttgctgctaggtacttcaccactctcactgatttgatgaatgttaatgccatgggaagcactgctattaacgacggtgatatcctcgctgttccaatacccgcttgtgcttcgaattttccgaaatccgcctctgattttggcatgcttgtccctaatggaagctacgccattaccgcggggcactgtgtgcagtgtagctgtggacccaaaaaccttgatttgtactgtatgccggcttctttggctgtttcttgctccagcatgcaatgtagaggcagcaaccttatgcttgggaatgttaccgttcagcagactagtggtggttgcaatgttactgcttgcaattatgatggcattgttaatggcagcattgtaacaacgttgtccccttctcttcagcctcaatgtccagggctgcaggaattccctcctcttgttgccccacctacaaccgttgcaagggacacggtgtttgcaccagcaccagcaccactgttcgatggagatggtccagcatcacccaaatcatcgctggtgccttcaacggggcttccaggaggattctctcctgcaaatggccctattagcggcatatcttctggtgcttcggctgcatgctccttggtgaaaccatttcccgctttgacgtatgcactagtgttattgcttgtcaagttgatgatacccgtggcattgtaa

SEQ ID NO: 44357 - DNA, 288 bp, Glycine max
  Peptide Sequence Number=SeqID_161135
atggatgaacaagagagagatgatgagacaccatgggctagcatatggccaaagtgggctcttggacttcacatatcggctttgagagagatatttgttaaaaggacagaaggagggacttgcaatacaaaggactccgatgctcaaataattgaatgtcagccaagagataaggaggttcaaatatactcaaatattaagaggttagaggtaacctgtcagttagggagccggctgctaagggttgaatgttcgtgctcctgtgtcaggactgacatggaggattga

SEQ ID NO: 44358 - DNA, 723 bp, Glycine max
  Peptide Sequence Number=SeqID_161136
atgaagatgaaggaagtagcatgtcaagctaaagtgattggaacaatagtaacttttggaggcaccttgctaatggcactatacaaaggtcccatagttagtgtcatgggatcttcaactagccatgctggccaacccgagaatgtgaacagccccactggtaaccactggatcctggggacatgtttcctcctcattggttgtgccggcttttctgcgttttacatattacaaaccataacattgagaaaatacccaacagagatgtcgctggccacttgggtttgctttgttggtgcacttcaaagctctgttgtagcagccatcgctgaacgccaccatcctcatacctgggcccttggttgggatactcgactctttgctcctgcttacgcgggaatagttacatctggagttcagtattacatacaaggcatggtcataaaatcaatgggcccagttattgtaactgcttttaatcccctgcgtatgatcattattaccaccttggcctgcatagtcctatctgaacaactctaccttggaagtattattggagcgatagttgtggttcttgggctctatcttgttgtgtggggaaaatataaagaatgccacggaagaccaatgccaccgtcccttacaaaggatacttctcctgaagaccaacggcaactaccggtcacagctcctaagaatgataccaatgatactaagggttaa

SEQ ID NO: 44359 - DNA, 714 bp, Glycine max
  Peptide Sequence Number=SeqID_161137
atgaagatcaaagaggtaacatgtcaagccaaagtgattggcacggtaatcacttttggagggaccttgctaatggcaatatacaaaggcccagtacttagtgttatgaggtcttcagccagccacgctggccaacctgagaatgtcaccaaccccagcggtaaccactggatcatagggacatgtttcctccttattggttgtgcaggcttttctgcgttttacatattacaagtcataacattgagaaaatacccagcagagatgtccctggccacttggatttgctttgttggtgcacttcaaagttctattgtagcagtcttcgtagaacgccaccatcttcatgcctgggcccttggttgggatacacgactctttgctcctgcttacgcgggaatagtttcatctggagttcaatattacatacaaggcgtggtcataaaactcatgggtccagttattgtgacagcttttaatcccctgcgtatgatcattattactaccttggcctgcatagtcctatctgaacaactctacctcggaagtattattggagcaacagttgtggttcttgggctctatcttgttgtgtggggaaaatataaggaatgccacggaagatcaatgccaccgtcctctgcaaatgataaccctccagaagaccaacggcagctaccggtcacagctactaggaatgataataagacttaa

SEQ ID NO: 44360 - DNA, 207 bp, Glycine max
  Peptide Sequence Number=SeqID_161138
atggaggttgcttcaggtggaagctacctagcttgccggggcgagctgggcggcagcctcctccctcctttttgctataaaatggcctttggggctgaggggaaggggttcaacacttcagatattcagttttcacttaaaattagtgaggggaagaagaaagaaggaaaaaatccaagccaaggtgcttccgtaatgctttcgtga

SEQ ID NO: 44361 - DNA, 342 bp, Glycine max
  Peptide Sequence Number=SeqID_161139
atgcattgtcaggctcctgaaacaatatactcatgtaagggaactagaggtacaacaagcgtcgttcaagattgtgaactagtgctattatatatggctaggattactcttgagcgcaaatcgaagaccataaacattcaggtgcttagcccaattgcttcgactgcggaaaatgagtccccaacgcgttcgtggctttgtaaggaatcgcagcaacgagagtcatgccatggaccacgacagcgactccacaattattgtttccaccgtgagcccacgacagcaaccttgtcgttgtgcagcatctcgaccacgagggcgatgagtgccttcttggtgtga

SEQ ID NO: 44362 - DNA, 732 bp, Glycine max
  Peptide Sequence Number=SeqID_161140
atggagcacatgaagattaaggaggtggcatgtcaagccaaagtgattggcacagtagtaacatttggaggcaccttgctaatggcactgtacaaaggccccgtgcttagttttatgcgatcatcaactagccatgctagccaacctgagaatgtggtcactcaaactggtaaccattgggtcatagggacattgttcctcctcattggttgtgctggcttttctgcattttacatattacaggccataacattgagaaaatacccagcagagatgtcgctggccacttgggtttgctttgtaggagcacttcaaagctctattgttgcaatcttcgcagaacgccaccaccctcatgcttggtcccttggttgggatacacgactctttgctcctgcttacgcgggaatagttacatctggagttcagtattacatacaaggcatggtctcaaaaattatgggcccagttattgtgactgcttttaatcccctgcgtatgatcattgttacggccttggcctgcatcatcttatccgagcaactcttccttggaagtattattggagcagtagttgtggttcttgggctttatctagttgtgtggggaaaagctaaagaacgcagaggtattatgacaccgtcccctgcagaaaataactttccggaagaccaacgacagctaccagtcatagctccaaggaatgataacattaatactaataaggcttaa

SEQ ID NO: 44363 - DNA, 1224 bp, Glycine max
  Peptide Sequence Number=SeqID_161141
atggcttcttcaatccctaatggacctccctctgcgttgaattcccagttctacgatgatctcagaccgccacagaggaccttcaacttttcttttcttcaacctgtcaaatttcctcgttctcaacgccttttcgtcgtcagagccagcgatttggagttcgaagccaccgttgtcgccggcaaggtgccgcccaaaccggcggctcctgtcggaactccggtggtcccttcacttccacttcaccggcgtcctcgccggaaccggaagtcgcctgcgcttcggtcggcttttcaggaaacgagcatttcgccggcgaatttcgtgtatccgcttttcattcacgaaggtgaagaggatactccaatcggggctatgcctggatgctacaggcttgggtggaggcatggacttgtagaagaggttgcaaaagcacgggatgttggtgttaatagtgtcgtgctcttccctaaaattccagatgctttgaagtctcccacaggagatgaagcatacagtgaaaatggtttagtgcctcggacaatacgtttgctcaaggataagtacccagaccttgttatctatacagatgttgcattagatccttattcgtcagatgggcatgatggcatagttagagaagatggatgttggatcatggatggctcaaaatgcctaacgaccgcatgcctaagcaccaagttaggttctgagtgcaaggactccacccattcaaaccatgacaaagcacattcctctattgccatcataactgcttgtaactcttcaacagaatccctttcaactgaaaatacttctcaacctggagttattatgaatgatgagacagttcatcagctatgtaaacaagctgtagcccaggcccaagctggagcagatgttgtcagtcctagtgatatgatggatggtcgggtaggagcactgcgtgcagctcttgatgctgaaggctttcagcatgtgaagcctggtcttccttacttggatatcataagtctgctcagggataattctcctttgccaattgcagcataccaggtttctggtgaatacgcaatgataaaggccgccggtgctctcaaaatgatagacgaagaaaaggttatgatggagtcactgatgtgcctccgaagggccggtgctgatatcatcctcacatattctgctctgcaagctgccagatgtttgtgtggagagaagaggtga

SEQ ID NO: 44364 - DNA, 285 bp, Glycine max
  Peptide Sequence Number=SeqID_161142
atgatcagttttaaaattacagggagtagtaacctctggaattacgtattatgtgcaagggttggtattgcaaagcaaaggaccggctccttcatttttgccgagcagcttcacctgggcagtatcattggagccatcattatcgcactgggtctgtactctgtggtgtggggcaaaggcaaaggcaaaggcaaaggcaaagactattcagaccccacgccaccatcacctactacaaagaaaacggagacacagcacctgccaattacctcatctgatatctaa

SEQ ID NO: 44365 - DNA, 1002 bp, Glycine max
  Peptide Sequence Number=SeqID_161143
atggtgaagttcacaattgttgttatcttcttgttctttatgtttcccattgcatttgctgatcttagggttggattctatagctctagctgcccaagagcagagcaaattgtgggtcaagttgttcagaggagattcaaccgtgatagatctattactgctgccttgcttcgcatgcacttccatgactgctttgtcagatgcaacccaccttatatctctcaaagcgcattaaaatgcattgaaaagtggattaagggctgtgacgcgtccatattaatagactcaaccaggggcaatcaatctgaaaaagctgcaggagcaaacggcaccgttcggggatacgagctaatagacgaaataaaaaaagccttagaaagagaatgtccatcaacggtttcatgcgccgatataatcaccctggccacacgtgattccgtggtcctagcaggtgggctcaaatacgacgtcgcaacgggaaggcgtgacggacacgtgtcgcaatcctccgaagtgaacctgccggggccacgatccactgtgtcgcgggtgttggaagtcttcagcgcaaacggcatgtcgttggacgaaatggttactctcttgggggcccacaccgtaggttttacgcactgcagtttcttccgagacaggctcaacgaccccaacatggacccttctttgcgggccgggttgggccggacttgcaacaggcccaacagtgacccaagggcgtttttggaccaaaacgtgtcgtcgtcgatggtgttcgacaatgcgttttacaagcagattgttctgaggagaggggtgcttttcatcgaccagcaattggccttggacactttgtcgaaagggttggtcacagtttttgcggggaataatgcggcttttcaaaggagttttgcagatgctatggtgaagatggggaacattaaggttttggtagggaatgagggagagattaggagaaattgtagggtttttaacagtgcttcctaa

SEQ ID NO: 44366 - DNA, 252 bp, Glycine max
  Peptide Sequence Number=SeqID_161144
atggcgtttgataatgagttctataaccagattcgtttgaagagaggggtgctttacattgaccagcaactggccttggaccctttgtccaaagggttggtttacacttttgttggggatgatgtgctttttaaaaggaatttttctgatgctattgtgaagatggggagcattaaggttttggttggggaagttggagagattaggagaaactgtaggttatatatgtacgttgatgtgcagggattctga

SEQ ID NO: 44367 - DNA, 939 bp, Glycine max
  Peptide Sequence Number=SeqID_161145
atgaagatcaaaatcctctacttttacttcatacttcttcccttggcattcgcggacttgaaggttggattttatgcatcctcgtgcccaaaagctgagtccattgtgaagaaagtggtgcagaatcgattcaatcgtgacaaatccattactgcagccttgcttcgcatgcatttccatgactgtgctgtcagaggttgtgatgcatccatactcataaactctaccaaggccaacacggcggagaaagaagccggagccaacggcagcgtccggggctacgacctcatcgacgaagcgaagaaaaccctagaggcagcatgtccttcaaccgtgtcctgtgcagacatcataaccctagccacccgagacgccgtggccttatccggaggaccccaatacgacgttccgacgggaagacgcgacggattagtctccaacatcgacgacgtcaacattccaggacccaacactcccgtgtccgtgacatcacagtttttcgcgagcaaaggcataacaacacaggaaatggtgacccttttcggagcacacaccgttggtgtcgcacattgtagtttctttgatggtagactctcgggggcgaaacctgaccctactatggaccctgcgttgaatgctaagttggtgaagttgtgcagctccagaggggatcctgctacacctttggatcagaagagttcttttgttttcgataatgagttttatgagcagattcttgccaagaaaggggtgctgctgattgatcagcagcttgcgttggatgcgactaccaaagggtttgtgtcggattttgctgcgaatggggataagtttcaaaagggtttcgcaaatgcgattgtaaagatgggggagattgatgtcctggttggaaatcaaggtgaaatccgcaggaaatgctcggttttcaaccgcaactag

SEQ ID NO: 44368 - DNA, 279 bp, Glycine max
  Peptide Sequence Number=SeqID_161146
atggaagaaatatgttgtgctaataattttggcaagaattacttcaccaaggcaaagccatatttcttaacggtggcactgcagtttggtttcgcaggagggtacatcttcaccgtagccagtttcaacagtggaatgtgtcgttttgtgttcattgtctatcgcaatgccttcgctgcattggccctcgctcctttgcattcatctttgagagtgttctacttactcaattatctgaagaacgaaagctacatcaaagtcggcttatccttgaagtaa

SEQ ID NO: 44369 - DNA, 846 bp, Glycine max
  Peptide Sequence Number=SeqID_161147
atgaagctgctatttgtttccaaattttctggggaggagtttgacaactttactgcagagaagttgcgtgctgactatgacttgggtcacactatgaatgccaaacaccttccaagaggagaatcatcagtcactgggcccatagttagcagtcccaattcaaagcgatgctactatggcatggacttcaaaaattcatttttaaccccaaaaagattgtctaatgtttttttggggggtgctgaatctttcaaatcaaaataccgagaaactgctgagcaatatagacaacagggtttaagctttctggttagagatgttaagtctactaaaggttctttccagtattttggagtgaaggaagaccaagtacctctaattacggtaacacgtaatgatgggaagaaatttcttaaacccaatttggaacctgatcacatgtcaacttggttgaaggcatacaaggaaggaaatattgccccatattttaagtctgaacctattcctgaagccaacaatgaacctgttaaagtggtagttggggacagtctccaggacatagttttcaactctgggaagaatgaattagcaccaatattggaggaagttgctgtctcatatcaaagtgatgctgatgttactattgcaaaactggatggagttgcaaacgatatcccaagagaaacctttgaagtcagaggttatccaactgtgtacttcaggtcagcaagtggaaagatatcacaatacgatggcaataggactaaggaagacattatagaattcattgaaaagaaccaagacaaacctgctcaacaaggaaaagatgaactagaaaaaggataa

SEQ ID NO: 44370 - DNA, 942 bp, Glycine max
  Peptide Sequence Number=SeqID_161148
atgtggaaattcatgctcaaatgccaccagaaacagttccaagctatcatggagagtaaaagtcagtctcttaagattaacgtgggtctgcaaggagatgaaggtttgaaggccattgtagaacttgaaaaggagcttttgaattggtgcagtcagttcaaccattgggttaagactcaaaaatcttatgtcaagaatttgaatgagtggctcataaggtgccttcctaatgaacctgaagaaacagctgatggtattgcccctttctctccaagtcagcttgatgccccaccagtttttataatttgcaatgattggaatcatgcaatgagtagaatatcagaaactggggtggcagaggccatgcatgaatttgctctaaaactacatgagttatgggaaaagcaagatgaagcgcaacgccagagaatcaaagcagagtatcttagaaaggactttgagaaacagcttagaactttgcacacagaaatgggaggctcagaacatgaccatgataaagttttgggaaagattgcattgtcaaagcttgcttctgatagtggtgtttcaccactagatgatcttaaagtggatttagattctatgaagaagaaattgcatgaagagagggtcaggcataaagaagccatcaaacttgttcgtgatgcagctaataatagtttacaagctggtttgattcccattttcaagacattagagagtttcacttcagaggtggtgaaagctcatgaacaagtcaggcttcaaagtgccggggacaagaaagcacctcttgaattaccctatagaggtttgctcggaacatgtttcagcgatgaaagttttgattctttgctcttcgcggatgtcctgattctgttcgactccattgaagctaaatggctgatccacccatttaagcctcaagaagtcatcttctga

SEQ ID NO: 44371 - DNA, 162 bp, Glycine max
  Peptide Sequence Number=SeqID_161149
atggtgtattcggctgacgagtcggatgttctcacgttagatcactcaaacttctccgacactgtaagcacgtacagtctcatcgtcgtcgagttctatgcaccaagttttgagaatttgataggcataaactcttccaagtgtgtgcagaactgttattaa

SEQ ID NO: 44372 - DNA, 1509 bp, Glycine max
  Peptide Sequence Number=SeqID_161150
atgggctgcagcgggtccaaggtggaggacttccccgcggtggttctgtgcagagagcgaaaggcgttcctcaaagccgcatcagagcaacgctacgctctcgccgctgcacacgtggcgtatttccattcgctgagtgaaatcggccacgcccttcacaagttcgccgaacaagacctcaccaccaccaccggttcctcctctccggttctcacattaccctcggaaaccaaaagcatcaacaataacaaactctcatcctcttccccttctatttctcacgccgattcccccgacggttctcacttacccttatcctctggatccgaattaagttctccttcaccttctcattctcattcttcttcgcctcacattcacgattctccagaaccggacccgcctccatacggatactatgaaaattaccattacgctcactacatgaagaggtctgtccctaatggaaaacccatggtctacgaagagcccgaaagacacgtggcaactattggacaatggcctgatccttcttacggctacggcaacaccggtttctacgggtttcccggtgggaattacccgtattaccctcaacctggaccgtcatcttctccgccgcgtcctcctccggcaccgccgtctcctcctcgcgtctccacctgggacttcctcaactttttcgataacttcgacaatggttacccgggttacccgcctcggctcgggtcgagtgcgagcagccccgattcgaaggaagtgagggagagggaagggattccggagttagaggacgaaacggaacacgaaacgatgaaagagaaagagaaggagtttgttccgttgaagaaggagaagaaaaagatgggagaggagaagggttttggtgttggagttagggatttcggggagggcccttcgaataccaaaacggtgccgttgcagcaggtgagtagcagcgaggggagctccaagacggtgaggtttcacgacggcagcgataacggctccgtcgagaaagagatcaacagcagccccgacactgttgcttccgaagagcgcggtgcgaagaaaggggttagtttcgagattgacgaagcgaccgttacgacggtggacggtgactcttccgttttgagcagcgccaccactttgtccgcacatggcacaagggatctccgcgaggttgttgaggagattcaggatgagtttgtgacggcgtcgaatttcgggaaagaggttgcgttgttgctcgaggtttgcaaacggccttatagatctagggttgctgcacttagagttatcttttccagaatcctgcagatgttagcaccttccaggctaccttcagatcttgtatctatacaattttcttctagggaaataaaattggcgcaagcatactgtggtggggaacctgggaaagacttcaagacaaatccagaaaacctttcatccacattggagaaactttatgcatgggagaagaaattgtataaggaagttaag

SEQ ID NO: 44373 - DNA, 177 bp, Glycine max
  Peptide Sequence Number=SeqID_161151
atggtgaggatgtcgaggtgggcccacgtcaagagtgacttaaagataacgatgatgaagaatggaggaaagacaatgatgattggtgcaactcatgatggaattgtaagggttgaagacaatggacaagaaggagaagggaaagaaggctggcaaattgtgcgtgggttttggtaa

SEQ ID NO: 44374 - DNA, 894 bp, Glycine max
  Peptide Sequence Number=SeqID_161152
atgcctgaatctaactggggttcgcggtggtggaggaactggataggaaaaaagagcgattctagttgtaagatatctaatgaaaccattgctggaattgagatctcattcaaagagaaagatatcaaatatctggagttcctttttgtatattatatggatgatccgatccgtaaggaccatgattgggaattttttgatcgtctttctccgagaaagaggcgaaacataatcaacttgaattcgggacagctattcgaaatcttagtgaaagactggatttattatctcatgtttgcttttcgtgaaaaaataccaaaggaagtggagggttttttcaaacaacaagggactgggtcaattattcaatcaaatgatattgagcatgtttcccatctcttcttgagaaacaagcgggctatttctttgcaaaattgtgctcaatttcatatgtggcaattccgtcaagatctcttcgttagttgggggaagagtccgcacgaatcggattttttgaggaacaacatgtcgagagagaattggatttggaatgaggattcgaaaatatcacacattgatcaatcaaagagagattcaacaactaaaaagaaagatcgatttcttttgtttggggatccttcctttcttcaaacggaacgaacaagagatagaatcagaggcgattccctaaaatccttttctggatattcctcaatgtgccgactattcatggaacgtgagaagcagatgaataatcatctgcttccgcaagaaatcgaagaatttcttgggaatcctgcaagagctactcgttcttttttctctgacagatggtcagaacttcatctgagttcgaatcctactgagaggtctactagagatcagaattgttga

SEQ ID NO: 44375 - DNA, 260 bp, Glycine max
  Peptide Sequence Number=SeqID_161153
gcggtgttgtccttgctgaggtgttgttggctgattcacgattcactcgaccggatatgggttttcacccaacaaaactcaatttcgtgcctagcgatgcggatgaggcgccactcgatgtttccatttgcctgcatgcctttggtattgtggggtgtggttcgtttagtggtgtcaagtcttgcgaacgtgaggacccattccatccagcctctttgttggggacgctggaggatttcaaagtcccacacgtgaaccac

SEQ ID NO: 44376 - DNA, 234 bp, Glycine max
  Peptide Sequence Number=SeqID_161154
atgacagacaaggtagatggagatgtaatccatagattcaaggttcaatcaaacagtcagatttttagcttaatcgtgggtgcaaaggatatgtcattcattcacaaggaaagtaaaaatcctgtcactggtcctgcggtgggtcctgatccatggcctcatcatcggtcaagtgcagcacaggcgtgcctgctggtgatccttacggggtgctcagctccaatattggtgtag

SEQ ID NO: 44377 - DNA, 1369 bp, Glycine max
  Peptide Sequence Number=SeqID_161155
atggaggccatgttaaaattgtctagtctttgtggtcaagagatagatgataagagagatacttccatttgctcagaagaggacttgtgtattgaaaagggtagtaaggaagataaacttgaatctgctaaagctgagatgagtaaggtgaaggaggagaatgaaagattgaagatgatgatagaaagagtaggaaagaattaccattctcttcaacttcgtttctttgacatccttcatagagaaacttcaaacaaaggtgtggaagattcagctgtttcccttgatgaagtggaggaacctaagcttgtgtcactttgtcttggaacaagtccatgggagcataaaaaggatggaataatctgtaactctagcaaacataaagaaaatgaagatttggaagccagccttacccttggtttagactgcaaaggtgtgtcttcaaaggaacaggtatctgatatgaacacctcagaagaaaaggaagaagattcaacaaataaattagtaaggaccaaagatggaggtgatgaaatttcagagataacacccccagccaagagggctagagtttgtgtcagagcaagatgtgatagtcccgttatgcatgatggatgccagtggaggaaatatggacagaagatagcaaaaggaaatccatgtccaagagcatactatcgttgcacacttgctccagcatgcccggttaggaaacaggtgcaaagatgtgctgatgacatgtccatcttaatcaccacatatgaaggaactcacaaccacccaattccagcttcagccacagccatggcttccaccacttctgctgctgtttccatgttgttgtcaggctcttcaacatctcagcctacagatcacagttttgcctatcatgcaaattctcctacactgttcagtggtgtcaatttcagtcttttagaccaaccaagagcaaaccaagtcttgttaccaaccccttcctcacatttactcccaacaatcactctagaccttacttctactccatcctattcattaaatcaagggaattgtttaccatcaaactttgcttcaaccccaagattccctccattaagtctaaacttttggtccccagagtccaacattccactatccttttggggcaagggaattcctaacaatggcactattcctattgacaaaactcacatcaagccattcaatataggaaaccaatttcaagaacatttctaccaacattacttcaagaaccaaactccattcagggaggctttggcagaaacactaaccaaagcaatcagcacagacacgagttttcggtcagcgatagctgctgcagtttcatctataaggggacaaggatcaagca

SEQ ID NO: 44378 - DNA, 165 bp, Glycine max
  Peptide Sequence Number=SeqID_161156
atggagaagaagctttggaagggaatagctataatgtcaaacgtaaaggtgactcttggagcaagaacagggtcagaatttaaaaatctgatcaagtttgtagcccggatttacaacaaaacgtacatcttcggcccaactgaacggttcaaagagcaaacttaa

SEQ ID NO: 44379 - DNA, 927 bp, Glycine max
  Peptide Sequence Number=SeqID_161157
atggggattgagaggaccttggctgatagaaaaggaagagacttttgtgaattgccgagagaaaccattgccagcagcaactcaaggaggaaccggcggcgacagaggaagaagccgccggttcagaagctcttcgagacttgcaaggttgtgtttgcctctgcggggacaggctttgtccctccccatgaggacattgacgagttgcaatctgttctagatggaataaagccagaagatgttggtttgagaccagatatgccgtatttcaggacaagtgccacacagagagtgccaagaatcacgtacctgcacatttatgagtgtgaaaagttctcgatggggatattttgtttgccaccttctggggtcatccctcttcacaatcaccctggaatgacggttttcagtaagctactttttggcactatgcacatcaagtcatatgattgggtcgttgactcgcctcctgaatctcctacaactctcaaaccatcagaaaggacttcctctagtgaccccaatagaactctcaaataccacaaaaccctcatgtacttttcaagtcatagggatgtgaatgaccaaggtcctgagatgaggttagccaaagttaaggttgatgctgatttcactgctccttgcaacccttccatcctttatccagaagatgggggcaacttgcactgtttcacagcagtgacagcatgcgcagttctagatgtgcttggtcctccatattctgatgctgaaggcagacactgcacatactaccacgatttccccttttccaacttttcagtggatggattatccataccagaagaggaaaagaatgcttatgaatggctacaagagagggatgaacttgaagacctagaagtaaatggaaaaatgtacaacggtccaaagattgttgagagctaa

SEQ ID NO: 44380 - DNA, 156 bp, Glycine max
  Peptide Sequence Number=SeqID_161158
atgatgagaaattgtgagggtgaagcagaggtgggtaaagattgtggattgatatttgatataaaagaggcaggaagaggcgctggcatggtgggctccgtagatcgtaccatgagttcagatatgctcgcccaggctcagaaacaggggttttag

SEQ ID NO: 44381 - DNA, 240 bp, Glycine max
  Peptide Sequence Number=SeqID_161159
atggccctcttggattttcctgctatctgtacccctttgtcctgtgactcacctatgattctattacccacgcttcagaggtggaacagtagcttgaacaagtggagcctagacgggttcgcggtcgcggtgggtgacagctatccaggagtttctcctcatggagacgcgccagacctgcggcctggaccaaagtcatcggttggtgcgcctgaaccttccgacgtatctccggtgtga

SEQ ID NO: 44382 - DNA, 270 bp, Glycine max
  Peptide Sequence Number=SeqID_161160
atggcactgccatcgagagaaaggaggcctcattgttgtcttcatcagaggtgggtcctcatcagaagagaaaagttacttatgcttctctgggagtgggtcctcattgggagagagaacaagttgtttttgcttcttccggggtgggtccttatcaaaggcatcaccttctttacgatcagattttggtgtcatctaagagccattgaaggcaacctcgtggttggagtggtcaagctcaaattggacatcgttcaggggtttagttga

SEQ ID NO: 44383 - DNA, 3351 bp, Glycine max
  Peptide Sequence Number=SeqID_161161
atggatcaaaaaacgtggctttggagaaaaaaatcctcagaaaagacaattatagctgctgacaacacagatctcagttcaaaagaaaatgaagaggttcaggcacttgtagctgataaagaagaattggagaaaaacttgaaaagattaaataacaagcttacttcggcactttctgattgtaatgctaaagatgagctggtgaagaaacaaacaaaagttgcacaagaagtaatggaaggtttgaagaaggcagaagctgaagtgttgtctatgaagcaagatctggatgaagcattgcagcagcgtttagtttatgaagaaagagtagtccacttggatggagctctcaaggaatgtatgcagcagttacgatttgttcgagaagaacaagggcaaaggattcatgatgccgtgatgaaggcttcaaaagaatttgaaaaggagcgcctagttctggaggaacagttatctgagacaagtaaaaggcttgcaaaagctgaggctgaaaattctcatgttaataagtccatatttgcaagagaaaatttgattgaagatctgaaaagacagttgaatcaagctgagacagatcactgtgctctgatgaatagattagagtccaccgagaatgataatacctctctgaagtatgaggttcgtgtacttgagaaggaacttgagatccgaaatgaggagagggaatttaactgtcgaacagctgatgcttctcacaagcagcacttagagagtgttaaaaaaattgctatgttagaatcagaatgtcagaggctgcgccttctggttcggaagcggttaccaggtcctgctgccctggcaaaaatgaaaaatgaagtggacatgttgggacgggattcatttgaaatcaggaggagcaaactgagctcaaccagttcagtggttgaatcttcagttgacacttctcctgagactcccattagaagaatcaacactttgaatgagcagttatatactatggaagaagaaaacaagactttaaaagaatccctgaataggaaaatgaatgagctccaattctcaagagtaatgctttctcgcacagcttccaaacttttgcaacttcagtcgcagattgaagaatcgtctaaagctcacataactgtggaacagctaagaagttacctcacatcacatgagttctctttggcatcaatgtctgatgctggcagcgatgacaaggctagctgtgcggaatcctgggcttctgcattgatttcagaattggagcactttagaagtcgaaaggagaaggaaccattgtcatgcaaaagtgttggagcttcagacatagatcttatggatgactttgttgaaatggagaaattagcagtggtctctgttgaaagaggcactgaaatctcatctgcttcttttaaagccgttagtgaaatcaatggcttctcagagactgggacaaaggataccactcctgaagtagaaggtaaggagatcattccagtgtctgatcacatttcaactgcgacaagtgagaccatccctgaagtagtaggtatggagatcattccagtgtctgatcatatttcagacctcccaaagtcaaataaaaaaacctgttccattgacatattgacgggcaatagtcctggttggcttcaggatgtagtaaaaatggtcttggaacaaacccatgtcacacacaaaagctctgatgatatactcgatgatattagagtagctttgaggtatgtgaacaatcctgatctgtttgactttgattcaagcaaagactctggtcatattgacacccaggatcctccccagtgtattcattgcatctcatgttcaaataattctttggtggcttctggtgatgaaaataacactggcatcttgtcaataaagagaatcacactacaatctcaggaagatctgagtaaatcaattggaaagataattgagattgttgaaagaatctgcctgccttctgtggactatgatagttcagatcccttgcacgaaggagatggggatatcgtttcatacaagaatgtaggaatgccaacaggctacatggttcgtgttttccagtggaaaacatctgaactcagtaatgttttacggcaatttctacatgtgtgttacgatttactgagtggcaagactgattatggaaattttgccaaagaactaacaatattattggattggattatgaatcattgcttttcacttcaggatgtttcgagtatgaaggatgccatcaagaaacaatttgattgggatgagacacagagtgaaggtgagacagagaatgagataagtcattttgcagaggaagacaagttgcagtttccaagggaaaactcgtcatctttgcctcaagtaactactttggatggtcatgatcttcagaatggagagatatattgtaaggagaaagaagaacttacaaatattaaagacaaattgatcagtgcagaatctcaaaaggaagtcttggaagggaagcttcaatcagctactgataggattgaatccttaatgaatcaactccaggaatcagataaaactattgacagtttgagattggagatacattcctttaaagaatcaaatggaaaacttgagaatgaaatcagaaatcagaaactgataatttcaaatcctgatgcacaacattcagaagaagaattaaaagaggctcgtaacaaggttttggctttagaagtggaactggagaaaaagaacagcaattgtaaagaactagaagccaaatgtattgaattgcagttccagcttgaaagcatgtcaaaggagtgctcaaaccatgatattattgagaaagataagccactgcataatgactgggagataacagctgcttcagaaaagttggcagagtgtcaagaaaccatccttaatcttgggaagcagttgaaagcgatggctgcaccaaaggatgcttccctttttgacaatgtcattgctgcccaatttaaagcaaataccaacactgccgccaccaccaccaccaatgtggatccaagtcttgcccctccaaaatttatgaaagtgaaaagtcgatctctactcgatcagatgctagccgatgatactaaagccaaggttcccaaaggaagcaatgacaactcgaacccgatcaccattcctggcgttctagagcccctggaaaagattctagttttgaatggtgttaaggatcacgaagacagaaccactgataattctttggccattgtaccagctaagaaaccaggaagtggaagtttgtggaggaagttattaaggagaaggaaaaaaagtgccatcttgaaaatatccctctag

SEQ ID NO: 44384 - DNA, 306 bp, Glycine max
  Peptide Sequence Number=SeqID_161162
ggacatttcaacttcttcaaaaagtattgcatgctgttggaagagaattataggcaattgaagaaacttgtgcctatcgaagaaaagtctgtttctcagatcagaaattcatccatactgagaaatgaggattatttttcttcatgtgctatgctatctcttaatgccaaggatcctcaagaattgccatggaagaagactgttgttccaggggagtccatttcaactaagactccgagtgatgcacaagaaaagaaatacaaagagcttgctgaattgggaggaataaatattggaagagaatag

SEQ ID NO: 44385 - DNA, 480 bp, Glycine max
  Peptide Sequence Number=SeqID_161163
atggagataaccaaatcacttgtctccaacaacaataataaaaagaacaaatgcacaccttccaggttagtagggcctgatggtgttggactgttggtactgccttgcaaagttgaacttaaggatgactcaagcttgctagttgcaacctatcaaccactaccagcagcattcacaaagcaaagcagctgctacaccaaagcaaatagtttctatataacatgctcaaaactaaagtactcaaatcaaaactggagaaacagtgttgggcttggttggaaaaggatgaaagagaggctgagagacaggaaaatgcagaggagcaaagtgcagagagtgagaaacaggcatatgcggcttcacgatgcaaaaaacaagggtgaagtagtggcaatatgctgtagcagggggtgggctatgcaatttccttgtgtttatgagaagagtaggcttgaaattcctatggctcacaatgtgtga

SEQ ID NO: 44386 - DNA, 462 bp, Glycine max
  Peptide Sequence Number=SeqID_161164
atggttactgatggaaccaaaaagcctcaagtttcagtacctacaccaccaccaccaccttggaaaatcaatttgcagaaatatgctgaatcccgtgctctcgaactccatagtcttcaatctatcataaaaaatagagtaaacagtgattataggtctcaaaagaacaagagaagaaggaaaactgtgtttgataaccaaatttcaagaaaatggtgcagaagaaaggggcaaaaactgggaataattgataaagcccttgccaaatcaggtttggaggagaatcaccaaaagaagcttcctcggtgtgttcatcggagatatgaactaaagaaaaacccagagaatggtttttgcacttctggggatgtaaccaagaggctgagaactcatgtttggcatgcaaagtggtttgctatgaccaagctttggggttaccaccttcctttgtgtcttcaatga

SEQ ID NO: 44387 - DNA, 1500 bp, Glycine max
  Peptide Sequence Number=SeqID_161165
atggaacctcgggttgccaacaagttccgtcttggccgcaagattggtagcggatccttcggcgagatctatctcggtacgaatacccagacaaatgaagaggttgcaattaagctcgaaaatgtcaaaaccaagcatcctcaattgttgtacgaatcaaagttgtataaaatactgcaaggaggaactgggatcccaaatgtgagatggtttggcattgaaggagattacaatgtccttgtgatggatttactgggacctagtcttgaggatttattcaatttctgtacccggaaattgtctctcaaaactgttctcatgcttgctgatcagatgataaatcgagttgagtttattcattccaaatcatttttacatagggacatcaagccagacaacttcctaatgggtttggggaggcgtgcaaatcaagtttatgccattgactttggtcttgctaagaagtacagagacacctctacccatcaacatattccttacagagagaataagaatttgactggaactgctagatatgctagtatgaatactcatcttggaattgagcaaagccgtagggacgacttagaatcacttggatttgttcttatgtattttttgagaggaagtctcccgtggcagggattgaaagcaggtactaagaagcagaagtatgagaaaatcagtgagaagaaagtttctacttctatcgagtctctgtgccgtggctacccctcagagttcgcttcatacttccattactgtcggtcactgcgatttgatgataaaccagattatgcttatctgaaaaggcttttccgtgaccttttcattcgtgaaggattccagtttgattatgtctttgattggaccattttgaaatatcagcaatctcaaattgccacacctgttcgtgttattgttcctgctgctggacaaagttctgggctgccaccagctgttgtaaatgctgatagacagacaggtggggtgaacagtaggcatactggttggtcttcatctgatcctgctcgaagaagaaactctggacctattgcaaatgatggaatgtcgtcaagacaaaaagccccagttccaagtgattcaactggatctaaagatgttatgttgtctagttctaatttccggtcaagtggatccacaaggcgaggtgctgtatcgagcagtcgtgatgcagctgttggcaatgagactgagccctctcatcctctcaccatggatgctagtccaggagcactccgtaaaatctccaatgctcaaagaagttcacctatcatgtcatttgagcacaacagaacatcctctggaagaaacacatcaaacatgaagaattacgagtcaactctccggggtattgagaccctaaatttcaatgacgagagccaccaactggtaaaacgaccactgctacaatactacaaatttcaggggctctttcacgtgcaaagaaggaactacaaattcgtaagcaagatgtga

SEQ ID NO: 44388 - DNA, 1011 bp, Glycine max
  Peptide Sequence Number=SeqID_161166
atgtcagtcattgtgcgtgatgaggagggaaacatcattcttttctgcaaaggagctgacaggacactgggaccttctattggtttctacaatggaatcattaaaatcctattcatgcttgtggagtttatattctacttactactaccatactatacaatcacagcaactccctgcttccagaggatgcctgtgaaaatacacattatcatatttgatcgactgtctaagaatggaaaaatgtgtttggaggctactactagacatttgaatgaatatggagaagctggtttgagaacgctagccctggcttacagaaagcttgatgaccaagagtactctgattggaacaacgagtttcagaaggccaagacagctgttgggtctgagagagaggcaatgcttgagcaggtttcagatattatggaaagagagttgattcttgttggggctactgcagtggaagataaactacagaaaggggtgcctcaatgcattgataaacttgctcaagctggtctaaagatctgggtattgactggggataagatggaaacagcaatcaacattggattcgcttgtagtttacttcgacagggcatgaagcaaatctgtatcacaatgaattcagattctgtaactaatgatgggaaagaggtcatcaaaggcaacatcttgagtcaaatcaccaatgcttcacaaatgataaagctggaaaaggatccacatgctgcatttgcattaattattgatgggaaaactctaacatatgctttagaagatgatgtcaagcaccaatttttgggattggctgttggttgtgcatctgttatttgctgtcgtgtgtctccaaagcaaaaagcattggtaacaaggttagtgaaagaaggaactgggaaaaccactttagccataggtgatggtgcaaatgatgttggcatgattcaagaagctgacattggtgttggaatcagtggggttgaaggtatgcagaaaaatgactggggctag

SEQ ID NO: 44389 - DNA, 549 bp, Glycine max
  Peptide Sequence Number=SeqID_161167
atggcttctacagagggtctagtgcccataactagggcctttctggcctcttattacgacaaacacccttttactcctctttctgctcatgtctccacgctttcttctcagattcgttcaatggctaatgattttctcactcagcatcctcctatccaaggagagagcatcttaataaatgaagctgaccagcaacctccgcacaaaatggatgagaacatgtggaagaatcgagagtacattgaagaaacaatttttttacttcagagttctaattggccagaggcgctgaagcagcagtccacagctgacagtgttgaatttgccattacgcttgggaaactgaaagataaacttcatattacattgaaggctttggaatctttccaaactaaaaatgctgaacatgaaaataaggagagacatgggaaatttatgggccagctgaccaagcttatgtctttgggaaaaccgcaagaacaggctgatatctttgggaaaaccgtgtggttgactcatacctccggtgaagttgctaggctagactga

SEQ ID NO: 44390 - DNA, 909 bp, Glycine max
  Peptide Sequence Number=SeqID_161168
atgacgaaggtacacccaaacgctaacgcatctgtgtgtgtgtcggagacggagacggagaagccaaataaaaatagtgatgcaatggcagtggtgctaacagtgtggaagaagtctctgttgccaaactgcaacggattcaccgttttcgacacccaacgagggaatctggtgtttagggtcgataattacgtcgcgcggaataaggatcagatacttctcatggacgctgctggcacacctctcctcaccatccgccgcaagaggctaagcttggtatcagacacttggctggtgtttgaaggagagggctccgtcaaacagaaactgctttttacagccgcgaggaagaacgtcaacgccaagtgtactttggcacacatcttcaacatcaagaaggaagtagcatatgagatagagggatcatacgcccaacgttgctgcacgttttacaacaacaataagataaaagttgcagagatgaagatgaaagaaacttttggcgcagatatcttccgtctcttcgtacagcctcacatggacaccactctcgccatggcctttgtcatcctccttgatcacatcctgccgtgtctaaagttcactgataaaatgataaaacaggagcgtgtttatactggagacagagactgtagaggaggagaggggctattctactctattaggaaagttcataccaaatctggtatagtggaagcaaaatttataacatgtttggctggtagtgaagtgagtatggggaataaagtggctgatgtcagtcatgtgatcggttggctatatgcaggggaaggggtgactttaaatttcaatgtctattttgctttgaaaaatttatgggtgataaggttgtattcatggatgccatactgtcgagttggtctatga

SEQ ID NO: 44391 - DNA, 510 bp, Glycine max
  Peptide Sequence Number=SeqID_161169
atgaaggtaggatctggtaaagggagaaaagtgtgcctgtcgctgacaggtgttgtgattgcaattgtattgctaattgtaatactagcgttgacagtgttcaaagccaagcatcctgttaccacagtggactcaacgaagctagaggactttcacatgggcttggatacaccaaaactaagggtcgatttgaatgtgaccctgcacgtggatgtctcagtgaagaacccgaacaaggtgggattcaagtattcagatagcaccgcccacctcaattacagagggcagttgataggtgaagtcccgatccctgccggagagatttcatccggtgagaccaaaggattcaacctcaccctcaccattatggcggaccgtcttctctccaattcccagcttctctctgatgtagcgtctgtagcaaagccatttgtggcactagagcaggaaaagaatttcagtcccgttattgcacgtactcctacccgcaagttattacaactgacatga

SEQ ID NO: 44392 - DNA, 2676 bp, Glycine max
  Peptide Sequence Number=SeqID_161170
atggtggcatcgttgcacttgcacatcagaagaatcgtctttaggaacgcacatcccagacttcactcaacactcactaaaccccagctcaaggccctcgttctcgaccactactcccatggcaagttcgccaaccttatccaaaacgttgtcgcgtcgccccccgtcctcctcactgcatgccaaaacctctccccctcctttccccccccggaccgcttcagcatcccggccacgtgccttgagctcctcgaaaaccgcttcgacgtggcatcatgctgcctcccactaactccctctttcgttttgcccaacttgaagctcaaggtcgtcattgaggccattcgaatggttatggaaatcgtctacgacgaccgcttcgtcaccttttgctacggtggccgcgtcggaatgggacgacacacagccataaggtacttaaaaaactccctcgagaaccctacttggtggttcaccgtcaggttcaagcctcacaggtttcaacatttccatgtcgagaagctctgttctgttattgaacgcaaagtcaacgattccgttttcattgatttgataaagaggttgtttcaatgtaaggctttggtcattgaattgggtgcggattggttaggaaggggacttcctcaggaatgtggcttgtgctccattttgatcaatgtttattttgatgcctttgataaagagattcaagagatgcgtcttcgggagaatcgagagaaccgggaattggatccgaagattattgcttcgggtttgtattctgatgtgttttacaagccggtgaaggtgtatgcggtgaggtacttggatgagatactccttgccacatcagggtccaagatgttggccttggagttgaggacgggggttgtcaagactttggaacttggattgggtttgcgtgttgataaggtgaataccgcgattcatagcgcggtgtcggagaagattgagtttcttgggatggaattgcaggctgttctgccttccattttgcgcccgccaatgtcggagaaagcaatcagggcacggaagaagtacctcaggcagaaggaagtcagggctcttgaattgagaaatgctagagcaaggaacagaaggaaactggggttgaagatatttagtcatgtttataaaaagatcaagcaaagtgacgggtttaaatttgactttagtattgaaaaccaggtccgagaaatttttagatcttgggctgatgaagtagtgcaagagttcttggggaatatagatgagtgtcaagaatggcatcgaagtctatcagctggcgatttcctacagttgagacacattagaaatcaattaccacctgagcttgttgatgcttatgataagttccaagagcaggtagatcaacatttgaatcctataaaagctaggaaggcgatagaggaagaagaaagaagagtaaaggaagaagaggaacaaaattattcaaaaggaacagttgaggatttgacaaagctctgtatgaaagttgaggcaccagaaatactcataagaaaggctgtgaagttggttgggtttacaaatcatatgggtcgtccacgaccaattgaatttcttgttgcacttgaggatgccgatattatcaagtggtatgctggcatagcaagaaggtggcttgattatttctgctgttgccacaacttcaagacagtcaaaactattgtaacttatcatttaaggttctcctgtatcttgacattagcagagaagcatgaatccaccaagcgtgaagtgataaagcatttcagcaaagatttgagagtctatgatatgaatggaaatcatgaagtgcattttcctacagaaagagaggttaagatgatgggagatagaaatctttctgatccaaaaccagtagatggggctttatctttggctgtagtaaggttggcatctgatgagcctccatgtcattgcattgcccatttctgtgacaagacaactactgtcttttatcgggtccatttgctgcaaaacagattgaatgtcagcccattggacaaagaaaaatgggtacaagggatgggtgtaattcatgaaagcctaaaccgtaagtgcctccctctctgtactgatcatgtaaatgatttgtacatggggagaatcacacttcaagacattgactgttcttattgtgtggatgagacagggtcggtcataggcgttgcagctggactggctaggaacattgtgacaggaatggtggaaggaactgtaatgatggttggtgcatctgaaggtgcgatgagtggtgtaggatttgtggggaaaattgaggttggtgagttatttgtgtattgtagaattattcgggttaggcacttcactgcccagcctgccgatgatgaggacagagaaatgttgcagggccgcttctcactgttggcatgttgctgctcttccacttcttgtgtcaggtgctgctatagctgtcatcataggcaggatgacatcttgaggtctcttggacaggcatcccctggcatgagtgttttggctgcaggttctgctgcagcttacaaaatgttgcaggtggaaaaagggttgaccaaagatgataaggcacataaattagcactaaggcttgaaattgtaagctcatacgtcaacatcttgacttatatataa

SEQ ID NO: 44393 - DNA, 1216 bp, Glycine max
  Peptide Sequence Number=SeqID_161171
atggaggctggcctttcagtaaaagctaatgaagactttgcttctaatagattggaagcagctgtcctcgatctagtggcagatgatggtgctggcattcagaagcaaagatctatgtatcactgggataagaggggtaaaaagtacatcaagttaaacaatggtgatcgtgttgctgcaaatggaaagataaagacagagagtggtgcaaaaacaaaggcaaacaagactggtatatataagaagtggaaagaacgctcacatgttaggatatcacttaaagggacaaataatggtgatcctcaggattcaacaagtttgacaggatcttaccaaagaggtcgtagtaattttaaaggcagcaagaagcagcattcaatgcccaatgctcatgtgcgttcagaactcaaagatatggatcaaattcgaaaggagaggcagacaaaggccaacagggtttcttatataaagagcaagtcgacaaagggtaaaagaaatatcttttatgaaaattatataagaagtgtgaaaagtaaaaggcagagactggggttttggcgctatttggcactcacaagacatcctaggcagcagcagtatctatctattcacttctttgttgtacttccaactcactcatctcaggggagggtttgcctggttggttggggtaaaaggcgtatggcttctggggatctgtgcaaagactcaatgaaagatactcccaccgattgtgtggttcctataactcccgaggctgtcaccgagaatggggatttgcaatctcaatcccctctcacactctcagtggtcaggaaacaactcatacgtgcgtgcattgattgcgattctgaccgtgccttggttgataataataataatgacattggtatcccccgaactcctaaggacggtgtttttgacccctttgcacctggtcctgataacatggcgcgggcacctaacagtaacaagtatcttgacgagtataggaccaccgttgcccggcggcttgatttccatccctcctttgatgttgttgctgaagcagattctgatactctttcagatgagaaaatggttgaatcagtatatgagaatcttttgcaagttattgtttctaagcaagctgagggtgctcttgctcaaatgtccgacgattgtgaaacacccccatctgtactccgcttcactggaattgctgatacttgtcctg

SEQ ID NO: 44394 - DNA, 153 bp, Glycine max
  Peptide Sequence Number=SeqID_161172
atggagaggaaatcacttgttgggctgtgcttcttctttgttgttgtcttagcttctcaaatggtggtggaggctggtaatcgtggtattttgttcccagaaggatgcattgagccagttgggagccaacagtgtaagacaggggaaggttaa

SEQ ID NO: 44395 - DNA, 715 bp, Glycine max
  Peptide Sequence Number=SeqID_161173
atggatgatttgagtatctcaaaaattcctcaggacacactgtatgttcctcagacaatcaaagataaacacaattttgattatgtaattaataatgtagaaaataatattcctttaggacaagacatatgggaagaatttcatttactctcaaaaaattcaattttcgaacataatagaaaatacaaatacctccagataggatgtgtccaagtagcaatcaaaccattaatagacataggtatagatgccacaatcttaatgtgtcttagagatattaggcacaacaaatttgaagattctttaataggaatagtcgaaacaagtctaggacaaggaccagtctatttcaactgttacccaaacaaaacagtaagtctgatggatagaaacattcttgaatctctgttcttaaacatccactttcatggacttaacatgaaagaaggatcaattccaatagccttgacttataggatccagtataaggtcataaacctccaaggattagatacaacttctagtatacctagaaccacacataacaagaacaagaggatgaccaaaagtcaattcaatctccaacatattcttctatgcatgaaccttatgatgttatctgacaaatttagcattgataaggaaatccttaggaaagatttctattctccaaagaatgaacctcaaaggagatggttttttcaacattttaagg

SEQ ID NO: 44396 - DNA, 210 bp, Glycine max
  Peptide Sequence Number=SeqID_161174
atgggtgccaagtacctcgaagtggtcaaacgagggtcgcatcccaacaatggatggtccccagacgaaattagggtgattctattctacccacatctgttcatttacttgcccttgattcctcatgatggcaagcttattttatttatctatctcccaaattcctttgcaaagactcaacgtataaaatgcatgaagtatgaattctag

SEQ ID NO: 44397 - DNA, 267 bp, Glycine max
  Peptide Sequence Number=SeqID_161175
atgcctcaatgtgaccatttcagttcaattggagttgacttcgttaagttacaagttgacttgtctcaacttttcaacgagatcaagcatctcattgtagggcctcagagaggcagagaagtcattgagcatgatagcctaaatgaagaacacaagggattggaggaaggggatgtcgtggtggacacaagtgcatttctgtatggcgtagctgacaatagatggggagattgggagagaggcaaagattgtggaaaggcaaggtag

SEQ ID NO: 44398 - DNA, 129 bp, Glycine max
  Peptide Sequence Number=SeqID_161176
atggcatgcctgcaagtcaacggagacttggacgtcagtgatggtggtgagagaagagaggttaagtggtggctggacagaaatatagaaatggcaataactgaagctacagggctccaaatgaggtga

SEQ ID NO: 44399 - DNA, 243 bp, Glycine max
  Peptide Sequence Number=SeqID_161177
atgaaaagaaaaaagcgagcatttgctaagcgcaacactcagtggctaagcccgaggaagaatccagaagaacatgagctgtcaggtttactgagtgcaccactccaggtcatcaagcgcaccgcttcagctcatccactaagtgagagaagcgcgctaagccaaaaattagtagcgtgcgttaagcggtccatacatgcgctaagcacacgagcacgaacaaggccacctatttcagcctga

SEQ ID NO: 44400 - DNA, 276 bp, Glycine max
  Peptide Sequence Number=SeqID_161178
atgagttggtccccaactttcattggccaattaacatcggcctctaagagggtggtggagggaactcatgagaatggacaacagaggtggtggttggtgattgttgatggtgatgtgatggctatgggaggtgttgtaggggttataggttgtgtcggggttagtgcactaatggtggtggtggtggtggtcgaaggtgtttgggttgtgaggtgggtggtggttatggtgtttggtgaaggggaaaggctagggaagaagaaagtgattatgtaa

SEQ ID NO: 44401 - DNA, 450 bp, Glycine max
  Peptide Sequence Number=SeqID_161179
atggcagccacaagcacggataagttggaggcaggaacggtttcaagttatgacaggaaaagtgaaatcaaggcatttgatgattcaaagactggtgtccaaggactggtagaaaatggtgtaacaaaagttccacttatgttctattgtgaaaactctaatctcaatgatggcataaccagtgcatcaaattcaaagatcagcatccccataattgacctcacagtcatccatgatgatcctattttgagagatcatgttgtgggaaaagttagatatgcatgtgagaagtggggcttctttcaggttataaatcatggaattccaactcatgttttggatgagatgatcaaaggaacttgcaggtttcaccaccaagatgcaaaggcgaggaaagagtactacactcgcaaacacttgcacatgttaggacttaataatggtggataa

SEQ ID NO: 44402 - DNA, 399 bp, Glycine max
  Peptide Sequence Number=SeqID_161180
atggggaaattggtcaagcatgtggcagatttgatggagcaaacaaagattggtttcttagccaatactaaaaccaatcccaagggttattgtagtgccatctttactagaagtggtggtgagtatgacactggaagtgagggtgaagaagaactggtaatagagggtgttggattgaacaaagttagagaaatgagtgctaaagaggaaaagttaaaagccaaaccccccattgttgtagatcttccttattcgaagaatccaactaaaagggataacgtggagatcgtcaatgttgttattgaggttagggatggaaagtttaagcttggagcgggtaatgaaaaggttacattcaatgtcttcaacgtcgtgagcccttcaaggggttggggttga

SEQ ID NO: 44403 - DNA, 525 bp, Glycine max
  Peptide Sequence Number=SeqID_161181
atgggtgatgatcctctgagtgtagcgaggtggaaaggggaacagattgagggttcttcgaaggaattcaggagtatctttggtagatatgagaaagtgaaggaggttttcatagttgagaggaaaaataaatggggtaggagatttggttttatttgcttttcagatacagaagaactggtgatttcttttccccgaaaaagccactgcatcggcctcaccaagtttattcatatagggagctgtaccaacataaagctaaagatgaaggggctgccagttaagaaagtatggagagtgaaaaataacaacgacaagaagtctgtaggggatgattggaagggtatggtaattaatgtaaacttagatgataaaagttggctcacagatagctgggtggggactcttgttgatcttaaaatgaatgatagatcacgtaagattcatgttatggatggaagtgaggaggttaacctgagatatatgggtggggatttagtactaacaacagggggtgtccgatga

SEQ ID NO: 44404 - DNA, 1746 bp, Glycine max
  Peptide Sequence Number=SeqID_161182
atggaattcctatatgctctctacgtactgttaaaaagccttgatcactcactcacccttctttgccaatgcaacatgagccgattgagaaaactgcaaaaaacagaagggcaaaggagaagcccacgaatatctgcattggaggctgaggctcatgtccattcaatgaggcgccacttggacaacggtcagggacctgcattccgaactaggggcagaaagaacacaaaactgaggccaaacaagttcacactcacaagccacattatgcagggtgtgaagcattcctgccatcaagatattcaaaagaaaagtggtgatgataaaccatcaaaactgccatcttcaccttcgttgcctgagaaacaaatacttcaacttgtacttgacactttacaaaggagagacacgtatgaaatatttgctgaaccagttgacccaaacgaggttgaggattattatgcaatcgttaaagagcctatggattttggcaccatgagggctaaattacacgaggggatgtacaggagtctagaacaatttgagcatgatgttttcttaatattcgacaatgcaatgcattttaattcttctggtaccatctatttcaggcaggctcgtgtaatcaatgaactagctaagaaagtttttgatctattaaaaaacaatcctgagaagtttgaattggaattctcagaaacaaggcgaaaagtaggtcggagaaaccaaggagattctagggattccacagacctgaaatccagtgaaatagctagtggtgtgccctcaaaaactgtgccatgttcttctcgtggtacaccaaacaagagaagctttaaggcaaatcatgggtctaagcatgttgagattactgcaggtactgaagagagaagcagaggcagatcttctgagattgataggcgatgtacttatagacctttgtcccttgaggaggataagtcaatattttcaacagtatatggtaaattgaaactgcttgagcacgtaaatcagcaagatattggctacaaagatagcttgatgttgtttgctaaagatttaggacccactgcacaaaatattgctaaaaggaaattacttggatgtgaaattcgtacagcatctacttctgctccatgcaggccagatacttctaatggaagggaaaaggttgaaggcacattgaatgctgaaagagagaaagactgcaggcccttagatggtaatgctttgggatgtcacaggttgtccttagggtgtcacaaagagttcccaaacaagagtttctgttttgattcatcctatttgcaagcttgtgctgaagattttacttactcagatcaaggatccaaagaaactggtaagaagtctgtgaggatgttactggacagatcaaagttgcttaatcaagaaaatttgtctgtttcagtcctagagaattttaaagctggtagtgtggtaaactcaaggttagaaaacagttgtgagcttcaaagtcaacctcaggccatagaaagtagtgatgtttcaggttacgttcaagaaaaaagccaattgcaaaacaatttcatgtttcgttcaaattgtgcaatgggtgatcgtgaaggaacaaatgagattagttgctcagctgatcaggccatgaagattttaaaatcagaccaaactgtgtcgtcggcttctagttttgttttcaatcttccatatttgaagacacgacttgatcagataaattcctcagagtaa

SEQ ID NO: 44405 - DNA, 1152 bp, Glycine max
  Peptide Sequence Number=SeqID_161183
atggcatacaggagaagacacggaatatccagagcttccaccttcaaggaagaggttcatccagatcatgataatgccaatgacccaactcctcttccatctttgtcctcttccttttccttcactccatcttcctcatcctcccttgctgctcaggccatcaaagcctctgctgctcgtcgtgatccctctctttcttttacttttcccaaatctgaacatgatcaacatcacagatcaaagagctttgacgcttacggggatgtttccaagtctggtgtgtggggcgtcctcgccaagaaagccaaagaaattctagaggacgacaagtcatccccacaacacaacaacgtcgtcaatatcaagcctgtcgtcgacatcgacaaactcaaatcacactcttttaatacctttgctcctaataaggcagcaggagatcacagaactccaattaaactaaaagaaatttctccagatcaatcaaatcaaactgcagcagatacgtggaatccatggcagcaaccagaccagacaggaggaggaggagcctctcaaactatccatgaaacacaactcaaggcatctcgcgacgtggcaatggcaacagctgccaaagcaaaattacttcttcgggagctaaaaaccgttaaagcggatttggctttttctaaagcacgctctgctcaactagaagaggaaaacaaaatgctccgggaccgcgagggtaccgacaagggacaaaacgttacccgtgcagatgatgatttgatccggcttcaactagagacacttcttgctgagaagggtcgattagctagtgagaacgaggtatatgcacgggagaatcgttttctacgggaaattgttgagtaccatcagttgaccatgcaggatttggtgtatcttgatgagggcatggaagaagtcacagaaatttatcccttagataccactggcactgtggttcctcgggtgttgccaaagtccccacgctcgcctttaagtcgaggaggctcgcatactaaatcatttttttctgtgccacaaatactagaacaagaacaagaaaacaatgttacatcagagttagatgaggctcctcctagtatcgatatctcagtctcagtttctaaagatcagcatgcaaagtga

SEQ ID NO: 44406 - DNA, 321 bp, Glycine max
  Peptide Sequence Number=SeqID_161184
atgacgaaaaatgagtcaaaaccaaataaaacacatatgatacaggaagcctcaatctctaccctttctgcccctcaaagattttatccagatgggatgagacctgagtttgactttggggcattaggcatatataatgccccatgttggaatgtagaacttcgtgatggttcaggtggtactcaagttgtggaggttccaagggcaccattggcggaaggattgcctctgcctccaaacatacaggagactgagaacagggcccgtgtgtctgctttgagaagtagagctaggaaacgaaagggtaagggtaattcatag

SEQ ID NO: 44407 - DNA, 1062 bp, Glycine max
  Peptide Sequence Number=SeqID_161185
atggggcatcactcttgctgcaacaagcagaaggtcaaaagagggctatggtcacctgaagaagatgaaaagctcataaactatatcacaacttatggacatggttgctggagctcagtcccaaaacttgcaggcctgcagaggtgtggaaagagttgcagattaagatggataaactatctaagacctgatttgaaacggggaagcttctctcctcaagaagcagcactcattatagaacttcatagtattctaggaaacaggtgggctcagatagccaagcacctacctggaagaacagataatgaggtgaagaacttttggaattcaaacataaagaagaaactgctttctcatgatgttgttccttctttagccacattttctgatattcacggtcctcccaatagttccatggaaagtttcttccctttaactgacaaccctatccttaactcccatcatcacttagaccagctattccttcccatcatcccatccccaatcctacaagcctttgatcatcatcaccataataatgatatcaaacatattgacataaacaattttaataataataatgccaatttcctacattttcagaatccaatgccagaaacagtgcctccaatatccaacaatattccatctttgtatcaagaagatacatggtcttcattggggtgtgtacctattcatcttaatccaaatcaagaaaatcaaatcatgatcaccaaaagtgatcatactaccccacacttgattgttgacaaattcgtcaatccaagtacatggcagcagcagcactctgtggaagtggaaccccccattgtaccaaaagtgtgtgagagcattgaggattatgtctgtagcattccatattcttcttctgctaattcacatgaggaagctgttgcgtgttacacacctgcagttatttgtccacaagatcaaactgcagcaccgaatcaagtggagtacattgatgctctcatcatgtcatcgttgccatccacaacaacatcgtcttcatcagtatcattcttccaagcaaacaaatag

SEQ ID NO: 44408 - DNA, 1365 bp, Glycine max
  Peptide Sequence Number=SeqID_161186
atgctggaaaatgtgaaggacaatgttcctgatttttgcacaggaatgggaatgcttgcgattagcaaggaaggagaggtcacagtgagcttcaagaacaacataaacttgaatgatttctacaagcctgaacaatctactagcttgaagagaaggaaggtgggaaatctgaagctccaaaccacattctcattcaaacatctactttcagcgaactgtggttcacaagaggaagttgaggacttgttcaacaaacgaagccccatggttttgtcaaaaaaaccaaaacaaatgttttctccaacttcctctgaccagcttgatttagctgcattaatgattcagaaagtttacaagagttataggattagaagaaatctggctgattgtgcagttgtttgcgaggagctatggtggaaagattcaatgattactgcttttaacaggtgctccatatctagttttgactctgataaatcagaaaaagctatttcaaaatggacactagctaggaagatggctgctaaggtggggaaagatttgtccaaagatgataaggcacaaaaattggcactaaggcactggcttgaagctattgatcctcgtcatcgttatggccacaaccttcatttctattacttggtttggtttcatagccagagttgtcagccttttttctactggttggatgttggaggtggcaaggaattaaatcttgaagaatgccctacagagcaactgcagagacagcgcataaaataccttggaccatgcaatggttgcatcaatgacaacatgtcttatttgacattggaagagagggaagcatacgaagtgattgtggagggaggaaggcttgtttatagacaaagcagggaccttgtacatactacggaggattccaagtggatttttgtcctgagcacatctagaattttgtacgttgggcagaagaagaaaggtcaatttcagcactccagttttctagccggtggtgctaccattgcatccggaagattggttgctcaaaatggagttcttcatgctatatggccctatagtggtcactaccgtccaacggagaagaactttatggaattcattagcttcttggaggaacacaaagtggacatgacaaatgtaaagagagatccaattgatgaagatgtcccaccttctaatcctgtgaatgaggagccactatttgagtacatggaaggcaatgtgggtgccagtgacagtgccaataattgtggtaaagatgttgaagagaacaagccaatgtcaagcaaatggactactggagtaggtcctagaattggttgtctgagagtatccagcaaatttccaagttcaggcatttga

SEQ ID NO: 44409 - DNA, 553 bp, Glycine max
  Peptide Sequence Number=SeqID_161187
gccccaaagcggcaccaggaccagggccagtgtcttcaccatctaatactgtagagccagaaaagggtttaatggaagaagcatactactatagaggagtgagcaaaatagggtcaagtccaccaagttgtgagcacaagtgttatggttgcactccatgtgaagcgattcaagtgccgagcaccagcagcaggcgcagtcatttgggattgcagtacacaaattatgagcccgaaagttggaaatgcaagtgtggtccttccctctacagcccagaaaactctgtttatacactatgttaccctgcagtgaagttcttcgattcagcttgggatgatttcgcacggtataggctgctgcgtgtatcatgtggtagtgagggaaagcgtgtgccagtcaaggatttttcagacgactggccaaccaacagctcaaagatagcttttgaaaagtttgtgttcatcacgcttctcttgaggaacaatgttgacaaaagagaggcactggaaaacttggacctcattcttttatgccttgatgagattgttggagg

SEQ ID NO: 44410 - DNA, 327 bp, Glycine max
  Peptide Sequence Number=SeqID_161188
atgcaaaacaatgacagagcctctgaatcacatgcggcacacactggtgaatatgcagcatcaacttcaactaattggtacaatttcagctccaatattccctacttgcttatacagagcaagggcaaccaatataattcttctcataattgcacgccatatccaaccacaaagaagcgtttaattctaagcaaaagggtttattcaactagaactcgtggtcgttctggtcccctacagtcactggctctaaaacttggtcgattcaaggtccgagcagtaattgtagacgacattgcaagcgaggaaagcaatcgaaaaagatga

SEQ ID NO: 44411 - DNA, 363 bp, Glycine max
  Peptide Sequence Number=SeqID_161189
atgtctcttctcaatcagttcattttggtagttgctacgtctcaagttaacttctgtttgaaacttcaattttcatcgttgaatgaatacaatgaaagagtgatagctttatacaacaaaaggacttgcagcatatatatagcacatagtaaaaagcaacagcagcagctagcagctcaaaccctacctaattggtgggacgaactgaagcaaaacgctctccaattccaacccagttatatatccaacacacaccaccaagctgtcttacaccctaatccttcacacaccgtagttcagcaacaactggtttgcacttccttctcagaactccttctccagtcatcacaattcttaccctaa

SEQ ID NO: 44412 - DNA, 798 bp, Glycine max
  Peptide Sequence Number=SeqID_161190
gccacgggggtttggctgactaatgcaccttatggcaatgttattgagtgccaaatcatgctagatcacaatactgggcgatctagaggctttggatttgtcacttttgacgatgaagattcagttgaaaaggttttttcagggggaaaagttcatgaaattggaggcaagcagtcatatgatggttttggcaatggaatggatggatatggtgggaatagttccagaaatcgtaatcatggaaaaagaggtggacagtatacagattctgaaatgagcggagcatttggtcattttgatgggaactttgagggaagtgttgccactgtttatggtggctatggatttggatatggtgggccaatgtattgctttggtggttatggactcaattcttatggtaatcctgggggttatggtggcggcatttcttcctatgaagatagtggtggctatgacagcggcaaagtggctaagaaggatgatggtcctacgtacaaccatccttactggaaagttacgtccatgcggtgccagtgccaccaagcatggcaaaagaagaagaggaaaatgacccgtgttagtaagcttgtgaatcgcgttttggacaagtacgagaaacttccggcgagtcttaaagaccacataaatttagaggaaatgttgggaatgaaaatgaagagaagtgttgaaacacaaaacaccacttcctgtggtcctcagcatcctattaatgagaagcttgagcgcttcaaggttcgacctgtttttccctatgaagaggacaacaagaactga

SEQ ID NO: 44413 - DNA, 873 bp, Glycine max
  Peptide Sequence Number=SeqID_161191
atggaggtggaagttcatggtgaagatggttccaaattcgcactgggaagggatcagaaaacagtgtttggacgaggctgcggattcagcacccacgaccgcacagtgtctcgtcgccacgtgtccttcgaactcgaccattcacactcagaggatgctaatgctagggtttctttccaagtcatggggaagaaccccttttgggtgtacgacggagaagcgcttcggctcttcagaaagttcgacaagggtcacctgcaactcggacaccgtttctgcttctctcccaacacacccctctggttcactcttactaatattcagcctctgcctcaacttaaccttgatgaaattcacgtttcggaaatcgatcccgttaaagagtttggttttcttgtgatggggcatgagtttgaccactatcccaaggggatgatccggaatgcaaagaattgggactggttccttgaggaacgtaggaaggatagtgaggatgaggaagatgttgagaagcagaggaggaaaatgaggggaaagcgaaaaatgggcaaggttaatgaagatgatgagtggaccggtgaaagtgaagatgataagggccttgttgccaatatgcggaaaggtaagctgcccaggtactccacaaggtcaaaagacagtaaaggaggtatcaaagataccaaagctagtaaaaattctaaacaaaagaaagcgactagtggtgatgatactggtgaagaagaagatgatgatgatgatgatgagacactgggaggcttcattgttgctgatgaaggtgatgataaggaagaggaaaatgatgatgaagaagaggaagagtttgaagatgatgatgatgaattggatgattaa

SEQ ID NO: 44414 - DNA, 240 bp, Glycine max
  Peptide Sequence Number=SeqID_161192
atgcttgtgaagatgcacctgcatgactgcacgaatacacttactgaagtaaactctcttcagggcagctttggtgttgttgtggatttggccacaatcgaatggcttcttggaagctcaaattgtcgtccttcagggatgttttactgtcatagctcctggtttgatgatgtcagagacagagaagggttacatgttacggtgtggatttgctccattgagactgacataaacacataa

SEQ ID NO: 44415 - DNA, 201 bp, Glycine max
  Peptide Sequence Number=SeqID_161193
atgacaacattggcttgcggaaatttaaataagttgaattctgaggccttacatgtgaaattcaaacccacttccttgtcggatttctgcaataatcggcaagtaaggttgaacttgacctcagccataaagatcgcatcatctcggtataaaatatgcacaacgcaaggaccaagtggtaataaaggaagccgcagttaa

SEQ ID NO: 44416 - DNA, 342 bp, Glycine max
  Peptide Sequence Number=SeqID_161194
atgttatcaaacttaggtttacggtatagttttggaaaatttcaagtgtgggtggtatacgtaattagctatggacaaggcacgatttgggcttttcttcatgttgctcattctccttgcttctcagggaagctaggcactgtgagtaaaagagccatcgatttaaagggatgtgcctcagtgagcacaactgcgcttcggttagccatcttgaaggcttcacaggtggcaagtgttggggatttcgcagacgctgtttctgctccaagcactgttagttggttacatgcaattttacgtacgtctggttgctctttcacgattatgtttcagggattatga

SEQ ID NO: 44417 - DNA, 129 bp, Glycine max
  Peptide Sequence Number=SeqID_161195
atggtcggtcatttgaatacagggcacacattccatactgaaggacatgcaattcatcgaaaagggcacagtttggagctaatcaacggcactttcgcaacgatgctcactgctcagggagggatctag

SEQ ID NO: 44418 - DNA, 291 bp, Glycine max
  Peptide Sequence Number=SeqID_161196
atggaggacaagggacgcgtgaagaagctcaaggaaagagtagaaaggacctgggcaaatgaacttatagtggagaacggaaagaaattaaatgcacttcatacttgctcaatgacacaaggctctatatgcatgacaaaagttgatgctcacccctacctacctcaacagccttaccaattgtccaacatggacttaacaactagcatggattttgataagactactaaaaaaatagttttttacgactcaccttctaatacagttctcaaaaattgtcttagaatgtaa

SEQ ID NO: 44419 - DNA, 306 bp, Glycine max
  Peptide Sequence Number=SeqID_161197
atggggatagaagaagaagaggaatggatagaggaggagaaagggataatggatatagaaagagggtttcccatatctgagatactcaggctttggatatattcattagagagctctaagtctcgcgctgaggggtatttcgacgtccgacgacgaggaacggaagtacctcaggaacttgctcgtgacatcatagctcagcctaaatcaaccttcagatgtgcgaacatggaggaattgaaacacgaggccaacattggtggtgtcggtgccgctgcggtggtggatttagttggtcaagtgtag

SEQ ID NO: 44420 - DNA, 249 bp, Glycine max
  Peptide Sequence Number=SeqID_161198
atggagaaactcaaggatttaatcaagcaagttgcacctacaggggttccccctaatggaattcacatatcacaattgattagacgattgttttttcgacaaccaggtcattctaagtattccgaaaatttgattgaatatgacataacagaattgaaaaatgatgaagacgtgctaaaggaagaagggaagtcggggcagaacccgacttctgtgaagttgctgaaagtggtgtactttgggaattaa

SEQ ID NO: 44421 - DNA, 265 bp, Glycine max
  Peptide Sequence Number=SeqID_161199
atgatgaccaccgccacgccacttaacctgcaggtgcgcccgattatcgccgccgataatccgcggattgcgcaggtgatccgcgatgtctccgccgagttcggcctgacggcggataaaggttataccgtgtccgacccgcagctcgatcggctgtttgagctgtacagtgcggcggacagcgcctactggattgtggagcatgaaggtcaggtggtcggcggcggcggcgtggcgccactggcctgcagcgcaccggatatct

SEQ ID NO: 44422 - DNA, 297 bp, Glycine max
  Peptide Sequence Number=SeqID_161200
atgtcgtttgcggcgggggtggcgtcgccgtattcaattggaaaccaacgctgcgatacgctttatagcggtcgcgcgccagttgtttcagggattcttcataagcaggctgatcagcagatcgcgcggcgcactgccgcgtcgctgcggccaggccagctcaaccggcgcgccgtagcgcgggccttcgccggccaggttgtgcggcacaaaggcgttggccggacgctgccacagtgcttcatccagccgattggcctgctgttcatcttcgcaggcaatcaggatgcgcttacc

SEQ ID NO: 44423 - DNA, 1047 bp, Glycine max
  Peptide Sequence Number=SeqID_161201
atggtggaattgtctatctacttgaacccctatctacttgaaccccacaagaaatgggaggcacttgcttggcctatgttttgtgctgttatcacttatcatgaagaagcaggggagagtgctgagagtcaacatgatgaggtggaggctaaatttttagaggagcgatcaaagctggaggctaaataccagaagctctatgaaccgctttacacaaaaaggtatgagattgttaatggtgtggtagaggttgaaggagttacaaatgttgcagtaccagaagaagccaacaaagctgcagaagacaaaggagtacctgagttctggctaactgcaatgaagactaatgaagcactggctgaagaggtagtggaatttattactgaacgtgatgaggggtccctaaaatatcttaaagatatcaaatggtgtagaattgacgatcctaagggcttcaagctggagttttattttgattctaatccttatttcaagaattccgtgctaacaaaaacatatcacatgattgaagatgatgaccctatattagagaaagcaatagggacggagattgagtggcatccaggaaagtgtttgacacaaaagattcttaagaagaagccaagtaaaggatcaaagaatgctaaacccatcacaaaaacagaaaaatgtgaaagtttcttcaactttttcaatcctccccaggtccctgaggatgatgatgatattgatgacgatgctgttgaagagctcgagaatttgatggaacatgattatgacattggttctacaatccgggacaaaattattcctcatgccgtgtcatggttcacgggggaggctgcacagagtgattttgaggatatagatgaagatgattatgaagatgaagaaggtgatgatgatgatgatgaggatgaggatgaggatgaggatgaggaggatgaggaggaaaagaaagggaagagcaagagtaagagtggtggcagggccatacctggtaaagatcagccgatggagcgtcctcctgaatgcaagcagcagtag

SEQ ID NO: 44424 - DNA, 3477 bp, Glycine max
  Peptide Sequence Number=SeqID_161202
atggaaacttcttctagttcccaagatcctcgaatcaaatatgatgtcttcatcagctttagaggcacagacgtacggtgtggttttcttagccatttgaagaaggaactgcgccagaagcaagttgatgcctttgttgatgacaggcttgaaggaggggatgagatatcacactcacttgacaaagccattgaaggatcacttatttctttggtcatattctccaaagactatgcttcttcaaagtggtgcttggaagaggttgtgaaaataattgagtgcatgcacagtaataaacagattgtgattcctgttttctacaacgtagatccatcagacgtacggcaccaaaaagggacttatggagatgcatttgctaagcacgaaaaaaataaaagaaaccttgcaaaggtgccaaattggagatgtgctctaaatatagctgccaatctttctggatttcattcatcaaaatttgtggatgaagttgagcttatagaagaaattgccaaatgtttgtcatccaagttgaatcttatgtaccaaagtgagttaacagagcttgttggaattgaagaacggattgcagatttggagtcactattgtgcctaggatcgacaatagtaggtgttcgtgtcattgggatttggggcatgggtggtattggaaagacaactattgcagctgcagtatataaccgcctttattttgaatatgaagggtgttgctttatggcaaacataacagaagaatcagagaagcatggaatgatttatgtgaagaacaaaattatctctatactactaaaggaaaatgatctacagattggcacacctaatggagttcccccatatgttaagagaaggttgattcgtaaaaaggttctcgttgttcttgatgatatcaatgattcagaacaactagaaaatttagttggagcacttgattggtttggatctggtagtagaatcattgtaacaactagagataagggtgtgcttgggaaaaaggctgatattgtatatgaggctaaggcattaaactctgatgaagctattaaacttttcatgttgaatgccttcaaacaaagttgtcttgagatggagtggattgagctttcgagaagggtgattcagtatgctaatggaaacccattggccttaaaagtgttgggttcttttctttatggcaagagccaaatagaatgggaaagccaattacagaaacttaagaaaatgcctcaagtaaaaattcagaatgtattgagattgacttatgatagacttgatcgagaagagaagaacatatttctatatattgcatgtttttttaaaggatatgaagtacgccgaataatatatctgcttgatgcttgtggtttctctacaattattgggttaagagtccttaaagacaaggccctcataattgaagccaagggctctggaatctcaattgtatcaatgcatgacttgatacaagaaatgggctgggagattgttcgagaagaatgcatcgaagaccctggaaaacgaactaggttatgggatcctaatgacattcatctagtgttgaaaaataacacgggaactaaagccatcaaaagcataacttttaacgtctcaaaatttgatgaggtgtgtttaagtcctcaaatctttgaaaggatgcaacagttaaaatttcttaattttacccaacattatggcgatgagcaaatcctgtatcttcccaaaggccttgaatctttgcctaatgacctaagactttttcattgggttagttatcctttgaaatccttgcctctatcattttgtgctgaaaatctcgttgagctcaaattgccttggagccgagtggaaaaactttgggatggaatccagaatcttgaacatttaaagaaaattgacctgagttattccaaaaatctgctagagctcccagatttttcaaaggcctcaaatcttgaagaggtggaactctatagttgcaaaaacttgcgtaatgttcatccatctattttatctctcaaaaagcttgtacggttgaatctcttctactgcaaagcgcttaccagtcttagaagtgattcccatttaagatctctacgtgacctcttcctgggtggttgctcaagactcaaggagttttcagtgacttcagagaatatgaaagacttaattttaacttcaactgctatcaacgagttgccctcatcgattgggagtctaagaaaactagaaacactgacccttgatcactgcaaaagcctaagcaatcttccaaacaaggttgccaacctaagatcacttcgacgtcttcatatttatggctgcacacaacttgatgcatcaaatcttcatatcctagttaatggtttaaagtctttggaaacattgaagttggaagaatgccgtaacttgtttgaaattccagacaacatcaacctcctatcatcattgcgtgagttgttactaaaaggaacagatattgagagtgtttctgcaagcatcaagcatctttcaaagctggaaaagcttgacttgagtgattgcagaaggctttattctctgccagagcttccacagtccataaaagagctatatgccattaactgttcatccttggagactgtaatgttcactttgagtgctgttgaaatgctacatgcatacaagttacacacgacattccaaaattgtgtaaaattggatcaacattcactcagtgctattggagtaaatgcttatgtgaacataaagaaagtggcatatgatcaattttcaacaattggaaccaactcaatcaagtttcttggtggtccagttgattttatctaccctggaagtgaggttccagagtggttcgtgtataggactacacaggcttcagtaactgttgatctctcttcttctgttccatgttccaagatcatgggtttcatcttttgtgttattgttgatcagttcacttcaaacgacaagaactatattggatgtgactgttacatggaaaccggtgttggtgaaagggtcacacgtgggcacatggataattggtctagcatacatgcctgtgaatttttctccgaccatgtgtgtctgtggtatgatgaaaaatgctgtctgaaaaaccaagaatgtgaaagtgaaagcatggaagaacttatggcaagttataatccaaagatttcatttgaattctttgctaaaactggaagtatttgggaaaagcggagcgatattataattaaagggtgcggagtgtgtccaatatatgacacagaatgtgacaatttctttaaacagatggaattggagttggaaatcacattgcaatccatggcaactaaaatgtcaagtaaggaagcaacactatctccaaaacaggaatctaagaaactgatctttccaccccatcaaattggaacttggaagaatgcaacacaagggttgaaagatatactgttcctgtga

SEQ ID NO: 44425 - DNA, 1674 bp, Glycine max
  Peptide Sequence Number=SeqID_161203
atggctgaggaagttccaaagacaagcacaactcaagaggaggtggtggtctctgacgtggcacctgctgagaaaccagacaccaccaacgttgttgttgttcccctagagaaagacgcacaaccacaacaaaatgaagaagaaacctcgccagagaagaagaaagagaacgttaccgaaactgaaaccgagtccgaggtttcaaaaccaagtggcgacggcaacgttcctgaatccggttctttcaaggaagaaagcaccattgtctccgacctaccagagaccgagaaaaaggctctgcaagaactcaaacaacttattcaagaagcgctcaacaaacacgaattctccgcggtgccaacaagtaaccctcccaaagatgaaaaacccgacaacaaggaagaacagaaccccgcggaggaagaagagaagcaacaagtttttgatgctgctgctgacgtggcagaagcgacagaaaaagaagctgcagaagttaaggtaaccgaaactgaggttgatgaagagaaagtggcggtgtctgcttcttctgctgatgaagacggagctaaaacggtggaagctatcgaagaaagcgttgtgtctgtgactgtttccgaggaagcaaaggtggaagctgtttctgcttcacccgaagaagtttccatctggggtgttcctcttcttgctgacgagaggagcgacgtgattctcttaaagtttctgcgtgctcgggacttcaaggtgaaggaggcattcgcgatgataaagggcacgattcggtggaggaaggagttcaagatggaggagttgttattggaggatttaggtgatgatttggagaaagcggtgtacatgcatggattcgacaaggagggtcaccccgtgtgttacaatatctatggggagtttcagaacaaggagttgtacaagaagagtttctctgatgaggagaagaggtatagatttctcaggtggaggattcagttcctggagaagagtatcaggaagctggactttaaccctggtgggataagcaccattgttcaggttaatgatctcaagaattctcctggccctgccaagtgggagcttagacaggctaccaaacaggccctccagctgcttcaggataactatcctgagtttgtagccaaacaggtgtttatcaatgtgccttggtggtacttggcagtgaacaggatgataagcccttttcttactcagagaaccaaaagcaagtttgtctttgctggaccttctaaatcagctgagacccttttgagatacattgctgcggagcaacttccggtcaagtatgggggactaagcaaagatggcgagttcggaatttccgatgctgttacagaaattacagtgaggccagcagcaaaacatacggtagagtttccagttactgagaactctctactctcttgggagctcagagtaatagggtgggatgtaagctatggtgcagagtttgtgccaacttcagagggaagttatactgtgatcatccagaaggctagaaaggttgcttcatcagaagaaccggtgctttgcaacaactacaaaattggtgaacctgggaaagtggttctcaccattgacaatcaaagctctaagaagaagaagctcttgtaccgcttaaaggtcaagccttcttctgactga

SEQ ID NO: 44426 - DNA, 619 bp, Glycine max
  Peptide Sequence Number=SeqID_161204
gggatcctcctttaccaccaccgctgcaggccatcgctgctacagaacatccagtgactcaccaacaccaattcctccttctctttcatctcccagatcatcaaccttgttttctttcgatgaccaacgtcagtggtattactcacaattctgcaatcgcatcattcttgaccctaatcaaggtgttccttttgagggaactcttgttgatgactgtaaacatgcttattcaagtcatgatgcttgaaaaatggtctggaatgaccatgctgacgtccattaatcttgcccatgcctctgaggaggatttaatcttgttgtgggcttttcaaattggtcgtcagatcgacatggcccatcttgttcagtatcgaatacataaggcatcacgggccaatgcacctctcccatatccccatcttgttaccttctttctccagtatttcaatgtccccttagatgatgaaccttttgtcaaagttaaacattcttttgctattggtgctggtgatgttacatcttttggttatcggaaagacatggatagtcagtgggtgcgcaagcaagacttaccacctcccattcttgatgacatcggaaagacatggatagtcagtgg

SEQ ID NO: 44427 - DNA, 1380 bp, Glycine max
  Peptide Sequence Number=SeqID_161205
ggacggtcttgaagcaacagtcttctttggccattgttgattcaatggagtttgttgagtcgaaccctctcttccaaaaccccaaatcaatgtcttattttgttcttctcctccaacttggtgtgggattggcgtttggagggctgatttgtaaggacaagtctgagaaatccctcctcccactggtagtgagaaggtggtctccaaaaactctcttggcaactaataggttcatttgtgagatctgcaacaagggatttcaaagagaccagaatctccaacttcacagaagagggcacaatttaccatggaagctgaagcagagatcaagcaacgagattataaggaagaaggtgtatgtgtgcccagaagccagttgcgtgcaccacgacccttcaagggctcttggggacctcactggcatcaagaagcacttctgcagaaagcacggcgagaagaagtggaaatgtgacaaatgctccaagaagtatgctgttcaatcagattggaaagctcactccaagacctgtggcactagagagtacagatgtgactgtggaaccctcttctcaaggagggacagtttcataacacacagagccttctgtgatgcattagcagaggagagttcaagatcagtgacaggcataggcatagtagccaactcaacttcaactcaaccaactgcagcagcagcctctcatcaacaagacatcatccatggtaatagtaacaatttctcattgaagaaagagcaacaagcaggtttcagaccaccttggattggacaaccatcaccctcttctgcttcatcattcttggtctctcatcaagaaaaccctaaccctagaggtggtggtcctggtcccactcttcttcctccttaccaaacagctcctcacatgtcagccacagcgttgctgcagaaagcatcccaaatgggtgcgacgatgagcaaaaccgggtccatgattgggacccaccaacaacaggctcacgtgtctgccaatgccgctttgaatttgtcctcacgtgaccaccagatgacccccactctccatggcttggtacctttcgggaataaagctgttcctgctgttggtaatggtgtttctccttcactccttcaccatatcatcgactctttctcttcaccctttgaagggacttcttttgaggacacttttggtggtgctggtggcgatgccatgacgaaaacaaccaccgccgatgacggtgccagaggaaacaataatgaagccctgacaagagatttcttgggtcttagacctctctctcacactgatatcctcaacattgctggtatgggaagttgcatcaactcctcccaacataaccaaaccccaaacccttggcaag

SEQ ID NO: 44428 - DNA, 716 bp, Glycine max
  Peptide Sequence Number=SeqID_161206
tcatggatcctatcaagttagatgggattgaaaatgaggctgccattatattgtgtcagttggagatgtattttcctccttcattcttcaatgtcatggttcacctaattgttcatctggtgagggaaatcaaatgttgtgattttgtggttgatgtacccgaagaagctattgagttttattcagagtacattgaaaagacaaaacctgttgagcttcccaagtctcggcatgacaaaaaagtcaaaggatacgatataaacaagtattcattctacatgaaaacacaagacgacgagagtacaatgcataatagtggggacccttttgatgaaaggtggtcagtggttctacacggaaaaacaattgatgttaatgttgaagatgatgatttaataattgatacttgtgccggtcctttgtccactcaaatgtcacctaacatcatcggagaagaagttgacgatgtgcatgcaaatcttggggtagagagaccactggttcatgtggatcctatgactaggaataccgatggtctccatagaaagaagttaagaacatacttggggatcgtctctcgcgataaggtggatgtcacatatgagaattggaaacaagtccctattactcaaaaggatttgatctgggaggatattcaggctgaatttgatatccttgaaacatctgatttgaggatgaagaagaaaatactttag

SEQ ID NO: 44429 - DNA, 100 bp, Glycine max
  Peptide Sequence Number=SeqID_161207
tgctgaaatttctttgtcggagacaggaaaggttgcagagacagctaacaactctgaattagaacaagatgcggttgttagtggtacctctaaaagctga

SEQ ID NO: 44430 - DNA, 414 bp, Glycine max
  Peptide Sequence Number=SeqID_161208
atgcctgaaacttggattgctattcctgagattatggagaataagtggtttaaaaaagggttcaagttttatgtagacgatgataaactttgtaatgtggtgggtgatgattatgatactacttctattgcttttgttgcttctttttcggattactcggtttcagagtctgactctgaggttgagactaggaggaggaataataatgctcccttgcctagaccacctagtttgaatgcttttgacattatttcattctctccaggttttgatcttttggggttgtttgaggagaaaaggggtgagacaaggtttgtggcgactggcattggttatcattattatttccaagttggaggagattgctcagttgcatgtttcagtgcacttgttggagactctcttgtaccttga

SEQ ID NO: 44431 - DNA, 297 bp, Glycine max
  Peptide Sequence Number=SeqID_161209
atgggtcaatgtccttacgccgaaattcagcaagtggaggcaacatgcgaacatgcgtttgttgttagtgcgtggatgatcaaatcttttggagagtactgggaagatagactgttaaaagccaaggcattgggcttgaacacaattcagacatatgttccttggaatctgcatgagccagcaccgggaaatcttgtttttgagggttttgcaaacattgaagctttcctcaacctatgtcacaaacttggtctccttgtgatgattcgactccgaccatacatatgtgctggctag

SEQ ID NO: 44432 - DNA, 756 bp, Glycine max
  Peptide Sequence Number=SeqID_161210
atggtccacttccagatcttgaaccgaacatcgacgtcgcacttagcgttggaagtggacgccgttgccggtttcttgccggagggaagagtgactctgattccgtcgcaggagactctgattcccacttttggggttttcaaatttcccatcttggccttcactttggtttccaaattcactttgagtggcaaccccttcgtcgctttggagcgcgtggccggagctgaggatggaggctttgatgagcgtggtgttcttcttcgggtgctggaagccggggacggttccgtcgccgacgtcgatgtcgccggagaggatggtgatggaggtggggtcgtaggcgaagaggatcttcttgttggggttcgtggcggagacggtgatgtcaaagcgggagttcagggtgttggaggaggaggtgaggttcaggtaggagagtttcagcgacgtgacggtgaaggtggggtggtgcgggcggtagaggaggtagaacaccgtgccggcgacgccgatcaggaggaggaggatcagcacggtgaggatcagccagaagaagaaggtgcagcagcaccgtcgccggctccggcgccggtggtggggttgagggcggtaggtggggcgggtggcgccgtaaagttgagccttcgtcgccgggaaagatgggttggcggcgccgccgttaaccacggcgggcttggcggatgggtacaccctgtctgtcatggctgcgtggagttactgttttttgtttaa

SEQ ID NO: 44433 - DNA, 555 bp, Glycine max
  Peptide Sequence Number=SeqID_161211
atggacatgaatctgggctacctcatctcccaccagatttctatcattgcccagcatgactcctctaggcttggatttctagccttaatcatagctttgtgtaaagctagaggagtcacatcagattccagatctttggagagtcttagcccaaccattaacttggcatatataaagaagaactgtttgaatctagatgatccaacaatggcattcagagggccaagggaggccaagggtaagagatctgaggctccccctacttcagcagcaccagatacttttgctcattctttatctactttaccaaacccttcaacaccatccacttcgactctacatcttccacagttaccagcttcatctcccactcccttactagctccatcaattccagctcctcctacaggaccctcctcattcacttcagagacattatttgccatgctccagaacctgcacagaggagtccagccttctctttctagagggggtgaggtctccgcagcccaagagcttgtgccagcagagcaattgtcattgtccttgtcctaa

SEQ ID NO: 44434 - DNA, 351 bp, Glycine max
  Peptide Sequence Number=SeqID_161212
atggtgaataggcaaaacagcttggtgaaggatggaagtaatcacaacaactcaaagaaaagaaggctggccaattcaaaatcatatattggtaaccatgcaattttaatggactctgggtcattattttatactgctacaagagcttttaagttccattctctatctcttgggtttatctctatctacatttttgagagtggtacaacatcggatcttagaatcatcgatgcacctttccatgaccagctctactttgctgttgctaatcaaccttgcttgcttgatgttcgaattgatgcaatgtatacaaagccttccaatcagagcaacttcatttgcagacattaa

SEQ ID NO: 44435 - DNA, 321 bp, Glycine max
  Peptide Sequence Number=SeqID_161213
atgggggagacacatgaaattccccaccacaacctagctgacttcgagccttggctcggatatgccactaaagggcaagcagttggtggtataccctttgaaaacactttggagagccctcagtttcgcccacaaccacaaccattgcattttgcggtgggaagagcccctcctgctatggctgaaaagggaaaggtggatcatctaaaggaaaggctcagggccattgaaggaggtgaagattatgcctttgctaacctagaagagttgttcctaatacccaaacatggtcattcccaagttcaaggtgctagaatttga

SEQ ID NO: 44436 - DNA, 447 bp, Glycine max
  Peptide Sequence Number=SeqID_161214
atgaggtgtccttgcactagggaccaccaccataacacagtgattggaaaaactaaaaaggaacaagtaggagaacaaactccagaaacaaaggctaaagatgtgactgacccagatgatgatagtgattcattggccattatagtcatagatgatgtggagacacgagtggaagaaaaaaaagttgtgaacacaaagaagagaaagagtcaagagaaacaagggaaaacagaggaaatggcatgggagccaaaacatgtaaagaaaagaggaaggggaaggtcacgaaagaggaagaacatggctcaggggataaacgggaaaacaagattacaagaacttggtgatgccaacactcaacaaaacaagttgcagcaattaactatgaggggatcggaggataacattttctttaagagatcacttttagagatacattatgtctaa

SEQ ID NO: 44437 - DNA, 304 bp, Glycine max
  Peptide Sequence Number=SeqID_161215
atgggggctgagagtgaaagtgggaatgtgaggagttttgaagaaaagagggaaaattgggaatggaaagagagacggaaaaccttaaccttcgtgagaatgagattgctgagaatggattgtgtttgttggggagaaatcaaagctcggttttctccgatttcagcttcggcgaagaaatcatttgggagcaaaggtggtggaggggtggcgaatatagttgataataatacgttggaggtgcttaatactccattcaaacacgaggaagtgaaagagcttgttctacaaacagttttgggag

SEQ ID NO: 44438 - DNA, 288 bp, Glycine max
  Peptide Sequence Number=SeqID_161216
atgtcacagcatatccaatgtggaatgctaaaaacatcagcagcagtgaggccactgcataatccaactactctgatcaaacaaatacaaaatttacaaaccattcatagaaaacattttcaaaggatggaggctgagagtgaaagtgagaatggagggttgagagtgaggtgtttggaagaaaagacggaaaattgggaatggaaagagaggcagaaaaccttaaccttgttggcagtgacattttgttatgattatgcgttgtggcaactggcaagtttgacctga

SEQ ID NO: 44439 - DNA, 1387 bp, Glycine max
  Peptide Sequence Number=SeqID_161217
gtggggtgggatacaaagctagtgaatgagtcatatccttgggttgagaagcagattgttcaccggccaaagttttcagattggcagagagcagttagggacgggcttctagcagctggtgtgtctcctttcaatggcttcacctatgatcacaagtacggaaccaaagttggtggaaccatttttgacagatttggccgtcgccacacagctgctgaattgcttgcttctgccaaccctcacaaacttactgttttgatccatgccactgtccaaaacattgtttttgatacaacaggcccttataagtgggttacaatcacatacatgagtgaaaatggtgatgctattgttgcaggaaaaagaccaaaagctaccggggttattttcaaggatgaaaatgggaagcagcatgaggcgtatctaggaaatgacaggcagagtgaggtgattgtgtctagtggggcacttgggactcctcaattgctattgctgagtggaattggcccaaaagcagagcttcagaaattgaacatccctgtggtgcttgacaaccaatttgttgggaaaggcatggctgataaccccatgaacacaatttttgttccttccaaaagatcagttcagcagtcactcatagaaactgttggtattaccaatttgggtgtctacattgagaccagcagtgggtttggccagtccaaagacagcattcactgccaccatggtatcttgtcagctgagttgtccacaattccaccaaagcaaagatcacaagaagctgttaaagcttatgtgaagagcaagagagacataccagttgaagcattcaggggagggttcatattgtcaaaagttgcgaacccttggtcaacaggtgagctcaagttgaaaaacaccaacgtggaggacaaccctgctgttaccttcaactacttcagccacccttatgatcttaggcgctgtgtggagggtattcgcttggcgataaaggttgtccagtcagaacacgtcacaaactacactttgtgtgagagagaaactgcagagaaaatgcttaacctcagtgtgaaggccaatatcaacctcattcccaagcgccccaatgacacaaagtcagtagaacagttttgtagagactccgtgatcactatttggcactaccatggtgggtgccatgtggggaaggtggttaactctgagcataaggttcttggtgttgatagactccgtgtggttgatggctcaacattttctgagtcaccaggaaccaaccctcaagctactgtgatgatgatgggcagtcccatagcgaaggatgctcaagcgttgagttttcaacttgtgccctcatcccggttctccgatgagtttccggttgcaggag

SEQ ID NO: 44440 - DNA, 1191 bp, Glycine max
  Peptide Sequence Number=SeqID_161218
atggttgacggcggaaaaggagagggaggaggagagcaagcatcgccaccctcgacggcggcgcgtcacggaaccactctccggccacgcgcctccgtggagagtgttttcagcggcgggtatagccccggtcccatggctctgctttccaatttctacggcgacggcgatgagtgcaagtcgttctcggagctcctcgccggcgccatggtggaccccacggcaccctcgcccatgcccaccacaacgttcgcgcttccacctggattcatcgattcaccttctcaagtaataacacataatctcatatgctatattttgtaccaacaacaacacattaccaaaagggatcatgggattcctcttgggaaaatctttattatgttggagattagtactataaggaagacacggctgaactctgtatttgctattgaagagggccaatttggaataacacaccagcagatgctagcacagatctcatctcaagctgtgcaaacccactctgaacatccattctctatatcagccgtatctgctacctcatcatgtgctgcacaacagctgattccaccctcaatgccagattctaaggtgaaagaatcccttgattattctcactctgaacaaaaattgcagtcttctgtgaatgttgataataagcctaataatgatggttacaactggaggaagtatgggcaaaaacatgtgaaaggtagtgacttctcaagaagttattataagtgcacacgtccaaattgtcctgtgaagaaaaaacttgagcgttctcttgagggtcatgtgactgcaattatttataaaggagaacacaatcatcaacgtcctcatcgcagtaagattgtgaaagaaacacaaacttcaaatgaaaattcagtgtctaagatggatctagggtctagtcaggccacaggtgaacatggatcaggaacaagtgatagtgaggaagtagatgaccatgaaactgaagcagatgagaaaaatgatgaacctgatgccaagagaagaaacacagaagccaggatccaggatccagccactttgcatagatctgttgcagagcctagaatcattgtgcaaacaacaagtgaagtgaatctcttagatgatggatatcgatggcgcaaatatgggcagaaagttgtcaaaggcaacccatatccaaggtga

SEQ ID NO: 44441 - DNA, 477 bp, Glycine max
  Peptide Sequence Number=SeqID_161219
atggtagcgcgtctgactccagatcagaaggttgcgtgttcgattcacgtcagaggaatcgaggaattggtcgagctgtcaaaacaggtagacccaccaacccacctaagtaaccctaattctaatttactaactaaacaacacaacacaagttacaaacaaacacatctcatcaagacatcgacccactcggccactctctacctcaggcacctcaagcctctcgctctccatcgacagctcgatgccttagtgctctcactgctcagtcctcacacatgtcgtcctcgactcgacccacttactcactccctctctgtcacacaactcgagctcaacacttcacgagatcaagcctcgacccattctcgtcgagagtcgagacttaagacccattctctgccacgattgcaacctactctctgtcgcgagcatgcgacccactcaagatacactctctgccactctttgatgtga

SEQ ID NO: 44442 - DNA, 597 bp, Glycine max
  Peptide Sequence Number=SeqID_161220
atgggcagaagacagagagagtggaagtgtctggttcttgcaggttctctccttggcttcttagggcagatggggtcctctgctagagcaagccactttcaggaaccgtcaccgtctctatctttccgaacaggtcgctctttaactacttttcctttcctttcatttcaaattttacttactctcttcttatcttctcagactgatggcagtgttcccaatactcttgttaaacccagggttgctgcagagtttaatgaagaagctcgctctccctttttcaagaagtacaaaactgtattacatcctggcgaggtgaatagaatcagggagtttcagcaaaacagtaagatagtagctactcacacggattgtcctgaggtacttatatgggatgttgaaactcaacctaatcgtcatgctgttctgggggctaccacttctcgtccagacttggtattaactggtcataaggataatgctgaatttgctctggctatgtgcccaactgaaccctttattctttctggaggtgatgattctcgccttatactctgggatgcacgacttggatctgctccagttgttaaggtttaa

SEQ ID NO: 44443 - DNA, 1983 bp, Glycine max
  Peptide Sequence Number=SeqID_161221
atggcgaacaatgagaaatgttgttccactcaacttattgatggagatggtgccttcaatgttgccgggattgaaaacttcatgaaagaggttaaattaagtgagtgtgggctttcctatgccgtggtttctattatgggtccacaaagtagtggcaagagcacgctcttaaatagtttgttttgtactaacttcacagagatggatgcatttaagggaaggcatgtttctacaacccccattcattcacttcaacagtccaatctggctatcacaattaacaaggatgatactacatttgaaaagcagagtgctttatttgctttggctatttctgatatagtgctaataaacatgtggtgtcatgacattggtcgcgaacaagctgcaaataagccgcttttaaaaactgtgtttcaggtcatgatgagattgtttagtccacgcaaaacaacaatgttgtttgtcatacgtgataagacaaagacaccacttgaaaatttagaacctgttttgagagaagatattcagaagatatgggattctgttcctaaaccagatgctcacaaagaaaccccattaagtgaatttttcattgttgaagttgttgctctttctagtttcgaagaaaaggaagaacaatttaaggagcaggttgccaacttgaggcaacgattctatcattctattgctccaggtgggcttgcaggggatcggcgtggagtagttcctgcttcaggcttttcttttagtgctcaagaaatctggaaaatcattaaagagaacaaggatctcgaccttcctgcacacaaggtaatggtagctactgtacgatgtgaagaaattgctaacgagaaatatgacctttttgctacaaataaggattggtgtgagttggaagaggctgtgcaatctggccctatttctgaatttgggaaaaagctcaattcactccttattgcttgtctttctgagtatgatgctgaagccaactattttgacgaaggtgtgagatctgcaaaacaaaagcaacttcaagaaaaactgtttcaacttgtccaaccaacattccaaattgtgctgggacatatgaggtccggaattttggataagtttaaggaagcatttgacaaggcattgaatggaggggaagggttttcttctgctgccaataagtgcatagagatttatatggctcagtttgacgaaggatgtgcagatgttgttattgaaatagcaaactgggatacatctaaagtaagggagaagctacagcgtgatattgatgcacatgttgcatctgtacgagcttctaagatgtcagaacttgtttcatcatatgaggaaaaactgaaagaggccttgtctgcacctgttgaaactctattggatgcagctaatagtgatacttggccatcaataaggaaacttcttaatcatgagactcaatcagctgtttctgggttctgtgttgaacttatcagatttgatgtggatgaacaaacaaaaaagagcatgattgtgagtttagatgattatgcaaagggtgtgatagaagccaaggctagggaagaagctggcagagttctaatccgtatgaaggacaggtttttgacattgtttagtcatgattctgattcaatgcctcgtatttggacgggaaaagaagatgttcgagcaatcaccaagtctgcccgctcttcgtgcttgaagttgctgtctgtaatggctgtaattcgcttggatgatggtgatgacatttataatattgagaaaacattaatagttgcattagcagattcatcaagcagttctgctaaagataagagcatgacggcagttaagccactagcttcaagcacttgggatcaggtaccgccctctaaaacattgatcacacccgtccagtgtaaatccttgtggaggcaattcaagatggagacagaatattgtgtctctcaggccatttctgcacaggcatga

SEQ ID NO: 44444 - DNA, 564 bp, Glycine max
  Peptide Sequence Number=SeqID_161222
atgttcgatcgtcgaaatcttacaagtggtggagttggatcacctatctataaatttgaaggtcatgatgcagcagtcctctgtacagttttgggcattgtaattgagtgcttgttaacctacaattttgatctgtttcagtggagtcctgacaagccatctgtatttggaagtactgctgaagatggtattttaaacatctgggaccatgacaaggttggtaaaacaacagactctgctagttcaaaagcatcaaatactccccctggtttattctttcgacatgctgggcatagggacaaggttgttgacttccactggaatgcatctgatccatggacaattgttagtgtttctgatgattgtgaaagtagtggtggagggggcaccctacaggaaattgtaaaatgccggagatatgaaaatattctgatatgtatcataggttttggtcattattgtgcatatatggcggatgatagagatataatatatcgaccagaggaagaggtgctcactgagctggataaattcagatcacatatttttggatgcaactcatga

SEQ ID NO: 44445 - DNA, 851 bp, Glycine max
  Peptide Sequence Number=SeqID_161223
atggagcctccaccttcctattcctattccccattcccattctcacttgagcgccacacacagatacaaatgcacgatcccattctcttcttcctcttcttcgcgtccctctcctcccttctcttcctctctttctctctcttcaaacgcttctcgacaaaaaaggaacaccaccaccatactcaaaaagttcccagcttgttgggagaggaacagagacccaagaagaagagaaagaagcccaagaagaagagaacccaaggtgacgacgccgccaattcgggttcgggttccgactcggggctccgacttgaatccacgtgccagtatccgtttacgtcttccagtagcgttatgcagagaaagatcaaacagcagtatgatgagctcgtcagatgcaaccacttgaagaaactcacgctgccccagggatatggagtgttgcatttgacacaagggtgtgtggtatttgtgtcagtgagcggggttgtgcagtttgctaatagtttggttgatgctagaaatgagctacaacacaaagctgatgtgattcaacgtaagtttgtaataacgaaggctttactatgtaaggcagatagatcttcttttgaccgccttcatcaacagatatacaagctagaattagagcaaaaacgtttagaagaggatgtttttgtttataactcgcttcaacaacagcttaaactgtcaccagcctaccagaagatgcttgaacttggagcttgcatggagaaggaaaaatcaagtgaactgggagagaacagagatgatgattttgctgaaatttcttttgaggaattgttagcacaggagaagaaagattcattttg

SEQ ID NO: 44446 - DNA, 2139 bp, Glycine max
  Peptide Sequence Number=SeqID_161224
atgaagcatcaaatgcaaaaatttaccacgaagattgttgatttgatgaaagcggagaggttatatgaatctcagggtggtccaataattatgtcccagttgactagagtggggatgagtactaagactgttatctttactactggtgtttttgttcagattgaaaatgaatatggacctatggagtatgaaattggtgctgctggtaaagcttacactaagtgggcagcagaaatggctatgggacttggtactggggttccatgggtcatgtgcaagcaagatgacactcctgatcctcttattaacacttgcaatggcttctattgtgattatttctctccaaataaggcttacaagccaaagatgtggacagaagcttggactggctggtttactgagtttggaggtcctgttcctcatcgaccggctgaagacttggcattttcagttgcaaggtttatacagaaagggggatcatttataaattattacatgtatcatggaggaacaaatttcggtcgaactgctggtggtccctttattgctacaagctatgattatgatgcaccacttgatgaatatggattgctcaggcaaccaaagtggggtcatctgaaggatttacacagagcaataaaactctgtgaaccagctttagtatctggagatcctactgtaacaaagattggaaactatcaagaggctcatgtctttaaatcaaagtcgggagcctgtgctgcattccttgcaaactacaaccccaaatcttatgcaacagtggcatttggaaacatgcattacaacttgcctccttggtctataagcattcttcctgactgcaagaacactgtttataacactgcaagggttggttctcagagtgcccagatgaagatgactcgtgttcctattcatggcggattctcttggctatcattcaatgaagaaacgaccactactgatgatagttccttcaccatgactggcctgttggagcagttaaatactacaagagatttatctgactacttgtggtactccacagatgttgtgcttgatcccaatgaaggatttctgagaaacggaaaggatcctgttcttactgtgttttctgctgggcatgctttgcatgtttttataaatggtcagctatcaggaactgcatatggaagcttagaattccctaaactgacatttaacgagggagtgaagcttagagccggtgttaacaagatctctctactgagtgttgcagttggactcccgaatgttggtcctcattttgaaacatggaatgctggtgttcttggtccaatttcattaagtggtctcaacgaagggagaagggacttgtcttggcagaaatggtcttataaggttggtcttaaaggtgaaatcttgagtcttcactctcttagtggaagttcctcagtggagtggattcagggatctttagtttctcaaaggcagccattgacttggtacaaaacaacatttgacgcgccagctgggactgcaccattggctttagacatggacagcatgggcaaaggtcaagtgtggttaaatggacagaatcttggccgctactggcctgcttataaagcatccggtacctgtgattactgtgactatgctggaacttataacgagaataaatgcagaagtaactgtggcgaggcttcccaaagatggtatcatgttcctcaatcatggcttaagccaacaggaaatttattggttgtgtttgaagagctaggtggagaccccaatggaatctttttggttagaagggatatagatagtgtatgtgctgatatttatgagtggcagccaaatcttataagctatcagatgcaaacttctggcaaagcacctgttagaccaaaagttcatttatcatgtagcccgggacagaaaatctcatcaatcaaatttgctagctttggtactccagcaggttcttgtggaaacttccatgaaggaagctgtcatgctcacaagtcttatgatgcctttgaaaggaattgtgttggacagaactggtgcacagtaacagtgtcacctgaaaattttggaggagatccatgtccaaatgtcttgaagaaactctcagtggaagctatttgttcctga

SEQ ID NO: 44447 - DNA, 243 bp, Glycine max
  Peptide Sequence Number=SeqID_161225
atgaaactcaccgcaatgcgaaaccaccgcgaacctccgaggaatctcactgccgcgttcgcgctcagatcactctgttgttgggtgacgcggctcgaggaccgcccttctccttccaccgttaacggcgacggcaccgtttacatggcatccgcggatgggaggattaaggtttggaggacggaaggcgaggcgaaaggacacaagtttgacggaggtggtggcgcggttggacggtggtga

SEQ ID NO: 44448 - DNA, 489 bp, Glycine max
  Peptide Sequence Number=SeqID_161226
atggttatttgcttgaagctcataataatgtggaatgtggcactgcttctggttttttctctaattggttctgctaaggcctcagtgtcctatgactcaaaggctatcaccattaatggccagagaaggatcctcatttctggatccattcattacccaaggagcacccctgagatgtggccagatcttattcaaaaggccaaggatggaggtttggatgtgattcagacttatgttttctggaatggacacgaaccttcacctggcaagtattattttgaggggaactatgatctggtgaagttcataaagctggtgcagcaagcaggcctttatgttcatctcaggattggcccttatgtctgtgctgagtggaactttggtggtttccctgtttggctaaagtacattccaggaatcagtttcagaacagacaatgaaccatttaaggttagattccaatcttccttgtaccttaagaattggtaa

SEQ ID NO: 44449 - DNA, 232 bp, Glycine max
  Peptide Sequence Number=SeqID_161227
atggggttgtcctcctgggaaattcatgctcaaattcgatgctcaagagacgtgttatttgctgagaggggaagtgaaggtttacccaaaaggttcgtctgagtttgtacaatttgctgcgggggaccttgtcaccatacccaagggaattagttgcacgtgggacgtatcaattgcagtggacaagcattacaagttcgagtcttcttccactgcaccatcctccgaatga

SEQ ID NO: 44450 - DNA, 1008 bp, Glycine max
  Peptide Sequence Number=SeqID_161228
atggcttcagcttcgcttcaattctggtcttcgatagcacctctatcccaccgttacacccatcgattcgcttctctaacctcactcaaattcgtcactcctatatcctcaaccaatacaagtccgactctcccaaatccagaacctgaccctcaaactcttctccaagaaattgctgacagttttgatcttccttctgattactttgcaaagcttccccgcgatcttcgattagatctaaacgacgctgcattccacctttcaagtggacctgttttagatgagtgtggccaagagttgggagagactttgctgaatctctctcgagcatgggaactagctgacacatcaacctcccactctttagtgaaaaagctccctttgattgaggccaagttgacgggttctgccaaatcagcacttggaaagcatttggtatctgctggaagaaggtttcaatcaatgggacagtatggccaaggtgagccacaaaaggatgtcaagctattattaggaccaaaagaggaactgaggaaccataaaattgcaaaagcagtgattgcagctggtagagctctgtctgctagttcaacgtcagcagtgatagttgaagaactgaaagaggaaactagggtgctgaaagtcggtaattattctgtctctggcattgacaaggtttattttggagaattgcaggttgaaataacaccagataaggccaatatcggggctgtaattggattagtttttggaggatggaaacaaggaaaactcaattcttgttttaatttggaacatatgattctttcttgggaagtagcgcagggaattcaaaacattcctgacagttcgttgcagtatgcaaatgacaatgctttgctgcttgctaagtctttaaagggagcattgcttgctattttctactcgtcaacgttcttgtctgcattacctcggtgggacttgttctacttgggttacagctcaaatcaaagaaagattgagttctag

SEQ ID NO: 44451 - DNA, 771 bp, Glycine max
  Peptide Sequence Number=SeqID_161229
atggagtttgactataaaaaaataaaatctacctccattaagaatttgagactcaatctacatgcgtgggtgggggtgatgatccaaattgagatcagtgttttgagagcgtcaggggacacacaccagagactccctcacaatcccaacgctcacagaaagattaagaataacattgttgcaactcccactcccactcccactattacgcgcaagagggagcgagacatttccgtttttctcccgcgcgccccccctcccccccccatcgggcatatagaagaagtacaagatgaaacctatttggggtatgagaaatggctcccaactccaccaaaagtggtcaagcctcgttccgtctttaatgctgctactttagcctatattggtgattgcatatacgagctatatgcccgtaggcactttttattccctccccttagtattgaagaatacaatgatcgtgttatggcagttgttcgttgcgaagctcaagatgcattgctgcagaaacttcttgagagtaacttcttatcagatcaggagagggatgttcttcgatggggaaagaacattgtttccagcaaaactaagacgaaaaaacgtgctggtgcagctgtgtataatagagcatcttcactagaaacactagtcagtgccttcaaaccatgggttctctcttctgttgatataaatcttgcacaaagtagttgtctgattcttgagaatttcctttatagttcatacatttgtttaaatctaaaatggtga

SEQ ID NO: 44452 - DNA, 252 bp, Glycine max
  Peptide Sequence Number=SeqID_161230
atgaacaacatcaacggcgaattaaagaggaatacagatttaatacctcatgaaaacgaagggaggagggcgacacaagagattgacgatcacaaaagagcagagggaaagagagttcagggtgcgcgagatttagggaaagaggttcagggtgcgtttgacggtgcaagaggtgagagggtccagcgaaaaaggtttaggggaagaggttcaggaggcgcaagggttcaacaaaacacagtgaatgcctga

SEQ ID NO: 44453 - DNA, 158 bp, Glycine max
  Peptide Sequence Number=SeqID_161231
ggatagggacagcgattgaagtagaagacgaagcaagagcagagaaaaacgtaggaagaggagcagaagtggagatagatacagggaaacgtgaaggcgaagcaggagcagagagagacataaggatagtgaaagagggagacagaaaattgggttag

SEQ ID NO: 44454 - DNA, 459 bp, Glycine max
  Peptide Sequence Number=SeqID_161232
atgactataggtgatccacaccaacagaagacaagtcagggaaatgagaaaaagacagaaggcgacaatattactcaagggctatcaaaacaaagaaaggaatttaggattggagatgacgggaagggagtggaaggtggaagagaaacatctgggttcattgcgaagacgaagacacctctgataaaatattacacacaccaggcaaatgtggctaaccggaaagactctgcaatgaggaaacaaaacattcacagggatgagtttccgcgttgcaagagatgcgggaaggagcgcaggttccatctcaagagcacaccagacattaagaactaccatgatgctttaaacaacaaatgcaggacttgttctctttggccttatcaaaattggtacttagtcttgcaaaacacattatatgttggaaaaagatactcgggactcacgatgtgtcaataa

SEQ ID NO: 44455 - DNA, 408 bp, Glycine max
  Peptide Sequence Number=SeqID_161233
atgtcatcagcttctaagctcacactgtacggaatcggaaccgcactgttccgcacccgtcgaactgcacctgtaagtgtaactccctttctcttcttcaaacccattcccttacctcggccgccgcgcttcctcctcctccgcgattcctcttcctcctccgccgccgccgcagaaatcctaccctccgttgaccacccctggccggaatgggtctccttcgtcgaccgcttgagcaccaaaggctacctccccaaaccctcctcttcttccgatgacaccgtaagcctttacaccaacatgaactctctcaaggacgcttgtctcagcttctcgcgtgaccgttacgaccttttcaagttcgtttttctcttttctccttttcatgcgaaaaaatacataaattga

SEQ ID NO: 44456 - DNA, 1413 bp, Glycine max
  Peptide Sequence Number=SeqID_161234
atgggtgtctcagggaagtggatcaaggcattggtggctcgaaagaaatcagaaaagccagagtcattagagaaggatggaaataaggttaaggctagcaagttacaccatcagggaaagcctgctgtcgagtttgataatggtaatcttccaaacgaatttgataatgatgctactcaacctatcggagatgacagtggtcatacaaacattgatgcccattattcaccttctacttcacaacaagcacatgatgttgcacataatcatcaaatgagggaggaatgggctgcaatacgcattcaaacagcatttcgaggatttctggccagaagagcactacgagctttgaaaggagtggtaaggcttcaggcccttgtaagaggctatgcagtgagaaaacaagctgcaataacactccgttgtatgcaagctttggtgagggttcaggctcgtgttcgggcaaggcatgttcgcatcgcattggaaactcaagcaacacaacagaaacttaagcaaaagcttgcaaacaaagttcaagttcgagaaacagaattgcctatgcatcccatttgtgttcagcatgttttcatgaaggaaggatggtgtgatagcataggatctattgaagaaattcaagctaaaatattgaagagacaggaggctgcagcaaaacgggggagagccatggcttatgctctagctcatcagtggcaggcaggatcaagacagcagcctgtttcctctggatttgaaccagataaaagtaactggggttggaattggttggaaagatggatggctgtccgtccttgggagaatcgctttgttgacattaatctgagggatggagtaataatacatgaaaatggggctaagggtggtcaaaatggaacaacacatcaatcaagacctgctaacaagaaaccattgtcatcaaaccctcatctgtaccctgtaagtctgagaactggttccattctttctgatggctgtgattcttcacctacacttagtaagtcagcaggtttgccagaatcatcagacacacagcctgttaagccaaattctaaggcaaatgttgaaaattctgttgaagaaacatattcaaaacctggaattgagtcaagatctcattcaaatccaaaggagagaacatctcaggcagataagcaggcaaaaaagcgattatctctgcctaacaatggttttagagctaagagtacagatgatcaatcacttccaagagtttacattaaggatgaaaaggcttggggtggtcctggatctcaaactgccaaacatcctattggaactagtgtgaaagggacgctaagcacgcaaaaacctagcagggataagcgtaagctcaatagaggaaaggatgtgaatatttcaaaatcagttccatag

SEQ ID NO: 44457 - DNA, 771 bp, Glycine max
  Peptide Sequence Number=SeqID_161235
attcggaatgagaaggctagaagataccttgctagcatgcagaaaaagcaacctattccattctccaaaaaatttccaaatgcagatccattgggtcttaatttgctggagcgattacttgcatttgatcctaaagatcgtccagcagctgaagaggcactaagagatccttatttccatggtttgtcaaatgtggaccgtgaaccgtcgtccactcagcccatttcaaagcttgaatttgagtttgagaggagaaagttggccaaagatgatgttagagagttgatttatcgagagattttagagtatcatcctcagatgctcgaagaatatcttcgtggtggagaacaaacaagcttcatgtatccaagtggggttgaccggttcaagcgacagtttgcacatcttgaggagcattatggcaaaggtgaacgaagcactccattgttgaggcaacacgcctccttacctagagagcgagttcctgctcccaaggatgaaaataatcaaaacaatgatgttgaaaatccaactggagcaaatcatcagagtcctccagggtctgatgtgacaaattctggaaatccagatgcacaaaatgaaccctccaggccaaactgcagcgcacgtagcctgttgaagagtgccagcattagtggttcaaagtgtatagatgtgaaacaaagtaaagtttcagaggaggagccacttacaggggtcaacgatgagctggatgagttgacacagaaggttgcttccctccatgcttag

SEQ ID NO: 44458 - DNA, 225 bp, Glycine max
  Peptide Sequence Number=SeqID_161236
atgaggaaacaaaacattcacagggatgagtttccgcgttgcaagagatgcgggaaggagcgcaggttccatctcaagagcacaccagacattaagaactaccatgatgctttaaacaacaaatgcaggacttgttctctttggccttatcaaaattggtacttagtcttgcaaaacacattatatgttggaaaaagatactcgggactcacgatgtgtcaataa

SEQ ID NO: 44459 - DNA, 684 bp, Glycine max
  Peptide Sequence Number=SeqID_161237
atgggtgcaccggtggtagagttttttactgagtatggagaggcaagtaggtttgaaatccacgaagtgattggaaaagggagctacggtgttgtgtgttctgctgttgacactcaaactagggaaaaagttgcaattaagaaaatcaatgatgtttttgagcatgtgtcagatgccacacggatcctaagagaaattaaactccttcgtttgctccaacatcctgatatagttgaaattaagcatataatgcttcctccctcacgacgagagttcagggatgtctatgttgtgtttgagttgatggagtctgaccttcatcaagtaattaagtcaaatgatgatcttacccccgagcactaccaatttttcttgtaccaacttcttcgaggcctcaaatttatacatacagcaaatgtgtttcatcgtgacttgaagccaaaaaatattctagctaatgctaattgcaaactaaaaatatgtgatttcggacttgctcgagtttcatttaatgaggccccatctgctatattctggaccgactatgttgcaactcggtggtatcgtgcacctgaactttgtggttcttttttctcaaaatatacgcctgcaattgatatttggagcattggatgcatatttgcagaaatgctcagtgggaagccattgtttcctggaaaaaat

SEQ ID NO: 44460 - DNA, 186 bp, Glycine max
  Peptide Sequence Number=SeqID_161238
atgttcatcagatcaaaagacaaaccagcagacgtgaaggatgtgataaattatgacttcccaggatcacttgaggattacgttcatcgcagctggtgcctgaggaactgcatacacattcttcacagaaggcgaggttgcattattatctcatttatttgtctcgcggaatgtgctcgtgcctaa

SEQ ID NO: 44461 - DNA, 438 bp, Glycine max
  Peptide Sequence Number=SeqID_161239
atgggccccactccaccaccaccgtgggttttagccactgcaatcatcttccgtcattgcaatgttgaaagtggagacgtcaacaaagtcgttgtccataaggaggatgaaggggttgaattcaacatgcaggtggtgggaggtggcataggtttcaaggaagaagggtggtgggaggtgggagttggtggaggagctcgtggaagacgaagggtggtgggaggtgggagttggtggaggagctcgtggaagacgaagggtgggccgagtagttgggctgggtggaggcccattggaagaggcagagggcggaggagtcaggctagtggcagaggaggtcgaggagctgggagggggtggtgggtgacaaaagtggaagatgagagtgcgaaagaggagaattctcaatgtttgattttttttttttactttaattga

SEQ ID NO: 44462 - DNA, 1647 bp, Glycine max
  Peptide Sequence Number=SeqID_161240
atggaaattactcctcctcttcttcatcatctgtggtttttgttgttgctgctgctgctttgttatcttgttctctgtgcttctgccaccgatgttgaatttgacaactgcaactgcgatgacggggaaggtatttggagcatacatagcatcctcgttggccaaaaagtcagcgattttttcattgccgttgcgtatttttccatacccattgaactcctttactttgttagccgttcaaacgttccattcaaattgctcttccttcaatttattgccttcatagtgctctgtggcatgacccatttactcaatgcttattcttatcatggccctccctccttccaattgctgctttccctaaccgttgctaaattcctcaccgctcttgtttcctgtgcaactgctttaacccttccccctctcatccctcttctcctcaaagtcaaagttagggagcttttcctgaggcagaacgtgatggagcttggccaagaggttgggatgatgaagaaacagaaggaggcaagctggcatgttaggatgctcactagggaaattaggaagtctcttgataagcacaacatcctctacaccacccttgttgagctttcaaaggcgttggatttgcataattgtgcagtttggatgccgaacgaggaccgacgagagatgcacttgactcacgagttgaaaaccaactctgccaagaattttcagaattctattccggtgaacgaccctgatgtgttggagataagaaagaccaaaggggtgaagattctggggcccgagtctgctctaggagctgcgagtagtggtggctctgtggagttgggtgctgtggcggctattcgcatgccgttacttcatgtgtcaaatttcaaaggagggacgccggagttggttgagacgtgttatgctatacttgttttggttctgccaagttcaagcactagggtttggacctaccatgagatggagatagttgaagtggttgctgatcaggtggctgttgccctgtctcatgcatctgttcttgaagagtctcagctgatgagacagaagctggaagagcggaaccgagcactgcaacaggctaaaaagaatgcaatgatggccagccaggcacggaagtcgtttcagaaggtgatgagccatggaatgcggaggcctatgcattctgttctggggatgctgtcattgtttcaagaggataatttgaggtctgagcagaagattattggtgatacaatgttgaaagttggacatgtgctctccagtttgattaatgatgtaatggagatttcagaaaatgaaaagggaggcttccggttagagatgaaacctttccttctgcattcaatggtgagggaagctgcttccattgccaagtgcttgtgtgtttatgaaggctttggttttgaaattgatgtccagaagtctttgcctgaaacagttatgggtgatgaggcaaggacttttcaaattactgagagttctcagtcagatgaagcaatttcaacaatacattatactggtaggaggcagtactacaacaatgaacctaaggggggcctgagcttcagcatgtgcaaaaagttggtacagggactaaaacttaaggtttttgcatacaagaattga

SEQ ID NO: 44463 - DNA, 342 bp, Glycine max
  Peptide Sequence Number=SeqID_161241
atgtttccaagcagtaacagaacaaccactgacaatactcttttaaccagaactcaaaccttcagtgctacagaatggctggtaaactttcatcaaaaccatggctttcagtcaccaacaggatggattctgcaagtacgctaccaaaatagaagcaaatctgtgaagaatcagataccctttcagctcagaaagcaagatgttgcatccttcaagctttaccaagtactatgtatcaaagcactacacatgaaggcccgtgagacaatccattacaagagaacagttacagacactagactccagaggaaccccctgccaaagatcccaccacagaaatag

SEQ ID NO: 44464 - DNA, 636 bp, Glycine max
  Peptide Sequence Number=SeqID_161242
atgagtagtgaaggcgaagcagaagcagaagcagaagcgcaatacttctgcaaggacttcgactgggaagacctaagagcagagatcgaagcaaacccttcctttgcctaccacttggaatcttcttcttcgtcatcatcagcaccaccagaatcagacgtacaagcatggaagcaatttcacctccgtcacgcctctggaaaattcttcaaggagaggcgctatctgttgaaggagttccccgaacttctctcctgtcccccaaactctatgctcttggaagttggttgtggcaatggcagcaccgctcttcctattctgcgggccaacaaagatttgattgtttatgcatgcgactgtagtgatgagactcttgagagggctaaagagattataagtgcagcctccacagatgcatcctttaagcatcgattccgcacattctgttgtgatctttccactaatggattcccgaactggttggcgtgcaatccttcccaagataattttttacagaaacagtcatactgcttatcaggtgtcagagaggataatgggctgcattttaccaatctgtctccctcggaagaatttgaatgttgtggtggtggagttgattttgtaacattggtctga

SEQ ID NO: 44465 - DNA, 276 bp, Glycine max
  Peptide Sequence Number=SeqID_161243
atgactgaaccctgtgtaacaggcctctatgatatgaccatgcttcgatttgagccagacaagcaagtgggattcagggaatacatgcggtcagatggaacacgatcatatttcttttgtttggatactgtccggagcctatttttgggtgcaggcttcaccgagctcgagcttgattattgttgtgttaagtctgtaaatcgccagaaaggaaagtccatgcaaagagtgtgggttcacgggaagttccagaagcctgcactgagttgtcaataa

SEQ ID NO: 44466 - DNA, 771 bp, Glycine max
  Peptide Sequence Number=SeqID_161244
atggagttcacagctgccatcacaactctcacaaagaagctctcaaacggcggtggctacagtgtccccaaaagatctagatacgatggcatcatttccacttcgatcaagctccatgctcctagattctcctatcagttcgacgactaccgcaagattttctgtgccgccaccagaggctcgatttcgatcctcgaacttccaaaactcaacaagagaagaaacaatgacgacgttcgacgctccaagttcgattactcgaatgtcttcaacaggttcgggaatctaggcgctgttgcggtgcctttcgagaagcttgttgttgaacctaagaagaaagatagctttagaacacatatgaagcatgatttgcaatcaaaggaatatgatgcaagtatgaccgaggaagaaatggttgtcaacctcccagttaaaagagttgatcctccaaaagaggacaagacacaagtaataagaacaaaagaagtcgttctaatttctaaatatgaagatctacactgtatgggtaccaagaatcttccaaggtttattcatgaggtattccataattcaaataatatgattgagatttcattacttatattagaaaaaaaggataaaggagcgcaaccctcactagctgaaatttacattgataatcgaactcgaggaaatggaagcattgcgactgaaaaggcatccaatgtgattgatgaattaaagaagctcatggtagaggcaccagttcaaaaggttctcaagcgctcttga

SEQ ID NO: 44467 - DNA, 549 bp, Glycine max
  Peptide Sequence Number=SeqID_161245
atggcatcatcatcatcattatcatcatcaaagaggcatccattgtaccatggaatccgttgccgtggaggaaaatgggttactgaaatccgcgaaccgcgaaaaacaaaccgcatatggctggggacgttcctgactccggagatggcggccgcagcctacgacgtggcggcgttggccctgaaaggcggcgaggcggttctcaacttccctgactcggttggcgggtatccggtgccggcatccaaatcgcctgcggacattcgcaccgctgccattgctgcagcagaactcatgaagcctgaagcaagccacaacaacaacaacgttaatgcatcaacaacaaatgaggcagaagtagttcagtatgataacaataacgttttcacttcgtttgatactgagtttatggacgaggaggccatattttccatgccaagtttgctggtcgatatggctgggggaatgttgctatctcctcccagaatgagccctccctccgatgactcaacccaaagttatgttggagaaactttgtggaacttttga

SEQ ID NO: 44468 - DNA, 192 bp, Glycine max
  Peptide Sequence Number=SeqID_161246
atgtaccctcaattagcgggcaagtctatgcctaacgcaaagaaaaacccacatggaagtccaaaggtgcacttagtgcaaaagcaagtgctaagcgcaaagtgtgatttgaggatggttctaatctttgaaactcaacatctcctggagaatatctctgtgatgccaatcaacaaaatatcttcggagtaa

SEQ ID NO: 44469 - DNA, 351 bp, Glycine max
  Peptide Sequence Number=SeqID_161247
atggctgggaacgttgtggtttttgacttcgactcgacaatcatcgagtgtgacagtgataattgggttcttgatgagtttggtttaactgaaaagttctatcagcttcttcctaacatgccttggaaccctctgatggataagatgatgaatgaacttcattcacaaggaaaaaccattgaagacattgtacaagttctgaacaggactccaatgcatcccagcattgtcccagccattaaggcatcatattcccttgggtatatacctttttcctttctcttttcactcaccctttattacaagtacgatatgcctaatagcatagtaggaacaaaggtgaataattaa

SEQ ID NO: 44470 - DNA, 114 bp, Glycine max
  Peptide Sequence Number=SeqID_161248
atgggtgtttggtggtggaagctgtttgttgctgctcttgctgggattctcttctcaacccaacattgtgcttcccaaaaagattggagctatttaattagattactcatctga

SEQ ID NO: 44471 - DNA, 1410 bp, Glycine max
  Peptide Sequence Number=SeqID_161249
atggcttctagtggtgccacacctctgtgtaataatcattctctaatacatctcccaaaacgctccgttttgctgaaggactacctgagggatgacctcagttcgtgttcaacgaacggtttcaaatcgttcccgcgccgacaatgctgcaccaccgtgggattcttcggggagaaagatctccagctccaacgcaaaagaaggagcacgctccctcgacgacgatccacaaccatatcggccttgcagagagcttctggagcagtaatcaacgcgataaagtcactgccgccgttgtcacaaaagagtggtaaagcgaagaaaggtgttgccggtgttctttgtagaagcttctcgaggaaggttttgagtagaagattctggaggaaagcggcggcgagggaagagggaaacgaagatgtgccgcggaggaggagatctttccatgaactcatcatgctggatcatgaggagcatcgtaaagcgacgtcgttgaatgaggatagtactaccgtgttcgctgcgcatgccccgagcgtgaccacctcttccgcttgtggcagtgaaagctggggagacagcgagttcacttttacatctgccggtgcttcttcttcctctgagagctccaacgagaattacctcgtacttgagggtaccgaagagggtgcgccccatcacaaggtggaagaagtagtaactaaggaatattggccgaatgatgagaaggaacaatttagtcctgaatcaatactagattgcccgtttgaagatgaagaagatatttacaagtctcaaatcaattccacttccattactctttccttttctcaaggaaggaaacacaagcatatgcacaaaagatgccattttgaaagtgtggttccactggagccagtggttttagagaaaatgttcgcgcggttagagctggaggatgaaccacacaaccattatacaaaacaatgttcccgcttattagtgccaaaagtgcgtgcccaaaacaacttgcgtcgtgacaacaatcacaaccatgaggacaatgctcgtgatcttctcaacttcgttaaaaggtcaattacacccaacagtttgataacaaaggcagagaacctgctgtttgattacttcaagcagagtattgaggaaaacaaagacattgattattcaaagaagcttcaaatttgcaaggtagctgaagattggataaatggacaaccccaagaaatgtatttgggttgggaagtgcaaggaggaaggtgtgtctacattagggagatggataagtgtgaggagtggaagagctctgatcaagacatacaacaattgggtcaggagctggcaaacgaggtgttcactaatttggtgaatgagttcacacttgaactcacgtcatgtgctagccactaa

SEQ ID NO: 44472 - DNA, 258 bp, Glycine max
  Peptide Sequence Number=SeqID_161250
atgaggtaccacaattgcaagcagcacagcaaaagcaaaaatcatagcaagcacagacacgaatcaaaggcaaaggaggatggtgacgtggtggaggtgtttaaagtgatcaagtattgtccgaaacttcaaaatcttgtcaggctacggctgattctggttacgatgatgatggtgttcctagatgcattttatcgcaccttaaaacatgctctgttaataattatggtggctctgaaacagagtttgaatttgtaa

SEQ ID NO: 44473 - DNA, 924 bp, Glycine max
  Peptide Sequence Number=SeqID_161251
atgggtagggaagcggggtgggatggaagggtagtgaatgagtcgtacgaatgggtggagaagatagtggcatttgagccacaattgaagcagtggcagtcatctgtgcgggatggactaatagagataggtgtggtgcctaataatggcttcacttatgaccatattgatgggactaaagtagggggcaccatctttgaccagaatggcttcaggcacactgctgctgatcttctgcaatatgccaaacccactggaattaccctgcttttggatgccactgtgcataggatcttgtttagagtcaaagatagatcaaaaccaatggcccatggagtggtgtttagagattcattgggtcgtaggcacaaggcgtacctgaagcccgatccaaggaacgagataatcgtttcggccggtgcacttggaagcccacaacttctaatgttgagtggaattgggccggaagagcaccttaaagcccacaacatcagaataacattggatcagccattagtaggacaaggaatgtcagataaccccatgaacgccatctttgtcccatctcctgtccccgtagagatctctctgattgaggtggtgggcatcaccacttttggcacctacattgaagctgccagtggtgaaaactttgccggtggttccccaaaagactacggaatgttctcccccaaggggaaaaagaagaagatgagtaatcaaaaccaaatcaacctcgttaaattcagagtaaaatattgggcaactctcaacggtgcctccgaagcaaagaactccggaggccctagccaaggcaatagaagtgatggaaactctggaccaagcagcattcagaggtggattcatcctggaaaaaatcatgggtccaatatcaagcgggcatttggagctccgaagccgtga

SEQ ID NO: 44474 - DNA, 375 bp, Glycine max
  Peptide Sequence Number=SeqID_161252
atgggtcagctccagcgacaagccttttgcaaagcttacggtaagatctgggacctaaccatggtagaggtctccacggaggccattgcctcccttgcccaatattatgatcagcctttgaggtgctttacctttgggaacttccagttaacacccatgatgcaagagtttgaagagatcctgggataccctcctagaggaaggaaaccatacctcttctcgagattctatccctctttagctagaatttctaaaatagtcaaaatctcgacacaggaattagaccgcgggaagcaagtcgaaaatggggtgattggggtaccaaggaaatgtttggaagcaaaggcgaaagtcttggcaagtcaaggcgaatag

SEQ ID NO: 44475 - DNA, 891 bp, Glycine max
  Peptide Sequence Number=SeqID_161253
atggtgaaacgaacggtgaaggagcgaagaagtgaagagggtgaagatagtgtgaaacgggccctgaatggggtagtccccacggggatacccgagttgtggggagaattgtcatgcctagatgtgggtgcaggaatggcctttggcagtggtctcagtatattcattctctacatgacaaaggaccaaaagaagctcagactatggagattatcaggagagatggatgaaatgtctgcaaactcttggcatcatttgcatctctttgtgaagtcaaggtctggttcctcctcttcttcaaccatcaattctttagtgtctatggtgggagtttggagtcttaaggtgcctggtcttttaagtgctagccagcttggagagcaggtcagttctggtgttgctctccctaagtatatagtacatctcaaagaatttgaaattgtcaatgagagttttgacaatatggtagtacttgagctggactatttccttggtctgggttacattatcaagtccttcgaggatgattcataccctacttcccttcatgttggacgcgccgtcaacataaaggttccaccagtctgtggtggtttggtcattcccaacaaattctaccagaatgtcttccatgaattgtgtctttatggggctagggctcttcctcatggtgtcactccatctccacaatgtggttttggagttgttggaggaggattggatccttcgataggggtcttgcatttaaggctagactacgtgctaaccatggttgaaaaaaaaagagagactaaggggtgggctcctagacttcgcatgtcagctagagagtggcctttgttaggagggaaaaaggggaggaccagcaaaataaaggactctagcgctcaa

SEQ ID NO: 44476 - DNA, 459 bp, Glycine max
  Peptide Sequence Number=SeqID_161254
atgtgcggccccataacagaggacctcgaatatgtattcaagaagttcgatgcaaacggcgacggcaaaatctcctcttcggaactaggctccatcatgaagagccttggccaacccgccaccgaagaagaggtcaagaggatgattcaagaggttgacgccaacggtgacggccacatcaacttaggtgagttcttggaattgaacaccaagggcgtggaccccgacgaggttttggagaatctgaaggacgctttttccatcttcgacgtcgacggtaatgggttgattaccgcccaagaacttaacatggtcatggcgagccttggagatgcctgttccattgacgagtgccagaagatgatcgccggcgtcgacggcaacggagacggcatgatcaatttcgaagagtttcagttgatgatgaccggaaacggaaacgggaacatgaacaaataa

SEQ ID NO: 44477 - DNA, 386 bp, Glycine max
  Peptide Sequence Number=SeqID_161255
atggctgagcaaaccttcatcatgatcaagcctgatggcgtccaaagaggccttgacgtgttttctatttttggattttcagaaaatgggtccatgaatgttttgattggcgagatcattagcagatttgagaagaaaggtttctacttgaaaggtttgaaacttgttactgtggaccgtccttttgctgagaagcactatgctgatttgtctgccaagcctttctttagtggtttggtggattacattatctctggccctgttgttgccatgatctgggagggcaagaatgttgttacaactggccgaaagattatcggagccacaaacccagctcaatctgagcctggaactatccgtggtgactttgccattgacattggaag

SEQ ID NO: 44478 - DNA, 306 bp, Glycine max
  Peptide Sequence Number=SeqID_161256
atggcgagaagacgtagcagcgagtcgagtgaggatgacgtgaggaaacgcagtggtagtgaatatgaggatgaggagagggataggtatcggtgcggtggtgggagtagtaagaagaattccggtcactgtggtgacagtgatttgggggaagaacggaacggagctatgaagggtggtgggatgctaagtgataggaagagtaagagtagggagagaacggaggagtttgagagctctgaggaggagggtcagattgtgaacaaagagagggttagggaggagaaggaaggggatgggagatag

SEQ ID NO: 44479 - DNA, 186 bp, Glycine max
  Peptide Sequence Number=SeqID_161257
atgacagtttttaaaactggtgctttcctgcatagcgcgacatgtggcaccacaagacaggaggcgcagagcttccctgcacagtgcgacacgtggcaccgcaagataagaggcacaccgcaagacaagaggcgcagcgcaactacaagcgcagggctgccaggcgcctcccccaacaccctttag

SEQ ID NO: 44480 - DNA, 495 bp, Glycine max
  Peptide Sequence Number=SeqID_161258
atgcagaccactttgccgtacactgcagggacatcacaacaggagaatgccatgtcagccgttttgttttatccgcccgccagcccgcagcacagcgtggcttatttgcagcacaaactcagctactacaccgatgcctgggatctggcggcggatttggcgcagggcgtcacgcagattgtggtgattgatgcccgcagccgcgaggcgtatcaggccggacatctctgcggcgcgttgtcgctgccgcatcgcgaaatggatgcggccagcaccgcgcggctcgatcgtcaccgcgtctatgtgacttactgcgacggcatcggctgcaacggttcgaccaaagcggcgctaaagctggctgagctggggtttcaggttaaagagctgattggcgggctggatttctggaagcgcgacggccacccgatggcgtggggcgcggcggcaggcgagtggcccgccgctgcacccgcagcggagtgcggctgctga

SEQ ID NO: 44481 - DNA, 549 bp, Glycine max
  Peptide Sequence Number=SeqID_161259
atgcagcacgcctttttgccactgtttcgccatcagacgcagggcggtttacgtcagcggctgtgcgccacgctgcgccaggccattgtcagcggccatttgcgcttcgggcagaagctgccttcgagccgccagctggctgccgatctggcgctgtcacgcgtgacggttgaagccgcttacagccagctggagagcgaaggctacgtgcagcggcacagcggacgcggcaccttcgtcgctatcgccctgccgccaccggcggaaaaggcgacagcgcagcgcgcaccgcgcttttcgcagcgcggcacgcaggtgctggcgaccggtggctgccaggatcccccttttccccttgcctttgccgccggatcaccggaactgcgcgcgtttccgcaccgccagtggcagcggctgagccacagcgtacagcgcgcgctgggcagtcaggtgatgggctatggcgatccgctcggttatgcgccgctgcgccaggcggtggcggattatctggcgctgtcgcgcggcgtgcgctgtacggctgagcag

SEQ ID NO: 44482 - DNA, 399 bp, Glycine max
  Peptide Sequence Number=SeqID_161260
atggctcatgcctatgatttttacaagcctaatcttgccagtgaatatccagttgttgatgggaagctttctcaaacttgttaccttatggcccttgattcttgctataatcacttaagtcacaagcaccttatgacatcgcttaattacagatatgatatacaagagggaatgcaattttctatttctgatgctgaatactttgtatttcactctccatatgacaaggcatcccaacaacttgcaaagcctcaatacgatgcaaaggatggtaagagggtaatattgttctcgtatggaagtggcttaacttccacaatgttctctttgcaattacgagaaggtcaacatccattcagcttgtcaaacattgctaaagtgatgtttctagcaaattga

SEQ ID NO: 44483 - DNA, 615 bp, Glycine max
  Peptide Sequence Number=SeqID_161261
atggaatggtttgtggctcgtgatggaggaagggtcattaatggttggaagagagaggaatatttggtgagtaagggcgtcgtagttgtgatggtgatatctggactgatcctagtgactttagccattgtactcctagcattacatcagctccacaaattggaagaatatggaagtcaaccaaaaaggtgtgtgcctgaatgtgtcccgcaacttccgaacaaacttggttgcactgaagttgtgtgtgcttcctccatcaatgagaatctgaacatggtggttttcaatgaggcccgtgactcacaagctggtgatgcctcctgtgaagctataagagctgttggagacggaggattgggatcaaaatcctgcagacactcctcatcctctataacaaacaggaacaaggacggggtgcacttatggccacgaatggtggttgtggcgggtttagctggtgacaaagttaagagcaactcaactggtttagtgacaaccggtggtgatactcatggcggcagactgtacgacgaactaggggagtttcaaactgaagatcgtcgcccatctagcatcctttcctcatgtagtctagcaaaggagatttcctga

SEQ ID NO: 44484 - DNA, 1833 bp, Glycine max
  Peptide Sequence Number=SeqID_161262
atgcacccatctcgtgctgaagcagaagcagcatcacaaccgtgctttaatggctgtttcccatctccactccttgcctctgagaggtcccatagaactacttccaagcccaaagtcaataatgatgcaacttcatcacacgatgacttcgtcgcagccacatcttccacccttcacccacacacaaatttcacaaaccacgagtccctcccatctttgcaagactcatacatcagcttcaccaaagtattccctcagttctccacaacttctgaagttgatcgaattcgagcccgagaataccatcacctgaaccactcctccaactcttgcttcgactacactggatatggccttttctcctacgatcagcaacaaagatcttactcttaccccacagttgcttcttcttcttcgtcatcattgccttactttacatcagatgcatctttctttgatatatcatacaagtcagtgaacttgcagtcacaggttctatacggtggacacgaatcagaactagaatccagaatcaggaagagaatcatgtctttcatgaacgtctccgaggctgaatacacccttgttttcattgccaatgaggtatctgcttttaaaattgtagctgattctttccaattccaaaacaatagacagctcctcacagtgtatgaccacagcagcgaggcactggatgtgatgattgagagctgcaagaagcaaggggtgcatgtcttgtcagcagaattctcctggccgaacctcggaatggagtggaggaaactaaagaagatggtaacgaaaaacaaaagggaaaagagaaaaggaggtttatttgtttttccacttcattcgagggtcacaggagcaccatattcctatgtttggatgtccatggcacaagaacatgggtggcgtgttttgcttgatgtgtgtgggctcaaacctaaggaaatgggcaccttgggtatgtcactttttaagcctgatttcatggtttgctcgttctacaaggtttttggagaaaacccttcaggttttgggtgcttgtttgtgaaaaagtctagtgtatctgctttgaaagatcctggtaatgccataagcataggaatcataagccttgtcccagcatttagacatgagaccaatgaacaagtagttattgaaactgaaacggaacatcatcagcaagtagaaattgaggagctaagcataccctttgactcatctacagatagaaacagattaggtactaaaaatgaaggcttagagattcattgtagaggattagatcatgcagactcggtggggttattactaattagtagcaggaccaagtacttggtcaattggctggttaatgcactaatgagtcttaaacatccacatcatgaagatagcatttccctaattaggatttatgggcctaagataagttcattacgtggacccgctgtggcatttaatatatttgactggaaaggggaaaaaattgatcctgcacttgtgcagaagcttgctgataggaacaacatctctttaggtagctcatatttgagaaatataaggttctctgacaagaatgaagaggagagacattattgggccttggaaacaagaggtggttctgaggttgaagggttgggcctgtccaagaagacacgtagccaagagcctgggatttttgttgtgactgctgcactgggcctcttgacaaacttcgaagatatctacagattatgggcttttctttctaggtttctggatgcagattttgtggagaaagagaggtggagatacatggctctaaatcaaaagactattgaagtatga

SEQ ID NO: 44485 - DNA, 1683 bp, Glycine max
  Peptide Sequence Number=SeqID_161263
atgaacggtggcgatgaggtagtggcagctccggcggctccaccgcaccctctggagtggaaattctcgcaggtcttcggagaacgcacggcaggggaagaggttcaggaagtggacataatttctgctattgaatttgacaagtctggtgatcatcttgctactggtgatcgaggtggtcgagtggttctctttgagagaacagatacaaaagatcatggtggatcaagaagggatttggagaggatggactattctattggtaggcatcctgagttccgttacaaaacagagtttcagagtcatgagccagagtttgactatcttaagagtttggagattgaagagaaaatcaacaaaatcagatggtgccaaacagctaatggtgccctgttccttctttctacaaatgataaaacgatcaaattttggaagtctgccatggtgtcagtcttaggcactgcagaaattgtgttgagaaatatttttgctctgcagctctcaccctctactgttacagaaatcatggttcaagaaaagaaggtcaagaagatttctgagatgaatgttgacccttcaaaatctatggggaatggatctattgctagttcaagcaattcaagtagttctaggccatatcttgtaaatggaggatctccagatagatacaattatataagcaatgacttttcatttccaccaggaggcctaccatcactaagattacccatggtaagtagccatgaaaccagtttagttgctcgatgtcgtagagtgtatgcacacgctcatgattatcacatcaattctatttcaaataacagcgatggtgaaactttcatatcagctgatgatttgcgaataaatctttggaacctggaaattagcaatcaaagttttaatattgttgatgtaaagcctgcaaatatggaggatctgacaggtctgggctcaaatttctctaccagacttgagccattcaagttgggttggacctgggttcatcttaaaaagcttgctgttcggattaggtattgtctaagctttgggctggtgtggctggcacagcctcacctagactcaatcttgaccagctctagggttgggaaacatgataaaaaaatcacccaaggtgaatcaaggggaaaaacaggtgggttgaaggttggtagggaaaaacagggggttgaagaggttataacatcagcagaatttcaccctacacattgtaatacgttggcatatagcagttcaaagggttcaattcgtcttgttgacttgcgacaatcagcattatgtgattctcatgctaaactatttgaggaacaggaagccccagggtccagatcatttttcacagagattattgcttctatctcagacataaaatttgggaaggatggaagatacatactaagtcgtgattacatgactttaaagttgtgggacattaatatggattcaggccccgttgcaactttccaggttcatgagtatttgagacccaagctttgtgatttatatgaaaatgattcaatcttcgataagttcgaatgttgtctaagtggtgatggattgcgcgtagcaactggttcttacagtaatctatttcgtgtgtttggttgtgcccctggaagtgctgaggctacaactctagaagccagtaaaaatccaatgaggtaa

SEQ ID NO: 44486 - DNA, 630 bp, Glycine max
  Peptide Sequence Number=SeqID_161264
atggacttcccagccaacggcgcctccgcggcccattccctcaacttcctcatctacggccgcgcgggctggattggcggcctcctcggcaccctctgccgtgcccagggcatccccttccaatacggctccggccgcctccagaaccgcgcctccctccaagccgacatagcccagctcaagcccactcacgtcttcaacgccgccggcgtcacgggccgccccaacgtcgattggtgcgaatcccacaaagtcgagaccatccgaaccaacgtcatcggaaccctcaccctcgccgacgtctgccgcgaccacggcctcattctcatcaactacgccaccgactgcatcttcgagtacgactccgatcacccccttggatccggaatcggcttcaaagaaaccgacattccgaattcgatgactatattggatgaactgcttcctatctccattgagatggggaagaggaatctgactgggatctggaactttactaaccctggagtggttagtcacaatgaaatcttggagatgtacagggattatgttgaccccaatttcacttggaagaacttcactcttgaggaacaggcgaaggtgattgttgctcccaggagcaacaattaa

SEQ ID NO: 44487 - DNA, 778 bp, Glycine max
  Peptide Sequence Number=SeqID_161265
gatccgaatacccgccacctgcgccgcgcggatcttccagctcacccgagagctcggccacaagtccgacggcgagaccgtccggtggctcctggagcacgccgagccggccatcatcgaggccaccggcaccggcacagttccggccatcgcggtctccgtcggcggcgcgctcaaaatcccaaccacctcatccaactccaacgaggaagccgccgccgccgccgcctcctccaacaagaagcggaaacgcccctctaacagcgagttcgtggacataaacataaacataaacgacgccgtttcaaagtcgtccggtctggccccggttcatgtgccgcagggcctggtcccggtctgggccgtaagtaaccccagcatggtgatccccgctaacactttctggatgatccctcaggccgcgaccacacctaacccctcgggtggagtagcgggccctgcaagccagcagcctcagttatgggccttatctccctccgtgttcaacgtcgccgccaggcccatatcgcctctggttacaaccaatattccagaagcccggcccgttatgacggcctgcagtaacggttccaactccgccgttagcacgagcacggtgggggctaagctggcaacgaaatccagcatggcacccagtgttagttctagcggaaccaagagtggcaagactcaaatgttaagggatttttcgcttgaaatttgcgataaacaagagttacagctcttgggccgctctgggactcacgcgcagagttag

SEQ ID NO: 44488 - DNA, 528 bp, Glycine max
  Peptide Sequence Number=SeqID_161266
atgaaacaccttttccccctaagctttttcaaacacattctatctgattcactatgtgattcaggagtcagtttgggagaaggaacaggtgcaacaatgtcagatgatgaagatgatttgcagatggatggctctttagaccagtctagcgctgagggacatgacttaatgggatttggtccattgcttcctacagaatctgaaaggtccctgatggaaagagttcgtcaggagcttaagattgagctcaagcagggttttaagtctagaattgaagatgttagggaggaaatattaagaaaacggagagctgggaaattgccaggcgacacaacatcggttttaaaggcctggtggcagcaacatgctaagtggccctacccaactgaagatgacaaggcaaaacttgtggaggagacagggttgcagctgaagcaaatcaataattggttcatcaatcaaaggaaacgcaactggcacagcaactctcaatcagttacctctctgaagtccaagcgcaagaggtag

SEQ ID NO: 44489 - DNA, 684 bp, Glycine max
  Peptide Sequence Number=SeqID_161267
atgattattcacccttcaagtattctgtcatgctatcgtatcaaatcagaggtgcctaagaaacttttcgttgtctattggagatgctccagtataaacaaaacagttgaacgctatcaaaggaagatcgaggacctgggtgtcagcaacaaaggaatccatgaaaatacacagcctcctacagtttttagttgtgtctgtcatgaaatataccgtaaatggaagttgcatgctgatattccttataaacatctgaaggaagttgatatgagcatggcaaagaagatcgagcatctagaagattcaagaagaaagcttttgggagatgaattggataaatgcagtattgacgagttacaacagctagagaaccagctcgaacgcagcctggacaaaattagggcaacaaagaacttggtactgcctgtgattcagaatcaattgttcaggaagcgaatcgagaagctaaaagaagaggaaaagtgcttactcgaagtaaataaacgcttacgtgagcagtaccggattgaacgacaacgttgtttgagtgatcaggatgtcgaattcgccacaaaaaaggagggagaagaggtggagacggagttattcataggaagacctgagagaagaatgccgttaaagttgaaacctacaacatatagtgctcatgcatacatagcgtaa

SEQ ID NO: 44490 - DNA, 120 bp, Glycine max
  Peptide Sequence Number=SeqID_161268
atggacgatagcaatgaaaatccaaggcttcctcaccgtcgcaatcccaacgaatcagtttcattggaccaattagcagatagtgcttcaattgttacctcttcagtcttcattgattaa

SEQ ID NO: 44491 - DNA, 213 bp, Glycine max
  Peptide Sequence Number=SeqID_161269
atggtgccaagaagtgactattgtcacagggctagcttggcaacactgactaaagcaagccattatctattggtgagagccctaccattataccatggtggaaagagaagattggatgcaccatacgagttaaaggggttggaacaaaaaggctacaacaagcacattcaatatggatggatgtttcaagagaaagaagaggattcttcctaa

SEQ ID NO: 44492 - DNA, 246 bp, Glycine max
  Peptide Sequence Number=SeqID_161270
atggggtcgaaccaagcgccctcctttaaaaagaggttctatcatgtcaaagtcaagagcctagatctagccagcttgcgagagctagggcaacggatggatcaagttcgatgtcaagccttccacaaagcgtatgggaaaatctgggatttggccctgatagaagtgtccgttgaagccatcgcatccctctctcaatactatgaccagtcgctcagatgcttcacgtttggggactttcagttg

SEQ ID NO: 44493 - DNA, 444 bp, Glycine max
  Peptide Sequence Number=SeqID_161271
atgtctctaaaatatgatgtcatgcaagtcagtggtaaactttactccattcacactgagcccgcaggatcaaatgtgaaatccttccaggttcttttacgcaagcaggaaggagatcgatcagtgtgggaatacccatttgcagttgctggtgttaacatcacatacatgctgatacaaatgcttgatcttgaagcagtcaagccacgcaatctggttggagcaacttttctaaaatttcttgcagaaaatgggtcagcttttgatcttctctattgcataactttcaagctaatggatcatcaatggcttactatgcgtgcctcatacatggattttaatgcagtgatgaaagaaacacgacgtcagctagagaaagagcttctcattgaagacatagcccggcttgaagatttaccctcatacaaattactttcccgataa

SEQ ID NO: 44494 - DNA, 399 bp, Glycine max
  Peptide Sequence Number=SeqID_161272
atggacgatagaggtagctcattcgttgctgttaggagaattcctcaaggagaaacctgccatccaaattctgggattgtgtggcatgtgggtccacgtccagaggttgtggcagggtcagctgcatggctaggtcgaggtctgtcttgtgtctgtgtacaaagaagagatagtgatgtttctaacactttcgatttaaccctagcccaggaggaatgcttgcagaggatacagagacgtatagatgttccatatgatagttctataattgagcaccaggatgcccttagggctttgtggaatgctgcgtttcctgaagaagaacttcatggcttgatatctgagcaatggaaggaaatgggctggcaaggaaaagatccatcaacagattttaggtag

SEQ ID NO: 44495 - DNA, 999 bp, Glycine max
  Peptide Sequence Number=SeqID_161273
cgagcgccatctgacgcgcctgtttcgccagcatctgggtatcagcgtgcgggaataccacgagcagctgcggctggtgattgcgcgccagcgccagcagcagggggaagcggcggagaaagcggcgctggccgccggcttctcctcggcacgccagctgcgccgcgcccggcagcgctgggacgatcagctcaccagatgatgcttgtccacgcgtttcagcagcatcgccagcagcaggctgcccagcagggttacgccaaacacccatggcagatccagccacggccgcgacggatcgtcgtaatgatgggtgcgcagatacacatttttaagcagcgccagcaggctaatcgcggcgataaacaccagcgggccacagtagagattccaggtgtcattaaacgcgccgttaattttcagcatctgtctggtgccgagcgcgataccgatgacgcaggcgacaaaactcaccccggccagccagctgatgccgcgcctgtcggtatccatcacgccaatcgcccgtccaagcagcgcatacagcaggtagtaaatcgagtcgccgctgacatacagattgaccggcagccagtggaacggccccagcgactggctgacggtattcggattagcaatcaccgcgaggatcagcaccagcagcgccacatagcgcggcggcacatttttcacctgaatcagcggagacagcagcgaacggccttcgctgatcggcgtcagccaggtgatgtaggccagcgcgacggcgctgtagaacagcaggcacagcacaatgcgcagcagatgacggccctgcgcgctgcgttcgccaaagaacagataaccggaaatcatgaagaacagcggcacgcagacgcgcgaagccgagttaagcagattggcgacgtcccagctgggtccggtgactgccatcggaccggtgatgtaccaggtggtggtgtgaatgacgatcaccatcagacaggcgaccgcgcgtaa

SEQ ID NO: 44496 - DNA, 339 bp, Glycine max
  Peptide Sequence Number=SeqID_161274
atgtcagacagatcttatgatgttgcaccaacaccatctccatctccgattgaagccagatcatctttgactgaagttagaccatcttcatctccgattaatgcacgtggatcgtccccggtacctacatccacaccatcctcatccccgactgtatcaaacatgtatgctgatgaaaatgttccaaatttggccatggaagaccccccccccaatgatcgtcttacggttgcggaaaaggttatcacattgtccattagacaacaatttgctaacccatggcctacatggggagtgattccaaaagatcatcaagaactcttcttccaatgtttcaag

SEQ ID NO: 44497 - DNA, 279 bp, Glycine max
  Peptide Sequence Number=SeqID_161275
atgcacataggtggttctattagcttggaggttcacatcattcgcttgcggttgtgtttgaatgacaagaagattttgaagctaaactatctcaagctaggtttgatgctgcatcaaattcagttgtacttcagttcctcccatctgaagtgcagaacattattcatcaacatcaacaacttgaccaacaacaacaaaacaatgaccaaccaaatgactaacaacaacaagacaatcaccaaccagataaccagtagcaataagacaatgaccaactag

SEQ ID NO: 44498 - DNA, 1821 bp, Glycine max
  Peptide Sequence Number=SeqID_161276
atgtctaatggagaggtttctaaatctattatcgaagtgctgaccaaaaaaatatccattatcaaaacaagttacttgaactgtccgaagctagtggacaaaaatagattcatggaatgcaatctctttgttgtggatcccccatgcaaagagggaatagttaacaaccttggaattgggaagaaaatagattattttgacacatttacgcatgactgtgctgaacaaaacagtattcatcatgtggatgaagatggtattggtaaaagtaatacttgcaaagatcaaccaagagaaccaaatgaagatgatgaggtggaaagtggttcaaagaaagggctgattgattctggcacaaatagagtcaaggaagatgttgctcagagggtcaatgctgcactatgtggagaagcattgactaatggtttggaacaaaagaaccatgtccatgcaatgaatttggaaaaggagagtgagagaaacacagggactaagtctactaataaaatatcaaattcctcttcaactcctaagcgacctttgaaatcttctagcatattaaagggaggacagaagaatgatctccaccccaagtcacaaattcttaaagagtcattagtcagtaataaatttggtaatgttccaaaaaatgttgatcaacgtaaaaatgaacagaatcttacagcaaggaagcaaaatcataaagagaacatggctggaaatattgccactactactaaggtggagaaaagagcatatccatcatttgaagcttttacaatagaggaagaagaaggttcaggtggttatggcaccgtttaccgtgctcaaagaactactgatggaaaacgggttgcaataaaatgtcctcatactaatgctcataaaaaccatgtaaataatgaacggagtatgctcgagcgttttggtggtaaaaactatataataaggtatgagggctcttttaaaaatggcaacagcgactgctttgttttagaacatgttcaccatgatagacctgaggttttgaaaaaagaaattgatatagttcagcttcaatggtacgggtattgcatgttcagggccctttattgcttgcacaaagagggagttgttcacagagacattaaacctggaaacttccttttctctcgaaagctaagcaaaggctatcttattgattttaaccttgccatggatttaaagcagaagcacaacatcggaagtaaatctaaaccaagccatgatgcagcatccaatattgtttctttctcttctggttctgcccctctggtccgagacaagaaccttggaggcagcaagtctttaacatccaataaaagggctttggcagattataagaattattctgaacttaataggcatgtaaagcaaaaggattgtaccggtcctctgaaaaattgtcctgataaggctggtgggagttttcttagagcacaaggaacagatggctctggtgtaacttctgcgaaagatcctagcactaggactgcttctgcagagaggctcagggaacctttaccttcccatggaagaaaggagcttatcagctttgtgaataccatgaaatgtgcaaacaacagttcaacaataggcccttcttcacaaaggaaaagggttactgctccctcaagcaaggtagatggcaagatttttaatattactccgatgcctttgcattcatctactgttggtgggggattaatgagaagcaaaggtgatggaaagaaaaaagaaggttcatgtgttggaaccaaaggattccgtgctccggaggtgcttgttgaaaaagagaattag

SEQ ID NO: 44499 - DNA, 583 bp, Glycine max
  Peptide Sequence Number=SeqID_161277
cgcagtcaagacgaatctcaatggaaaattcattactaatgacgatgataaagagattcctgtcgctgtcaacacattaatttttacaatagcccaacattttattggagacccatccttatggaaggataagtctgcagaattattatcaaatcttaggtgtagaaccttagcagattttaggtggtacagagatactttcctaactagggtttacaccagagaagatagtcaacaacctttttggaaggaaaaatttctagccggtcttcccagatcgttaggagacaagaagttaagaaatcttaacctagaacccgcaattgaagagcaaataaacaatttgctcatagaaacctcggaggaagaaacagaaacttcatcctccgtgctttccgacgaagacctaaacttaatccaacaggatgaccaattatcatcgacagatgatgatgatgggcaaatcaatactctaacgagagaacaagatctcttgtttgaagcaatcaattccatccctgatccccaggaaaagaaggtttttctggaaaaacttaagaaaaccattagaggtaaaacctag

SEQ ID NO: 44500 - DNA, 294 bp, Glycine max
  Peptide Sequence Number=SeqID_161278
atggtgcccttgaccaagaaaccacaactccacggaagcagactacgaaagggactgacgacgaagctgacgggaccaaacggatcagctttcgacggaagcgcggtggcgcgtgggcttcacatgaagaaaatcgcacgagacaaaggcggcatgtgggagctcctttggcggtgcgacttccaggggtgggttgcatttttcgaggcgatcctaaccctggtcttgccagagaaaacgaatggagatgacggcggccaacggcggacagaacccgctctgatgccaacttga

SEQ ID NO: 44501 - DNA, 176 bp, Glycine max
  Peptide Sequence Number=SeqID_161279
atgtctcctccacctctagaaacctcacaatctctcaaaatctcatccaaagcttcgcaagatggcttcctcgtcaagctcagctctctcttagtctctccacagctaaaaactctcaaaaaactcaacaacctctccaaaatcgagatttcagctttaaataggcattcctgtcg

SEQ ID NO: 44502 - DNA, 366 bp, Glycine max
  Peptide Sequence Number=SeqID_161280
atgaagaacggacgaaaaccttcacggatttgcttacggaaacatctcggaagcgttacggaagcacctcagcttggattttcttcacggaaacaatttttttcacccaaaacagctgaaatacatagccagggggaaaaagggagaggaggttgccgcccagctcgcccaggcgaggaagcaacccagctccaaaaaacgttctggaagccttacggaaaaagttatgggaattttacggaagcattacgggtgtcccggaagccccggaatcccatttttcaacaaaacggggggtgtggtggccatctagctcgcccaggcgagctcagctcgcccaggcgagctaggttacttcaaccttaa

SEQ ID NO: 44503 - DNA, 1371 bp, Glycine max
  Peptide Sequence Number=SeqID_161281
atgaagctcctcgaatcgaagaaaagagccgaggcatggccagagtcatcggaaaacccttcagacaccggtccaccgcacaagaaaactagggatttgcttaacatgaccgaatgccacgtgtgtggcttcaaggttgacgtctgcacaggtaagaacagactccgaaccctctatagcgaatggcgtgtggttcttctctgtaagaaatgtttttcttccgtcgaatcttcccaaatttgctcctattgtttttccggagcgtctcctgaatcatttcgttgcaatcaatgtctgcattctgtgcacaaatcttgtttcttaaagtacagaaacgctgctccctggtcctatgcttgtttgggctctgaattttctgtatgtgtggattgttggattcctaaacacttggcaatttctagaagaaggaataaaataggagttaagaatgggaaacatgttagggttatacctgataagggcagttctagggtttttgggggtgggaatttggtgaggtcaatggaggatttggttgaggatgcaaaacgcacggtggaggtgaaggttgaggctgcttcaagggctagagaggaggcaatgaagaaggctttggtggctagaagttctgtcgagattgctaacaatgctttgagtttagtagcaaaaaatagggaggagagtagttgtctgaatctgcctcccaaggtggatgatgctgttaaagttcttgatggttctgagtttacttttgagttgcatccatgtttcgataggggcttgcccaggatttcaaagagttgctgcttattgaatgcaagttactttgatacttcaaagcggtggacctctagtgttgatttgtcgtgcaagatatcaaaatctaggaatgctagtgatcgtgataagcatgaagtagtatccaacaattctgtaggagcagccttggatagtggttccttaactgatctcaatcttctctacatgggcacaagtggcatggaaactggtttaggcacagctgaatttgacagtgaagggataggggaagaagagctgttgaaggaaggggagggaagctgttctgatcggctgataaacttcagtgaagatagtggcatggaacttgatcacaagcaagcagattctgcattgcatggggaagaacaatgcaatgggcaaccagatcgctatttgttcaagtatagtaggagatgcaatggccaaccagattctgcattgcatacagaagaacgatgcaatgggcaaccagatcgctatttcttcaagtatagtaggagatgcaatggccaaccagatcactatttcttcaagtatagtaggagaagtcgtagtttaaatcaaatttag

SEQ ID NO: 44504 - DNA, 1782 bp, Glycine max
  Peptide Sequence Number=SeqID_161282
atgcctccaagctctaaattcagaagagcccttggggcagtgaaggatcaaacaagcataagcctagccaaggtgggaagcagcacctcacttgctgaccttgatgtggccattgtgaaggcaacaaggcatgatgaataccctgcagaagagaagcacataagggaaattttgagcctaacatgttactctcgagcattcatcagtgcatgtgttaataccctggcaaggcgtctcaacaagacaaagagctggacagtggcattgaaaacactcattttgattcaaaggctgctattagaaggtgatcctgcctacgagcaggaaattttcttttcaactcgtcgagggactcggcttctcaacatgtctgattttcgtgacagcttaaaatctggttcgtgggacttctctgcatttgttcgcacttatgcgttgtatctagacgaaaggcttgagtacaagatgcaaagccggcgtggaaaacgcagcatgtatagttttgatgaagatgaggaggaaagggaaagagaaaaagaaaaggaaatcattgtaaggtccacaccggtgcgtgacatgaagttagagcaaatcttttccaaaatgcagcatttgcagttgctgcttgagcgctttttagcttgccgtcccacaggaggtgcaaagaaccatcgaattgtgatagtggctctctacccgattgtgaaggagagttttcagatatattatgatatatcagaaatacttggtatcttaatcgatcgcttccctgacatggatgtgtcagactgtgttaaggtatatgacattttttgccgcgttggaaagcagtttgatgagctagacctcttttttggatggtccaagagcattggaattgcacgctcttctgagtaccctgagattgaaagggtcacactcaagaagctagaggtcatggaagagtttatcaaggacaagtctgccttagcacaaagcaacatacctgaagcaatagaatataagcaccaagaagaagaaaaagaagcttacgaatcggaaccggaagaggatgttaatgcaacgaaggcgctaccaccaccaccagaggaaatcatcgaggaaccggttgaagaagtgaaggaagagccgaaggaagaaaaagttgtgcagacagagggagatttgttgaatttaggagatgacatgatgacaagtgaagcacatggagagaaactagccttggctttgtttgatggagcagcaccagcagctgcaggaggtgccacacaagcacttccatggcatgcatttgatgaagggggagattgggaaacagcactggtgcaatcagcaaccaacttgggaaaccaaaagccaacatatggtggtggatttgatacattgttgttggatggcatgtataaacaaggagaaatgaatgcagccatgcaagggcaagggtacggggtgagtggaagtgctagtagtgtggcacttggttcagctggaaggcctgcaatgcttgcattgccagcaccaccaacatcatggagtgggagtgattctaacaattctgacccatttgcagcttcattggctgtggcacctccttcttacgtgcaaatgtcagagatggagaagaagcaaaggcttttgcttgaagaacagatgatgtggcagcaatatgcaaaggaaggcatgcaaggacaagcagcactagcaaaattacactctaacaacaacaataacaattcttacactggagggtatccacaaaactacggcaactattatcgttaa

SEQ ID NO: 44505 - DNA, 201 bp, Glycine max
  Peptide Sequence Number=SeqID_161283
atggcgatggcgatggcgatggcgatggcgaattggatgataaaatgcatcaccattcagggattcacaactattcaaccatcaactcaatacacgattgaaagtcgccttttccctcagtgcactccacgttttcatacatgccacccaaatagagttggctggctgatgctttgcaaaattcgggctaggaatgtttga

SEQ ID NO: 44506 - DNA, 375 bp, Glycine max
  Peptide Sequence Number=SeqID_161284
atgggtcacgaacactccaagttgtcagaaggaaaaggatcgcgtcgtgcccgcttcaaagagcgtctgcgtcttcactttcgccgccgcagaagcggcaatggctcttccgatcacaagctcctccacgccgataacttcgccggaatcgctctcctcgccctccttcgcgcggagatgaagttcaaggataaatggattgcgtgcctttccctcggagaacagactttccgtaccaacacctctgaccagttaagctcttcttcatcttacctctgcaatacgcttcattcattctgttgtgctgattttgtgttattgatgatggtgcagcacagacaaacctctttggaactctgtgagtactacttttaa

SEQ ID NO: 44507 - DNA, 219 bp, Glycine max
  Peptide Sequence Number=SeqID_161285
atgataatcaatcaacaagtgaaagtgcccttctccattggaacatatacagatgaagtgatttgtgatgtagttcctatggaggtaggacaccttctcttagaagcaaagcttcatggtgaatcaaaggtgattcaaaggtgttttgatgataacaataatgatgacaaaggtgatgacaaaaagctcaaagatcaatcaaagaacaactcaaagtga

SEQ ID NO: 44508 - DNA, 381 bp, Glycine max
  Peptide Sequence Number=SeqID_161286
atggcagagtccgaattcgaaccaaaccgagtccatgacctcgaagagaaatcgtggcacctcctcgcgctcctcttccgaatcggccacgccgtttacccgcaacgcctcgccgcgcagtgccgtttgttcgccgcctcgcctgacttcgtctgctacgtcagcactctccccggctcgccgctctccgtcaccgacaacgggctcgtcacgccctccgtcagcgccgtcttcgccctcggaagcttcttctccctccgcttctcgccgccgcagacgcaccgtttcaggaaacgcaagttgcttttcgattccgccgaagatggaagagagcgcaagaggttagcgattcgtcatggacttcgagaattttcgttccag

SEQ ID NO: 44509 - DNA, 2742 bp, Glycine max
  Peptide Sequence Number=SeqID_161287
atgaatgcttcagcaaaccttgcaagcaaaacttattccagaggcaacaaacctggaacacgaggcaactggagaggctctaacttcagaggaggtagaggaagaggtagatctaaaccaacatgtcaggtatgcaacaagtttggtcacactgcagtgcaatgtttttatcgatatgacaagtcatacacaggctcaaatgctgagaataacacgcaagaaaatcacagtgccttcatagcctcaccctaccacggccaggactatgaatggtactttgatagtggagctagcaatcatgtgactcatcaaaatgagaaactccaagatctcagtgaaagcaatggtaagaattctctgttagttggcaatggtaaaagattgagcatattggcctcaggctcgactcaattgaataacctcaacttgcataatgtcttgtatgttccagaaataaccaaaaacttgttgagtgtatctaaattaactgcagacaataatgctcttgttgaatttgatgcaaactgctgctatgtgaaggacaaactaacagggaaggcactactaaaagggaaacttagagatggattataccaactttcaagtgtcaaatctcaagtcaataaagacccatgtacctacatgtcagtcaaggagaattggcatagaaagcttggacaccccaacaataaagttctggaaaaggtgttgaagaattgcaatgtgaaggcttcgtcaaatgatcaattttcattttgtgaagcttgtcaatttggaaaacttcacttgttaccatttaaaccctcttcctctcatgctaaagaacctttagatttgattcatagtgatgtatggggtccagccccaatcttgtctccatctaatttcaagtactacgttcactttattgatgatttcagcagattcacttggatttttcccttgaaacaaaaatcagaaacaataacggcttttattcaattcaaaaacatggttgaaaatcagttcaacaggaaaataaaagttcttcaatgtgatggtggaggtgagtataaacctgtccagaaaatagccatagagtcaggaatccaatttagaatgtcttgcccatatacctcccaacagaatggtagagcagaaagaaaacatagacatgtagctgaactagggctcacactactagcacaggcaaaaatgcctttacactactggtgggaagctttctctacctcagtttatctcatcaatagattaccttcatcagttaacccaaatgaaagtccatattcattattgtttagaaaggaacctgattataatgccttaaagccttttggttgtgcctgctatccttgcctcaaaccatacaatcaacacaaacttcaattccataccactaggtgtgtgttcttgggatatagcaactctcacaagggatataagtgcctcaactctcatggaagaatttttgtctcaagacatgtggtcttcaatgagaaccactttccatttcatgatggctttcttgacacaaggaacccattaaaaactctacctgaaatagtacctattgtttttccttcttgtcttgcagataccactacaagtcacacaattgaaccaactattagtgatgtgaaccatcaggaaggtgacttagctgtcaatgaagatcaaccagccctcagtgagactgcagaaaatgaagcaacaacaacagtagaaccagcagaggacacatcagtagacacaccagaagacaaccaacaggcccaggacaacaatctagcagaggacacatcagcagacacaccagaaaataaccaacaggcccaggacaacacacactgtatgcgtaccaggagtaaggctgggatctacaaacccaaattgccttatatagggttgacagtgacacacaaagaggacaaggaaccagaaaatgtcaatgaagcacaagtcagaccaaggtggaaagaagctatggatgcagaatttaaagctctaacagcaaatcacacttggatattggtaccatttcaggggcagaataatatcatagactcaaagtgggtttttaaaaccaagtacaaggcagatggctcaattgaaagaaggaaagcaagattggttgccaaaggctttcaacaaactgcaggtctagactatgatgagaccttcagcccagtgatcaaatccagcactgtaagaattgttctatccattgcagtacatttaaattgggaagttaggcaattagacataaataatgcattcttgaatggcaatctcaaagaaactgtgtttatgcatcaaccagaaggatatatagattcaaccaggcctcgtcacatatgcaaattaactaaggcaatttacggcctgaagcaagccccaagggcttggtttgacaggttgaaggacacactactagaatgggggtttcaaaacaccaagagtgattcatcactgtttgttctcagaggaactgatcatatcacactccttctcatatatgttgatgacataatagtaacagggagcaataagaagtttctagagacctttatcactcaactaaatattgctttctctcttaaagacttaggtcatctacactacttcctaggagttgaagttcacagagacactggtggaatgtacctgaaacaaacaaagtacattagagacctgctcaagaagtttaatatggaaaaagcctcatcctgccccacagcaatg

SEQ ID NO: 44510 - DNA, 369 bp, Glycine max
  Peptide Sequence Number=SeqID_161288
atggcatccaggaagagaaaaagcacagcttccagacctcaagctcaatatgataccaggcgattccagtctttggaagcttggaacaaatacacggataacattctcggccaaaatatccttccggagagaaatgttcagatttatcatattgagtttgatgagttcaaggtggagttggagaggcgtaatctacacaaacgcctcaccaacctccaagaaggaagcattgatgtggcggttgtcaaagaattctatgccaacctatacaaccctgaggatcaatcgcccaagcaagcaggaacaccagttgatgaaaggaaaaccagttgtgctagaggagggggagaccctacccacctactctag

SEQ ID NO: 44511 - DNA, 342 bp, Glycine max
  Peptide Sequence Number=SeqID_161289
atggtagaagtctccgtggaagcaactgcatcccttactcagtattatgaccagcccctaaggtgcttcacttttggggacttccaactagtacctactgtggaagagtttgaagaaatcctgggatgtccgctgggaggaagaaagccatatctcttttcggggttctatccctccatggaaagagtagccaaggcactgctgatatttggagtcgtcctctttccaaatgtggagggtttagtggacctagtagcgattaatgctttccttgcttatcaccatagcaaggaaagcccgatcattgctattttggttgatgtctatgacacatttgactga

SEQ ID NO: 44512 - DNA, 144 bp, Glycine max
  Peptide Sequence Number=SeqID_161290
atggacgagggtgaaggagatttaaacaggatggttgtcaaagatcttaaggccattgaaggagatggtcgaaaaaaggggaagctaggtattaccggtgaggcgaagaacaaacagtatagggttttgatcacctattcatag

SEQ ID NO: 44513 - DNA, 150 bp, Glycine max
  Peptide Sequence Number=SeqID_161291
atggcaaaacctcatggcaagatgagcaatttagatgcagggtacagaagattaattgctggcttttgcaaggatttaacttgcagcaactcaacaggttttggaattgtggagcattgcagactacctgtgaaaattggacgtgaatag

SEQ ID NO: 44514 - DNA, 456 bp, Glycine max
  Peptide Sequence Number=SeqID_161292
atgaggcagataacgtggttggccaccctcttgaacttcaaaaacctccaccttaggctcaacaatctgactcaacttcaggcaaaccctgctcttgatgttcagaaagagtttagcaaggctcacttaaccgcttctggttctaatgctgctggccgtccatcagaagatgttgattccagaaccatttttgttagcaatgtaagaactcttactcctctgttcttggtgtgggagggcaggcttcagggattggttcattttgctgccaccaaagatggcttgtctcggcattttaatagatttggggaagtcttaaaagtgattatagttactgatgcagcaattgggcagccaaaaggggcagcttatgttgagttcatgcgaaaagaagcagcagataatgcattatctctggataacacttctttcatgtcaagaattctcaagatgtaa

SEQ ID NO: 44515 - DNA, 749 bp, Glycine max
  Peptide Sequence Number=SeqID_161293
gacttcacgtcctcaccttcctagggctacatgccctcacctttagaggactacacgtcctcaccttcctagggctacatgccctcacctttagaggactagacttcctcgccttcagaggactagacttcctcgcctttagaggactagacgtcctcgccttcagagggctgcacgccctcgtcttcagagggccgcacgccctcgccttcagaggattacacgccttcaccatcagaggactacacgtccttgccttcgtagggctagacgccctcaccttccgaggactatatgtcctcaccttcagaggactacacgtcctaaccttcagaggactacacgtccttgtcttcagaggacaacacgtcctcgccttcgccttcgtagggctacatgccctcaccttcaaaggactacacgttctcaccatcagagggctacacgccctcaccttcagaggactacacatcctccatttcagaggactacacgtcctcgacttcagagggcttcacgtcctcgccttcagagagctgcacttcctcgccttcagaggactgcacgtcctcatcttcagaggattacacgtcctcatctttagaggacttcacgtcttcgccttcagagggctgcatgtcctcaccttcagagggctgcacgtcctcgccttcagagggctacgtgctctcaccttcactgggatccatatccgcacattaagagaatttaaggtcctctacccttaa

SEQ ID NO: 44516 - DNA, 174 bp, Glycine max
  Peptide Sequence Number=SeqID_161294
atgaaggaaatatgcagtaatctccaaggcaaggacaatgcacctccacctccacctcaatggattgaggctaagtatttttcagatggaacagcattagacactgacaccatgacgacaatacgcaagaagaaatgggcagcctatttgctagaagttggaaaatggatgtaa

SEQ ID NO: 44517 - DNA, 2016 bp, Glycine max
  Peptide Sequence Number=SeqID_161295
gatgagataagaaaggaggtacaacaagaacaaaagcagcaacaagaggcttggatgagggcagttgaagaaaaacagtggcaaaatttggagatgatgaagcaagagttaaaaaaatcattgaaagtagagctatctcatattgcatcacatcagtcagcccccattgaggcgccagaaatacaagctctacttgcgcgtgttagcacaaagggtagctgcgctggacctgaaggaagcggattacttaaagagcttttgagtggtggtgacgatctgatgggcttgttcgtagttgttggggaaaatattgtgcttgcgggcttgggaaaagtgtttgagaattcatctaccatacataatgttcgttatgaaaatgatgttgttaaggttcaggttgtcagaacatacatgccttacgctgaggtccctattcctacatcagaggttcattatcttgagcaggccgttggcacattcgtcgcatggccgacccatcttgttagggaagtaactaatgaggtggtcgtaggactcgataagcctccatcaaagtctgttggagagccgaacaggttaacatctgtggccacagatgacccactgggagaattggttaagaagtcatatgtggtttacacaaagccaatggagttggcatgggacggggcgaaatttgggttacctaatgcctcaaatggttttttcatcacacatgtagatgtgactgaaataattttaggtgacaaatgtttaaacatatctgtactgcaactgtggatgatgtttatgaatgattggagtacaagcattggtttttctccagtgtacggtttccttgagccccagtctatacgctgcacaaaggacacgcgtgaagaatgtcaaaagtacatagaaacgtgggtcaaggtgtcacatcgagaaatctacttaggaccttacttcaatcaggcacattggcaacttcttgtgttgtgtccacgagagaacattatagtatggttctattctatacgaagaaagcctgatgttcacattaagtttgcagtgaacaatgcaatgaaggaaatatgcagtaatctccaaggcaaggacaatgcacctccacctccacctcaatggattgaggctaagagccatgtacaacaaggaccatatgagtgtggatattatgtgatgcattggatgtggtgcatcgttagtgccggtttgaaaaatgaactccacaactatttttcagatggaacagcattagacactgacaccatgacgacaatacgcaagaaatgggcagcctatttgctagaagttggaaaatggatgtcagcgtttgacatgttcctgcttgggtcattcagtccgccgcaaccttctcatacattggtccaagaaatcatcgaaaaagctactcaggagaagcaactgcgatgcctacaagtgactctaaacagttcagctgataactatagtctaaatggtgaagttgctgtcacttgtctaaagaatgccatctcctacttcagtgatcatactgattacttgaagaatgttgctgctatgatttttccgttactccttgttctaccacatgctgagtgggaaacatcaatgacagctggtgatgcctcattggatgagttcaagcctgaagtgttagactgggattgcagtgcattctttaatgagcttttgtatgtcaagctgagacatctaaatgtgaagcgtgatgatgataagtgggtcaacaagataagggatctgtttgtattttttgcttcctctaaattgaagcatacattcctcgaacacctccattacttagcagcacagtgcaaaatatcacctccccgcctcttatctaagtttttcacagatgaaggtgttactgctgcagttcaggttgaaagtcttcaatgctatgcatttctttgtagcctgtcgcaagataaatggaaaattgaacttttagctgaatttccttctgttcttgttccatttgcgagtgataatcag

SEQ ID NO: 44518 - DNA, 237 bp, Glycine max
  Peptide Sequence Number=SeqID_161296
atggcagagttgtgcctagtgcctgacgtcgtcatccctccgaagttcaaggaaagtcttaacggggcaactatcacctgttacactaatctggaaccttctcgagtccattcttggaaggacttaatggctgccttcatcaggcggtatcaatacaactctgacatggctccagatacaatgcaattgagaaccatatgcaagaaggagcatgagtcattcaagaaatatgcctag

SEQ ID NO: 44519 - DNA, 159 bp, Glycine max
  Peptide Sequence Number=SeqID_161297
atggtagaatgtgattcaatcctccaagggaggggacccatcaccagatccatggctaggagactccaagaagattgggtcaaagatgaaggagaaggtcctagggagaaagatttaattgaattggaagaagtccacaccatcctaatggggaggtga

SEQ ID NO: 44520 - DNA, 192 bp, Glycine max
  Peptide Sequence Number=SeqID_161298
atgaactgcaccattgttgatgacgacgctctatcatcagaacgaaaagttaatggagaatttccttctatcaaaggaatattggcacttggcagaacatggaatttccatttttccagacaaagcaaacgcatcagaagcagaaatcaagtcgatggaagaacgacaactgaaggacttgaagataaataa

SEQ ID NO: 44521 - DNA, 450 bp, Glycine max
  Peptide Sequence Number=SeqID_161299
atgaagaagggtaaagaagagaaggtgtacaagttgagaaaagcactttatgggctcaaacaagcaccaagagcttggtacaaaggaggtaaaattttaattttgagtgtatatgtaaatgatttaatatacactggaaatgatgggagtatgtgtaatgattttaaaagctccatgatgtcagaatttgacatgattgatctagggaggattcggtattttcttagagttgaaattttgcagaatgcacatggaatttttatatgtcaaaggaagtatgctcgggaggtgttacctcggtttggcatgaaggattgtaatgcagtcaagaatccaattgttccaagaacacagctgtctagaaatgatgcagggactaaagtggatgctactttattcaaacaagtagttggaagccttatgtacttgactgcaatggagtcagcttag

SEQ ID NO: 44522 - DNA, 329 bp, Glycine max
  Peptide Sequence Number=SeqID_161300
caagcttaggtgcactaagcgcgagaagagatagcgtcctcgctggacgggctagttgggcactaggcgcacagatctacgacttatcctcttctagggtttcccatccgctaagcaagctggatgcctcgctgagccaaattgccttgctaagcatgtcatcagcagcttttaccttctcttctttggatgaatatttccgcatctgggcatattcatcatcatctaatccagaaacaccagtcaaagatgctgaaggtgacacaccgtctctaattgtccgtccaatgggtcaaaatgcagccaaaaggaagagcaaaggaaaagga

SEQ ID NO: 44523 - DNA, 369 bp, Glycine max
  Peptide Sequence Number=SeqID_161301
atgagggagacacatgaagtaccccaccacaatctagctgacttcgagcctcgcctcggatacgccactaagggacaagcagttggtggtgtatccctaccaaacactttggagggccctcaattttgcccacaacctcaacctttggattttgcggtgggaagagtccctcctgctatgaggctgagggccattgaaggaggcaaagattatgcttttgttgacatggtagagttgtgcttagttcccgatgtcgttatccctccgaagtttaaggtgtcagatttcgataagtacaaggggactacttgcccccaagaaccacctaaaaatgtactgtcggaagatgggggcgtacgcgaaagatga

SEQ ID NO: 44524 - DNA, 423 bp, Glycine max
  Peptide Sequence Number=SeqID_161302
atggagagggagatggtaccattgatagtaggcacattactagtgttctactatgagaagttggtaggttacatgccttcaagctttgccaatttagttttcaccggcaaaaggatcgaagtgggtctgagaagaagcaaatttgatcatcctactttgatgaataaaaagcctagggcaaatagagagaatgagaaggagggaggaacccatgttgtgacggtcgttcctacatggtcaaatttcccaccagctcaacaatatcattactcagccaatatcggcccttctcattacccaccaccctatcaaccaagaatgctcaatcatccacaaaggccacccctaaatcagccacaaagcacacctgccgcacatccaataccaaacaccacccttaacgcaagccaaaacactaactag

SEQ ID NO: 44525 - DNA, 483 bp, Glycine max
  Peptide Sequence Number=SeqID_161303
atgaggttgttgtggttattggtgatgtcattgaaatggaatgttgatgatgttggaaatgcattgacaagtgcatgttgtgtatgttcgtggggggcggagtgcactgaccttgttggatggcccattcgtgggggacaagcgtggttaaggaatctaagcatttctgaggggatgcttaagcgctttaattggttcatggtctttggcacttgcttttggccacattcatacgtcgtatgttgtgtatgtccatggggggggtgcattgaccttgtcggacgtcccttgtatgggaaactaaagtggttaaagaatctaagcatttctgaggggatgcttaggaactttaattcatccatggtcattgtacttgatggtgcccatggaactccttgtggccccaggtgtcgtgtagacacgcttagggctatttccttggtattggatatggtacgtatcgcattgcatctaagagttgag

SEQ ID NO: 44526 - DNA, 660 bp, Glycine max
  Peptide Sequence Number=SeqID_161304
atgacgatgaaaggtaaaatgctgctgcttatcggtctgctgtgcagtctgaacgcgcgcgccgacgatctggcgacgcaaatcgaaagcttcatccaaggcaagttcagcggcgaaccggtgcaggtgaaagtgcgggtgcgcacgcagccggcccagtggcccgcctgcgaactgccgcagctgtcgctgccgcccaacgcgcggatcggcggcaacgtcagcatttcggcgcgctgtggccaggagcggcgttttatccagacgcaggtgcaggtgttcggccgctatctggtttcggcgcgcggcatcagcgccggcagccggttgaccgcggcggatctgacgttgaaagaaggccggctcgataccctgccgccgcgcgcgctgaccgaagcgggcaaagcgttgggcgccgtcagcctgcgcaacatcagccccggccaaccgctgaccctcgccatgctgcgccgggcctggattatcaaggcggggcaatcggtacaggtcaacgcgcagggcgaaggattcaacatcagcggtgcgggcaaggcgatgaacaacgccgccgccgaagacagcgtgcgggtgcgcatggcgtccgggcagatcgtcagcggcgtggtcggagacgacggcgcgatccgcattacgttataa

SEQ ID NO: 44527 - DNA, 600 bp, Glycine max
  Peptide Sequence Number=SeqID_161305
atggtcgatctgctgattgagcagcaggccattgtgctgattcttttcgcgcagcgtttggctcagcagttgaacgcgttgccagcgatcggccaggggcgcatggctggcgcgaccgtcgccagcagctggcttttggcatcggttacgcgctgcagtgccacgccgggcaactggccggaacacagcaagtcgtgctcttcctccagcacgccattgagcgcctgcagcgtttccaacagtttatccagcagttgtgccagtttttccatagtgatgacttatcctttaccgctactcgccgccgcgccgtcagtcgcgcccggcgatccattgaatgtcgctctgcgcgtcttgcagcagcgcgtcggcgattttgccggcgtccatcttcagttcgccgctgcggatcgcctgcttgatggcctcgacccggcccatatcgatatcctgggtgcccggctgcatcaggcgcgcctgcgcctcgctcagcttgacctgcgtgccgctgacggccgtttcggccacggcggtcttacgcggttggagcgggttgtcggccggggtttcacgcggttgcacagtggaaaccggctgtaa

SEQ ID NO: 44528 - DNA, 303 bp, Glycine max
  Peptide Sequence Number=SeqID_161306
atgcaagtcgtaagtgggagtggcgacttcgtgtatgagctacacgtggcaagcgttgggggacgtgccaagctcgttggcgatttcaagctgccacagtggaagcgccagtcctgttggcgccaccagcctagggtcagcttttcaggcaggtacacgatgaattcaattataacagtgttgtatttcaatgaaagggtatatgaagataatgatggtgtaatatttgaaggtagtaaaaaagcgattcagattaaacgtggaattagtttcaatgctttgaagaaaaaacttggagataag

SEQ ID NO: 44529 - DNA, 399 bp, Glycine max
  Peptide Sequence Number=SeqID_161307
atggtagcctggcctgggacccaaccttctcttcatagggaaggtgaaggtcctacagcccaggtaccacagcatgtggaggatgagtcatctgaggccaccattcttgagctatttgttttaggggaggaggcaggtgagacacaggtaagacaggtagctgctgccactcctgagagatctattgaggccacttcaaagcctcttgcaccagtggtggacctaccctcatctcaacatacaacagacccctccactcctatcctagagataccagaggacccgactacaccagtcctaactatggacacttctcctccagctactccagtacttcatctgacagatgaggaggatgttcaaacacaggatactcaggaccagtcacaagaattctaa

SEQ ID NO: 44530 - DNA, 246 bp, Glycine max
  Peptide Sequence Number=SeqID_161308
atgggctcaaaaatctaccctaaggttcatgagaaccctaaggccttctttatcaactctagcccaatcctcttggagcctcttgctcatggctctggtaactggtcctttcctagggaggattgcatcaccaaggttctaagtagcttaaggttgtgtctcaacatggtcttttcattgtgcgtgcccgactttgatatttggggcaaaacaaattcatctgtcagggcgtcggttttgggttaa

SEQ ID NO: 44531 - DNA, 969 bp, Glycine max
  Peptide Sequence Number=SeqID_161309
atggatcagctccaacatcaagctttccgcaaggcctatgagaagatttgggatctagctatgatagaagtctctgtcgaagccatcgcatccctcactcagtattacaatcagccgctaaggtgcttcacgtttagggactttcaactagtgccgattgtggaagagtttgaagagatcttgggatgtccgctaggaggaagaaaaccatatcttttttctgggctttatccctccaaggcgaggatagccaaggtagtcagaatctgggcgcaagagttggaccgagtaaaacaaaacagaaatgggatagtcgaaataccaaggaagcatttggaggaaaagccgaaggcgttggcagatcaaggtgaatgggcttcgttcattgatgtcttggcgctattggtatttggatttgtcctctttacaaatgtggatgggatagtggacttagcggcgattgatgccttccttgcttatcaccatagcatggagagtccgatcattgctattttggccgatgcctatgacactttcgatcgaagatgcgaaaagagtggcgcaaggattgtttgttgcacaccagctctttatgtgtggctagtcttgcacttctttcgtcatgaaggtagacccgtttgtcccatacaaggtcaccgcttgtgcgccgagaaagggaaggaaaactgggagcaactcttggctagtgtggtagggggatccattaattggttcccccaatggaaggaaggaagagccacggttttatcctcatgtgaaggattctcaaacgtccccttgatgggaacaagggcttgtatcaattataatcccgtccttgccattagacaacttggctaccccatgagaggagcaccgtcggaggaaagcatcacacctttcatcgcacggggtttcagggacccaatgggaggatacttcaaggagtccgcaaggcatggggcatag

SEQ ID NO: 44532 - DNA, 585 bp, Glycine max
  Peptide Sequence Number=SeqID_161310
gactacacgtccttgccttcagaggactacacgttctcgccatcagaggacaacacatcctcgcctacagaggactacacgttctcgccatcagagggctgcacgccctcgccttcagagggctacgcgtcctcaccttcagagggctacatgcacgcccttagaggactacacgtcctcaccttcagagggctacatgccctcgccttcagagggctacacggcctcacctttagaggactacacatccttacctttagaggactacacgtcctcgccatcagaggactacacgtcctcaccttcagagggctacacgccctcacctttagaggactacacgccttcacctttagagggttgcacgtcctcgccttcagagggctgcacaccctctcctttagtgggatgcacgccctcacttttagagggctggatgccctcgccttcaaaggttcagttcctgggccaccccctgatcctggaggagggtcaactgtgcgtgcacaactagaggaggaggctatcgtacagccactatgcatactggggcaagatttcacctgtgccattacaaagagatga

SEQ ID NO: 44533 - DNA, 195 bp, Glycine max
  Peptide Sequence Number=SeqID_161311
atggctaaattcgatccggagatagtcatggagttctacattaatgccaggcctatcgaggagggtatccgagatatatcgtcctgggtgaggggccagtggattcctttcgatgcagatgccctcagtcagttcctggagcacccactaatcttgatgtgtaaactaactattaaaaaggggaaaatcaagtga

SEQ ID NO: 44534 - DNA, 270 bp, Glycine max
  Peptide Sequence Number=SeqID_161312
atgggaaatgcaagatttcttgaggaagttgagtttaagaaggaagagaacataaggaaagttgtctatgaggaagaacctgttattgacaaaacaactccagtaacagaaaacaatgttcaaactattgttgatgacattgttcaagaacaagacaacaatgaggttcttcctcaaatacctatacagcaacctcaacaacctcaaaaagtgtcattaaggagatttgatagagggaggagaagtgcaatcccttttgcaaaattgtga

SEQ ID NO: 44535 - DNA, 982 bp, Glycine max
  Peptide Sequence Number=SeqID_161313
atggagaattcgcgtagaccgttcgatagatcgcgagaaccgggtccgaagaagccccggttgatggaagagctggatcgggcttcgaattcgggtgcccgacagtttcatcagcgacaagtggcttctgggatcaccacgttgtcgtctgcaaggtttagaacaaacgacagagatcttgaaagcagtgattttggtcgccggggcggtgccggtggcggtggcggcggttatcagccgcagccactgccatttcaggagcttgtggctcagtataaggcagctcttgcagaacttactttcaactcgaaaccgataattaccaacttgactatcattgcaggggagaatcaagctgcggagaaggccattgcagccactgtttgtgctaacattctagaggttcctagtgatcaaaagctgccatcactttatctcttagacagtattgttaagaatattgggcgggattatataaaatactttgctgccaggctacctgaggtattcatcaaagcatacagacaggttgatccttctgtccatcaaagtatgaggcatctttttggaacttggaaaggagtctttcctcctcagacccttcaggttattgagaaggaattgggcttcactcctgcagtcaatggctcatcttctgcttctgctacactcaggagtgattcacagtcacaacgtccacctcatagtatccatgtgaatcccaaatacttagaaagacagcgtctacagcagtccagcaggactaaaggagttgttgatgatatcactggagcgatttcaaatacaaatgatgacccagagatgcctggtagaactttgggcgttggacgaccatgggtggatcctagtgttactgttaacatccattcacgtgaaaatgagcaatgcgctcacagaggtgcattcaatgattctgttctggaaaagagcattggtgcatcctatggaagcaatgaatatg

SEQ ID NO: 44536 - DNA, 1674 bp, Glycine max
  Peptide Sequence Number=SeqID_161314
atgtggaaagagaaatgtccatggaatctcaagccaaggaaaaggggcaattacattgatgagcagcaatctattgatgaattgaatcggaaggcaggtcactcggacagatttgtgtccacacatggtgccataccagccaatgcaaattcttctgctgccaggatggtcaatcagcctttcctgtcaaatgcaacaataggattgccaggaattgcaggccaatttcattctttgggagctgaaaacccttcagggcagtcacctttacaacaaaggtctccgtcaccgccagtaagtgtgcacccttctcatccactgcaaaatttggctgagcaagaccttccccagaatcataaagcatctcaatttctgggaggtctgcagagccaatatattaaagattcttcacccgcccctcctcctagtattcaggttggtaacttacaaagttcacaactgaaaaacttgcagggtccattctcttcaacgacttttcaggcaaggcatcagcaccaactgggctcttctcacaatgaagttactgttaagactgagaagccacccatgtccgaagtgcctttagccagagaaactaaaagtaatctggatacagggaatcttccatctcggttaggggttcggccttcacggtcaggtggcccttcccctgccacattaatttcttcagtgtccaaaattgcatcaccatcttcgttaggtccttccagcgataatgtatctgttcttccaaaaatacctctaagaaaggctggaccacctagggcatctactctaccaccagcttcctctaatgtcagcagtgcctcagcccagacatcaagtgataccaataataccttaaatccaattgcaaaccttttaagctctttagttgcaaaaggtttgatatctgcagaaacagagtcaccagctaaggtgccttcagagttgcttactcgattggaagaacaaagcgatagcattaccaccactagctctttgcctgtggcttcagtgtctggttctgccactgtccctgttccttctaccaaggatgaggtagacgacactgcaagaacgcctatatcattgtctgaatcaaccagcccaggaatcagaaatctcattggcttagagtttaagcctgatgtaattcgagaattccattcatctgtagttagtggattatttgataattttccacatcagtgcagcatatgtggccataagcttagattccaagaacagttcaatagacacttgaagtggcatgccacaagagaaagcgaagaaaatggtttaattagtgcatctagatggtatctgaagtcaaatgattggattcttggcaaggctgagtatccatctgagaatgagtttactgattctgtagatacatatggcaaagaagcagacaaaagtcaagaggatgctatggttctagcagatgaaaaacaatgcttgtgtgtgttgtgtggtgagctatttgaagatttttactgtcaggaaactggtgagtggatgttcaaaggggctgtttacctggccaactctgatagcaaaagtgagatgggaattagagatgtgagtactggaaggggtcctatcattcatgcaagttgcttatcagataactcagtttccagtgtcctcgagacgggacaggattaa

SEQ ID NO: 44537 - DNA, 390 bp, Glycine max
  Peptide Sequence Number=SeqID_161315
atggcaaggttggcggcgacaaaggacgcgcgcagcgtgagggggagacacgtgtggcatagcatgagggggaggtgctcgcgtgacaatgaaggtggagcgaagggacctcacgcgacgattaaggaggtggtagtgacctcacgcgaaggaggttggcatgacctcacgcgactaaagggaggcgcattagaggttggagcaaaggtcgatggcgatggctggtggcgtagcgaagttggtgaagaggagctgggaaaggttggccttacggattcgccgttacgcattacaaattcgtatgaaggattcttacatattcgccgttaccgattacaaatccatataaaagtctcatatgaattgtcaatccttcatacggatttgtaa

SEQ ID NO: 44538 - DNA, 459 bp, Glycine max
  Peptide Sequence Number=SeqID_161316
atgtcgatctccccctgtggaagtatcagttggtctgtgtcgttccgacgtaggggtagcgcccacaagacacccagtgggcccggaggagcccaacaggaccctagggtttccagctctagttacgagcctctgtcagtcctacagggtgcccatcccccccagaaaggtcatgccatcgtgacacagggatcgcgcccgcaagacacccagtggacccggaggagtccgacagggccctggggtttccagctctggttacaggcctctgttagtcctacaggatgcccatcccccccagcaaggggtcgcgcccgcaggacaccctgtggacccaacgaagtccaacagggtcctagggtttccaaacaccacaacatcctagggatggccagcaacaggcaacaaatgcaccgccaccacctccagagcccctcagctcatccacaaaaaggttag

SEQ ID NO: 44539 - DNA, 150 bp, Glycine max
  Peptide Sequence Number=SeqID_161317
atgggtcgccaatatcgtgccagtcctgtaaaaggatgggaaggtgtgaataacgctggggcaacataccagcgggccatggtagcattattccctgacatgatgcacaaggaaattgacatctatgtggatgacataatcgcgaaataa

SEQ ID NO: 44540 - DNA, 780 bp, Glycine max
  Peptide Sequence Number=SeqID_161318
atgcttatggagaggatgaaccaggaggcacatcatggtggtagttcacatggatcgggttcgttccatagagatcgcagttacatggctactcgtcaagcaaagattgattttccacaatttgatggtagtgatctcaatgattggttgtttcgatgttgccagttctttgaaattgatggaacacctacagaaatgaagatgaagttggcatctatcaacctggaaggacaccctgaagctggggtgattccctgggaaacttatgttgcagctttggaagaaagatttggagaaaagcataaatattcaatgtcaaaactgttatccttgaaacaattaggtaaagtttctgactactatgaccaatttgattactgggttggtagggttcaaatatctggagaaattgctttaggaatcttcttgaatgaccttaagcctgcaattcagcatcatgttaggagttttatgcctgcatctgttaatcaagcatatacattagcagtcttgcaagaaacctctttgagaactttacaacaagaatttagttcgaattctaggagatctcctttattacctactcctagaatccaacacatgaattcatcttctaccttgaaacctacacctaaaccatttgttgattccaagggcaaagctgttattgaatttgatgatagaaggtcgaaggggttatgcttttggtgtgatgaaaattatgtaaagggccacaagtgcaagaagaaagagttgtttgtgattgaggtcactaaatag

SEQ ID NO: 44541 - DNA, 384 bp, Glycine max
  Peptide Sequence Number=SeqID_161319
atgtctggtgttgagaagagtatggagatgatgaaaaaattgaaagagctcattcacaaactgattcaacaatatgtactagagcattccatttcctattctattagcaattcagctaattctagtacattggcttcaaacatggcctcacaacgtaatgatgacaacaatgataaggatgatgaatttagaatgaaaatgaagaaaaaacagggtgaggtgcaaaaaaatgaattatataggtatttagaggatgatgttgaagatgaccaccctgagtttgacattttgaattggtggaaattgaaattgtttgatttgattttaaattctgctaatattaaaacttcaagtgttggaacagcaggtgttgggacttcttaa

SEQ ID NO: 44542 - DNA, 225 bp, Glycine max
  Peptide Sequence Number=SeqID_161320
atggttttcacctcccttcacttccctttcccctgtgaaacaaacaaggaacttctcccttgcattaaaattcctccactctcctcctttaaaccaaaactttgctgggttcccgacaacagtagtccttggaggaacatccttaataaccacagaaccagaaccaaaaggctagacaagttccaaggcatgctacccactgaatggcagacctcgtgcttatga

SEQ ID NO: 44543 - DNA, 546 bp, Glycine max
  Peptide Sequence Number=SeqID_161321
atggatgtgaagaaaattgtggtggttgtagaagatgtgaatgcagcaagaactgctctagaatgggctcttagaaacatcattcgctatggtgacataatcacccttctccatgtctataatcactccacaagatcaagaagcagaagcaaagcacgtcttctacgccttaatggcttcaaattagccctttcctttcaagacatgtgcaacagctatcccaacacaaaggttgaaataattgtcatagaaggggaccaagaaggaaccaagattgctgccacggtgcgagagattggagcttccatgcttgtggttggactccatgattatagttttctatacaacttaaaaaggtttatgcaagtgagcttcaaaaattggtcacgaaaagcctttgcaaatgcacgtgccttctttaatggtgacaaagccttttgggatccacttttaattttaatctgctttgcctttaaaagaagcacccatgttgcgttcagagatgactatgctctaaccatgtatctatgctctaacttaatgtga

SEQ ID NO: 44544 - DNA, 543 bp, Glycine max
  Peptide Sequence Number=SeqID_161322
atgttgttcccccctctgacaagtaaccaaagtcaaaagacaagagtaagcataagaggaaacatcaggaccacaagtattctggggaaccctccaaccacaaaggacaacttatgggctttccatttgcgtgcaacggccatagttcaacacattgttggctcttgtaatgttatcaagttgaaatctaacttaaagaatgtcaaaagctctcttaactcagccttgactgctcacgttgccttggccggggataatgtgaccttaaaggaaaaggttgtgtcagacccttctctggacatgaagggtcattcccagttagcaatctattttccctctactgaatcctttttggcatcacctcagactctccaaaagagatttccttctttgtatttccttgatttgagcttcgatttgaaacgccaagtcattcgtcacttgcatgctttggtcatgatcattgcgccttctcgcacttgttcgatgagatctaagtctatttgtagtgcttcattgttctcggcttcgataaagttttga

SEQ ID NO: 44545 - DNA, 177 bp, Glycine max
  Peptide Sequence Number=SeqID_161323
atgggttcgacaaaaggtcacacaaaggagttcgaggagggtgtggccaacaacattgtaaatagtaagagggttaagggagatgcaaatgatgttgccattgcaataggtgtagaggccgatgaatccgatcacttggtggaggttcacccaaagaggcgtcaaagggttgtttag

SEQ ID NO: 44546 - DNA, 317 bp, Glycine max
  Peptide Sequence Number=SeqID_161324
aggaaacactgggtccaacaaagataggagaaaatcactcaaagtgtatcaatctcacacagtgcgtggcgagaaaatcgctagcacacaggattttgtcggcaatcaaagggagaggaccactttaggtcgtggtttcctttttcttgtttacatggtgacaattctgtactgttcagatattgtctggtccaaagacctttctggatggcaaggattgacattctcaccttgggtcaaggtttatgataagttgggattttggctcaaggcttgtagaacggctggtcatgatatatgtcagggtttggccagtg

SEQ ID NO: 44547 - DNA, 216 bp, Glycine max
  Peptide Sequence Number=SeqID_161325
atgaagtccattggatgttgtcataccctaatttcgtctggggactattgtttgatggcatgcaacctttggttgaccgcttcgaggtacttggcaccctttgtttcacaatacgtgaagttccgagacatgccggaaaggaagcattgttacgcaatccgtgaaattccgttacgtgccggaaatcaagaggaagtattgttatgcaatccgtga

SEQ ID NO: 44548 - DNA, 258 bp, Glycine max
  Peptide Sequence Number=SeqID_161326
atggatatgtcatcaacaacacatctaggacatcctaaggaagagatacaagtagaagatcagatcgacttgtcatccaatatagaggaattgactaagtacaaaattcaagttagatttgaagtaaacacaacaaaaaagaacttgggaaaactaaacttcccaaagactagggaggagaagcatagggatcaaccacccagggagcctctatatgcacaatataccaatctcaatgccaacagatccatgatttaa

SEQ ID NO: 44549 - DNA, 369 bp, Glycine max
  Peptide Sequence Number=SeqID_161327
atgaacccagtccccagtgaagtcgccaactgtcgcaacctacccttttgtgggcgagcgaagcgaggctcacaggatgcgtgttccaagaaaggaatacgcgcggagtcgccaccaacgtttatttgtggaaaacgtcggaaaaaccaaaggaaaccggtcataaagaatattccaagttcgggagttgtatttacgtttgaggaagaggtcgacaaaagcggggctcttgctcctacgtaccctccatcaaagaggaaatcagacctacatagttcttttttaagggtgaatcaagcgattctttttacttggaaggtggtcattttaaggcgttggaccttaaaaatgatcctttttacttggtaa

SEQ ID NO: 44550 - DNA, 693 bp, Glycine max
  Peptide Sequence Number=SeqID_161328
atggaaaaactcaaggatttaatcaagcaagttgcacctacaggggttcccctaatggaattcacggatcacaattggttagacgatttctttcgacaacgaggtcattctaagtatttcgaaaatttgattgaatatgacataacaggattgaaaaatgatgaagacgtgctaaagaggttgtgggaggagaatgtgaagcggctggggttttccaaggcagcggcggcgaggccggtgcagtggttcaccagagagcccgccgcaacaacaacgaggaaggcagtggcggcgaagagagtgagggaaggtgtggagttttacagcaatggtgatttctacgagggggtgtttcacaaaggaagaagcaacgggagtggggtctaccattacttcgtgaatgggaggtatgaaggggattgggttgatggaaggtacgatggatacgaaattgagagttgggcgagagggagtcgttataggggtcagtataggcaagggttgaggcatggttatggggtttataggttctacactggggactcttattctggagagtggtgtaacgatcagagccatggcgtgggtcttcaaacttgctccgatgctagctgttatattggtcagtttaagtatggcgtcaagcacggtgttggctgttaccattttagggtctccttgtttagtttttga

SEQ ID NO: 44551 - DNA, 387 bp, Glycine max
  Peptide Sequence Number=SeqID_161329
atgtcgtgtctaccctacattgctaaagggagcagcattgaccaggtctcatcgcatgacctcaaccgccttggccagtttgcgacaagtagacgacgagtccctcgaagagttcatggacaggttcgcaaatgtctcaacctcgaggtagcgttgcattccatgctcctcaccttatgtcccgacaagttgtgcgagcgagctaagggctacatccaaatggaagaaatgtccaaattttggaatgaagtccgccaagccggacagaagtgtgacaaacgtgaagcatacaccaaggccgacttgcacaagtcggacaagaggcacaagccaaacaaacaccaacctctctccaaagggcccaagtatgagcgttacacaccctaa

SEQ ID NO: 44552 - DNA, 539 bp, Glycine max
  Peptide Sequence Number=SeqID_161330
ggtacatcctttatggtacaagtagagggtacatctacttgggttgtaatactgaaaacaagagagggtacatctcttgtggatcagttcaagtggagggtacatccacttggttgttcaaagagaacaagggagggtacatcccttgtggatctttgcttgtaaaggattttacaaggttattggaaatctcaagaaccggtggttgcttggggactggatgcatccaggtgctcgtttgggtttgttgtctcatcgtaccacttgaggttaagtggttttcactccaagggtatgtttgcctccataacacagtcaacaaaaggatgccgacggatagtcacgctagacggtgcatgtgcgagagactcagatcatctacaatcttgtatcctccaactggtcatggtcagcctttagcattatcaactcctcctcgtggcgtctctccatctccgcgatgcggttttggagttgttggggatctcacgtctgaggccaaactgagtgctaatcatggatggatgtcagagaattga

SEQ ID NO: 44553 - DNA, 537 bp, Glycine max
  Peptide Sequence Number=SeqID_161331
atggtcactaaaaccctcaatttcgagcactccaacattcaagtcaaggacttcataatggggagtggggactcatatgagggaccctttaggactcaattttttagagtttttggccttggacgaggtccattttctgtgaaaagtcaactttatgcaagagccttttcattttgcgtagtgagtcttggatcggagaaaccctcctctcttgagttttatgacacaccaccacctaaaccaaaccaagatggtaatactaatagtttcattatggttcccttaagtgacaacagtagataccatttctacaactttgtgcagtttgtgggaattgccattaacggtctaaattttgtgttcttcaagttggacaacaaccaattgatcttttcaacaaaagagggaacgatttgtctatcgtttgctgaaggaaattctgcacttaatgtgattggcagtaacaacctccaaggaacccttttaacttatgatttggttaatgagaatattgtcttcacatataatgagtgttag

SEQ ID NO: 44554 - DNA, 180 bp, Glycine max
  Peptide Sequence Number=SeqID_161332
atggcgttcaaaaaatcgtctccggcgtgcttacgtgcttcatttaacgcgaaatttttgttattcgattcagcgctcaaccctgacaaatcaaggcttgcagagcatgccgcccggatgatacagatttatactgcgtcgcacccagggcaggtgaacgcttccactgaattaacataa

SEQ ID NO: 44555 - DNA, 528 bp, Glycine max
  Peptide Sequence Number=SeqID_161333
atgatcattgatcaatcattgctattttctttgactaaattacctagtcaaggtgcaccttttgagggcaccattgttgatgactggaaatttgattattctagtcatgatgctcgccgtatgatcgactgggcttacttggttcggtaccgaatgcataaagcattacgggccaatgcacctctcccttaccctcaattggtcactctgtttctccatcattttcaaattccacttgatgatgaaccttttgttcaagtcaagcgttcctttgctattggtgctggggcagtcacttcatttggataccgtaaggatcggaatggtcaatggctgaagaaagatgcacttcctccacaagatgagcgtactccttctcctcctcctcagcgagatgattcagcccttatgactgaagttctttccgagttacggggtcttcgtacttatgttggtgaacgctttgattcttggataatcgctttgccggaatggatatccgtctcacacagcttgaagaagatgtag

SEQ ID NO: 44556 - DNA, 946 bp, Glycine max
  Peptide Sequence Number=SeqID_161334
caaaacgctgttcccggcgctgcgcatggcttatctggtggtgcccgtcggtctgacggagacattcgcgtgcagcagtcggctgcgtggctgcggttgcccgccgctgctgcaggccggcgtggcggattttatccggcaaggacatttctaccgccatctgaaacgcatgcggccgctgtaccgccagcggcgcgagtggctgacgcaggcgttggagcggcagctgggggcgtggctgagggtggtgccgcagcagggtggcattcagctattggcccggctacgtgacggggtggcggatacgccgttggcggcgcaagcctggcaactggggttggcggcgcaggcgttgtcggactggcgaatcgatcatcctgcggggcaggggttactgctggggtttgccaatttcactcggcaagaggagacggaacgggcggtgcaggggctggcgcagctgggtgttaacgccgggccagcagcacgccgagcacgatgccgacggcggcaccgatccctacgccctgccaagactggtggagccattgaaccgcgctcgcgcgtcgcgcagcacgcctttcgccttgctgtgcagctctttcagttcctctttggtcttgtcaccggactcgcgcaacacttcatccagcgtatcggccaacagagtgacgtcctgatcgatatcgcgttctgttctttccgctttcttaaacattcagctctccatttcgacacatgtcttttaagtgtagaccatggcgcgatttgcgtggccgatcacggaaaaaaaaccgccgtcacgcaggtgtttgcctgcgcctgggctttgtacatttggttactcggcgaaaccaatcactcacggaaacggcagtttgattccactagtatctgtttcaacggctccaccggagcttaccgaaacaacactctgaggatgtaa

SEQ ID NO: 44557 - DNA, 636 bp, Glycine max
  Peptide Sequence Number=SeqID_161335
gtagatgaacagcaggtaagccgcctggtgcatctcttcggtgtagccgttgttcagcatgcggataaaggtctggctttggcggccgcccatctcctggatcatcgattcaatcagcatcggcttgaccctcagcagatgggccagcgaatcgatggctttgcgggtgtcggacgtcaggatgcggtaaccgatgataaatacgacgatcagggcggcgaggatgatccaggtcatttaggctttattacactctcaatacgccagaagaggggcgggaggcgctgtgcgacagcgcccgctatcaatgctgtggtgattgaaggtggccgcgtctttggccagcgcgtccagatgggcgccgagcattttgatctgcttcaccagcgcatgctgctccggcaccgaactggcggtgctcagtttgcgcgccagttgttcattctgcgcccgcagcgcggcttcgcgctgtttggcttcttccagcagttgctgcagcgcctggtagctctgctgccattcgcggtgttgccgttcgaagctgctctgcaactcattcatcgcattttgaaactggatttccagctcgcgcattgtcatgggctcgatcctttgcggcactcaatgatggcttag

SEQ ID NO: 44558 - DNA, 669 bp, Glycine max
  Peptide Sequence Number=SeqID_161336
atgccgctgacaattcccggcttgcaaccgtggcaaggcgtcttacaatcgaccccattcccggccgtaaaggctgccgttcaagagaggtggaagatgagcgagcaggaaaaagacttttttgaacaggcgatggcggacgtggtgccgctggcgagcgggcggcagacgctgtacctcaagccgcaggagacggtagacaaaagcgcgcggcgtgaagcgcagcggctgcggcaggaaaacttcctcagcaccgatttcctcgaggtgatcccctgtgaacagccgctggagttcaaaggggaaggcattcagcagggcgtgctggacaagctgcgcaacgggcgttacccgccgcaggcgtcgctgaacctgttgcgccagtcggtcgaggccagccggcaggcgctgtttcgcttcatcgtgcaggcggaggcgcaaaacctgcgttcgctgctgatcgtgcacggccgcgggcggcagaacgaaagccatccgaatatcgtgcgcagttacgtcgccaaatggctggcgcagtttgaacaggtacaggcgttttgccgcgccttaccgcgcgacggcggcgagggcgcctgctacgtcacgctgcgaaaatcggcgcaggccagggcggaaaactttgagcgccacgccaagcgcagccgttga

SEQ ID NO: 44559 - DNA, 542 bp, Glycine max
  Peptide Sequence Number=SeqID_161337
ccaccaccaaggccttggaacaagagaccaaaagggcccgtagggaagaacatggccggaacaaattccgaggggctctgtggggcagtaacagcgagcttaagctccggagagaggaaagggaccaatcacgagtagacaatttgctcttgaaggatgaattgaggatttgcctaaggtccaagagaagcttgtctcagcggttatgcgagaccgagaccaacatgttagccatcatcagcaagtaccaagaagaattaaatctagccacgacccacgagcacaaagtggcggacgaatatgcccgagtgtatgcggaaaaggaggctagaggaagggtgattgactcattacatcaagaggcaacgatgtggatggaccgatttgctcttactttgaacgggagtcaagaacttcctcgattgctggccaaggccaaagcaatggcggacgcctactccgccccccaggaaatccacggactcctcagctattgtcagcatatgatagacttaatggcccatataattaggaaccgctag

SEQ ID NO: 44560 - DNA, 1372 bp, Glycine max
  Peptide Sequence Number=SeqID_161338
atgagttgttattctctgaaactattttatgcacttttgctgcttttattgcatgctgctggatccattcttggattcaacagccttcccaatagcacagaaattaagtgcattcagactgagagacaagcactcctcaacttcacacatggcctcaaagatgactctggcatgctgtctacatggagggacgatggcaataacagagactgttgcaaatggaaaggcatccaatgcaacaatcaaactggtcatgttgagatgcttcatctccgtggtcaggatacacaatatttgataggtgcaatcaatatctcttcattgattgcccttgaaaatattgaacacttggatctcagctataatgattttcaaaggagtcatatcccagaactcatgggctcgttcaccaacttaagatatctcaatctctctgcttcttcatttcgtgggactattccttctgatattggaaagcttacacatttactgtctcttgatctaggtggcaatagctatctccatggacaaatcccttatcaacttggaaaccttacacatttacaatatcttgatctaagttataattatctggatggggaactcccttatcaacttggaaatctctcacagttgaggtatcttgatcttggtggaaattcattctcgggagcagtccctttccaagctgggaatcttcctttgttgcacactcttggacttggtggcaattttgatgtgaaatctaaggatgcagagtggttgactaatctttcttccttgacaaaacttgagctaagttcactacacaacctttcctcttctcatcactggctacaaatgatcagcaagcttattccaaacttaagagagttgagactatttgattgttctctttcagatacaaatattcaatctctgttttattcaccttccaacttttccactgctcttaccatccttgatctttcttcaaataagctcacatcctcaacatttcaactgttgtcaaactttagccttaatcttcaggagctttatcttggtgataataacattgttttgtcatctcctctctgcccaaactttccggctcttgttatccttgacctttcctataataatatgtcatcatcagtctttcaaggtggtttcaacttcagctcaaaacttcaaaatcttgatttgcataattgtagtcttacggatgaaagttttcttatgtcatcttctttcattatgagttcttcatcttctcttgtttcccttgatctctcctcaaatctgttgaaatcatcaactatattttactggctctttaactccaccaccaatcttcataagctttccctttatcataacatgttggaag

SEQ ID NO: 44561 - DNA, 264 bp, Glycine max
  Peptide Sequence Number=SeqID_161339
atgacgaccggtgtcccatcccatgttcgaatttgttccaaagatctgaaattgagcttattagaacgaagcttaaaaagatactcagtagacatgcaagaactaggtagtagaggaaggacttcgtttgtgttaattggttgtgaaaggagtgacgagtataggtgtaggaaaaaagaatttattagaagagacactggaactggaaaatgtgggtgtcccttcaagcttcgttgcaagccagtggttggaggagaagactag

SEQ ID NO: 44562 - DNA, 226 bp, Glycine max
  Peptide Sequence Number=SeqID_161340
atgggatgggacaccggtcgtcatgtggaatattacggttcaaaaatgcgcataacacattctaatttaaattttctgatgcttctaataaccaagaatgtggggatcacaccactgcacggccgtgagaaaatgccttttatcatcttctctttccttctactttgcgtatattcttcctatgctttgaagcactgctatctatgttcagattcaccttcggtgg

SEQ ID NO: 44563 - DNA, 462 bp, Glycine max
  Peptide Sequence Number=SeqID_161341
atgggattgttaaatatgtcttccaattatctcattggtgcaattcctaatatatcattgaagcttcctaacagaccgtctatacttctgaattccaatcagtttgaggcaagcaataaattgtcagggaagattcctatgtccatgggcgcccttgttaatatggaagtcttggttttacgaaacaatggtttaatgggtgagttgccttcttctttgaagaattgcagcagtttaattatgctggacctgagtgaaaatatgttgtcgggtccaataccatcatggattggagaaagtatgcatcaattgataatcttgaacatgcgaggaaatcacctctccggaaatctacccattcatctctgttatttgaaccgtattcaattgttggatctttcaaggaataatttgtcaagcggaattccatcatgcttaaatgtacccattcatctctgttaa

SEQ ID NO: 44564 - DNA, 543 bp, Glycine max
  Peptide Sequence Number=SeqID_161342
atgcaggggcacccaaaatttagtagggactggattgtgcagtatgatcctcctgatgaaccaaaggaatatatccacagggttggtagaacagctcgtggggaaggtggaaaaggaaatgctttacttttcctgattcctgaagaattgcaatttcttcactatttgaaggcagcaaaggttcccgtgaaagaatatgcgtttgatcataagaagcttgcaaatgtacaatctcaactggagaagttggtggctggcatttatcatttgaatgttatggctaaagatgcatataggtcatatatattagcatataattcacactccatgaaagatatattcaatgttcaccgccttgatttacaggtagaactttctcattatattttacattattgttattttcatgatttgctgaactgtttgaatattcatgcccatcaaatagagcatacactatctgaactgcctcttgagggtgtgcacgcatacacactgacataccttacatacctggcattgttggagggtgtgcacgcatag

SEQ ID NO: 44565 - DNA, 1149 bp, Glycine max
  Peptide Sequence Number=SeqID_161343
atggccgaagcagaacacaacgatcccacctcgccggagcgcgaggtccaaaccaaaagcaacaagaagaaactccgcaagaggaaaaggcctcacaagaccgagcagaaacgagatgaggacaagaacgatgctaacattgatagtgcccaaacacaaaccgaagatgaagaagaagaacaaaaagaagaagacacaaacaacttctcatccggaatcatgagcaccgagtctttctcctctctgggcttgtccgaacccacttccaaagccattgcggacatgggcttccaccattcaagcgaaggcaattccgccgcttctgaccaggaaggacgttctgggcgcggcgagaacgggtgcgggaaaaaccctagcgtttttagttccggcggtggagttgctgtacagcattcagttcacgcctcggaacgggacgggtgttgttgtgatatgcccgacgagggagctggcgattcagacgcacgccgtggcgaaggagctgctgaagtatcactcgcagacgcttgggttggtgattgggggttccgggaggaagggagaggcggagcgcattgtgaaaggggtgaacctgttggtggcgacgccaggaaggcttctcgatcacctccagaatacgaagggtgcctaatgattgatgaagctgacaggatattggaagcaaattttgaggaggagatgaagcagattattaacatacttccaaagaaaaggcaaacagctttgttctcagctacccaaacaaagaaggtcgaggatcttgcccgcttatcatttcaggcaactcctatctatattgatgtagatgatgggagaaaaaaggtcacaaatgaaggattgcagcagggctatgttgttgttccctgtgctaaacgttttgttgttctctattcattcttgaggagataccaatcaaaaaaagtgatggtctttttctcttcatgcaactctgtcaaattccatgcagatcttctcaagtgcactgggttggactgtttaaatattcatggaaaacaaaagcaacatgccaggactactacgttcttcaacttctgcaaagcagaaaaggggatcttgctctgtactgatgttgctgctcgtggacttgacatacctgatgtggtatga

SEQ ID NO: 44566 - DNA, 357 bp, Glycine max
  Peptide Sequence Number=SeqID_161344
atgacaaagggggaggcagtgcagaggcgaggtgacgacgagggaggcgacacgacgacaatctacaaagaggcatggcgggaggtggtctctcacaacatggaatgtgaaaatgaaggtcacacgatgatgaaggaaaagaggaggtcacgatcagattgtgttttgtttagggataagctactccaagtagcttatccaaataacacgacgacaatctacaaagaggcatggtgggaggtggtctctcacaacatggaatgtgaaaatgaaggtcacacgatgatgaaggaaaagagaaggtcacgatcagattgtgttttgtttaggggtagtcctatccaaaatattcattaa

SEQ ID NO: 44567 - DNA, 406 bp, Glycine max
  Peptide Sequence Number=SeqID_161345
atgcattttgggagagatttgaagattgatagaaattgtaaaagaagaataatgataatttgtaagcctgattatctctggaattcttactatgtaaagattagggataagaaaacacgacagttaaggacatgccgtgatgaacatacttgttctagaaagtataataccaagttgcttaagtcgagttggttaagcacaagattgcttcaaggattgagggagaatcctaacatgagtctgctaggtattagaaacagggttcatgaacaatggaatgctgacatcattagaaccaaggcattcagggctagggctactgcaaaagatatggtccaaggatctttcaatgaacagtttacaaggaaacatgactactgtcatgaattgttaagatctaatgaag

SEQ ID NO: 44568 - DNA, 354 bp, Glycine max
  Peptide Sequence Number=SeqID_161346
atggtggatattgcagctagtcaaggaattgttcacctttatgttgagaattttgtggaagaggttgaggttctcaatttctgccaagttgtttccatgataatctacaagatgcaaccactgatcaacattgttgtatgcttttgtttgattaattcaagtagtaatgttgaacagtcaattggtgatcacattgcaaggttagaacttgatgttgaaatgcaccatcaatctaaacaaaatccacaacctgaagtgcaccatcaatttgaacacaattcacagcctccacaacctcaagtaccaattttagcacctaacattggaagttcaaagcctctcattgcaagttga

SEQ ID NO: 44569 - DNA, 489 bp, Glycine max
  Peptide Sequence Number=SeqID_161347
atggatgtttccttaaggattattatgggggggattttggcaattgtgagcagagatcctaatgaccaaaagttgcattttgcatttgttgtggttaagggagaaaacacacaatcatgggagtggtttctagatttgttaattaaagatcttggtggtatagagcattttgagagtacttatgccataatttcatatcagcaaaaggtacttaatgaaaattccttaagacactggaacctaaaaaatctaggaggaaagaggctggagaaaccgcaggcacaacaagcagagtgtctaggagaggaatgcaacaaaaatgttcaaggtatggacaaccaaaccacaacaaaagagcttgtcctttacctgcaccatcctaagcccaaacctaacctcaatcccaacaagttgcttcatcccggacctaacaacttgcaccaaccaaaaaaccatttaaggcaaaactctaaacaaagaggaaggtga

SEQ ID NO: 44570 - DNA, 1471 bp, Glycine max
  Peptide Sequence Number=SeqID_161348
tgcggccagcagcatgcaggtcaggctgctggtcatggcgaaggcgcggtcgcagctggccgacggcatcagcagcgtgcaggtatcggcacggccggcaccacgacgggcgagttcgccatcggcgttgcaggtgatgtcgaggaagcgtgcctcatccacatcggcgcgcacgcggtccaccgcggccacgctttccggactggaaccactgcggccaaacgagaccagcagggtggggcggtcgcgctgcaggtacagcgccggatgggtcagcaggctggtggtgtgcaccacgcgcacctcggccggccactgcgcgttgatcgcatcggccaccatctcggcgatgaagccggagctgccggcgccggtgaacagcacgcgctggttgggatcgttgaggctgccgccgaggaaggcctgcaggcggtcgcgggcacgcgacagatcctgggcgagggcttcccacagcgctggctgctgggcgatttcggtagcggtatcggctccgccaaggcgctgccaggcggacacatcggaaagcaggtcggcccaaccgctttcgaaacgcccggtgaacgggttgggagtccgtgtggaaatctgcgttcgtcgctcgccgctgatgctggctctgttgccggcattgatggctgggacctgcagaccgacaagggcgcgcgcctccgcatcgaactgccggccaccgacatcatccgcgtgcaggctggccgcaacggcacgctgaccggtgccggcgacaaggctgcaccgatcgtgctgccgcagcccaaggcgaacgtgcaggcgcagctggaagaagacgcgcaggaaatccgcgtgcgcactgatgcactggtgctgcatgtacagcggcagccgctgcgcatgcgcctggaacggctggacaacggccagcccaccgcgctgtggcaggaactgcagccgctggacctggatgctgcgcagagcgtgcaggtgctgtcctcgcaggccgatgaaggctatttcggtggcggccagcagaacggccgctaccagttcaagggccgcgagctggaggtgtcctattccggcggttgggaagagggcgaccgccccagcccagcaccgatgctgctgagcagccgtggctggggcatgctgcgcaatacctggagcgatggcagctacgatctgcgccagagcgaccaggccacgctgctgcatcgcgaagaccgcttcgatgcctattacttcgtcggcgccgacctgccgaaactgatcgagcgctacacccagctgactggccgcccgaacatggtcgcgcgctgggcgctgtcctacggcgacgccgattgctacaacgatggcgacaacagcaagaagcccggcaccgtgcccgaaggctggagcgacggcccgaccggcaccacccccgatgtgatcgacagcgtggccaagcagtaccgcgcccacgacatgcccg

SEQ ID NO: 44571 - DNA, 249 bp, Glycine max
  Peptide Sequence Number=SeqID_161349
atgacgactgaggccgcaaaggaaatcgctgcgaagatcgattcctttgaggatcaggcgacacagggatccttcgtcccccatggatgtcaggatgttctcgccgctgctattggacgtccagagcaccttggacgtgtccgtgctgctggagccggtgtcaccatcaagcaatactttggatcggctccatggacgtcccgtagctcttcctccctgcctcctgaagaattgcagcaactgacctag

SEQ ID NO: 44572 - DNA, 159 bp, Glycine max
  Peptide Sequence Number=SeqID_161350
atggaattgttaaaagacgtgaagcggctaggttcgagttgggttggtcaagctaggtgcaaaggaagaacaacgaagaacaaggctagggttcgagtggggttagcagtcaaggtgcaaaggaagaaggaagaaaggttagctaggagtgaaatttga

SEQ ID NO: 44573 - DNA, 252 bp, Glycine max
  Peptide Sequence Number=SeqID_161351
atgcacgcaattgttgatctgtttgaaattccagagcagtttcataatcttcaggccacagttagcgatgcgacttcattggcaataattcacgggttctccttcatggatgcttttctgcgtctcaacacctcggccaattgtcttcgatggactcaaatcacggtcgaatgtagcccaaaggctttatctatatggctgaaagcccccaaactttttccagttacttggtacctgcctccttatggatag

SEQ ID NO: 44574 - DNA, 498 bp, Glycine max
  Peptide Sequence Number=SeqID_161352
atgactcactccttaaatgatgttgaagctatacatgcaacaccagtatccatttgcaatcctactaattacgacattggttgtgacgatgttgttaacaaccaaaaaaatgagaatgaaatcccacctgcgacacaaaattcaaagccaaaacgaggaagacccttcaaaacgccacctgaatcgattaaaaattggtatgttatacgcaaagaacgaaagatcgccaacaggttcgatacgacttatattcataaggagacaggctttcggtgtcggtcattgaaggagattaagaattatgagaaatatggaagtcctcctcgacgtcaaaaagtgaaagcacaagccaaagaagaaagcaatgacaaaacaaaaaatgaaacagaagaaatggttgttgctcaaagaaaacagaaagcagaagttatgagaacttttgttgaagagtttctttcggaagcttatcacaatcagcttcacatgttcgacccataa

SEQ ID NO: 44575 - DNA, 174 bp, Glycine max
  Peptide Sequence Number=SeqID_161353
atggcgatgttagtgtctacatgctatcggactcccgaatctggaatattcttcatgaccggtttccttcggttttttcgacgttttccacaaataaacgttggtggcgactccgcgcattttcctcctttggaagacgcacccgtgagccttgcctcgctcgcccgcaaaagg

SEQ ID NO: 44576 - DNA, 337 bp, Glycine max
  Peptide Sequence Number=SeqID_161354
ttgtgttgcggtgatgcggaaacgttgatcccaaatgcacccgtacaaccggctaccaagcagcgggcactcgacgccgtcgccgccgccgtcgccgctccgctcgccgaggctccgccacgcagggaagtccaaggccgggcgggcgttttcctcttcgctcctctcatttacatctccggaatgctcctctacatgggaacggcgtcgttcgacgtcgttccggtaattaaacaccgtcccgcgcctggctccgtctaccgtagccctcagctcttcgccaagctccgcctcgacatggattccgataattcctccgccgatgcggttattccgg

SEQ ID NO: 44577 - DNA, 393 bp, Glycine max
  Peptide Sequence Number=SeqID_161355
atgtaccccgacgggtgcagagaaacgcaaggaactagaacagagaggcggcatgcaaatcgaggcaggattttagcattcaaaatgtcaaatttttctctccttgtggctgagtatgaagtcacatcaaggggaaaagaaatttcagcagctcttcttctcccttccacaaagctttttcttcttccttcttctccaccattgttctccattaaagctccaaaatttcttctcatttctactccaaattgcaaggagaagccatttttggagtcttggagcacacctctacattgtggggcttcgaatttcagaaaattggtggagatgatgggaagagttaacttagggttaaatgaaagcttgggcagagcaaatgagaaaaatgagtga

SEQ ID NO: 44578 - DNA, 954 bp, Glycine max
  Peptide Sequence Number=SeqID_161356
atggcctggatcatcttagaccctaagtacctagacatagccttctttaatgatgagacatttgactgttatcaagtgtttcaaaactcaggattagttgattttatgtccttaaaattgccttattatcctgaactagttagagtcttttacagtaatttaaaaatacaggatggtacgattcactctgaggtgcatggtatttctataatcattgatcaatctctgttctttttattaactaaattacccagtcaaggtgcaccttttgagggcaccattgttgatgactggaagttcgactattttagtaatgatgctcaccatatggtctgtaatgaccaggctgatatgaccggtagattgttggccggatcattaacctttgattgtcgcatcatgcactatatcatagttagaattttgcttccccgttcttctaatctagctcaagcctctgaggaggacttgattttgatgtgggatttcgttaccggtcgtcagatcgactgggctcacttggttaggtaccgaatgcataaggcattacgggccaatgcacctcttctgtatcctcaattggtcaccctttttctccgtcattttcaaattcctcttgatgatgaaccttttgttcaagtcaagcgatattttgccattggtgctggtgcagtaacttcatttggttaccgtaaggatcatgatggacagtggctaaagaaggacgtgcaccctccgcaagacgagcgtactccctctcctcctcctcaacgagatgattcctcagcccttatgaataaagttctttcggaatttcggggcctccgcacctatgttggtgaacactttgattccttggatggtcgcttaggaggaatggatacccgcattacccagcttgaagaggacgtgagttatcttcgtcggtgcttcgaccttccaccaccttcctag

SEQ ID NO: 44579 - DNA, 396 bp, Glycine max
  Peptide Sequence Number=SeqID_161357
atgccggcgtcaactcggtcccagactgtaccgaacgagtcaaactcggaacacgatgccctaaaggagaagatgaaatcgcttcttgcgttgtacgagcagcacaagcagaagcacggtgctgctgcagcagcacctcctcccagcaagaacccttctttgaagactgggacccgcattctggtgttcgttagggttaggccgttggcgaagaaggaaatggaagcgggttcacggtgctgcgtcagaatcgtcgatcgccgcgacgtttacctaacggagtttgcgtccgagaaggattacctcaggctgaagaggctcaggggtcgccattttgccttcgatgcttcgtttcccgattcggctactcagcaagacgtttattccaccacgtga

SEQ ID NO: 44580 - DNA, 285 bp, Glycine max
  Peptide Sequence Number=SeqID_161358
atgatggttgctaagtttgaaaaatattgggagaagtatagtgttgtacttgctctaggtgctgttcttgacccacacacaaagctttctttattggaatattcttactccaaagttgatgcatctacaagtgagagtaagctagaaagcataaagaacaagttgtacaagatatttgagtatcactctttcaaggagcaaaatactacgaccacccaaggcacacctacttccaacattgtgaatgaacccaagttttctctaagctattgtttaatgaactaa

SEQ ID NO: 44581 - DNA, 651 bp, Glycine max
  Peptide Sequence Number=SeqID_161359
atgcagctagcacgacagcatcagaagattatgacactccaagcacattcctcagctcccccaacaccaccttcagctacatctcttctttccactcctccaacttctgccccaccaagtgaaaaacgaaggaccaggccctctttgttagctgcaacacatttcactccagaggccaagaacaagggagatgaggtagctgttacaatcagaacacttcaacaaagagttaaagccttggaggcagagctagagagagtgaaaaaggattacagcttgcagctaaagcagaaagatgatgtcattcgtgagctttcacaaaagggtgggaaaaaagtggtagcaacaagggctagtctacggccaaaggaggcaaacactggagaattgaagagtccaagctatcgtttttggtcaccagtacaaactgcaaagaaacgaagcttttgggacataactactgctaacagcccgtcagtcaccacattgaatgggagaaaaactagaagtcatctcatttctgaacctactgcacatccatctatgcttcttcagcttcttggattatattattcagcccggatttgctcgaaaaaagggcgatatttaaacgtggggtcttcttggaaggagttacaagaggaagtttaa

SEQ ID NO: 44582 - DNA, 258 bp, Glycine max
  Peptide Sequence Number=SeqID_161360
atgacgaggaccagcagtccaacacagcagcacgacagcgatgacgaggaccaccacgacgcgagtagctcagcacccaaaccaaacttgaacaaggctgaagctcaaaaagctctacatggtggttttcataagttgaagacccaaaatgcaagggaactgcttggggcacctagcatttttgctggtacacccaacaattttcccaaataccaaaaatgcccttatgggtatttttggttacaaataacatattag

SEQ ID NO: 44583 - DNA, 114 bp, Glycine max
  Peptide Sequence Number=SeqID_161361
atggacaaaggggaagcaatggtggtaaaattgggcggtggtctggtggtaggacgggtaataacagcacctgaagagggggttcgttttgtcaatccaaatggccctggctaa

SEQ ID NO: 44584 - DNA, 315 bp, Glycine max
  Peptide Sequence Number=SeqID_161362
atggaccaaaatgctagagctagaggtattgaggtggacaaggccaaaattgatgttattgctaaattgccacctctgaattccaagcgaaggctaattcaatggattctcttgttgcaagagtttgatcttgagattaagggtaagaagggttgtgagaacattgtagctaaccatttgcctcatttggtggacgaagatgtgactctcaaagaagatgaaattcgaaaggagtttttggatgaggctttgatgttggtgaatgagagaccttggaatctgttgattcatttgatgattgtctcatgcatataa

SEQ ID NO: 44585 - DNA, 595 bp, Glycine max
  Peptide Sequence Number=SeqID_161363
atgggttgtgagaaccttgtagctacccatttgtatcgtttggtgaatgagaatgtgactctcaaaaaatctgaaattagaaaggagtttctagatgaggctttgatgttggtgaaggagagaccatggtttgcagatacaacaaacttcaagactgttggaattattttggagggcgtgaataattttctaaggaggtgtgttccaatgaagaaagaagccaagagcattatgtggcattgtcacaattctccttatggcgatcactacaatggtgggaggacagctaccaaggtgcttcaatctggattctattggacttcaatttttaaagatgcacatgctcatgcacaagaaagagtcaaagcctgtcatgagaagaagttgctcaagaaggagtcttatgttagacaacaagtgctcttgttcaacttaagattgaagctcttccctggaaagcttaaattcaaatggtctaggccattcatcatcaaaaaggtcaagccctttggtgctgtagaattagttgagccttcatcctttgaacctaaaagaagttggattgtctatggccaaaggttaaagtcttacaatg

SEQ ID NO: 44586 - DNA, 171 bp, Glycine max
  Peptide Sequence Number=SeqID_161364
atggggaagttagaatgtggtagcccgttttggatgatagatgtagtgcctcagacatgcttaagcgtgactcttcatgggcttaagcttcaattcctggaagcagccatgttccagcctctatcaggcttaagtgtggttcttctctcacttaagcaacaggtttcctga

SEQ ID NO: 44587 - DNA, 417 bp, Glycine max
  Peptide Sequence Number=SeqID_161365
atggaggccataaaagagcaaatggccacaatgatgaaggccatgatgagcatgaagaagataatggaagccaatgcggttgtagttgccgctattagcgctgtcgctaaggtgaacccgatgctcccatctggcctcaagcaaatgaatcatccaacctcaaatatggcacatatctctcaaaccatggaagagactcatgaaattccccatcacaatctagccgacttcgagccttggctcggatataccactgaagggcaagcagttggtggtatacccctacaaaaccctttggagggccctcagtatcacccacaactgcacctcttgcattccacagcggttaaaaaccctcatgactatggcaggaatgggaaagttggatcatctagaggaaaggctcagggccattga

SEQ ID NO: 44588 - DNA, 1694 bp, Glycine max
  Peptide Sequence Number=SeqID_161366
atgacatcatcagtctttcaaggtggtttcaacttcagctcaaaacttcaaaatctggatttgcaaaattgtagtcttacggatgaaagttttcttatgtcatcttctttcattatgcgttcttcatcttctcttgtttcccttgatctctcctcaaatctgttgaaatcatcaactatattttactggctctttaactccaccaccaatcttcatgaccttttactttataataaaatgttagaaggtcccattccagatggatttgggaaagtaatgaactctcttgaaattcttcacctctccagtaacaaactgcaaggcgagattccatctttctttggtaacatgtgcgcattgcagaggttagacctctcaaataacaagttgaacggggaattttctagcttcttccgaaattcttcatggtgcaacagacacatatttaagagcttggatttatcttataaccggttgactggcatgttacctaaaagcattggattgctatcagaattggaggatcttaacttggctgggaattctttggagggtgacgtcactgaatcccatctttctaatttttccaaattagaatacttggacctatcagggaactcgttgtctctgaaatttgtcccgagttgggttcctccattccaattagaatatttgagaatcagatcttgcaagttgggccccacttttcctagttggctcaagactcaaagatctttgtctgagcttgatatttctgataatgggattaatgactctgtaccagacttgttttggaataacttgcaatatatggtattcttaaatatgtctcacaattatctcattggttcaattcctaatatatcgttgaagcttcctctcagaccgtctatacttctgaattcaaatcagtttgagggtaaaattccgtcatttttactacaagcttcccagctgatgctctctgaaaataatttttcagatttgttttcattcttatgtgaccaaagcacagcttcaaatttggccactttagatgtatcacacaatcaaataaaggggcaactgccagattgttggaaatcagtaaagcaattactgtttcttgatttaagcagcaataaattgtcagggaagattcctatgtccatgggcgcccttgttaatatggaagccttggttttacgaaacaatggtttaatgggtgagttaccttcttctttgaagaattgcagcagtttatttatgctggacctgagtgaaaatatgttgtcgggtccaataccatcatggattggagaaagtatgcagcaattgataatcttgaacatgcgaggaaatcacctctccggaaatctacccattcatctctgttatttgaactgtattcaattgttggatctttcaaggaataatttgtcaagaggaattccatcatgcttaaagaatttcactgcaatgtctgaacagagcatcaactcaagtgacactatgtctcgtatatattggtataataacacttactttgaaatttatggtctttactcattcggaggttatacgcttgacataacatggatgtggaaaggtgtggaacaggggttcaagaatccagagttaaagctcaaaagcattgatttttccagtaacaatttaacgggtgaaataccaaaggaggtcggatatttgcttgg

SEQ ID NO: 44589 - DNA, 195 bp, Glycine max
  Peptide Sequence Number=SeqID_161367
atggaccgttgtcgtgcagcaacatcgttgccttcgatcaaaaaagagttggagcattttcaagcccttgctgaagctcaatttccaaaggacataattattattgaaaatccacgaccaattatcagactaatcacgacctatcaccaacttgaattagcttggactaaattcccaaggccttgtgaaacataa

SEQ ID NO: 44590 - DNA, 405 bp, Glycine max
  Peptide Sequence Number=SeqID_161368
atgcctagggctttgacaagccggtccacggtgagcctcacgttccgaaatgactatctttgtgcaatggagagaaagagaagaccaatgtttaactacatggatagagttcaacacatggttactgtaaacatgagaggaatctttatggattggttagtggaagttgttgtagagtacaagcttctctcaaaaacccttaatctctctatgtcatacattcataggtttttgtctgttaatcctatgagcaaatcgaggcttcagttgcttgatgtttcttccatgctcattgcttcgaagtatgaggaagttaatccacccggtgttgacaaattctatagcatcactaataacacttatgaaaaggcagagagatggaagctaaaatacttgcgtccctaa

SEQ ID NO: 44591 - DNA, 840 bp, Glycine max
  Peptide Sequence Number=SeqID_161369
atgatgatgtatgatgcaaaacatatatcaaatgtactaagatccgtcaatcaagataacaaccaatacaaatgccactcaaaggagtcgggcatattaatgacactttttgacaataggagagacaaggctgcaacttaccaatttactattacccctagggtcaaaagtgtcttggataaaattgtggaagatgggaggtattgtgttgtcacacatggtggcaatgatgagtatcagataacttgcttgccatgtaaacatgcttcgacatgcattgcttataagagggacaaatttgagaagtattgtcatagaatgttctctatttctatgctaatatttgcttatgctggaattattcatccaatgcatgagcttgatgttactaatacgggaggctatcccaacataaatgctccagctttaaaaaggatgacaggtagacctacaaaagcaagggaaaagattcatgttgagagaccttcaggaacacaagaggctaagagatcaaacactctcaggtgttccacttgtaatgaatttgcacacaactcttggatttgtcaatgggctccagtgaaaaagagcaaagaaaaaaggttgtatagtaactttaaactttatgattattggttgaaatcaactgttgaaggtgcgaccggtggagaggcaattcctattgatccaaatgctactttagttgctgccactcaatctgtccaagctgaaaacactgatccaaattctacaagtggacagaacattaaaactagtagagctatgcaagaaaagaagaagccaagagcaagaaaaaaagttaacaaagttggaaaatag

SEQ ID NO: 44592 - DNA, 378 bp, Glycine max
  Peptide Sequence Number=SeqID_161370
gaggctggcatccatgtgaagaggctacattcagctgaaggtgcagaaattttaccacgtcctgcagttgtaatagtgatggttttgggtagccacagctacggagctatcaaaaggcttaaactaggatggtatgtgatctttgtgacatcaactccaagcaaggtccacaaagctgttgatgcatgcaagaatgttcttagaagactgcatagcaagaaaattactgagagagagttggacaggatttctacatcggttgtcctaataagcgatgtagaatgtcagaattcaacatcggtcgctcaaccgtcattgtgtttcaacaacaccaggctacaacgacgcgtgataaccgatgtagaaaggtgccgatga

SEQ ID NO: 44593 - DNA, 474 bp, Glycine max
  Peptide Sequence Number=SeqID_161371
atgttggatgtaaccaataacgtggtccaattccatgagcttccctctcagtacattgaccctgaggcaccggagatgttgactgcctccaatcttattcccggtgctgtctattggaccattcggagtatagtgtcctgtgcatcgcatgttttggacataactggcttgggtcaaggatatttgacatcaacaacagagacttgggagctttcgagtttggcccataaacttgataacataaatactcaccttcgaatgcaactcaccctttgtcctcagtatttagatgacaacagagagaggcatttgaaacacttcggctcctttttgagagatccccccaagataattcaaaggttctcaaagctatgttttgcagccaggatgattcgttgccactgttcgatggttcttccaaacaacggcttaaccctgaaaccgttctctcttgctctcactcttaatctttaa

SEQ ID NO: 44594 - DNA, 144 bp, Glycine max
  Peptide Sequence Number=SeqID_161372
atgctccaaccatgtgggatcggcgcgagcttaaaggagcactcaaacaggatgacccccaaggcctaccctcggaagagtccgtcaggggctctccctcctaagtcagcccttgaaaggccttacagttgtatgattacataa

SEQ ID NO: 44595 - DNA, 354 bp, Glycine max
  Peptide Sequence Number=SeqID_161373
ggtcatcctaaggtggtcattctcaagaacctttctgatgagcattttgaggatagcttcatcaatcttaacacatcttcacaggttaaagcattcttaagtagattgcttcataaggttaaagtgaagcaacagctgttgttcttctcatggacgacttcaactttcaacttgattgcattttcgaatgtagttagcattcactttctgatgtgccctcacgagtatgtcccgctaagcgaggcaccagcgtgctcagtgagacacaagaatctggaagagaatctgccttgcaagcacgcgctcagtgcgttgtcgctcgctaagcgagtcatccgttatcttccaagctaa

SEQ ID NO: 44596 - DNA, 465 bp, Glycine max
  Peptide Sequence Number=SeqID_161374
atggcggaggatgatataagcaaaactgccttttggacacaccacggtcactacgaattcctggtaatgccttttggcctctgcaatgttccatcgtcttttcaacaagaccttcccgaaacatctagatcatttaaataccaccttcaaagtcctcagtatcaatcagttttttctcaaatttttgaaatgttcattcacgacttccaaagtggagtatttgggtcatatcgtgtcccaacatggggtggagccggtctatcggggttttatcgaagattcataaagggatacgcaactatcacaacacctctcacggcacttttggcaaaggactcattttcttggaactctgaggccgaacaggcattcatcaaattgaaggatgctctgtgtcaagcacctgtccttagtttaccagacttttctttgccattttttgtggaaacagatgcttccggatag

SEQ ID NO: 44597 - DNA, 612 bp, Glycine max
  Peptide Sequence Number=SeqID_161375
atggcacaagtcattcaaatgccagagcagcagatatatttggcacgattattgggatatgactacacgatacagtatcgtgccagcaggatgaatgaattaaaagtagaattgttgaacaatccagaattttttttgcaggacagtccttataaacaccctgagtgctcactccgacaagatttcattttgcagaaggggcgtatctggttacccaaggggttgcaatccataccaaccatactcgtggagtttcattccacgcctacaggaggccatatggggattgtgaagaccttagcgcgtgtcggtgagaattttgtttggctaacaatgaagaaagatgtccaacaatttgtcacgacctgtgttgtttgtcaacaaatgaaatacgaccatcgaaaacaaccagggttgttatgtcctttaccaatttcggcacggccatgggaagatctctcactggatttcatcatggggttaccaacttttctaggtcattctgtcatattggtggtggtggatcatttctcgaaaggtgtgcatttggggcttttaccggcacactacacagcttctagcgtcgctagagtattcatggacatcgcctga

SEQ ID NO: 44598 - DNA, 447 bp, Glycine max
  Peptide Sequence Number=SeqID_161376
atggaaagactcaggctaaatggtgctctctttcatatacacagtagtggagtagtcgatttcctgggatttgctgacacacccaagaacttgattatctttttggataatgcatctataggggccagggtaatgagttcggcgtatcaccctcagtccgatgatcagaatgaagtaatgaaccgcatcatcgagcaatatctttgggcattcattcatcagaaaccttcaacgaggggtcattttctgatatgggtcgagtggtcttataatacctccactcattctgccaccggaatgtccccgtacgaggtcaccttcagtaagaaactgccaaacattcctcaatacctggtaggaacatcaaatgtggaggccgttgacgattggttgacccatcgtgacacgatactcatcagcttggcgaagaaattaaccaaggcctaa

SEQ ID NO: 44599 - DNA, 951 bp, Glycine max
  Peptide Sequence Number=SeqID_161377
atgcctgatgtcaccaccgtgaaccgtttgcactacaagacatgggatgcagaaggggagttgcatgtcaagattcaacaacgcaatagtgatagatacacagctttggggtttatgaatacagtcacagctagaagctctaaagaaatgtcctccaagaggcaccactttcactggacaaacaaggttggcactgaggatggtgaagttcccacttcagaatcattctcaacactcttccaagatgagaaaaaagatgaacacaaggttcctgttgctgctgctcctgaggcaaatgctccagcaccagcatcacatactgcagcaaggaagaagctgcaagcagtggcagtctctagaatccggtctgtgttgaccgtgttcaacaagaacaagaacaacaaccgttcgaactcggctttgggccttggctcgcgcgtggtcggaacccttttcggctacagactcggccacgtgcattttgcattccagaaggaccccacttcccagccagccttcctgatagagctcgccacgcccatcagtgttttggttcgcgaaatggcgtctgggctggtcagaattgcccttgaatgtggaaaagagaaaggagcagagaaaaaacaacatgtgaggttgcttgaagagcctgtgtggaggacttactgcaatggcaagaagtgtggctttgccaccagaagagagtgtggcccaaaggattgggatattctcaaagcagtggaaccaatttcaatgggtgcaggtgtcttaccaggaaataataataacaataataatagtggagctgaagcagggtcagagggtgaaatcatgtacatgagggccaagtttgagagaattgttgggtccagagactccgaagctttctatatgatgaatcctgatagcaatggtgctcctgaactcagtgtctacttgcttagagtctag

SEQ ID NO: 44600 - DNA, 1344 bp, Glycine max
  Peptide Sequence Number=SeqID_161378
atggctgaatcaacgcggtccaaatccaattgggatcgccttgaagaagctatagccaaattggcctctaaccagatccacgttactgagaaacttgatgaccttctacaccgtgtcaccaccatcgaaaacacttcaaccccagcagcttcaccttcgtcgtcctcagtcatacttgcaccacctacccacttaaccaatccaccaaaaatgaaactagatgttccaagatttgacggctcaaacccttctagttgggttttcaaaattacacagttctttgaataccatagcctccttttatatggagggtccggccttagcctagtttcagtggatgatgcgaaaccatcaactcaccacctggacaagcttcctacaggaaatcgagactcgtgtcgcgcattccccaccctgacattcgacgcaaggtgcaggctcttcagtctctcaccttggttcacgtcgccagtttggcctgcctttaggaagaaaaacttgcaaaacatcgccggagctctcgccaaaacccctcccttacccttaaagaaactcacccccgcgaaaatggcaagccgacgagagcaagggctctgctttaactttgatgagaaattcactagggggcatcaatgcgccttccgattcttccttctcatcgcagatgaagaacaggaagatgatgttgcagaccttaaaatagaatttccagccccaagtttggatgacccgccccaagcccaaatcagcctttacgcattatcgggtagtacacacaattttatgcaagcacacctggtcaagcacttgggcctcatatctcagcccacccaggtcctgcgggtgctcgtcgaaagcagtaacgaagtcgaatatcaccaactccgtctaggtgccacggttcatgtggagggatgcgtgttcatgatggacctccttgttcttttgctctatggcgccgatatagtccttggagtccagtggcttaaatcgcttgggctagtattgacagattacaatgaattgataatgaagttcgttcatgaaggaaagcttattaaactcaagggtgacacgaacaaggatctccaagctatttcatcgtcacaactgtgccatatgattcagacaaatggtgccaacaaatatttccacatcaagggagaccagtcagggtcacgatgttttgcgagaatgctccaaccatatgggatcagcataggcttaaaggagcactcaaacccggtgacccccaaggcctacactccgaagagtccgtcagggcctctccctcctgattcaggtccaacccgtaaaatcattttagcacacagacactgctag

SEQ ID NO: 44601 - DNA, 399 bp, Glycine max
  Peptide Sequence Number=SeqID_161379
atgtttgcccttctgactgaacgtgattttgctgccaatggtagtagtgcagtagcagaccctgatatgcaagaagcctttccttggttgcatactgtttaccttgtccatcctaaatgttgtcctgtgctttctgcttcccaggcattgaaatgtatcaactcattggttcttggatttggcgagtacattgaggaagtttatgcagcatatgaacaacacaagttggagacaatgcaagactctttaaaaggtgccaagtggagcaacagagctgagatgactgaggaagaagcattggctgaacagcaaaggatgtttgcagaggcacgtgcaagaatgaatggaggagccattacttccaagcagccagacgctcaccaaagtttagagagctaa

SEQ ID NO: 44602 - DNA, 282 bp, Glycine max
  Peptide Sequence Number=SeqID_161380
atgccctcctttgcgtcagggcaaacccaaaagcgcgttgacgccaacctccccacgcgcctagagggcgcgtgggaagctgcttgcggaaccccacaacaaactttctgttgtcacgttcaactggaaactggtcacctgtccggttcaaaagtctctcataaccgttctggcatcatcgaactggtgactaacaggttgcttaatctgtttctcaatctcgcaccttctccggcaaaaggaacttcttcaggtggtgtgaatttgaatgacggaggttga

SEQ ID NO: 44603 - DNA, 258 bp, Glycine max
  Peptide Sequence Number=SeqID_161381
atggcttttgaaagattgagaaatggctacttggaaaaggtgaattttattggtgatactaatgtcatcaagtttcaagttctaatggttttggttggcctcaaatcaccaagatgcaaggatctatacattgaggaaggcgtggcattaattgaagcatctaaatttatcatgacatttgtgaatttgcactcgcctatggtagattggagagtgaaagtgtcaggatctttgcacttctatgacatggtgggttga

SEQ ID NO: 44604 - DNA, 3570 bp, Glycine max
  Peptide Sequence Number=SeqID_161382
atgggtggtaatagaaggaggaggcaccacttcagcagaatccatgcattctcttgtggaaaagcttcattcaaaggggagcattcactcataggaggtcctggattctcaaggatagtgtactgcaacgaagcggaacgaggtgaggggagtctcgtgagttatggtgacaactatgtgagtactactaaatatacagtggccactttcctgcccaagtccttgtttgagcaattcaggagggttgccaatttttacttccttatctgtgcaattctgtcttttttcccggtttctccttactcggctgtcagcaatgttgttcctcttgtggttgtggttgctgctacaatggggaaagaggctgttgaggattggaagaggaaaaagcaggatatagatatgaataacagaaaggttaaagtgcaccgtggagaaggcatttttggctattctaaatggaaggatttgaaagttggagacatagtaaaggttgagaaggatgaatttttccctgccgatctcatcttactttcatcaagcaatgacgatgcaatttgctatgttgagaccatgaatcttgatggagaaactaatctaaaagttaaacaatcacttgaagaaacttcaaagctgcaagaagattcaagctttcaaaatttcaaggctatcatcaaatgtgaagatccaaatgcaaatttgtactcgtttgtaggcagtttggagcttgaagatcaattgtaccctctttcacctcaacatctactgcttagggactcaaaactaaggaacactgagtttatctacggtgtggtaatctttacaggccatgatacaaaggttatgcagaactcaacagaacctccatccaagagaagcacagttgagaaacggatggataagatcatctactttctgttcttggtcttacttttaatttcttttattggttcagttttcttcgggattgcaaccagggaggaccttgaaaatggagttatgaagcgatggtacctcagaccagatgacaccacaatttactttgatccaaagaaagcaccagttgcagcaatgctgcacttcctgactgcacttatgttgtatagttacttgattccaatttctttgtacgtttccattgaagtcgtgaaagttcttcaaagcattttcatcaaccaggatttgcacatgtattatgaggaaactgacaggccagcacatgctcgtacctcaaatttgaatgaagaacttggccaagttgatactatactttcagataaaacaggaactttgacttgcaattctatggaattcatcaagtgttctattgctgggattgcctatggccaaggagttacagaagttgagagagctctagccaggagaaaaggagtacctacagatcaggagttgacagaagatggcaatgttccaaagtcttccattaaaggttttaactttatggatgaaagaatcatgaatggaaattggatcaatgaacctcacgccaatgtaatccagaactttctgcggttgttggcagtatgccatactgcaatacctgaagtggatgatgaaattggtaaagtttcatatgaagctgagtcacctgacgaggcagcttttgtggttgcagcaagagaacttgggtttgagttttatgaaaggacacagacaaatatttcactgcatgagttcaatcctagatcaggcaagacaactgaaaggtcgtacaaacttttgaatatattagagtttagtagtacaagaaagcggatgtctgtaattgtaagagatgaggaggggaaactgctactgtttagcaaaggagcagacagtgtcatgtttgaacgacttgcaaggaatggaagggagtttgaagagaagactaagcagcacattgaagaatatgctgatgctggtttgaggaccttgatacttgcgtatcgtgaacttgatgaagaagagtacaatctattcaatgaagagtttatggaggccaagaacttagtgagtgcagatcgggaacaaattgtggaggaaatatcagaaaagattgagaaggatttaattcttcttggtgttactgcagttgaagataaacttcaaaatggggttcctgagtgcattgacaagctagcgcaggcaggaattaagctatgggttctgactggtgataaaatggagacagcaatcaatattgggtttgcttgtagtttactaagacaaggaatgaagcaaattataattagttcagacactacagaaaccaaatcactcgagaaaatggaggacaagtctgctgctgcagtggcaattaaggcaagtgttattcatcaattagcgaaaggaaaggaattacttgctgaatctgatgaaaactctgaggcattagcccttatcattgacgggaagtctctcacttatgcactagaagatgatgtgaaggacctatttcttgaacttgctgttggctgcgcatctgtcatatgctgtcgttcatctcccaagcagaaagcacttgttactagactagtaaagattaaaactggtagcacaactcttgcaattggtgatggagcaaatgatgttggaatgcttcaagaagcagacattgggattggtatcagtggtgttgaaggaatgcaggcagttatgtccagtgatattgccattgcccaatttcggtttctagagcgtttactacttgtgcatggacattggtgttacagaagaatctcatcaatgatctgctacttcttttacaagaatattgccttcggcttcaccctcttcttctacgagatctatgcctcgttctcagggcaagctgcatacaatgattggtatctctccctatataacgtattcttcacttcccttcctgtaattgccttgggagtgtttgaccaggatgtctctgctagactatgcctcaagtttccattattatatcaagaaggtgtacaaaatgtcctattcagctggaaacggatccttggctgggctttcaacggagtcttgagtgctaccataatattcttcttctgcatcaacgcaatggagaatcaagcattccgtaaagccggggaagttgctgatcttgaagttcttggtgccaccatgtacacatgtgttgtgtgggtggtgaattcccaaatggcattatccatcagttacttcacttacattcaacatttattcatatggggtggcattcttttctggtacatattcctcttagtgtatggaaccatggacccctctctatcaaccactgcctataaggtcttgattgaagcttgtgcaccagcaccatcttactggctcatcactttgcttgtgcttgttgcttcactccttccatacttcgcctatgcttcaatccaaatgcggttcttccctactttccatcaaatgatacagtggatacgaaatgatgggcaaactactgatccagaatacgttaatattgtgagacaaagatcaataagacacacgacagttgggttcacggctcggtttgaagcatcacatagttcgggagcatccaagagtattcaagtatga

SEQ ID NO: 44605 - DNA, 555 bp, Glycine max
  Peptide Sequence Number=SeqID_161383
atgtcaaagcttcaggtgaatcaactcaatcaattaagggaaatttttgcaaaatttgacatggattcggatggcagcctaacgattttggaactcgccgcgctccttcgatcgttggggctgaatccctcaggggacgaaatccatgccttgttagccaacatggactcaaatggcaatggctttgtggagtttgatgagttggtggaagcaatattgcatgacataagtgcagagattttgttgaaccaagaaatgctatttggggtgttcaagtgttttgaccgtgatgggaacggttacataacagctgcggagttagcaggggcaatggcaaaaatgggtcaaccccttacatatagagagctcacagagatgatcacagaggctgacacagatggtgatggtgtgattagtttcaatgaatttgcctctgtgatggcagagaggttcctcattgtaaaccacgattttgcgcattggaacatgtttctgtccttgatgttgtgctttgttgacttcacacaaaaaggagaggaaggattccttcactaa

SEQ ID NO: 44606 - DNA, 205 bp, Glycine max
  Peptide Sequence Number=SeqID_161384
atggttccattccaccccatgaaccaccccactatcatcgcatgcatgtttaggcactttgttgtagtgttgttacatagattcttggggattctcaaaaggatcatgaggtctaaaaatgatgcaagggatcacatggtgattgtagtggggagaaaggtgaggaagatgtggcgaaggatgtacggcgtggaggttggaggtg

SEQ ID NO: 44607 - DNA, 195 bp, Glycine max
  Peptide Sequence Number=SeqID_161385
atggccgaaaagtgtaaggccatccttcctttgagggaggtggccgaaaggttctcattgttgaattatttgagttgtactccacacaaaacttgttgggccataaatgatcgagtcaattgcagtcaaatgattgccaagttacttgagactaagtatcaggctgacaaaatgaccgagatacttactgagtga

SEQ ID NO: 44608 - DNA, 147 bp, Glycine max
  Peptide Sequence Number=SeqID_161386
atgactacagctggacgagaagtagagggatccatgagaaagattgaaaaggtgagtaagcgtgaagcagaggatcatggtcgtgaaaagcggaacaaggaagaagaaggtgtaagtgatggtgacagaggctttgctcccaagtga

SEQ ID NO: 44609 - DNA, 414 bp, Glycine max
  Peptide Sequence Number=SeqID_161387
atggctgtgcggactagtcttatgcctggcattttgaaaattgttgctcacaacaaggatcatccaaagcccataaaggttatctatggcaggtggaggaatatcacagaaattccgccatataaacatttcattgtggcctattgtgccactctagcgggcctctcttcccaaattgcctatggcagaggtgatatagcagttttggatgaacaaagagatgttggtgcaaaaaatcttcgccaacttgctgctctgtactgtggtgctaatgctggatttgagataattcatggcttggtggacagagtaatggaaaagaatggggttccctttgtttcacctggtgataaatcgggttattatattgagcggtcagatgtattaaacaactttgacattcctgatccctga

SEQ ID NO: 44610 - DNA, 1464 bp, Glycine max
  Peptide Sequence Number=SeqID_161388
atggggtttgctggtaatgttgagccatgttttaatgttccgacagtggttgcaattaacgagtcctttcttaatcaatcgaggaattcctctaaaggcaattgggttgcccagcacaatgctggcgtaatggcagatcttgatttcttcattggggatgaggccctctccaaatctcgatctagcagcacttataatctcagctacccaattcagcatggccaggttgagaattgggatgccatggagcgcttctggcagcagtgcatattcaactatttgaggtgtgatccagaggatcactattttctcttgacggagagtccattgacttcgccagagagtcgcgagtatactggggaaatcatgtttgagacgtttaacgtacctggactttacattggtgtgaattctgtgcttgctcttgcagctggttacacaacatctaagtgcgagatgactggagttgtagtggatgttggagatggggctgctcatgttgtacctgttgcagacggctatgttattggcagtagcatcaaatcgattcccatttctggaaaggatattactctttttgtgcagcagcttatgcgggaaagaggagagaatgtaccaccagaagactcttttgaagtggcacggaaagtgaaggaaatgtattgctacacctgctctgacattgtgaaggaatttaataagcatgacaaagagccagccaagtatatcaagcactggagaggtattaaaccaaagacgggggcaccatattcctgtgatattggctatgaacgatttcttggccctgagcttaacagaggggggttatacagaaaagtggtaaaaagtaaaagaggccgaagtactagcgtgggaaggggcaagggaggcttaagtacaagcaatattttctttaatcctgagatatatggcagtgactttaccacccctttgccagttgtaatagacaagtgcattcagtctgcgccaattgacacaaggagatcattatacaagaatgtagtgttgtctggaggttcaaccatgttcaaggattttcacaggaggttgcaacgtgatctaaaaaaaatagtggatgctcgtgtccttttatctgaagcgcgcttgaatggggagataaaatcgcagccagtggaggtaaatgtactcagcaatccaatccagagatatgcagtttggtttggaggatcagtgcttgcgtcaacacctgatttttttacggcttgtcatacaaaggcagaatatgaggagtatggagcaagcatttgccggacaaatcctgttttcaagggaatttatatgataagactgttgaatgaaacagctggttatcgttatcctcaattcacttcctgggctttcttcccacctatattcagggtggcagaagtagtcagtttcacagggttaatacagctgtcagcagatccagacgatacttaa

SEQ ID NO: 44611 - DNA, 1728 bp, Glycine max
  Peptide Sequence Number=SeqID_161389
atggatgccactaccagtgaaaccccaactatccaataccataacatccctgatcagccaattactaccattgttgccacacaattgccaacatttcaaccgcagcaacgccattgcttcaaggactctagtccaggagagtttcccttgtctgacaacccctccattgtccttcatgtccttacaacatgtaacttgtatgctcaagaccttgctaaacttgaggcaagtgctgtgcttgcaacatgctccttcttcaagcggccggcaaactttgatccggattttgacttgtccttgtcagagcttgctgcattggacatgtgccagaagagagccatttttaatccaatgacaacagaacaacggcaacatttgaagcaaagatgtggcggttcttggaaattggttctgaggtttttgcttgctggagaagcatgttacagaagggaaaaatcacaggtaatagcaggccccggtcatagcattgctgtgacatcaaaaggggttgtttattcatttggttccaatagttcaggacaacttgggcatggcaccactgaagatggatggcaacctcggccaatcagagctttgcaaggaatccgaattatacaagctactgctgctactgggagaacaatgttgatcagtgattctgggcaggtttatgcctttggaaaacaatatttttgtgaaaatgagattggaaatgaaggatctaaaatggttacaactccacagttagttgaatctttgaaaaatatatttgttgtgcaagctgcaattggaaactatttcacagccgtattgtcaagagaaggcagggtttatacattttcttggggtagtgatggcaaactctgtcaccaaactgatccaaatgatgtggaaccccgtcctttattaggagctctggaacacataccagtagtgcaaatagctgctggattctgctacctgctttgtttggcttgtcaaccaagtggaatgtcagtgtactcagttgggtgtggtatgggtgggaagctcggacatggcacagaaacggatgagaagtatcctcgtttgattgaacaattccagctgttaaaccttcagcccatggtgattgctgctggttcttggcatgcagctgtggtggggcaggatggccgtgtttgcacatggggttggggccgtcatggctgcttgggtcatggaaatgaagaatgtgcattagtacctaaggtggtggaggagctgaaaaatgtcaaagcagttcatgttgctgcaggagattacactacttttgtagtgtctgatagcggtgatgcgtattcatttggttatggagaatctggtactcttggccatgaccctgaaaatcctgagcaggaacacatgcatgcagatgtgttaactccaaagctagtcacttcgatgaaacagaactatgaacgggtgatacagattagtctgaccaattcggtatattggattgctcatacatttgccctaactgaatcagggaagctgtatgcctttggggctggggacaaaggacaactaggtgtagagcttcgtccctaccagactgaaagacgaaagccacagcgtgttgatattgatcttgaatcaaagaatgcatccataaggtccaagctaggtctaacaagggcctcaccttcagctatttgtgcggttgttgatattaatctttggcttgaacttgctcatcatagttga

SEQ ID NO: 44612 - DNA, 1386 bp, Glycine max
  Peptide Sequence Number=SeqID_161390
atgggctgtccagaacaacttcaccgtttgcttgctaacgtggtccagggccactgcaatgtgtttgataaaatgcctgaaggaaaacaagtaccttttcttacggtgactcttagtttcagtacaatgggtcgtaaattttgggagctactttacggtggaaaccattttattagacccaacatgtctacagcattttacctaaactccatgttttatcactcttcaagagaggctctgaactttcagtggtatcagaatgagtttcccaaagtgaaagagttgacccattcgctagcaaatgtggatgcagttaatgggaggcttgttgatattaatagcaattcaaccgtttttgatgatgacattgagcgtgaaatgtgcaccttcaagtcccttgttcgtgagtttgttgggtctccattagttcagcacagaatgaaacattttctggcctctttcctcacaaatgtaaaagatgaatcttttaccccttttggtacagcaactgaaagaaagcctatggtggtcgattcattgaccaaagtgagcaactttctcagtgtttctgctcaacaaaggaaattggttcgtttcagggtgtgcccgcaggttactcagcaccgcatatggactggcgcacttaaagaagttctgaatggttttgcagttgatttggattgtttggcttctcggggcttagacaacgatgctttgttgggtggccaaattgttcatagctgcttgaggtttctgactgaaattggtgtcttttcggagcctgagtcttcttcttggatgaagctttcgccttctaaaacagttgattcctctgattcccggagatgggaagatgttcttgtgatgctcaatgatcttactaaatgctgcagaaatgaaaggaggttaaagatgaatgtagctaaggctgaaatcatgaaggaggggcttttgcacataagggatgttttagttgatagcaatgttggatataaggaagcacagcatcaagaaagcctagtgaagaagaagctgtccaaaatgttgggtcactcgtcttgttgcctgttcactctattactgtattacctctatggaagggtggcggatattgaagtagacatgtgtggtggggtttatgcaaacgggagtgatggcaagttttgcttgtttatgggaagaattttgacttcagatagtgagaagatggttggacgtggcgtgaagcagttggaccgggcacttgggattttcaagttcgtgtgggaaatggctgaaatgaaagggcatttggacttgcagggccatatgtggtgtgttggagcagacaataggatgcttaggtatagaggaaacacatactttgtgcatggaatttgcctttga

SEQ ID NO: 44613 - DNA, 1062 bp, Glycine max
  Peptide Sequence Number=SeqID_161391
atggagttcagtttcgacgagaaggacttcgcgtcgtgctgcggaagcaccaaattcgcgaaggaaatggcttcggcctctcctttccgttcgttccaggacgctgtttctgtcgcgaagggcgtttggttcaacagcgttgatgtcaacggttggcttcaggccttctccgcgcaccctcagatcggtcaaacccacgctccctctgtcgcctctgaagccagtgctcagttcaccagtgcccacccagttcagtacttcaaatttatctcttttcctcatctgggtcactcctttttgtgttttggtgtgaaagaattgagttgtgaatgcaaagggtggagtaagggagagcaatcaactgctttagcaactgctactggttctagcttacaggaactatctgaatggaatgctcggtatagggaaaagtttgggtttgtatttctcatttgtgcagctgggagaagtaccgatgagatacttgctgaactgaagagacgttatacaaacaggccaattgttgaatttgagattgctgctcaggagcaaatgaaaattacagaactgcgccttgcaaagctcttttcaagtagagaaaacatttcttcttcagttgataaatattccgctgctaaaaaggcagaagaagatcgtataagcattattggtggtcacgtgactgctgcttcagagatttcaacagcaaaattgattcaccatcctgccagaacccgccctcccattacgactcatgtgttggatgtttctcagggctctccagctgctggtatcgaggtacttctggaggtgtggaggggcactcagtctcgaccgacatttggggcctcaggcggtggcagttgggtgttccaagggtcttcaacgaccgatttagatggtcgtagtggtcaactgttgagcatagttgatgatgtgaatccagggatatacaggataagtttcaacactgggaagtacatcccaaatgcacttaccgtggaagctaggattataggcacagttgccaaatggatgtcactgatatttgtgggtacctag

SEQ ID NO: 44614 - DNA, 312 bp, Glycine max
  Peptide Sequence Number=SeqID_161392
atgtgggtggttgtgactcttgattttattgagactgtgaagaaagcagttggagatggaaggagactccgttttggttggagccatgggttgggagagaggctttggaggttcattatagatgacttttttcatcttacttgcttatctgattctaaggtggttgaaactcgggtgagaggagatggagactggtgttggaattggtggaagagggatcttttgaggtgggcaaaagatttgttacatgatttggaggttgaggctggtcatgaggggtttagggagggttttggagattctcggagatag

SEQ ID NO: 44615 - DNA, 552 bp, Glycine max
  Peptide Sequence Number=SeqID_161393
atggggtttgctggtaatgttgagccgtgttttattgctccgacagttgttgcagttaatgagtcgtttctgaatcaatcgaggggctcttctaaaggcaattgggtggcccagcacaatgctggaattatggcggatcttgatttcttcattggggatgaagcacttaccaagtctcgatctagtagcagttacaatctcagctacccgattcagcatggccaggttgagaattgggatgccatggagcgcttctggcagcagtgcattttcaattatttgagctgtgatccagaggatcactatttcctcttgaccgagagtccattgactccgcctgagagtcgcgagtatactggggagatcatgtttgagacttttaatgtgcctggactttacattggtgtgaattctgtgcttgctcttgcagctggatacacaacatccaagtatggcctcagcagcaacaagtttggtagctacctaaacacaaaatgcactggatgtttcatcagcccctgcaatttgacacatttggatgctttcacttga

SEQ ID NO: 44616 - DNA, 300 bp, Glycine max
  Peptide Sequence Number=SeqID_161394
atgtggcattttgagttgattacaggacttgtagttttaatatcatcatgtcgctatttgctattgaagacgtggccagattttgctgagtctagcgaagcagcgaagcagccaatcagcaggtccttagctcacttcagcctttggattatattgttgttgcatttttgcctgtatgaacaagacggaaagccactacctaagttcggggaatgggatgtgaatgatcctgcctcagctgaaggattcactgttatattcaaaccatcgttgcagagccttctcaaaccatcgttgtag

SEQ ID NO: 44617 - DNA, 213 bp, Glycine max
  Peptide Sequence Number=SeqID_161395
atgggagtctataaaatgatgcccaatgatgcacaactaaaaactgcattgagcagtttctcaatgtcgttttctattttcagcgatgattcttcagttgttcttcttagacatgttaagccccggcgcagtggttgtcgtgcagatcttgctggtagtagcaaatattctaatgagaattttgatggccaagagtggaaaggttccatgtga

SEQ ID NO: 44618 - DNA, 2730 bp, Glycine max
  Peptide Sequence Number=SeqID_161396
atggtaatcgattacatgcctatggtaatcgattacatgcctatggtttcgtcatcgtggattctgatccacagtgcaacaattgcacccgtcatgcttcgcagatccctcatcatcatcctacacttgtcgttgttgtcgttcggatatgcggatcccgctcccaattgcactcgcctcagctccgtcgtcaattcggagtcggagttcgaaatggttcaacaccaactccgaggatccctgaaaatcagggacgattgctcctttagggtttcccaattcgacatgcttcccggttccgacgtccactggtggggtgcgcaggcttccgatttcgataacctcaccgccggattcattgtttccaactacggattgaacggaacctacaacaactccaccttcgatgtgcatttgttgagcaatgtttcctggagcatgatcaacgtcctcgccgtctgggatcgtgccaccgcctccgatttcggccacgtcgtgctccgcaaggacgccccggcgtcgcctcctcctccgacggtgttcgagaattgcaaggttttgtcgaagaatttcaggttgaggtggagtttgaatgtgtccgaggattctcttgaaattgggttggaggccgcgactgggatcaccaattacatggcttttgggtgggctaattccagtgctcaagattctgatctcatgattggtgctgatgttgtcgttgcagggtttaaggaagatggtatgccctttgtggatgattttttcattactaagtatagtgagtgtgtgagaaatagtgatggagttgctcaaggggtatgtcctgattccttttatgaaggccctgatggggtgggtttagtcaacaattcaatgttggtttatggccataggaaggatggggtgacctttgtcagataccgcaggcatttgactaaggtcgatggaaagtatgatcatcccgtgaaccattcagcgaatatgaaggttatttgggctttggggcgtatcaagcctcccgattctattaatccttactatcttcctcagaatcatggggccgtgaattatggccatttggttttgaatgtctcggagcatgtgaatgagtgtacaggtcccttggatgctgaagacaaagaagatcaaggtctcatcactgcagatgcaaatgttcccttggtggtttcttctgctccggcaatgcattaccccaaccctccaaatcctgaaaaggttctttatatcaacaaaaaggaagctcctgtcttgagagtggaaagaggggtgccggtcaagttttcgatccaagccgggcacgatgttgcactttatattacttcggatccgcttggtggaaatgctaccacgagaaatctgactgagactatttatgctggaggtccagaggcccacggagttcaagccagtcctacagaattagtttgggctcctgacaggaacactcctgatcacgtctactatcattccttgttcgaccagaagatgggttggaaggtcgaggtggttgatgggggtctatcggacatgtataataacagtgtcattttggatgatcaacaggttaccttcttttggacattgtcaaaggattccatatctattgcagctcgtggcgagaaaaaaagtggttatattgccatagggtttggaagtggaatggtgaacagctatgtgtatgtgggttggattgatgatactggtgtgggacatgtaaacacttattggattgatggaaaggatgcttcaagcatacacggcacgcaggaaaatttgacacatgtgagatgcaaaacagaaaatggcatcattacttttgagtttactcgtcccttggacccgtcttgtaggcgggaaaagagggtagaatgtaaaaatatcgttgatcccacaactcctctcaaagttgtttgggcaatgggtgctaaatggactgatgatcatcttactgacaggaatatgcattctagtacaagtaatagggctattcttgtacacctgatgcgtggttcagcagaggcggagcaggatttacttcctgttttggctgtgcatggatttatgatgtttgttgcatggggtatcctgtttcctggagggatattggcagccaggtacttaaaacatctcaagggcgatggatggtaccggattcatgtttacttgcaatactcagggttagtaattgttctgcttgcccttctttttgctgtggctgagcttaggggattttatttcagctcaactcatgttaaatttggatttgctactatattgttggcttgcatacagccagcaaatgctttcctaaggcctccaaaaccagccaatggggagcaggcatcctccaagagggttatttgggagtgttttcacacaattgttggtagatgtgccattgttgttggcattgctgcactttttactgggatgaagcatctaggagacagatacgatgtggaaaatgtccatggactcagatgggctatggcaatttggtttttaattggtgcattgattgttatttatttggaataccatgaaaggcagcgaatagggcggcagatatctggaagaggcaattgggtgcttggtaatcttgaggaagatgattcagttgatctcttgaggccaaccagaacaagtgcagataaagagttacagccctctgcgagaatggaagtccagttagaacctttgaacagatga

SEQ ID NO: 44619 - DNA, 201 bp, Glycine max
  Peptide Sequence Number=SeqID_161397
atggagaagagcaaagagaaagccagagaagctcgcgcaagagagagtgatcaggactcaggagcatgtgatggtaagaatttagagccaggaaaagaacatgcgagggaaaactactctacatggaaactagaaagcaacataagtcaaaaaaagagatcgataagtgcctcccctttcacctccaacaacacctcataa

SEQ ID NO: 44620 - DNA, 306 bp, Glycine max
  Peptide Sequence Number=SeqID_161398
atgttcttttgcctagaagtcattgaagaaatccagaagagaggtaccagagaggcaccgggagatctcttagatgataaatttgttcaaaatgacaacttgcactcttctcttaatccagctgccccaaattctaaccttttaccttccaggagtgctgtgcttcaagcttgcataataacttctggtctcatagctgctttgggaatagtgattcggcaggtgtctcatgttgtgtcagtggaaggatttccagtcttggactgctcttcagaagtatcatgtattacactcatatttacttag

SEQ ID NO: 44621 - DNA, 297 bp, Glycine max
  Peptide Sequence Number=SeqID_161399
atgtggaaagaactagtttcttacatgccacaacacgacgaactacaaataccgtccaaattaccgttcaaatggaaccagagcctgaaaggaggagtaggaaatggagatggaagagacattgatactcatgatttcttagctataactctaatagtaaaccatgatttcacgttgtttatgaggaccttcgagtcgctgctgtcaggagatgcacatcaacctccatcatcttctgcattcacatcaagtgcacacatgaaacaacaccacaatatcataagttactataactag

SEQ ID NO: 44622 - DNA, 456 bp, Glycine max
  Peptide Sequence Number=SeqID_161400
atggggtatcctgtttcctggagggatattggcagccagccagcaaatgctttcctaaggcctccaaaaccagccaatggggagcaggcatcctccaagagggttatttgggagtgttttcacacaattgttggtagatgtgccattgttgttggcattgctgcactttttactgggatgaagcatctaggagacagatacgatgtggaaaatgtccatggactcagatgggctatggcaatttggtttttaattggtgcattgattgttatttatttggaataccatgaaaggcagcgaatagggcggcagatatctggaagaggcaattgggtgcttggtaatcttgaggaagatgattcagttgatctcttgaggtcaaccagaacaactgcagataaagagttgcaacactctgcgagaatggaagtccaattagaacctttgaacagataa

SEQ ID NO: 44623 - DNA, 408 bp, Glycine max
  Peptide Sequence Number=SeqID_161401
atggcaagaggaattgtggtgcaacaaaagtcagaagctgcaatcccagtgacaacattgtcaccacctgaaggcaacactacattcattgatggcacaacttggtgtgtggctcttgctggtgtttcccaagctgacttgcagaatgctcttgattgggcttgtggacttggaatggcagattgcacagccatccaacatggtggaccatgttttgaaccagacacactagtttctcatgcatcctttgctttcaacagctactatcaaataaatggcaattctgatattgcatgcaattttggaggaactgctgccttgacaaagcataaccccagtgagttaaatattaatgtcacccaaattctgtcccagttaggacaaacttttcgaaaaacacttaaatag

SEQ ID NO: 44624 - DNA, 375 bp, Glycine max
  Peptide Sequence Number=SeqID_161402
gtccaaaatcagccggagaagaagaaccccttcgtcacttctacggcactcgcttctccaaatccctccgccccactgaaacgtcgtcctctcgaacgccatcatcttcggcgccgtttggcggaggggaggggcgggtttgcaaaacggcgccgtttgaccgtgagtcgcagcggcggatggcggaggcgaaagcttcctagtctcatcggcgacgactcatctgataattggtttgggtttggaggtccaaaatcagatctgagtttcaatttttgtatcccttggttgatgctctcctcgccgattttgacggcgacgtggtggaggagcgttgtgtttagccgtagaggtggtggcagatccagacgctga

SEQ ID NO: 44625 - DNA, 279 bp, Glycine max
  Peptide Sequence Number=SeqID_161403
atgggggatgtttctgaccggataggacgtcccacagataatggccagattggcattattgatcctgattgtaggttgattggactccacttgtatgatggtttgtttaaagttattcccttcgacaataaaggacagctcaaggaagcatttaatataagtgctagtaactatgagcctatgaccttgattaaggattaccagttaccaaagccctggttgtgtaagaatgaactgcgaacctatgtcaagttggatgttgttggtgtctttacataa

SEQ ID NO: 44626 - DNA, 285 bp, Glycine max
  Peptide Sequence Number=SeqID_161404
atggattctcttctatccgggaattctggtttggcattagggtcagtaccagaggacgagccgagaagagagagagtctacgggcgggcagtgggagatgatgcagacgagtttacgagtgtaacagaccgcctgggggcggagttccgtgttcaagaaagagcgctcttagttagtgcggatcgggagcagaagatccaatctaaaccagaatgggctttagctctgaatctcaatcttctggccgggacgatcgacctcaacccgattactctaccctcttaa

SEQ ID NO: 44627 - DNA, 171 bp, Glycine max
  Peptide Sequence Number=SeqID_161405
atgtctacaactgttggaggagaggttgcatttgtcccataccagctaatttatctgagcagactgagccttctgctatttctactgaagaactgggttgaaagagcatttcttgaagcaaagtgtggatttctgataactacaagtgcaaagggcatctttttgtgctag

SEQ ID NO: 44628 - DNA, 432 bp, Glycine max
  Peptide Sequence Number=SeqID_161406
atggaatctgattcatcctcagaactaagctggttagtttttttagcaatgcaaacctcctctctcagaccctccaccaaattagtgtctatgctttttttgtatacacccttactcctatccaatagccctttcttcagcaggcttgtgaattcctctccaatttgtacagctggtaatcatatgtggaaggatcctatcactagtgagcataagcaatttgcacagcataacctggagttccaactgattttgctgaaggatgttcatttcctcgtgatggagctccaaggcttctggagccaaactgaaacacagaacaggagagcctccactatcaagaaaagaggactcaataaatatattgggatatcttctgataaaggtggagagtttgaggtcactcggaagacaaagtgtccacagtggtga

SEQ ID NO: 44629 - DNA, 256 bp, Glycine max
  Peptide Sequence Number=SeqID_161407
atggcttcctatggtgaagcaaaggactccattgatgaagaagatccaaggcctacaagctccaatggagcttacatcaacaaggactaccaccatagagatcgacataaggatcatggtgagagaagggaaaggacaaagaatagagattacgatgattatcacaaatgtcgtgactttgacagcaaaaggactagtggttttgatatggctccccttatgtctgttatgttggtcgatgcttctactattatag

SEQ ID NO: 44630 - DNA, 1803 bp, Glycine max
  Peptide Sequence Number=SeqID_161408
atggaaacggaagaaggtgggagcaggggtgcaaagagaaggggatgcacgtttcagaaaaacgatttcttcccggaggaatcgtttaagagttggggtaactacggaaaagcgctgagggagacaccgtggaggtttaaggatcgggttatgacccgatccaaggacgagacggaggtggtggagatgaaggggaggagcggcaacgagatgaagaagacgctcaactcgtgggatctcatatggttcggcatcggcgccgtcatcggctccggcatatttgttattaccggcctcgaggctcgtgaggttgccggtccagctgtcgtcttgtcctacgttgcttccggcatctccgccttgctctccgtcttctgctacaccgaattcgccgtcgaaattcccgtcgcaggtgggtcatttgcatacttaagagtggaactgggagacttcgtggccttcatggccgccggaaacatcctcctggagtacgtaataggcggcgccaccatatcgcggtcatggacctcctacttcgccaccctatgcaaccaccacccagacgagttccgcataatagtccccaacatgaaccccgactacggccacctggaccccatagccgtggtggccctcatcgccatagccaccctcgcaatgtgcagcaccaaagcctcctccctcttcaacaacatcgccacgatactccactgcctcgtcatcgtcttcgtcatcgtcgccggattaatcaacgccaacccacaaaacctgactcccttcgcacccttcggcgcccgcggcgtcttcaaggcctcggcggttctcttcttcgcctacctcggcttcgacgcggtggcgacaatggcagaggaaaccaagaaccctgctagagacattcccattggacttgtcgggtccatgacgataacaacgttggtgtattgcttattgtctttaacactatgtcttgtgcagtcatacaaggaaattgacgtggatgcaccgttttctgttgcttttaacgctgttgggtgggattgggctaagtacatcgttgcattgggagcgttgaagggaatgaccactgttttgctagtgactatagttggtgagtctcgttacttgacacacatttcacgtactcacatgatgccaccttggtttggccacgtggatgacaagacggggacgccggtgaatgctacaatagcaatgctcacagcaacgtcagtggttgctttcttcacaaactttcgtgttctctctaacctcttgtcgatttccactctccttattttcatgctagtggccgtggcgcttctagttaggcgatattactcgagtggggtaacaacaaaggagaatcaagtgaagtttgttgtgtgccttgtgctaatatttggggcttcgtgtggcgtttcggcttattgggcaaacagtgatgggattattgggtacgtgatttgtgtgcctttatgggttttagggaccggagggctttggcttggtgttccaatggccaagaaacccaaagtttggggggtgcctttggttccgtggctacttgctttgtctatttttatcaacattttccttcttggctctatcgacctcgactcctatattaggtttggggtgtggacgctgttgctcttgctttactatgctcttgttggcttgcatgcttcttatgacacggcaaaggactttgagagtctaagtaatattactactaatcaggttcatgaccaagacttaaaccatgtggaacagggactgcaaacccaaaagactactacatag

SEQ ID NO: 44631 - DNA, 273 bp, Glycine max
  Peptide Sequence Number=SeqID_161409
atgactggtaatgttccagcattggttgtcccattgggtctatggacagggattggaagccttccattgttcgtctacaagacaggaaagaggagcaaaagcaaggaaacgtatatcataacctttacagatgcatctaatgttaaaggacatcctagctccaatcttttaggctggatcccaatctctgatagccagcacgagattactcaagtgatcatgcttgtaaagaataaacaggacacagatgatacaaagcccagcaacggatag

SEQ ID NO: 44632 - DNA, 867 bp, Glycine max
  Peptide Sequence Number=SeqID_161410
atggattcttctgatcactcttacccatcaaataaccagcagcaagcaaggttattggaactagaagaaacatctgtgaagacttactaccagatttcagattcagaatgttctctaatagaagtagaatcccttccaacacaagttgatcatccttctacctttgagccagaaatcacacatgaagcatctgaaaagactggagattctgttgatgtagctgaaatggagcaagaggaacctttggctgagtctacttcaaagccaaagtcttcggagtgccctcctgagcagaaacctttggctgtgtttggacatccattctcacttttcagcctcaaccgaactgaaatggacaaggaaggtgatgacgttaattctgttggacaaagctcatcattggacacagttgaagttgaaggatatcaagtaaggccagaattggagtccatagtaagaaaatttctcgttaagcatggagacatttttcagaattgtatggtatcgacaatgatattccattcaatgttattggagatgatatgtgacatcatctcagacttgcaagacaataatctctatgaaatcacagaagataagctacatagcatgattactgttgcaaatgatatgaaagtgaacattgagtgtctacacttgaaattgaaagagattcttgaggcaaagcagactcttgatcaatatgccaagctagaagagaaaaaacatatcagcaaaaagatcgttgaaactgtcaagagactgcttgacaaggatgattattccaagatatctcaaactttcacagatgctagatctaaagtgagacaattcgctaattgctctctggccgatggtttgctttag

SEQ ID NO: 44633 - DNA, 537 bp, Glycine max
  Peptide Sequence Number=SeqID_161411
atggcctcagaaaatggagacaaactagagcttgctttcagtgctgttcctgatcccaagcccaagaaggattgggtcattttgtcccttagggtggtcgcattttttgccacagcatctgctacacttgttatggcattcaacaaacaaaccaaaggcatggtagttgctaccattggcaccaacccagtaacaattactcttactgcaatgtttcagcacactccagcttttatattcttcgtgatagtcaatgcaattgccagtttctataacttgctggtgataggagtggagatattaggaccccaatatgattacaaaggacttcgccttggactgattgcaatattagacgtgatgacgatggctctagcagcaactggagatggtgcagcaacattcatggcagaattaggaaggaatggtaattcacatgcaaggtgggataagatatgtgacaaattcgaagcatactgcaacagaggtggtgttgccctcgttgcctctttcgttggcctcattctccttctcgtt

SEQ ID NO: 44634 - DNA, 300 bp, Glycine max
  Peptide Sequence Number=SeqID_161412
atgtttcttaggtttctatgtgggtctcataatcataatgttgctcggacattggttagccacccatatattggtcgactaactcgtgatgagaagacaatgcttactgatatgataaagagtatgctccatatggagcctataggccttggatcttcttcatcaatggagtcctttgcttcttcaatatcaatggctgcggaatggagaaggaagaaaaatgattggagatgccacttcaacgagaagatgagtcaagaagaagctcactaccataggaagccatggataagagcttga

SEQ ID NO: 44635 - DNA, 99 bp, Glycine max
  Peptide Sequence Number=SeqID_161413
atggttttatctgccgaagcaaaagacaaatgttgcaaacgccagtttgttgcggaatgtggaggagtaggaaagccaacgaatgatatgctgagttaa

SEQ ID NO: 44636 - DNA, 771 bp, Glycine max
  Peptide Sequence Number=SeqID_161414
atgtacaaagataagtgggctcatactgagtccatgggcccaaaatctatcctaaggaccatgaaaatcctagggccttctcctgcatctctagcccaattttcttggagtcttctatccaatgtccttgggggtaggattgcatcatgtatactgccagaaccacatatggaagatctctcaggcctcagaatagaaatgcaacatttaatgtatttgttagagcgtgatatgtatattcattggcatgtagcgaatgatgaagaagttgcacgtgacatattttgggcacatcttgatgtggtaaagttgttgaatgcatttaacatactgttcttcatggatagtacatacaaaaccaacatatacaggctgcctttgcttgagattgttggtgttacttgtactgcgctgacattttctgttgtttttgcttatatggaagttgaacgtgaaaaaactttgtgtgggcacttgaaagtaaaaattgtgtttcttgattcacataatttgttgtgccaatttcatattgataagaatgtcaaagcaaagtgcaaacaacatgtaactcccaaaaaggcttgggatcaagcaatagaggtatggatttttgttatggattatcctatagagtgtgcctatgaagatcatctgataagggttgagtctgtccattgggcgttgaagcggttgcaacataatgaaattaaagcctcatttgaacatagcattcatgtcggtcatatttttagtgcacaattttataagtga

SEQ ID NO: 44637 - DNA, 3545 bp, Glycine max
  Peptide Sequence Number=SeqID_161415
tttttaagatagataagggagaaactgttttgtggaatgtctctttggctaattgggactctgataagttgaaattggctgcagaatctcacgccaaagaggctgttctttacatgttatgtgacttttcgttttttggggtttggaaagattggaaatttctcaccctggtggtggtggctgattgtatcctgttgtctttgaattctgagagctatctccaaccttgcatcaatgatgagtcaatactgctagttgaggcttcaatcaaacttaaatctttctcatggcatacactgcttataccttaccagcataagcaaatgaagggcatcaatgttgataatccttgtaggcataaaccagaaatggaaaacacacttgagtcttctggcagtccacggcatagaaagatatcagccagatgggatccggatgaagcatgccagcctatagttgatgaagcacctgtgttttatccaactattgaggagtttgaagacacacttggttacatagctaagattcgcccccaagctgaaccttatggcatatgtaggattgtccctccagcttgctgggtaccaccttgccctcttcaggagaaagatttatgggaaaatgcaaaatttcccactcgtattcagcaaattgacttgcttcagaacagggaacccatgagaaagaaaattaggggaaggaaacgaaaacgtagaaagcagtcaaagatgggcatgggtatgagaactgccaaatcaggttctgaagctaatgttgcttctgagcctgaggagaagtttggattccaatcagggtcagacttcacacttaaagactttcagcaatatgctaatgtttttaaagattgctactttggattgaatgatgccaatgaatatgaaaaagttagtgatagtagtcaccagcagagatggaaaccctctgtggaggaaattgaaggtgaatactggcgaataatagagcaaccaactgatgaggttgaggtgtattatggagctgacttggaaactggatcacttggaagtggttttcctaagacatcttccttaactaagaatgagtcagatagatatgccctgtctggttggaatctgaataacttcccacgactgccaggttctgccttatgttttgaaggaagtgatatctcaggagttgtagttccatggctgtatgttggaatgtgcttttcctcattttgctggcatgttgaggaccatcacctctattcacttaattatctgcactggggtgacccaaaagtatggtatggagtagctggaagccatgctccaggtctggaagatgcaatgagaaagcacttgcctgatttatttgaagaacaaccaaatctactcaatgaattgcttctagaagagttaatccttggccttcccaagaatcaaagttcactagttcagtatagaatctacctggtgactcagttatctccttcaattcttaaatctgagggggtgcctgtacatcgcactattcagcattcaggagaatttgttgttacctttccaagggcataccactgtggcttcaattgtggcttcaactgtgcagaggctgtgaatgtggctcctgttgattggcttgtgcatggccagaatgctgccgagctttacagtttgcagtgccgtaagacttcattgtctcatgacaagttattatttggatgtgctcaggaagccatgcatgcccttgcagagctaactcttcatggaaaagaaaatctaaaatatataaaatggagaagtgcttgtgggaaagatggagttcttaccaaggcagttaagacaaggataactatggaaaaggaaaggcttgactgtcttccaactcatttaaagatgctgaggatggacagtaaatttgatttgtttgaggaaagagaatgcttctcttgcttctatgatttgcacctatctgccataggttgcaagtgctctcctgactgttattcttgtctcaaacactcaaatttgttttgctcatgtgaaatggacaacaggtttattctgtttcgttatactatgaatgaactaagtacattggttgaagcattagaaggagaatcacatgccattgaagtgtgggcaaatagaaactctggaatggtttctgctaatgctgaggatgcttgcatttataaacaagatgtggagagtgccatttgtcaaacccagagttacaaagaagggaaaaactcaacttgtgcaggaactaatgataagtcaaattcaactatacttagtagttcttacagccacatttcagcagaattagtccactcagagtttcaccatgaaacttttagtgcaccatatggcactaaagactgtcataaagacaatttgaatgaaaaagatttggtaatggacaataaagttatggtggagaaaggaggttctgtggatttgaatattgatgttatgtctggtgaacctgaaaattattttctgcatgctgctgattaccatcataataagggtgttccatatgtggaaaaagtcagctttgcagaggccagaaaagaacaagacaacatggaacctggggctgattgtattgctgccaaagaattttcatcttgttcaagggatgttcaaaattcttgtacacttgatggttataaattgtttggagtggatctgcagatgcattctgattcaggagagcaactcaacagtgtatctaaaataggtgacgccgaaacctccaatacaagtatatcgttgacaaaccaaagcttcttaatgcagaagtttggtatttctgttgagcctgtaaatttgggctctgttatttgtggaaagctgtggtgcagtaagcatgcaatatatccaaaaggattcaagagtcgtgttaagttctttagcattcttgatccaccaagaatttgtaactatctttctgaagtctatgatgctggatttcttgggcctattttcaaggttaccatggaagaacttccaaatgaggctttcacaaacacctcagcagataagtgctgggaatcagttcttgacagactaaatcatgaaatcaaaaggcaaaggagtcaaggtgaaatagaacttccttccttggaacttctgcaaagcattaacggtcacaaaatgtttggattcctttcaccatccattattcaggccattgaagctgaggatcccaatcatcaatgcgtcgagtactggaatcacaaagaagttgtctctgaatcttcaggcagtgccattgatgactgtaagttcagtcatggttcaagcaactccctaggtgatgccaagaccaagctttttgatgctggtttgataaggcaggagcaagatagcatcataggaagttatgattcttttgaagagatgaaattggtgctacaaggattcttgaaaaaagcaagttctgatgaattaagtgccatgcataagttattcagctctgatgcacagttcactaagtgcagagcggaatttgtgtcgctgatagaagaaatccagaaagcttgtgcataa

SEQ ID NO: 44638 - DNA, 258 bp, Glycine max
  Peptide Sequence Number=SeqID_161416
atgttcttccgacttaatgaggatatagtcgagcagatttactcaagtataattttttctaacacgttgaagtcaaggactcaaggtgatagtgatagtgctacgaaagaatttggattctctgccgagctagccatttctctctctctatgttgggaattgcttgtgacggtttggaagtgtatttggggtggtatgggtcatactaatagggatgaaacttgtcttaaagacattattaaaagaatattcaaataa

SEQ ID NO: 44639 - DNA, 378 bp, Glycine max
  Peptide Sequence Number=SeqID_161417
atggttgtggtggtattagtaagtgctcatatgtgggtaggtttatatgtgaatcattacggactgtggggtgctcttgatgatgaaatgaattcggtagtggattttgggggtgctttgaatgaagacatgaattcagtggttgattttgggggtactttggatgatggcatgaattcagtggtggattttgggggtgctctggatgaaggcatgaattcagtggtgatttttgggggttctcttgatgaaggcatgaattcagtggtggattttgggggtgctcttgatgatgacatgaattcagtggtgactttggggggtgctttggatgaaggcatgaatttagtggtggtgagtggtttctcaagatcatga

SEQ ID NO: 44640 - DNA, 210 bp, Glycine max
  Peptide Sequence Number=SeqID_161418
atggtggatagcggccataaggtggtggattgtagaccggtggcttctccaatggtggtggctcataaattggaggtttgtaaatgggtggcttctcatgaggagattggtaaagtggtggtggtggtggagcgatgtgagccgccgatatggcggagagaactaagacgggctataggctctgataccatgttagatttcatcttataa

SEQ ID NO: 44641 - DNA, 243 bp, Glycine max
  Peptide Sequence Number=SeqID_161419
atgtcatcgcacgctcagcgcatcattagcttgttcagcgagaagattgtctcttctgggcttagcgcgagaatggcgctaagccaaatttcacttacttgcactaagcgcaaaaatagcgctaagcgtcccttcgtgaacaaaaagccctttttaagcctgaattttcaattgggtgctcaagaaacctctagttttggcacttgttttcacactaattttcaattgaaatttcaaaactaa

SEQ ID NO: 44642 - DNA, 237 bp, Glycine max
  Peptide Sequence Number=SeqID_161420
atgaccaaacacaagttgcatgccaccaagcacaggtccccggacgaaattagggtaaagcaacaaaatgtccaagaggtggaaaaccttcgaaaggagaacattgtccttagggaaaaataccaaaagcttcgggaagacaacaacatgcatttgatcttggtagctgatactctgcggaccaatctacccagaactaacatgacatggaaggaaggaactccatcagtcacttag

SEQ ID NO: 44643 - DNA, 399 bp, Glycine max
  Peptide Sequence Number=SeqID_161421
atggcatctaagaaaaggaaggctccttctacaccttcccaggccatatatgacagatccaagttcacctctcaagaagcttgggagagatatactaatataactgtgccgaggaaatttcttctagagaggaatgtggtagtttattacactgagtttgatgagttcaaggaggaacccgagagaagacactgggataaggaattgactgattttgctaacaacaacatcaacgttgccattgtgaaggagttttatacgaacctctatgacaccgaggataaatcacctaagcaggtgttggttgctaagctttgtatcccagggaggggattcaagctaaatgctaatgggcagccattgaagatattgaggaagaacatgaccactttagcttag

SEQ ID NO: 44644 - DNA, 372 bp, Glycine max
  Peptide Sequence Number=SeqID_161422
atgaaggccgacatgaaggcattgaaagagcaaatgaccataatgatggaggccatgatgagcatgaaaaggataatggaagccaatgcggttgcagttgccgctaccagcgctgttgctaaggtgaacccgacgcccccatctggcctcaaccaaatgaatcatccaacctcagatatggtaggcaaatatttgggaagtacgggcagtccccatgatgtgcaaattcaaaacaagtacgccttctcgccatatggcttgcctcccaactatacaccaccaaatgtagcatacactcccaatgaggatgtcaataactccactcccatactcattgagagccgacgacctcatcatgcacatgtctcttaa

SEQ ID NO: 44645 - DNA, 321 bp, Glycine max
  Peptide Sequence Number=SeqID_161423
atggtcacatggttcatggagctatctgagtttggattgaaattccggtcacaagaacctattaaagctcaatgcttgcttgacttaatgtcaaagcttcctcctaaatcgagcaatagagcttgtaaccccaagagtaacagagcaggaatgacccttgaaggacttggagatatctcactcgaacaatcatcaaggtttgatttcaaaacttataacaatcaagttgagtataaggctttgattgtagggttaaaattaggaaaagaagtcaggtgtgttggatcgagtggcctcagaataattaagaaggggggttga

SEQ ID NO: 44646 - DNA, 534 bp, Glycine max
  Peptide Sequence Number=SeqID_161424
ttgcataaatcggctaaaccatttcgattcaaagtgcttcaaaactgggatgatatagtggatttgtgtgttaaagatagagccattggacatggagctgaaactgctatggatgctgatgaagtgatgagtagagaaacaaatgaagtggaattcataggtttaggtgctgctgctattatagacttagaagaaccaagctctattacaaaaggaaaaagacaaggttcaacttcttttggcatacattctcacaagagaaagattggagaaaaagaaggaataacagcttctgcttctttggataaaatggccaactcttttgaccgaatggtagaaaaaatggatggtaaaatcgatgatgaagatattcaagaagtgttacgtgaggcagctttgataccagatcttaatagacaacagtgggctaaagctattaaatggttagttgatgatccaaagcagttagctattgtgaaagtccttccaattcacgaaaagacaaattatgttttaacacatcttgcaaaatga

SEQ ID NO: 44647 - DNA, 561 bp, Glycine max
  Peptide Sequence Number=SeqID_161425
atggccggtgcacactcccacagacaatcacagctgcaccaccaacaaccctcctcacgtctcctcttactcctcaccgtcctccccttgactctcgcaaccctcgccttcgtcctccaatggcgcggcggggtcaccgaccccgtcacccgctggtcacccgatcacgatcagttccccggcatggccaccaccaccaccaccactccctcccgccactcctccgattgcggcaagaaccctctctaccaatcacacaacccttccttcccttacttccgcgactggaccttagatttctcctctaacctctcccccaagatatgtattacgacgagtacttccgcggggttggagcagacgctgccgtggatcttctaccacaaggtcatcggagtctcaagttttatccttttcgtcgaagggaaggctgcctcgcctaatgtcactagggttttagacaccattcccggggtgaagattgtatatagaacaagggagttagaggagcagcaagctaaaagatctttggtggaggtttgtgtttcggttatccaataa

SEQ ID NO: 44648 - DNA, 240 bp, Glycine max
  Peptide Sequence Number=SeqID_161426
atgactatgtctgtgatgccgcgacaaagtcccacatggccggtcctaattcctagctgccctatcaggatttcttcttctacgattccccctttcatccacttcaccagcctcggtacattccacggaccactaagtggggcatttggggttgatagttcattattttgggtgaatgaaggagttccccctgaaggaggagaggatccaaatatgcctgtcatattgtaccctggttga

SEQ ID NO: 44649 - DNA, 390 bp, Glycine max
  Peptide Sequence Number=SeqID_161427
atgggctcagaaatctaccctgaggttcatgagaaccctagggccttcttcagcagctctagcccaatcttcttagagcctcttgctcatggctctattgactggtcccttcctagggaggattgcatcactcttgctcatggatctagtgacggctcctttcctagggaggattgcatcagggtaagtgaaagaattttaaataggggaggggtgaagccatttcttcaccccaatttcttccccaaagcatccgagaatgtaagtgctcacggactcacgaacccaacagccctaagtcaccattttcatgttcttgctttcattttttgcactcttgtttgccttctacaagggatggctataggcctatcttggcttctggtatga

SEQ ID NO: 44650 - DNA, 363 bp, Glycine max
  Peptide Sequence Number=SeqID_161428
atggcggggagatgggtccggatcatgcgcactagcatgaccaccctcacgcagatttggatgacgttgctactcagcaacattctccccagcgaccataattcagacctcccattgccgaagtgtcagctggactacgccatcttgactcagcaaccagagaaggaccaacagcagctagccacaggcgtgctgccgccgcctctacaggagacacaatccctggggttcatccctgatcacctgcgaaggttagagctccagatgcacaggggccaggtgcagctaaatgagaccttctaccggtacactatgcaccagcagagccaggacaccagtcctttctcgtggcctactccctag

SEQ ID NO: 44651 - DNA, 340 bp, Glycine max
  Peptide Sequence Number=SeqID_161429
atggccgtaatgatggaggccatgatgagagtgaagaagataatggaagccaatgcggttgcaattgccgctaccagcgttgttgctaaggtgaacccgacatccccatctggcatcaaccaaatgaatcatccaacctcagatatgggccctcagtatcacccacaaccacacccctcacattccacagcgattaaaaaccctcatgctatggcggaaatgggaaagttggatcatctaaaggaaaggctcaaggacattgaaggaggcgaagattgtgcctttgctaacctagaagagttgttcctagtacccgaacatggtcattcccaagttcaag

SEQ ID NO: 44652 - DNA, 252 bp, Glycine max
  Peptide Sequence Number=SeqID_161430
atggattctgctcttgaagatgaaaccaaaattgaaaagcttgaacaaagaaataaaatcactgccacacctcctaaagacctccctagagaatggagaactcaaaaagacctttccttggataactgtcggaacatgcccttttgcgggcgagcgaggcgaggctcacgggtcgacaaaagcgaggctcttgctcctacgtaccctccatcgaagaggaaatcagacctacgtagttcttttaaaagttaa

SEQ ID NO: 44653 - DNA, 208 bp, Glycine max
  Peptide Sequence Number=SeqID_161431
atggccttcggggggtacttggcacccattgctgcacaatacgtgaagttccgtaacatgccggaaaacaaaggaagcattgttacgcaatccgtaaggttccgtaacatgccgaaaatcaaaaggaagcattgttacacaatctgtgagggggtgcaaatagaaaccaggctcacttgggccttccaggatgttcctccagaaggcg

SEQ ID NO: 44654 - DNA, 159 bp, Glycine max
  Peptide Sequence Number=SeqID_161432
atggcttgcacccacattccgtataaacttgaaaatcctgacgagtcattagagacatctaacaacagctttcaaaattgccccatgtgtggcatctcttgtcaatgtcaagatttacacgcgattctcctcaaatttcagccagcccgcatcaattag

SEQ ID NO: 44655 - DNA, 435 bp, Glycine max
  Peptide Sequence Number=SeqID_161433
atgccaaccactccgttcccattccccttgaaggccaaaaaccctagttggggcatgcaccctttgctcagcctgcaggggaagtgtgtgaagagccccgagatcatgctctgggtgatttcgaaccataccctacatatgccactgagggaccagcgtttagtgctatgcttagtgcccgacgttgtcatcccactcaaattcaaagtgccggacttcgacaagtacaaggggaccacctgcctgaagaaccacttaatgatgtattgtcgaaagatgggggcatactcaagagatgagaaactcttgatgcacttcttccaagagagcttggccggggcggcgatcacctggtatactaacttggaagcttcccggatccgttcttggacggacttgatggctgctttccttaagcagtatcaatacaactga

SEQ ID NO: 44656 - DNA, 249 bp, Glycine max
  Peptide Sequence Number=SeqID_161434
atggagttgccaaatgtcgcaagctacccttcggcgggaaggcaaggcgagactcgagggtgcgtcttcccaaaaaagaaaacgcacggagtcaccaccaacgtttattcaaggaaaacgttagaaaaaccaaaaagaggtctgcaaattttcagaataagggttcgggagttgtttacgtgcaggaaaggtattagcaccccacacgtctgtcacaagggatggcagcctttaatcgaattcaactag

SEQ ID NO: 44657 - DNA, 705 bp, Glycine max
  Peptide Sequence Number=SeqID_161435
atgactgcgttggctgtttcagtgtgttctgggttaggtgcacatgctgttatatggggcaagatacctggttggacaactcgagattataaatgtcatttcacatgcctaccgcgacctccctgtgccctcattgacgcctaccacgacaacctttccctgattccctcacctctccacaaactcttccgacaaccactcttcattgaacttcaagtttatgtcaaacccgatcgacaacctcaaaaccttaacaaaactctttccacaaccctccaattacatcatctgcaaagtaaagattatgttcatcaatctaaagcacacgagcaacaacgatttgagggtttcgtgttgagctattttgtacaaagcctcaggttgatctcattgccattttcgtctccccatcgcaagcgctaccacactcagatccaatgcgctcgctccctccccattttgggattcaactcctcgtgggttcatttctacaagatcgcacctatgctagagaaggggcttgcaaaaagaagggggagaaggaaagaaggagtgggtggtgattcgaggggaacgacaatggtgggttgtgactggctatcgataaaaatagaggagccaacagaaatcaccccggacagtgatgtgcaagatagcgtcgaggttcacaaggaagagaattggatgaggaatgatagggtgtga

SEQ ID NO: 44658 - DNA, 3220 bp, Glycine max
  Peptide Sequence Number=SeqID_161436
atgtctagcaatgcattaactctttttatcttgtttctcaacatctccttgttcccagcagccacctcttctctgaaccaggaaggtctctctctactttcatggctctcaacattcaattcatctgattctgctactgctttttcatcatgggatccaacccaccacagtccatgcagatgggactacataaggtgttccaaagaagggtttgtcttagagatcataatagaatccattgatcttcacaccaccttccctacacagcttctttcttttggcaaccttacaactctagtcatctcaaatgcaaacctcaccggcaagattcccggttcggtgggaaacttgtcatcgtcactggttacattggacctcagcttcaatgctttatcaggaaccattccatctgagatagggaacttgtataaacttcagtggctgtatttgaattcaaattccttgcaaggcggaattccatcacaaattggaaactgttcaaggctgaggcagctggaactgtttgataaccagatctctggcttgattcctggggaaataggccagttgagggatcttgaaatacttcgagccggagggaacccggcgattcatggagaaattccaatgcagatatcaaactgcaaggctctagtttatctaggccttgcagatactgggatatcaggggagattccaccaactataggagaacttaaaagtctcaagacacttcaaatctacactgcacacctcacaggtaacattccaccagagattcagaactgttcagccttggaggagttgtttctctatgaaaaccagctttctggaaacattccttctgaattgggttccatgacaagcctcagaaaggtacttctgtggcagaataatttcactggagccattccagaaagtatgggaaactgtacaggccttagagtcatagatttttctatgaattctttggtaggtgaacttcctgtgactctcagtagccttatcttattggaggagcttcttttgtctaataacaacttttctggagagataccttcttatattggcaacttcaccagcttgaagcaattggaattggataataacagattctctggggagattccacctttcttggggcatctgaaggaactaactttgttctatgcctggcagaatcagctccatggaagcataccaacagaactctcccactgtgagaaacttcaagcacttgatctttcacataatttcctcactgggtccattccaagttcactatttcatctagagaatttaactcagttgttgttgttatcaaatagactttcaggtccaattcctccagatattggcagttgcaccagcttggtcaggctaaggttgggatcaaacaacttcactggccaaattccaccagaaataggctttttaagaagtttgagctttcttgaattgtcagataattcactcactggagatataccctttgagataggtaactgtgctaagctagagatgcttgacttgcacagcaataagttgcaaggagcaattccttcctcattagaattcttagttagtcttaatgtcttggatctttctttaaacagaataactggcagcattcctgaaaatttaggcaagctagcatctctaaataagttgatactcagtggaaaccaaatctctggtttgatccctaggtcacttggcttctgtaaggctttgcagttgctggacataagcaacaataggatcagtggttccattcctgatgagattggtcacttgcaagaactagatatcctgttgaacttgagttggaattatttgacaggccccatcccagagaccttctcgaatctctcaaaactttccaacttggacctctctcacaacaagctctcagggagtctcaaaatactggctagtcttgacaatttagtttctcttaatgtctcctacaacagtttttctggttctcttcctgatacaaaattcttcagggatcttcctcctgctgcatttgctggcaaccctgacctgtgtattaccaagtgtccagtaagtggacatcaccatggcatcgagtcaataagaaacattatcatatacactttccttggtgttattttcacttcagggtttgttacttttggggtaatcttagctctcaaaatccaaggggggactagttttgacagtgaaatgcaatgggctttcactccatttcaaaaactcaacttctccattaatgacatcatcccaaagttgtcagattcaaacattgtgggaaagggttgctcgggggtcgtgtaccgtgtggagactccaatgaaccaggttgttgcagtgaagaagctgtggccaccaaagcatgatgagacaccagagagagacctttttgctgcagaagttcacacccttggatcaataaggcataaaaacatagtgagacttttagggtgctacaacaatggaagaactagattgctcttgtttgattacatatgcaacgggagtttgtccggattgctccatgaaaatagtgtgttcttggattggaatgcaagatataagatcattctgggagcagctcatggattagaatatcttcatcatgattgtattcctccaatcattcatagagacattaaggctaacaacatcttggtaggtccacaatttgaagcttctcttgcagattttggccttgcaaaacttgttgcttcgtcagattattctggagcttctgcaatagttgcaggttcttatggatacatagctcctgaatatggatacagtttaaggatcacagagaagagtgatgtgtacagctttggtgtggtgctcattgaggtcttaacagggatggagccaattgacaacaggattccagaagggtcccacattgtcccttgggttatcagggaaatcagagagaagaaaacagaatttgcaccaattctggaccagaaactagcactgcaatgtggaacacaaatccctgagatgcttcaagtgctaggggtggctctcctctgtgtgaatcaatccccagaagaaagacctacaatgaaagatgtaacagcaatgctcaaggagatcagacatgaaagtgtggattttgattttgagaagtcagatcttctacacaaaagtgttgtcaccaatccaaaagctgcagttcagtgtccaaacttctccagatctt

SEQ ID NO: 44659 - DNA, 417 bp, Glycine max
  Peptide Sequence Number=SeqID_161437
atgaagcagaattgttgcttgaggttgccacaacatgttgaccctagagaaggggaagtacgctgcacaaatgttgtgcaaggaataaggagaaggaggattggctctggaggaggggtagtagctgcagttctagcaaatgctggatacaaagttctagtcttggagaaaggaagctattctgctaggaacaatgtttcccttcttgaaggacctagcatggatcaaatgtacctctccaatggtttggttgctacaaatgacatgtttgtgcaaatactagcagcctccacagttggtgatgaagggaatagtcaatactgttataagaagagggtgtgtagcaatggggaagcagaatctctttggaattttggagaacaactccaatcaggccatcaattttcaaagttttga

SEQ ID NO: 44660 - DNA, 914 bp, Glycine max
  Peptide Sequence Number=SeqID_161438
gaagatcaccaaaaagacaactccaaggccctcgtcctccacctcttaggataaacaaggactcccacaagatcaagaagaagcccccggtggcgccgccttcatcacaaccgcaaccaccgctgcgccaaccggtgatcatctacaccgtctctccgaaagtaatccacaccacaccaagtgacttcatgagcctcgttcaacgcctcaccagctcttcgtcttcctcttcatcgtcctcttccaataaggtctcaatcgaccctttaaatggcaacaaaggccatggtggtggtagtggcatagtttcgcccgcgggtcgatacgccacaatagagatggctagaacaacaactcaaagcactaaacaacacccaattgagaatagtgatgatgttggaggggtagatttagtaggtcatggggtgttgttgaagagaccaaacatgtttcatgggattttgtccccgggaccatcttcgtctttatctcccattccttcaaatttcttctctccaccgtcgattgatccaaacatgggtagcttttatcatgatttaagccccatccttcgtaataacagaaatttcatggagggtactactactactgctactttcatcatgcctagcccttcaaactttgtttcacctcaaaacggcgcagctaaagcggaaaacaccacggagggtggcacgctgcccgtggcgccactggtgcaaggtccagcggtgcgaggtcgccacgggggtggcagtgtgagggtggcgatggcgcggagggtgaatggtgatggcgatgctcctacactaccatggggccttgccgacggccatggtggagccaccacagaaggtggcgcggtgggttacttgatgatccttctctcttctctgacaaagttcgtcaaatag

SEQ ID NO: 44661 - DNA, 1830 bp, Glycine max
  Peptide Sequence Number=SeqID_161439
atggccaagatgcttggcctcttgttcatgattggagcaatgttttttggtgttgtagctgagccagtggaagataaacaagcattgcttgatttccttcacaacattaaccactctcattatctcaactggaacaagaacacttctgtgtgcaaaagctcttcattgacaagaacaggattgagtggtccaattccttccaacactcttagccgtctctcaaaactcgaaactgtgagtcttgcatcaaatagcatatctggttctttcccttctggcttatcacagctaaagaatttgacatatctctatctccaatccaataatttttctggttcattgccatcagaattttcagtttggaagaatcttaggattgtcaatttgtccaataattctttcaatgggagcataccattttcactttcaaatttgactcatctcacttctttagtcctagccaacaactctctttcaggtgaaattcccgatctttatatcccttccctgcaagatctgaatcttgccaacaataaccttagtggagttgtgcctaaattccttgagagatttccaagtggggcattttctggtaacaatcttgtttcttcacatccatctcttcctccttcttatgctgttcaaaccccaaatcttcatccaacaaggaaaaaatcaaaaggacttagggaacaagccttgttgggaatcatcattggtggttgtgtgctgggaattgcagtgatggcagcttttgtgattgtgtgctgctatgagaaaggtggcgcagatgaacaacaagtgaagtctcagaaaagacaagtatctaggaaaaaagaaggttctgaaagccgagacaagaacaaaattgtattctttgagggttgcaatcttgcatttgacttggaggacttgttgagagcatctgctgaggttcttggaaagggcacgtttgggacagtgtataaggctgctctagaagatgcaacaacggtggtggtgaagaggctgaaggatgtcacggtcggaaaacatgagtttgaacagcagatggagatggtagggtggattaggcacgacaatgtggctgcactaagggcatattactattcaaaggaggagaaacttatggtatatgattactacgaacagggcagtgtctcttcaatgttgcatggcaaaagacggggaggaagaatttcattagactgggacagccgattgaaaatagcaattggtgtagcaagaggcattgctcacatccatactcaacatggtgggaaactagtccatggaaacataaaggcctcaaacatcttcctcaactccaaagggtacggttgtctatccgacatcggtcttgcggcattgatgaatccagcattgagggcaacaggataccgtgcaccggaagcaaccgacactcgaaaagccattccggcgtccgatgtctacagcttcggggtgctgctgctcgagcttctaacagggaggtctcccttacatgccaagggaggagatgaagttgtccacttggttaggtgggtgaattctgtggtcagagaggagtggactgcagaggtgtttgatgtggatttactaaggtatccaaatatagaagaggaaatggttgagatgctacaaattgggatggcatgtgttgtgagagtaccagatcagaggccacaaattggtgaggtggtgagaatggttgaagaaattggtagagtaataaacactgaaaatagatcacccactgagtcgagatcagaaggttccactccaacccctcatgcaattgagacaccttctagctcttttgcacattga

SEQ ID NO: 44662 - DNA, 415 bp, Glycine max
  Peptide Sequence Number=SeqID_161440
acttatcaaggtaatccttatggcgtctatcctgacttatcttccttcaccggaagtggcgtctaccctgacttatcttccttcaccgaaagtggcgtcatccaaatctctgtaacctgtatcaagcgatccgctcctagtcaggccaaaagcccaagtggagaaggacaaagcccccgagtggagaaggatgaaggcacaagtaatccttgtggcgtctaccctgacttatctttcttcaccggaagtggcgtctaccctgacttatcttccttcactagaagtggcgtcatccaaatctccgtagcttgtatcaaacgttccgcccctcctatgtctccaaagtcaccattagcaacagagaatgtgttgatgtcaaaggaaaaggagttgtcactgttagaaactccagcac

SEQ ID NO: 44663 - DNA, 1259 bp, Glycine max
  Peptide Sequence Number=SeqID_161441
gtacaccttctgatggcatatttcatagaagtcatatcttagatgtgctaccaagcaggaaaactaaacagttgacatttcaaactgaagagtctcacggcaaaaatatggctccgtctactctaattggtgcaaaatctgctcctactagtgtgattgatatcattgatagtgatgatgaacctaatattattcagaaccctgtaccagataggcagggtagtgaaagcatttcagtttcagcgtgctttgcagcagatgggaaggagtctaacaacagtagtgcccaaaacaatcaggatagtttggatttggatgaaaatctcttatttgttgcaactcctaagagaaaacgaacttgtaatgttgttacaagcgagtctgaaagtgatgatgataatattctgatttgtaagcttaaaaggaagcatattcaggaaccaagttctgatcaagttagacctgacttgagtagttcacctcctgctaatatttcagaggataacaaggtcacagacagtgtaatgactaggcgccgtctatggcctctgagaaaatgtgcaagaaaaagtcaggatgataaaatatcttcatgtaggcctcgtaaggccaagaatcagcaaagtattccaactaatgacgatgctgatgatgaatcagaagaggatttgtcatacagtgagggagaaaatatgagtgattttattgttgatgattctgatgtatctaattgtgaagacacatctagcacgtcacaggacgtagctaattctgatgtggcggactctgattctgctaactcacaagatgtacaagatagtaacatggaatcatattcacaggatgtatcagatgaagatatggactttggtaatatattatcaaaaattcagaggagcaaaaccaacatgaaatgggaattcgaggctgacatgcttgcagcatttggaaaggatccagaattgtgtatgaaggctgtctgtgctctttatcgacagcaaacttctgaggaacagatgagcaagggagcattgctctccaaccagcgtggattcaataagtttgatgcttacaagggcagtattttggccgagttcctcactgatggagatccttatggtggtttaaagaagtctgtgaaggagttgcaagaaaatgacccagaagcagttgaactgtgcagatcactagcaactcactactctaagcaactatatgagatttacaagaacaaagaggatcctcttttccctggctag

SEQ ID NO: 44664 - DNA, 1131 bp, Glycine max
  Peptide Sequence Number=SeqID_161442
atggcttccgcttcatctcctcctccaccactgtcgtcaccggcagtgatgccttctccagcttcacttttgcagtctatctcaatgaaactcacaaattctaattacattctatggtgtaatcaagttcagccggttatcaaaggtcatggtttatcacattttctggttgctccaatcattctgccgcagtttgacactatcgctgatcacgaagcggggattgtcccaggacatgtggatattattcttgagagacttccaacagagtatgaatctacggtaaccttcatttacaatatgtctaaactgatgcctgttgatgatgttgaatcgctgcttcttgctcatgaatcttgcatagctaagcttaccaagaagtctttgggcttggtgaatctcactgagtgtaaccttaattccaccccgaattcaagtgaatctcagtcgcaggtcactgattcctctaatttcaatccacaagtgcatctcactcaagcatccaacaacacttctaatgacaatggagattacaataacccgtatggtcacaaggcaacctttttccatcattggtatgatgataactatgttcccttgcaacctatggattataccaactcgtcttccactcaaaactctcaatctcagacccaaacacccacccaaccctcacagtggccttctaccactgctcaaacccatcctcaaacttattacaatcactatccttccccttttccctattactcttacccaccccaatacatgacacctcctactattatcccccacctccagttcagccttacccctccacctcctcaagaccagaaccccaagctcaggttgtctctgcaaccagctcaaacttccaaatggtaccccaattctagtgcttctcaccatgtaaccaatgtatctcacaacattcagcaagtcactccttttgagggccctgatcagattactattggcaatggtcaaggcctcaatatatatccttcaagtgtctcttcctttcattctcctttcaactctaaagtacctttaactctcaaaaatctgttatccattccttctatcactaaaaatcttccaagtgttagtcaactctgcaaagataactga

SEQ ID NO: 44665 - DNA, 477 bp, Glycine max
  Peptide Sequence Number=SeqID_161443
atggggccaaaggcaaccaagaggaagatgaaggagaaaagaggtgcaacatcttcatcgattatggactcaacaggcatggaagcaaaaataagggaaaaaaaagaggcagtttcgacgaaggtttcaaatgcagaagccattgttccttcgaattgtagagcttttgtaaaggatgtgaatgagatatttgaggataagtacttgagaagtccaaacaacaacaattgtctgctacaaaatgcaaagacacatgggtttccagacgaacaagatacatacaatggtagtgttgatgttgattatgatcatgtagacgaagaaatttcaaacgttgatgtatctcatggtgcttctcttgactacacatctacaaataagacactatatgcatataagaggagtttatcaacaactttaagcaaacttagggagcatatttgggcatattttagccacaacaatgttggaatttaa

SEQ ID NO: 44666 - DNA, 285 bp, Glycine max
  Peptide Sequence Number=SeqID_161444
atgaagataaaaatgcaatgtcaatgcacacaattgagggcattccctgtaccgcctgtacgctcgtttttttcaaaattggatctccgtgatatagcgtacgagatcatcgttgaggcttgtcggagtttgggatcaaagcaattgacgttcgcagcgagggagattgggagtgtgcgtcagtgtcggcattgtattgtggtagctgacttcgacggcagtgaacaagatgaagacgggggtggaggaattagaagagcaaccagtgtgtatatgtgtcattaa

SEQ ID NO: 44667 - DNA, 204 bp, Glycine max
  Peptide Sequence Number=SeqID_161445
atggtcagtgcattgacgattcctatgtttcatacttcatattgcatggaaatcaccataggggaggggggtgttgcctgtgcacgacaagatgacctcgacacttgctgcctagttttcctaagtgagagtgtcgcatggacatgcttaggctatttcctaaagaatggtatcacattgcatttgagagatgaggtcagatag

SEQ ID NO: 44668 - DNA, 1155 bp, Glycine max
  Peptide Sequence Number=SeqID_161446
atgataaagcaaaagagttccttaccgatgttggtttcattgacaacttcagatattaagcagtcgaattctttatactttaaacatttcaaaccactgtctcattattcttcaatattggacaaaattgagggtctgatatcagctagagattatgatgctgcaatggatctatcccaaaacctcagaagtttggcattgcaagggcttcactattttcagacttacgattggctgatgctcttttctgtaattacccttgggtatgttggctggatgatctatcttgttcttcatgttctgcagtcttatacctcactgccaggaaatgcttttggaatggagcaagcagttcagaaaaataaccgtggaaaaatatatctatatggatctatggtgacgggaatgctttgtttgcttttgttgctggagcagtctcctcctctttaccatgcatacatcataatgacttcatttttatgggttcggataattagtgaataccagtttataaaaacattatggaagcacttatctagaaggcggatgaattatattattaagcttctagcaatcactgctatctcagttttcattcttgagttcctggttaacagcttcactgagaggaagctctatacgtggtgttttttgattgccggggccacagcttcattttatctttttaagtcaattccctggagatctggtataccgatatatgtttgcctagcatgttggtttttgtctcttttcacattgatgccagcagaaattcctgacaataatcaattagtagttagtagtggggttattattatcattataggaatagttgcaagatggctagatttgcatgctggtggaaggaagtattggctaagtatatgcaattgcaagttgaaaagttccaaattttcatctctattttacttacaggctcttttggttgctctatcttcagtgatggtgtatttatcaactgttcacagaactgaaaagcgagagttgcttgcatcgcaccaattgataaattggtctgttgctgcggccatggcggaatggcgtcgtggaattttggaaaaacgccaccaaatagcggtggcgttgcgggttgcttatggcggccgccatagccatggcggaatcgcgtga

SEQ ID NO: 44669 - DNA, 1536 bp, Glycine max
  Peptide Sequence Number=SeqID_161447
atgcacagcgatgggatcttaggaaacagagaaggtagcggaagaaagtggctgaggagaagggagagatggctggtggtgctaggagtcatcctccacgccgtttacatgctcagcattttcgacatctatttcaagactcccattgtccacggcgtcgatcccgtcactcctcgcttcgctgcccctgccaaacgtctcgtcctcctcgttgctgatggcttgcgcgccgacaagttttttgagctggatgcgaaagggaatcagcgagcgccgtttctgaggagcataatcgaaacgcagggtcgttggggggtttctcatgctaggcctcccacagagtccaggcccggccatgttgccattattgctggcttctatgaagatcccagtgcagttacaaaagggtggaaggctaatcctgttgagttcgattccgtgttcaacagaagccggcataccatttcttttggaagtcctgatatagttcccattttctgtggtgccttgcagcataccacttgggatacctatccccatgagtttgaagacttcgcaactgatgcatcattcctcgacatgtggtctctggataaatttcaaagccttcttaataggtccagagaagacccaaaattaaaggagttgctgcagcaggataatcttgttgtattcctgcatctgcttggatgtgactctaatggccatgcacataggcccttttcatccatctatctcaacaatgttaaggttgttgaccatgtagctgaaagtgtttacaatcttgttcaagattatttcaaggataatcggacatcatatatttttacagcagatcatggaatgagtgacaaagcttccacgacaggttgtgccttaaccggcgaagctgcaggttctggttgtgctatgctgaaaccccttgttgcagatcttgcgcatgaaactggcaccgtcgtcacgcggcccaccatggggagggagggagagaaagagagagtaagtgaaagcgatgtgatgctgttcatggaagcaggaagtggaagagaggagatctctgctgtctatgattgctgggagtcgcctcagcgccatggagatgggcacccttcgaacactgatactcctcttgttgcgtggggagctggtgttaagtatccaaggcctatatctagcagcaaccattctgattgtggttttaggtttgttgatgaccatgtgcatgacacaccaactccagttgaatggggcttgaatgagatagaaagggtggatgtcaatcaggctgatattgcaccactcatggtttctacactgctcggtctgccatgtcctgtcaattcagttggaagtttacccctagattacattaacatgaccaaggctgatagaaaccactgtcaatggatgacaaacacaattgagaagaacagtgagttatggaaactaatgtggaaatgcgtattaatcaaggaaaagcaaatacagagggatcagtatccctactgcccagggctaagctcctccagaggctaa

SEQ ID NO: 44670 - DNA, 1995 bp, Glycine max
  Peptide Sequence Number=SeqID_161448
atggtgatgaatgggttgaattacatggtgaggaaaatggggttaccgggcaggtggcacttcaaagcttattcggtaataagccttaccaagtggtcaaaggaacacgaggtcaacaatttgctgactcagtaccaagatattttcaagaaaccccgaggcttaccaccaccacggaaaaaggagcatgccatcattcttttggagggacaaggtcccattaatgtgcggccctatcgttatccgaaccaccacaagaacgagattgagaagcagatgaagaagtgggtgttagttttctttgatgacatattagtctttaggccagattgggcttctcatgcagcatttgatggcggtgttggagtggagtatttgggacacatcatctccaaagacgaggtagcaatggatcctaataaaatcaagagtgtgcaccaatggtcggtacctaagcacgtgaaaggcgtgcgaggttttttgggtgtcaccggctattaccggaagtttatcaaagacaaaggtaaaatagctcaaccattgactgttctcaccaaggaggggttccagtggggacctcaagctcaggagacttttgaaatactcaaagaaaagataatcatggcactggtgttagccttaccagatttcaacctagagtttgtcatcgaaagtgatgcttcaggccaagggttaggggccatcctcacacaacagggcaaacccgtggcctattttagcaaggcactaagtgaacgaaatttggccaaatcagcttacaaaaaggagcttatggcagtagctttggccattaagcattggcaaccatatttaatagcagaaaattcactgtttgacatcatgtataaaccaggtctagagaacacgggggctgatcctttatcaaggatgtatggcaaggggaagcttattataatcctgaggccaagcgaggaattccattccactcctcaaggtggtcactctggtttttaccgaacttataggcgtattgaagctaacctatattggattggtatgaaaaagtatgtcctacagtttgtcaaggaatgtgatgtttgtcaaaggcaaaagtacctggccacagctcttggcggattattgcaacccctgaacattcctaatcagatttgggaagaaatctcgatggacttcattactgaacttccaaagtccaaaggttttgcagccattctcttggtggtggacaggtcgtcaaagtacagccatttcattccgctgaaacaccgttacacggctaaggtgatagctgaagtatttaccaaagagatagttcgactccacggtattcccgcatctattttgagtgacagagatcctatttttgtcagtggtttctggcgggagttatttaagcttcaaggcagtcggttgaagatgagcacggcctaccatccacaaacagattggcaaactaaggtagaagcagtgcagcgaaagttgtcggatcgtgatgaagatttgcgtcaactaaagcatcacctacaacgagctcagtgccggatgaagactcaggtgctggaaaaaataggtgcagtggcctacaaactccagttacctgaatctgctcctattcatcctgttttccatgtgtccctcttaaaaaaggctattggagactaccgtgttgaaaaagaccttcccaacaatttggagggtgataccgctactgtccaggagcctgaaacagtgttggcagcccggaccattgaaaaatggggggatttgggaaggctgttgaggaagccacttgggaggaatagttcaacattcggagtcaatttcccatgttcagacttgaggacaagtctgtttctcaagagggggacaatgttaggacctcattattgggctctgatactaatgggccttgttctctacagttggccaggcccaccatatggagagtctacactaagaggaataggaaggaaaacacagaataattgctga

SEQ ID NO: 44671 - DNA, 528 bp, Glycine max
  Peptide Sequence Number=SeqID_161449
atggcttggatactatttgaaaatacaattctcaacttaaatattgtgaataagtcatctgattccactaaaagtgttacaaatcatctcatccatggatctgataatagatctttgcagttatctgatgtgaggattccattggtctttatggttttattcaatgttgctttttttggaacgggaaattttgcaagtattgctagttttgagatttcatctgtctatcggttcattaccatctttagtcccttcctgatggcagcgctactcatcttcaaattatttatacctttcttgcttgtaatatgcgtattcagtgcgattaccaaactaaaccaagttccaaggttgggatgctattttcttgttatattgttctcagacatgatgaccattcacttcttcttcctgccgactgtcataggggtacagcttgtaatcccttttggtctcaatgtcttgtacttatgtactaggtgtaagtccaaaaacatacaccaaatttcatccattgaattgagttag

SEQ ID NO: 44672 - DNA, 330 bp, Glycine max
  Peptide Sequence Number=SeqID_161450
atgcaatggcatcccgctgccttccccatcatagatggaggtatccagaatctcttcctaatcccagatggaggtcgtccattgggtcatgttgcttcgtgtatctacttcttgtctatttttgtccttatggctataagttggcctcccagggaggaagaatggtccataatccctcaagtgctaaggttgttaaggccaaagcacttaagtcatgaatttatcttccttatccatccttatggctatgagttagcgtaccagggagggaggacagtccatagtcccttaagtgctaaggctgttaaggtgcaagcacttaagtcatga

SEQ ID NO: 44673 - DNA, 333 bp, Glycine max
  Peptide Sequence Number=SeqID_161451
atgcaaagaaacggtttccggattcaaacccatgaccaaccagtcaccaagacacagctggttaggaatacaggaagttggatggaaattggaaatagtatcagtcattttggcatcatgagtgcccaagttgtttttgttctattactctttgccctcacaaatacatacacaaaagacatccactgtaactcagcagtatcatcgactcgattgagaacgggcggcagtgatctggaactcagggaaaggcgagcaaacattgtgcctcaccatttgatctgtacaggtcctggtcctggccctggcccgggtgatggaatttttgtttga

SEQ ID NO: 44674 - DNA, 111 bp, Glycine max
  Peptide Sequence Number=SeqID_161452
atggagaaatcgatgattggacttaacgaggatgacactcttatgcctcatgttcaatcaaaacatttggacgaagggacaaaagctacatggtgcaaatggttgcgttaa

SEQ ID NO: 44675 - DNA, 177 bp, Glycine max
  Peptide Sequence Number=SeqID_161453
atgacggcgacagcgacgaagtctatttcattgaagcccttaggaagagacgggaccgtgaggcgccatttggcggaggagattccgattgtggtgcctaggtacgccatcaagcctctagcgacaatggcattggaaaataaaggtgtatgtaggtataaggcatttttcttgtag

SEQ ID NO: 44676 - DNA, 114 bp, Glycine max
  Peptide Sequence Number=SeqID_161454
atgaagcttcattctctagctagttaccttagccaggagatactggcagagcaagaagttgatagagtgcatggattacctgcgcagcatccggtgaagttcaacaatatggtg

SEQ ID NO: 44677 - DNA, 863 bp, Glycine max
  Peptide Sequence Number=SeqID_161455
aattctatgcaaacctctatgaccccgatgacaaatcacctaagcaggtcagggtgagaggtcatctgattaagtttgatgaggatactcttaacacattcttgaagactcctatagtgttggaagagggggagaacttgtgcacatactctagatttgcactcctgaggcctgatcctcaggagttagctgctaagctttgtatcccagggaggggattcgagcttaatgttgatgggcggcctttgaagattctgaggaaaaacatgaccactcttgctcagacttggagcattctttccttttctaacctcatccccacttcccacacttttgatgtaactcttgacagagccaaacttatttatggcatcatcatgaagatggacataaatatggggtacctcatctcccaccagatctccctcatagcacaacatgacacatccagactaggattccctgccttgatcacagctttattaactttcagaggacccaagaaggccaggggtaagagatctgaggccccttctacttcagcaccatcagaagcaccaacaccctcttcttctccagtaccccccttttcatccactcagattctagttattcctccagcacctctacatatgccattcccagctcctttatctgcagggggtggggcctctacaacccaggagcctatgactgaggagccaccagcaccagcaccagtaccagtagcaacagaggaggagactactctagaccagacccaaccatcttcaccagttgcgaagcctgagcagcttatacaggattcaacagtaactccagcactagatcttaatgaagaccagccacatgaggagcaggat

SEQ ID NO: 44678 - DNA, 491 bp, Glycine max
  Peptide Sequence Number=SeqID_161456
atgggtatcacccgacgcgattttctcaacggggtggcgatcaccatcgccgccgggttgacgccgctgcaaatcttgcgcgcgtcgccgcaaaccgccaatcaaaccctgtactacccgccggcgctgaccgggctgcggggtaaccatccgggctcgttcgagcatgcgcaccagttggggcgcgacggcaaaacctttgatttcggcagcgtgcccgccgttgaagagttcgatctggtggtggtcggcgccggcatcagcgggttggcggccgcctgcttctggcagcagctgaaaggtgagcaacagcgcattttgctgatcgacaactatgacgatttcggcggccacgccaagtgcaacgaattcaacaccaaccacggcatgctgctcggctacggcggcagcgaatcgctgcagtcgccgcgctccaacttcagcccggtggcgatggggctgctgcgcaatctgagcgtcgatatcgatcg

SEQ ID NO: 44679 - DNA, 333 bp, Glycine max
  Peptide Sequence Number=SeqID_161457
atggcagccaccatctctagagtccatctctgctcacatgcaaaggatggagctccagatgcacgcatatatgcagcatatgaccgaccaagccaagatcccagccctttcccgtggcctacccccaagcagttcagggccacagttgcattgtctggagataggctcaatattcagacaggggcaggacccgtagtgatggaagcttgcttatggggcttctatggaggctggatctttaagcttcaatggggtcctttaatggtgattttccaccatggagatgcagcggaagacaaaggaaaagaggtgagaggaggcaccatccattaa

SEQ ID NO: 44680 - DNA, 201 bp, Glycine max
  Peptide Sequence Number=SeqID_161458
atgtgtgttcaggaagaagaaaggcttctaatgaagatgggtgagagtgcattgctgacaactgcttgtggaaagaaaaaaacaactaagtctcaagctaataagaagaggaatggaaaaataccacctcaagttgataataagaaggtggcaaagtgtttcttttggtatgcaaaacctaaggaaaccagtgggaagtga

SEQ ID NO: 44681 - DNA, 2802 bp, Glycine max
  Peptide Sequence Number=SeqID_161459
atggcaactgagagtccaattagaatctctgaagctgggagtaaatggccgtctcttaaggaagctgcaacttttggctcgccatcccgtcacatggcaacagaggatctgggtatatttttaaatggccataggtttcatggcagtggaaaggatgcagtacccaaccgcagtggcagtgcacctccgagcatggaaggctcatttctggccatagaaaacttgttatcccagaacaccaccaggaatgcgagcttgggatctcggaacagagctatgcaaaaatatgatagtggtaaagggtcttttcatttgtcacaaggaactcttgcaacacacaaggaggagtctgaggatgatttgacccaaaagctgtataataatttgttagacaaagctagtggaaaatggcatagacaggatgcggcttcaacatcatctcaggacacaaatttagtactggaagattttccccatatcatgtcacctgtatataataagtctcttggagtggtggatgaactaattgatgtggatactggttccagttcttctcttggccctcctgtcaccacagtggatgctgtaaaacctaccataggtgcagatgatgtaaggctgtcatcaactgttgattcccgtgcccctgtcacaagctcatcatctctcaattccactggaagcatgggatttaatgtcttagatgttacaattgtagaatctcaattaagggctctcaatgtatctaatctaccaaattcagaaagccagagttatgaagataaatggaagaacagctgccagaataatttgatgcaacaccagcaacaaaactatccatgtgtggtgcctaacaccaattctcaaagtgaaaaatgcacatatgttggtatggagcagtttcttcacaatcccagcaagttctcctctgatgtccagcctgtactgcaatcatcagggtatacgcctccactatatgctacagcagcagcagcttatatgacctcagcaaatccattttacactaatttgcaggcttcgggtatatattctccgcaatatataggtgcatacccttttagtcccacagctgttcctccatatattgctgcataccctcctcatggttctgtaccacttgttgacggggctactggttctagttttactccccaagcaccagggatttcttctactgcaggaaacatttcacacggagctgaaatgatgcatgcaaacaagttttttggacaatttggatttcctctgcagccttcttttagtgatcctatttacatgcaatatcatcaacaaccttttgtggagggatatggtgtatctgctcatctgctggcacctagagccagtgttggcggccaaattggtccctttgattcccaaaaaaggcccaatagtggtgcttacttggatgacaaaaaattacataatcagaaaactggtgctaatttgaattctaatagagatgggctaatacaccctggttattttggacacccttcaaatttgggttttgtaccccagtatccaagttccccactttgtagaccagttttatcaggatacccagaaagtagtcctggccttctaggtggaaggaatgaaatgaaacgctctccagcttctggtagaaatggaggtttattatctggatggcaaggtcaaagagcctttgacagtgctcatgaccccaaaattgctatttttcttgaagagttaaaatctggcaaaggtcgcagatttgagctatccgatattattggacatatagttgaatttaggcaacagaagttggaaagctgtggcgttgaagagaaggaattagtattcaaagaggttcttccacatacttcaaaattaatgactgatgtatttggcaactatgtaatccaaaagttttttgagtatggaagccctgagcagagaaaggaacttgcaaatcgacttcttggccagatactgcctttaagtctgcagatgtatggctgtcgtgtaatccaaaaggcacttgaggttatcgatcttgaacagaaagctcaacttgttcatgagctagatggaaatgttatgagatgtgtccgtgaccaaaatgggaatcatgtaatacagaagtgcattgaatctattccaactaaaaacattgactttataatatctgcatttcgtggtcaaattgctcttctatctatgcatccatatggttgccgagtcatacagagagttctagagcattgttcaaatgaggttcaatgtcagtttattgttgatgaaatcttggagtcagtttttactcttgctcaggaccagtatgggaattatgttacgcagcatgtgttggagagaggaaagcctcaggaaaggagtcaaattattcacaagctatctggacatattttccaattaagccagcataaatttgcatcaaatgttgttgagaaatgtttggagtatggtgatgctactgatcggcagttgttaattgcggagattgttggacatgacaaacaaaatgataatttattgagcactgaaaagtggtcattggtattcctttcaaatcaaataatccagttaacttcaaaaatgacaaaccgcagtcaaatcttagcctccttatttctgcttctaaaatgtgttctgagctacccagggttcatggagaatcccagacatactgcttcacaggaagaggaaggtagctgggttacaatgcaaataagtgggttactcgtatctgaattacacctgcacatgacaatgaaggcatatttgcttgtttcttga

SEQ ID NO: 44682 - DNA, 777 bp, Glycine max
  Peptide Sequence Number=SeqID_161460
atggcggaagttaacactctggtggtgcggaagccctgttttggtcttccaaccggttgccctcaatgcctatctgcttacatctatctcaaattcgctcaatttccattccaattggacttccacctcaacaaccctcattctgatcaaatcccttactttgaagttggtgactatgtggcttataacaatgagaaagaggggattattgagtgtttgaagaaagatgttggggttgttgatttggatagtggggtttcttcactccctgagtggatttcaactaaagcaattctcaccacttggcttgctgatgcacttacctatgaactctggctgggatgtgaaggctcctctgcttatagtatctattaccctgatcttccatggccattggggaagattctctcttggaagaaagctcattgggtgaagctgaaacatgggataactaatgacaatgctgaggtgaagaaagaagagatttatgagagagcaaagtctgcatatgatgccttgtcaagttgcttaggtgaacagaattacttatttgagaacagagctattattgacttcaacctcctggtgatgtattcatatgctttatttggtttatgcaggccatcaagcttggatgctatttttcttgcacatggactagttgttcttcatgctttacctttggttgcagttgttgtgttcctcacacttatgacttcatttgatgatgctgaagtggagttagatgatgatggtggttatgatttcgatgaatga

SEQ ID NO: 44683 - DNA, 114 bp, Glycine max
  Peptide Sequence Number=SeqID_161461
atgaaaagagatgaaattttatcccagcagatctatgcttaccaaatgctaacagcaaatccattcatgggcaaggacaacaaccatattcgattatgccgtaaccttatttga

SEQ ID NO: 44684 - DNA, 267 bp, Glycine max
  Peptide Sequence Number=SeqID_161462
atgccactggagaaggatccagtgcggccccataagtggatatggagtttgacgaacatcggttttgaagtgaggaacaccaatgccattttgaagcaatcaagggttggtctttcctcaaggagagacagggatcacgccttccagacacctagtggacctagagaagtccaacagagcactgaggttttcagccttgatcacgggcctctgccagttctatggggtgccagttactccctcaaagcttatccggccccccattaa

SEQ ID NO: 44685 - DNA, 228 bp, Glycine max
  Peptide Sequence Number=SeqID_161463
atggcttcatccctcccctttttaaatttttgtgtcagacacgcttgcccaagtgttatcgtgttcaatttttacttaaacgcttacagcaccccgctgatcgagccaaatggctctggattcagtgggcaagatcgagaatgtgaaggcaattcttcatcatccatgctcgcaagcaacaatgctcctcccgaaaaagccttcttcacaacgaaaggtccttcataa

SEQ ID NO: 44686 - DNA, 324 bp, Glycine max
  Peptide Sequence Number=SeqID_161464
ggtgtactggtagaagctctcattcagttgcacctgacccctatgattagccgcctgctggtcggtcacatgctgcatatatgtgtgcatctggagctccatcctttacaggtgagcagagaaggactccagagatggtggctgccggctgccgtagaggtggcagcgatgcatctgcagctggctggtcctccccctgctgctactgtgcccaaccctattgataactggcagaggcccgtgatcaaggctgaaaacctcagtgctctgttggacttctctaggtccactaggtgtctggaaggcgtgatccctgaaaattga

SEQ ID NO: 44687 - DNA, 447 bp, Glycine max
  Peptide Sequence Number=SeqID_161465
atggacttgaaagaaaattgtacttatgtcatgcacaattttaaagtgctaaaaaacaatggtcagtacagagtgtgtgatcaccaatttaaattggtgtttattggggttactgttgtgagggagtgtgttctagaggacatcccttttagaaaatacaggtttgctggatttgcggatgttgtggctggccagtttgaacctaggctattggttgatgttattggtgttgtggaggaggttgtctttcgccaagtttcaggaaaaggtagaagggtagtctttaaactaaaggacttgagccagcaattgctatcttgcactttgtgggatgattattgcttgcagtttttaaagttcttagatgattatgaaggtgatggcccaattagagttctattgacccatggtagaataaaggaagctcagggtatatccttatcttga

SEQ ID NO: 44688 - DNA, 516 bp, Glycine max
  Peptide Sequence Number=SeqID_161466
atggaagaaggatttaatgtgaacaagcctcccatgttggagggagccaactatgatgactggaaggaagggatcattgccttctttgaatccactcacattgatatgtgggatgttgtagaaaagggcagtcagattcccctagaggaatattccaaggttgatggctacagaagtgccaaacagatgtgggacacctttgccattacctacgaagggtcctgtgagacaaaacataaaaggttgagccttcttatgcgtaagtatgaactcttcagtttggaagaaggaatagatgtccaaaccatgtttggatgtttccaaaacatcctaaacgagctttactctctaggtagacattatgacaattatgatcacattgataaaatcttacaaagtttatctagaaagtggagaccgcatgttacagctttaatagccaacaagaatcttgattcaatgactcttgaagagctcgttgggattcttaaactgcatcaacaaaagcttgcttaa

SEQ ID NO: 44689 - DNA, 342 bp, Glycine max
  Peptide Sequence Number=SeqID_161467
atgggtgaagtagaagaggtgcaaaagcagatgaaggccgacatggaggccatgatgagcatgaagaagataatggaagccaatgcggttgcagttgccgctaccagcactgttgctaaggtgaacccgatgcccccatctggcctcaaccaaatgaatcatccaacctcaaatatggtaggcaaagatttgggaagtacggacgacccctattatgtgcaaattcaaaacaagaacgccttcccgccatatggctttcctcccaactatacaccacccaatgtggcgtacactcccagtgagaatgtcaataactccactcccatactcaccgagagctga

SEQ ID NO: 44690 - DNA, 231 bp, Glycine max
  Peptide Sequence Number=SeqID_161468
atgtgggggtaccgtatggttatccgcaccttttgtcatcccaagatggcgagtctgatgacatgcggggggtaccgtatggttatttgcacctttcgtcatccaggggcaaacaagcccgttgatgcgcagggactaacgtcgtcctctgcacctttcgtcaaccaggggggaagcgagccggttgacgcgcagagactaacatcgtcttctacaccttttgtcatctag

SEQ ID NO: 44691 - DNA, 252 bp, Glycine max
  Peptide Sequence Number=SeqID_161469
atgcacggagtcgctactaacgtttattcaaggaaaatgttggaaaaaccagaaaggtgtggtctacgaactttaatcgtgaaaggttcgggagttgtttttatgcacggggaagggtgtttccctcgctcctacgtatcctcaattgcgatgaggaaatcatacctacgtagttcttttagaactaaacgttggttaagttgttttgatctttttcgcaagatcgattttaaccgaacaaaagtcgtttaa

SEQ ID NO: 44692 - DNA, 714 bp, Glycine max
  Peptide Sequence Number=SeqID_161470
atggttatcgatacacgtggtgcatatagtaggaaaggttgcacagaatgtagatgtgacctacttaatcttccaaaggacttttataatgtcacaagagacattaatgatcaaccattgtccctaaattataaaggaggactcttttgttgtaaagataacttacaatgcaaattaagaaagggttttcatggcccaacgagaaagctttcactgagatacaaaataagatgggttgattgggatgaacaccaagtgccactaaagttttatatacttgatacaactgatcgtgtgagaacaaatggctcttcaacaattcatgattgccaggcagaatataccattccaagaattggtcatggtgactcccctcatgttaagaaagcaaacatcccaatgaaaaaaggtggttatcttatatatggcacttctcatatgcatactggtgttgtcaatgcaactctctatggacaggatggaagggttttatgtacttcaacaccaaaatatggaacgggaaaggaagcaggaaatgaaagaggttacctagttggaatgtcaggttgttatcccaaaccaggctctgttgagattaaagatggtgaaattctcactctagaaacgacatatcaaaacaagttccgtactggagctatgggatttttctatattcacttggctgaacaactaccaaacattttaaagatttaa

SEQ ID NO: 44693 - DNA, 1248 bp, Glycine max
  Peptide Sequence Number=SeqID_161471
atgactttgcaaatatttttcatagctaatttcttaatacctaatgatttatgtacagtggttctctctggcacaacatactcaattttcctagagtctgaaaatcatatcaaatcggctacttttgtgtctaaaagttttgaagtgggaccaggaaaaattgcatcaaaagcactttatgatattgagtttccaaaaggtcatattggggtcaagagttttgatgccgaactagttgatgaagatgggaaatctgtacctttatatgaaacctatcttcatcattggtttgcaataaagtacaatgaaaatattactatgtcacggtacattgagcaatctcatgacattagtaaaggtatcaattacacaagaaatgatggtgcatgcagaggctttttgcttccacattattggggattaggaggagaatcacgaggaacatcctcaaatcttccagacccttttgcggtagaatttggtaatcctacaaatattccacatggatttaaggaaaaatggttgttcgacatcatggttatcgatacacgtggtgcatatagtaggaaaggttgcacagaatgtagatgtgacctacttaatcttccaaaggacttttataatgtcacaagagacattaatgatcaaccattgtccctaaattataaaggaggactcttttgttgtaaagataacttacaatgcaaattaagaaagggttttcatggcccaacgagaaagctttcactgagatacaaaataagatgggttgattgggatgaacaccaagtgccactaaagttttatatacttgatacaactgatcgtgtgagaacaaatggctcttcaacaattcatgattgccaggcagaatataccattccaagaattggtcatggtgactcccctcatgttaagaaagcaaacatcccaatgaaaaaaggtggttatcttatatatggcacttctcatatgcatactggtgttgtcaatgcaactctctatggacaggatggaagggttttatgtacttcaacaccaaaatatggaacgggaaaggaagcaggaaatgaaaaaggttacctagttggaatgtcaggatgttatcccaaaccaggctctgttgagattaaagacggtgaaattctcactctagaaacgagatatcaaaacaagtttcgtactggagctatgggatttttctatattcacttggctgaacaactaccaaacattttaaagatttaa

SEQ ID NO: 44694 - DNA, 231 bp, Glycine max
  Peptide Sequence Number=SeqID_161472
atggaagaaggatttaatgtgaacaagcctcccatgttcaagggagccaactatgatgactggaaggaagggatcattgccttctttgaatccactcactttcatatgtgggatgttgtagaaaagggtagtcagattcccctagaggaatattccaaggttgatagctacagaagtgccaaacagatgtgggacacctttgccattacctacaaaggtttagtactttag

SEQ ID NO: 44695 - DNA, 279 bp, Glycine max
  Peptide Sequence Number=SeqID_161473
atggaaaagtatcttgttagcaaaacaattgagtttagtgagagattgagctactttggaatagctactagcttggtcatttaccttacgaaagttcttcatcaagaccttaagacagcagttaaaaatgtgaactattggtctggtgtcaccaccttgataccattgttaggaggattcctagctgatgcttacttaggccgttacaccgctgtgatagcatcatgcattgtttatctcatggtaatcaacctcaaatctcaatcaccattcaactaa

SEQ ID NO: 44696 - DNA, 1465 bp, Glycine max
  Peptide Sequence Number=SeqID_161474
cgatgagcagctcggccagtatgccgacgccatccgcacgcacattactgccatgcaatctctggcgctgagcgatgacgaatatcgttacctcagcagcttaccgtttttccagcaggattatctcgactggctgcgccagttccgcttcgatgcctcgcaggttgaggtgcgcgaggatcacgggcatctgcgcattcagattcgcggcccgtggcgtgaagtgattctgtgggaagtgccgctgctggcgctgatcagcgaagtggtacaccgtcaccggacgccggaaagcggcgcggaacaggcggtggcgcatctgcagcagaagctggtgcacttccgtgagcaggtaggcgatctcgatatgtcgcgcttccagctgatggactttggcacgcggcgtcgttattcgcgcgcggtgcaggaagcgattgtcagcacgctgaaaaacgaattcccgtggctgctgggcaccagtaactacgatctggcgcgccggttgcagcttaacccggtcggaacccaggcacatgaatggttccaggcacatcagcagatcagcccggtactggccaacagccagcgcgcagcgctgcagtcgtggctggatgagtacgataaccagctcggcattgccctgaccgactgcatcacgatggacgccttcctgcgtgatttcggccccggttttgcccatcgctatcagggcctgcgccatgattcgggcgatccggtggagtggggagaaaaagccattgcgcattatcagcggctgaatatcgatccgctcagcaaaacgctggtgttctccgacaatctcaacctcgacaaagcactggcgctgtatcgtcatttcggtcagcgcgcgaacgtggtatttggcatcggcacccgcctcacctgcgatattcccggcgtcacgcctttgaatatcgtgatcaaactggtgagctgcaacggcaaaccggtggccaaactctccgacagtcccggtaaaaccatctgccaggataaagccttcgtgcgcgccctgcgcaaagccttcgacctgccgctgcggatgtactgcacggccgtgtcgcggttgacagtgaagtcaccgtacgtggttgggtacgtacccgaagagattccaaagccggatgaagtgctgcgtctgaccaccggctgttcggtgatcgtcaccggtaaagtggtggagtcgccgggtgaaggccaggcattcgaactgcaggcgacccaggttgaagtcaccggctgggtggacgatccggatacctatccgatggcagctaaacgtcacagcatcgaatacctgcgtgaagtggcgcacctgcgtccgcgcaccaatattgtcggtgccgtagcgcgcgtacgtcatacgctggcgcaggcgctgcatcgcttcttccatgaaaacgggctatttctgggtctccacgccgctgatcactgcctctga

SEQ ID NO: 44697 - DNA, 563 bp, Glycine max
  Peptide Sequence Number=SeqID_161475
atgttgctgaacaagaagagcagagttaatcgtgctgcaatagcactcagtttgtcactgatggcggcaccgctggttatcagccaggcggcagacgtcggcgcgctgccgcacagcacgctgtctgtggctgccagccagcagcaaattcagcaggcatttagccccagcgaacgacccttttatctgcccggcctcgccggcatctatgcggcacgcaacatggcgccgctgtggcaggatcgcgacgccgtgcaggctttccagcagcagctggcagaagtggcgctctccggcgtacagccgcagtttacccgctgggtagagttgctcactaatccggatatcaaaggcttcgcgcgggacgtggtgctgagcgacgccatgcttggctatctgcagtttgtcgctaacgtaccgacccagggcgaaacctggctgtacagcaatgtgccgtacaagctgaccatgccgtcactttccgccatcaatcagtggcaaaacgcggtgaacggcggcggcagccgcgcctttgtggtgtcgctgcaaccgcagcatccgca

SEQ ID NO: 44698 - DNA, 994 bp, Glycine max
  Peptide Sequence Number=SeqID_161476
atggcttttgacattttgaaagccgcaattaccaaggcaccagtactggcattgcctgatttttccaaagcctttacattggaaattgatgcctttggtataggcattggggctgtattgagtcaggaacaacacccaatagcttttttctctaagaagctcacacctaggatgcaaagacagtcagcttatataagggagttctatgccatcagagaagcagttgcaaaattcagacattatttacttgggcaccgatttgtgatcaaaactgaccaaagaagcctcaagtcactcactgagcaagcaatccaaacaccagaacaacagaaatggctacataaattgctaggatatgacttctctattgaatacaaaccggacaaagagaatttagctgcagattccttgtctagatcatttttcatggcatggtctaaaccaaaactcaagttggtgattcctagtaatcatgagttggtgaagcgaattttgcatgaatttaacacttctttgattggtggacatgctggagtggccaggaccttgtctagaatagccttgcaattctattggaaaggtatgcataaagatgtaaaggaatttgtgcaacaatgtttaacttgtcaacaagctaaaagtgacactatgctgccattggggttattacaacctctccctattcctatgcaaatttgggaagacctagcaatggatttcatcaccggacttcctccttccaatggcttcacagtgatattagtggtgatagatagactatctaagtatgcccattttttcactcttaagtttgattataatagtaaacaagttgctgaagtgtttgtcaaaaacatagtcaaattgcatgattttcccaagtcaattgtatcagacagagacaaggctttcactagtcagttttggcagcaaatgttcaaactcaatggcactacaatcaacttaacaactacttaccacccccagttggatg

SEQ ID NO: 44699 - DNA, 394 bp, Glycine max
  Peptide Sequence Number=SeqID_161477
tcttctccttcgacgagcaacagccacgaagacgaagacgacctctcccagagcgaagcaagatcctcctccttccaatccaccgtactccgttcccgtctacgggaggcagaacgaagatgtttacggagagagagtgcttgcctacgatggcgggaaggtggaactgtacggtgcccgaggctcggtgccgaaatcgtcttccacttggtcaagttttgacgattacgggagggccatcggtggtggtggtggtgctcctccccctgcgacggcgacgagcaaggttgttaaagcgatgccgaaggtggacgccgagggagacacgaagagcggagtgcagaagtttcgggtgaagctattggcagaaagtggtggtcagatcactattgat

SEQ ID NO: 44700 - DNA, 162 bp, Glycine max
  Peptide Sequence Number=SeqID_161478
atggagctccagaacaattggaggtgttgccagagagaaaacgttgatgacacagctggtgctgctcagcttcaaatggtctgtatgatgctggtgcgattcccagcattcgagctgcggaaatctacgggcttaatgtacttgcagaacaaattcaagtaa

SEQ ID NO: 44701 - DNA, 516 bp, Glycine max
  Peptide Sequence Number=SeqID_161479
atgaaagcagagctgaagtgtagcagtgaattctcccgtgatttccactgcaacttcaacataatatttaatattaaaaccctacgctctaatcgccagagcctccgcagcctccatcactccatagcctccgcaatattagggttaggtgttttcgttctcaccaaaaccctacccttcgccgcctcattctctggcttcggtgatcccatcccctggctcatcgccctcgctttcttcttcgccaagggttttatcaaaaccgacctcggaaactgcgtggtgtaccaattcattaaactcctcggtagctcctcgttagggttaggttacagcttggtcttcagcaaggctcttcttgcactggcaattccctcggtgtcgatgagggcggggggaattttcctaccactggtgaaggccccgtgcgtggtgtgcgggagcaacaccagcgacgggatggagcacaggttggggaatgtccatcacgagcttgcggaggtcacggtagggtga

SEQ ID NO: 44702 - DNA, 753 bp, Glycine max
  Peptide Sequence Number=SeqID_161480
atggttgatgcctccactggtaaaacagaaccagcactggacacaagttcagacgatcaggattcccagcctgatgacaccgtcaactctgatggtgaagagctaatcttcgaatctagagaagatttaattaaagggcacaatcatctactttttatctctcctcacgtctctaaatcttatagtaaactaaacaaacattttcaacatcttgaaagagagcataaggatcacaagaaagaaagggtgaaatccttaaccacagctcttgatgattcagaagaagagcgcaaggaactacctccaaagattgaaaaactctataaagagatagaaaccttcagagataacctaggcaaatttatttgtggtcatgaagcccttaaaaaaattattaaggtgcaaagaaaccccaaagacaaatctagccatggtttcaaaggcaaaaaggttgtgaatgctaaagaagtcaatgtttcctatttttatggaaaagtgggtcataaggctcataagtgcaaggacctccctaaagagggcaacccatcaaaggatctccttgatagcaggaaggaaacaccaatcatggtacctagacaatggttgctcacaacacatgacaggcaaaaagtctatttttcaatcccttgtagaagcaagcttcatgatgatgaatcaagtagttttgatgatgacaaaaaactcaaaagaatgatttcaagattgagccaacaagttcaagatcaagattaa

SEQ ID NO: 44703 - DNA, 369 bp, Glycine max
  Peptide Sequence Number=SeqID_161481
atggtgtcgccattcacgatggcgtgttgcagggcttggactcgccagtcaaattggcgagttgagggtgcagatttcctagggtgcaggcagcagcagcagcagcagaggctgtttccaaggttgcagtctgcaacgctgcaggaagtcgccatcttcaatggcgttttgcttggccaaaggcgccagcaccagcagcgattcgcgttgcctgagctgcttaaatcccccctcttcgtagaccatttcacacgagaaaaaaaaaaagaaaagagaagattggtgctgtgtttgaggaaaaacgaaggagtgttgctgtgctgtttgtatttgagcaaacctcttcttttgtttttcatcttaagttag

SEQ ID NO: 44704 - DNA, 210 bp, Glycine max
  Peptide Sequence Number=SeqID_161482
atggttacttccatacttcaacttgactcgatgaaccttttcgtaaaagcacgagcttggttcaaccccataacccagggaatggcaattttgatcgccaatacttcgtcaacaattcatagggatgaaagactcgggaatatgcatgctatgcatggaaaatgtaattatgagatcgagatgcccgaagaaacatcctttcttaattaa

SEQ ID NO: 44705 - DNA, 321 bp, Glycine max
  Peptide Sequence Number=SeqID_161483
atgaaggattgggggaatttcctccaccgaatccttgaggaggattctgaggattccactccaattacaacattcttcttggtgtggaggttcggcggcaagcaacgacggctcatggtggccaccgggggtcgtgggtggtggagaaggagcgcaattccctctcaggttggtattgcgcttagcgcggccctcgcgcttatcgagacatcaaaagttgatattttcaaaatcccaacggtcaagctgtggagagttgtctttggaacctccagtcaaagtttgaagacgatccaatggttaatagatctgggatcgtga

SEQ ID NO: 44706 - DNA, 129 bp, Glycine max
  Peptide Sequence Number=SeqID_161484
atgggggtagtttatgttgtgagcttggacttccggatgtgtgatgctgccatgataacagcttttggtaaatatgtcgcggattcccttgatgatggtgagtcagatgatgtagaatcagaaaaatga

SEQ ID NO: 44707 - DNA, 488 bp, Glycine max
  Peptide Sequence Number=SeqID_161485
atgcgtatggtgaagaagaaaagtccggtggcctgggagactgtgtgcagaccgaaatgtcaaggaggactggatattataaacttgactgtttggaatcaggttgatagccggagacattggtcttggatgttcaacaatatcttggatcaaagagagaaagtcaggctaaaacaggaatggaataatcagatgcaaagggataaattctcgatgaaaaccatgtataacctgctgatggataaatctgatcgggagtctgaggaatctattgcccatctgttttttgactgcaaaattacaaaattcatatgggagcagattcttaaatggattgaagttactcatgaacctaaaacttggggtgtagaactcaagtgggctattcgagaaactggaaagaaatggtggaaagctaaactcctgaaactagcactcactgaaactctttacgaggatgttggttgtggatctcatgagatcgccat

SEQ ID NO: 44708 - DNA, 340 bp, Glycine max
  Peptide Sequence Number=SeqID_161486
atatctaaaggcgttgggtcctcttactaagcaaattgatgcaattaaggatgtttctctaattaaagatgtttatgtgttctatgctaaaggctcaagtactaaacatcgatgtctcagcaaggaggagcatgaagcgttagtttgtttgtgtggaagccaagtatgctgggggagctatctgaatctgagtggtgaagaagctttccaaaagttcttgcaccttgcatggatccaaacagatagaaagttgggtggccttggtgacttgaattatcctttgatttctgatgccaccaaattcatattgaaatcttatggtgttctcattccagatcag

SEQ ID NO: 44709 - DNA, 2862 bp, Glycine max
  Peptide Sequence Number=SeqID_161487
atgccggaaagtacggtgcatctaatgaatacggtgattatgaccgatattaaaggtactcttcgacccaacggtgagacttgttatgatgcatcagcattgatgggtgctgttgaggagagtagtagtggctttgattccagcattgtgaaagagggtgagggagatgatagtgatatctcgaaagttgaagatgtagaggtcagaatggatctcaccgatgacctgttgcatatggttttttcgtttttggatcatcccaatctctgcaaagctgccaggatttgtaagcagtggcgaggtgccagtgctcatgaagatttctggaaaagtttgaattttgaagatcggaacatatctgtcgaacaatttgaggacatgtgtaggcgttatcctaatgccacagcagtgagcatatctggttctgctatttacttgcttgtcatgaaggccatctgttcattaaggaatctagaggttctaacattaggaagaggacagatagctgatacttttttccatgctttagctgattgttctatgttgagaagattgaatatcaatgattctacactaggcaatggcattcaggagataactattaatcatgacagattgtgtcatcttcaattgacaaaatgccgtgtaatgcgaatagcagtcaggtgtccacaacttgaaactatgtcgttgaagcgcagtaacatggcacaggttgtgcttaattgtccacttttgcatgagcttgatataggctcttgccacaaacttcctgatgctgcaatacgagctgctgcaacttcatgtcctcaactggtctcactggacatgtcaaattgttcatgtgtcagtgatgaaactctgcgtgaaatcgcgttgagttgtgccaaccttagttttcttgatgcatcatactgctcaaacatatctttggagtctgttagactgccaatgttaacagttttaaagcttcatagttgcgagggaattacttctgcctcaatggctgcaatagctcatagttatatgttggaggttttggagcttgacaattgcagcctgttgacttcagtgtctttggatcttcctcgtttgcaaactattagattggtacactgtcgcaaatttgctgatttgaacttgaggactatgatgctttcttctatactggtatcaaactgccctgcactccatcgtatcaacatcacttcaaattcacttcaaaaattagcattgcaaaagcaagatagtttaaccacgctagcactgcaatgccaatctttacaagaagtggacctctcagaatgtgaatctttgacaaactccatatgtgatgtttttagtgatggtggaggatgccctatgctgaaatcactagttcttgataattgtgagagcttggaatcagttcggttcatcagcaccactttagtcagtctttcccttggtggttgtcgggcgatcactgctcttgagctcacatgccctaaccttgagaaagtcattttggatggttgtgatcatttggaaaaagcctccttttgtcctgttggccttcggtctctcaatttaggaatatgtcctaaattgaatatactcagcatagaagccatgtttatggtctcacttgagttgaaaggatgtggtgtactgtctgaagcatcacttaattgtcctctcttgacatctttggatgcttccttttgcagccaacttactgatgaatgtttgtctgccacaacggcctcatgcccattgattgagtcattaatattgatgtcatgcccatcaattggtttagatggactttgttctttgcgtcggctcccaaatttgaccctgctggatttatcatacacctttttggtcaatttgcagcctgtttttgagtcttgttcacagctaaagagtgccaccacaccacctgcgcgctcaagaatagtgctgccaattttagtcagacaaataattttaatagcacctaatgaaattgtgatattaatttgttatgatgttgcgagccctggtgcagcggtaaagttgtgccttggtgacttgttggtcatgggttcgaatccggaaacagcctctttgcatatacaagggaatgtaaccagtatactcctcttatatgacatgtgcaatcctcctcccttaagtcagcttttgggagtgagtcaggcatgcaaatatctcactgactcatcacttgagcctctttacaaaggtgctttaccagcacttcaggagttggacttgtcttatggaacactgtgtcagtctgccatagaggaacttctttcttgctgcagacaccttacacgtgtgagcttgaatggctgtgccaatatgcatgatttaaactggggatgcagtcgtgggcatattgctgaattgcctggtgtaaatgtcctatctattgcaacttcccatgaaaatgtccacaagttaagtgagcaacccacccggttactgcagaacctaaactgtgtgggatgtccaaacattcggaaggttttcattccatcaacggcacattgttcacgtttgttgtttttaaacctttctctatcagctaatttgaaggaagttgatgtagcttgtctcaacctaagctggcttaatctaagcaattgttcctctttggaagttttgaagctagagtgcccgagattgaccagtctgttccttcagtcttgcaacattgatgaggaagctgttgaggctgctatatcaaaatgcactatgctggagactcttgatgttcgcttctgtccaaagatatgctcaatgagcatgggaagattacgtgcagcatgttctagtttgaagcgtatattcagcagcttgtcatcttcataa

SEQ ID NO: 44710 - DNA, 204 bp, Glycine max
  Peptide Sequence Number=SeqID_161488
atgacacccgacttcatgggtcaggatgacaaaggtgctgaagacgatgtaagtctctgcttgtcaacgggtttgcttgcccctgattgtcaaagggtgcaaaagacgacgttagtctctgcatgctaccggactctaagtttgacggatagcgaaatagtgtttatacggataaccacttgggtatctccgtctgccacctaa

SEQ ID NO: 44711 - DNA, 255 bp, Glycine max
  Peptide Sequence Number=SeqID_161489
ggcaaagaagagaatgttaaagttgctgatgactcgcttagcgaggcagatccgctcagcgagatgcatccgtttagcgaggcatccagctcgcttagcggatgggaaaccctagaagaggataagccaaagatctgcacgcccagcgcacagccagcccacctagcgaggacgttgtctcttctcgcgcttagcgttcccatgctcgctaagcaaaaattcactaactcgtgctcagcgagacatgctcactga

SEQ ID NO: 44712 - DNA, 264 bp, Glycine max
  Peptide Sequence Number=SeqID_161490
agtcatgaggatcttgcaaagaaacttcaggatgagctagaaaggaatagaaggatatcaggtacctattataatcggagtccaaatctggagcctgggttgcaaaacttgctgtatagtttggatgaattgtcaaagaatctctcctcacttcactccgacacgcatcataatgaagggctttttgtggaattgttgcagatgaaggtgtctatccaagggtttcatgttcgattattttactgttctatctcttgcacgtga

SEQ ID NO: 44713 - DNA, 522 bp, Glycine max
  Peptide Sequence Number=SeqID_161491
gatttgcctaaggtccaagaggagcttgtctcagcggttatgcgagaccgagaccaacatgttagccatcatcagcaagtaccaagaagaattaaatctagccacagcccacgagcacaaagtggcagacgaatatgcccgagtgtacgcggaaaaggaggcaagaggaaggtcaagaacttccctgattgctggccagggccaaagcaatggcagacgcctactccgcccccgaggagatccacagactcctcagctattggtgaccaagaggaagtacaggaacagatgaaagccgacatgtcggctttgaaagagcaaatggcttccatgatggatgccatgctaggaatgagacaactaatggagaataacgcggccaccgccgtcgctgttagttcggctgtcgaagcagacccatctctcgcagctaccgcgcaccaccctaccccaaacgtggtggatgagaaagaagaacactggggcacattagcaacccccatccggggtacaaccaagtag

SEQ ID NO: 44714 - DNA, 791 bp, Glycine max
  Peptide Sequence Number=SeqID_161492
caggcgtggcagctggatccgatgcatggtgcgcagccctttggcgagggcgcatggcatttgccgttgccccgtcttccgcgggctctggtgttggggggcggtcccgaaacgcccttcctggttccgttgctgcggagcctggggtggcgggtcagcgtggccgaacggagagcgcgctgggcctcagccgggcagtgcgcggatgcgcatcttcagaccagcccggccgaggcccttcatggcgacccgtgcgacgcggcactggtgatgcatcacgatttcgaactggaccgggaggcgctggacctgttcaagctgctgacaccggatcagcgccaccgcctgtccccgagacttcgatcaccggtcggcctgaacatcggcggccgagggccagaggcgatttcgctcagcatcgccgcgcagctgcagcaatggcgaagcgcgcacggcagcacccggctcggccagcccaagcagcttctgacccggcagggcgagaccctggtacgtcgcgtggtgcggttggccttggagttcgcgccagcgcaggtcctggtcgtggtgggcgcgaacgcacaggccgtgacatccagcattgccgggctggaggccactccggtaaccaaccaccactgggaacgcggcctggcgagcagcctgcaggttgccggcgcgcacttgctgcccacggtgaccgaggtgatggtcgtggcatgcgaccagcccgcaatcgagcgctcccatctgcaggcgctgctttcgggtgcccgcgcctcggcatcagg

SEQ ID NO: 44715 - DNA, 3072 bp, Glycine max
  Peptide Sequence Number=SeqID_161493
atggctttgttttctgaattacctgttcattttgccttattactccttttcctctttcttgagctacacaaccttttgattggtgtatcatcagccactttaagcatcagctcagacagagaagccttgatctcattcaaatctgaactgagtaatgacactcttaaccctttatcttcttggaaccataattcatccccctgcaactggactggtgtcctctgtgacaagcatggccaaagagtgacaggccttgatctttcaggcttgggactctcaggtcacttaagcccttatattggtaacctctcctctcttcagtccctccaattgcagaataaccaactcacaggagtgattcctgaccaaattggcaacctattcaatctgagacttctaaatatgagcactaacatgttagaaggaaagcttccttcaaacaccacccacctgaaacagctccagattcttgatttatcctcaaacaagattgccagcaagattcctgaggacatcagcagcttgcaaaagcttcaggctttgaaactgggaaggaatagcctctatggtgcaataccagcatccatagggaacatttcttctctaaaaaatataagttttggcaccaactttctcactggctggattcccagtgacttgggtaggctccacaacttgattgagcttgatctcactctcaacaatctcactgggactgttccacctgttatatacaacttatcttcccttgtcaacttggccttagctgcaaactctttgtggggtgagattcctcaggatgttggtcaaaaacttccaaaactcctagtgttcaatttctgcttcaataaattcacaggtggaattccaggctcattgcacaacctcaccaacattcgggtgattcgcatggcttccaaccttttagaaggaacagtgccacctggtttgggaaatctcccatttcttcgcatgtataatattggctataacaggatagtgagttcaggtgtgagaggtctagacttcatcacttctttgacaaacagcactcacctgaactttctggcaattgatggcaacatgctggaaggtgtaattcctgaaagcattggcaatctctccaaggatctcacaaaattatacatgggacagaatcgtttcaatggaagcataccctcctccattggtcgtctaagtggcttgaagttgttaaacttaagctacaattcaatctttggagatatcccaaatgagttaggccagttagagggactacaagagctatctctggctggaaatgagatatcaggaggaattccaaactcccttggtaatctcctgaagttaaaccagattgatttgtcaaaaaacaaacttgtggggagaatacctaccagttttgggaatttgcaaaacctgctttacatggacttatccagcaacaaactcgatggaagcatacctatggaaatactcaatctcccaactttgagcaatgttttgaacctgtctatgaactttttgagtggaccaataccacaaatagggagattgattactgttgcctccattgacttttctagtaaccaattgtttggtggcatccccagctcattcagcaattgtctcagcttagaaaatctgtttttggcccggaatcagctttcaggtcccataccaaaggctcttggagatgtgaaaggcttggaaactttggacttgtcctccaaccaactctttggagccatacctattgaactacaaaatctacatgtccttaagttcttaaacctctcgtacaatgatttagaaggagtaattcctagtggtggagttttccaaaatctctctgctattcatttagaaggcaatagaaaactctgcttgtatttcccatgcatgcctcatggccatggaagaaatgcaagactttacatcatcatagccatcgtgttaacattaatactatgtctcacaattggcttgctactgtatataaagaacaaaagggtgaaggtaacagcaactgcagcaacatctgaacagctgaaacctcatgtaccaatggtctcttatgatgaacttcgtctggcaactgaggagttcagccaggaaaacctattaggagttggaagctttggctcagtttataaaggccatctaagtcatggagctactgttgcagtgaaagttcttgacaccctaagaactggctctttgaagagtttctttgcagaatgtgaggctatgaagaactcaaggcatcgaaatttggttaagctgatcacatcatgctctagtgttgacttcaaaaacaatgattttctggctctggtgtatgagtacctgtgcaatggtagcttggaagattggatcaaggggaggagaaatcacgcaaacggaaatgggttgaaccttatggagagactgaacatagctatagatgttgcttgtgcattggattacctgcacaatgatagtgaaatcccagttgtgcattgtgatttgaagcctagcaacattctattggatgaagacatgacagcaaaggttggagactttggattggctaggtcgctgattcaaaactcaacaaatcaagtttccataagctccactcatgtccttaggggctcaattggttacatacctccagagtatggatggggagagaaaccatctgcagctggagatgtatacagttttggtattgtgttactagagctcttctctggtaaaagcccaacagatgagtgtttcacaggaggcctaagtataagaagatgggtgcaatcagcaatgaaaaacaagacagtgcaagtcattgaccctcagttgctgtccctcactttccatgatgacccttctgagggaccaaatctgcaactcaattatttggatgcaactgtaggagttggcatatcttgcactgcagacaacccagatgaacgcattggcattagagatgctgttcgccaactaaaagctgctagagactctcttttgaaactgtctgatgagagtcctagaagagataccgagcgttacttccatgtttcaataaagtga

SEQ ID NO: 44716 - DNA, 636 bp, Glycine max
  Peptide Sequence Number=SeqID_161494
atgaagaactcaaggcatcgaaatttggttaagctgatcacatcatgctgtagaattcactttaaaaataatgatagcttggaagattggaccaaggggaggagaaagcatgcaaagggaagtgggttgaaccttatggagagactgaccatagctacagatgttgctagtgcattgaactaccagcacaatgatagtgaaattccagttgtgcactgtgatttgaagcttggcaacattctattggatgaagacatgacagcaaaggttggagactttgggttggctaggttgcttattcaaagatcaactaatcaagtttccataaactccactcatgtccttaggggttcaattggttacatacctccagagtatggatggggagagaaaccatctgcagctggtgatgtatatagttttggaacagtgttattagaactcttctcaagatgggtgcaatcagcattgaaaaaacaagacagtgcaaagagaccaaatgtacaactcaattgtgtggatgcaactgtaggagttggcatatcatgcactgcagaaaacccagaagaacgcattggtatcagagaagctgttagtcaactaaaagctgctagagactcttttgaatcagtctga

SEQ ID NO: 44717 - DNA, 5466 bp, Glycine max
  Peptide Sequence Number=SeqID_161495
atggcggaacacggaacccgccgtaccactactgatagacttgaagaagctatctccacccttaccaccaaacactctgaattagctaataaactcgatgtgccgtgtttcgacggccatgatccgcttggatggatctttaaaatctcgcaatttttcgagtatcaaggcactccagaggaagaacgtattacagttgcctcgttctacctcgacggcgcagcacttagctggttccagtggatgcatcagaacggttttattacctcatggccggcgttacttcaggctattgagacacgctttgcaccatcattttacgatgaccctcgcggtgcgttattcaagctgacacagcgagcttcagtcacagaatacttgacggagtttgaaaggctagccaaccgtattgttggtctttcccctcccatgctattaagctgttttgtatctggtttaaacacagagattagacgcgaagttcaagcatttcaacctgtatctcttccccacgccatggcactagcacgtctacaagaagacaagttgaatgatcgtcgaaaacattcacgaacctctcttcccccgccacaaacaccttctccctccctcaccacacaacaccaaccacctcgaaccaaaccaccattcggtcgtgtacttctattcattgccgattccgacgaagcaagctctatggacaacccttcaatggaggacccagctccacccacccaagctactttacccccattcgaccccactcctctccttccacacattagtcttcacgctatggctggtgttccggccaccgatacgttccgactctacggcgtgatcaatcacactcgcgtcaccatcttagtagatagtggcagtacacataacttcgttcagccgcgaatcgcgaaatttctgggcctacctatggaagatactacttcccttcaggtgatggtcggaaacggctcggtactcgagtgcaagcagtcgtgccccgccaccaccctcctccttcaacaacactcattcacggtgacactacgtgtcctcccgataagtggcgccgacgtcgttttgggtgttgaatggctaagaaccttgggcccaattattaccgactacacctccttcactatgcagttcacccacttgggccagcccattatcctccgtgctgacgttactacatgcacagacacagcctcggcccatcaagttaagcgtctccttcacactcactcactctcaggcctcttccacttatcactcctacccacccacatacccgaaaccgcccctgacccgccccaccctatatccgccattaacgagcttttgctcagattccacaccattttccagcaaccttcatcacttccaccccctcgtcaacatgaccattatataaacctcatcccatctgcccatcctgttaatgtcaggccctataaataccctcattttcagaaaaatgaaatagaaaagcaagtgtcagctctgctcgaatcgggattcattcagccgagccggagtccattctcttcacccgtcctcttagtaaagaagaaggacggcacgtggcgtatgtgcgtcgactaccgcgcccttaactccatcactatacgcgaccgtttcccgatccccaccatcgacgagcttcttgatgaacttggccatgcttcatggttttcgaagcttgatttgaggcaaggcttccatcaaatcttgatggcagacgcagatgtgcccaaaaccgcgttccggacccatcacggacactatgagtatcgcgtgatgccctttgggctgtgcaatgctccgtcgacgttccaggcggccatgaacgccttgctcagtcccttcctacgaaaatttgcagcagtcttctttgatgatatactaatctacagtaagtctctccctgaccatcttcaacatttagaatgtatcttccatgctctctcacaggccaaatattacctcaaacgttcgaagtgtttgatcggacagcgcaagcttgactacctgggtcacgtggtttccggtagcggggtacaaccagacccctccaaaattcaggctattaccgattggcctattcctctcactccgaaggaccttcgcgcattccttggtctcacagggttctacaggaaattcgttaaaggatatgcgaccttggcggcgccattaaccaaacttctctgccgcgatgccttcaactggacatctgagtctcaagttgccttcgaagctttaaaggaagccatggtaaccaccccagtgcttgccttactagatttcacacacccttttgccctcgaaacagacgcatcaggtatcgccatgggagcagttctccagcaacataaccaccccattgcttattttagtaagcccttttgccctcgtcttcagcacgcctcggcatacgtacgggagctacatgccatcacggcggcagtccgaaggtggcgccaataccttttaggacacaggttcacaatattcactgatcatcgcagtctccaggagctgatgtctcaagtggttcaaacgcctgaacaacagttctatctagctaagctattagggttcgattacgacattcagtacaaggccggttcatccaatgtcgttgccgactctctatcacgcattgagaaccttcctcagggccagtgtctcatcctctcgattcctcacgaagacttcttggtacaactcaaagcttcattactcacgagtccggagtatcatcaacaactcgaggccatacactcccatcccgatcaacaccgtgactttacactctccaatgaccttatattcttcaaaggcgctatctggataaacccccagaacccattcataccatcactcctccacgagtaccatgcaacacccattgggggtcactttggagtaaaaaagacgttgcatcgcctgcgttcgaacttccattggagttctatgtcaaacgacgtcaaggcattcattcgcaagtgcagtatatgccaacaagtcaagcaccttactcgcaaaccagcaggacttctgcaaccaatccctatccctagcaacatctgggaagatttatctatcgatttcatcacgcacctcccgagctcacatggcttcacggtcatcctcgtcgtcgttgatcggttctccaagggtgtccatctcggcgccttaccaacacagttttccgcctttaaggtagccactttattcgttgatacggtttgcaaactccatggattcccacgaagcatcatctctgatcgcgatccaattttccttagctccttctggcgtgagctctttcgcctctccggcacgacactgcgcatgactacagcataccatccccaatcggacggacaaaccgaagctatgaatcgtaccatcgaaaagtacctccgttcatttgttcgtcagcaaccctcaaattggtacaaattcctggccatggcagaatggtcctacaactcctcaccccactccggtaccggcatcactccctacgaagccgtctacggaaagcctcctccatctatccctcgctacctcctgggttcttcctctaatgaagccgtcgaggatgtgctacgcacgcgagaggagattcacacactgctcaaacacaagctcatcaaagcccagctcgccatgaaggaatttgcagaccgcaagcgtcgcgatgtccaataccacgaaggacagcttgtctatgtcaagcttcgtccttatcgtcagaactccgtacggcctaacaagcatcacaagctatctaagcgttacttcagaccatttcgggttttagaatgcattgggaaagtcgcataccgtctgcaacttcctccggggtctaaaatacaccccgtgtttcattcttcgctccttcgtcctcatcatgggtccctcgacttacccacctcctctcttccaccagagactcttcacaaccaacccgtccttgaaccattaaccatcctcaacactcgcattgataccaccacttcaccacccactcgttgggtactcgttcagtgggtcgacctaccaccagaagactccacctgggaaaaatgggaccttattcgtgatgctcatcaccttgagggcaaggtgagttttccaggggaggatattgttagtacagacccaatagctcgaccacgaagggagatctcacgccctaaacacctcgaagactacgtggttcaaaagcactcctcagagatcttccacacacacattcttggagagtcaacagtggttctttgtggccctggagcaaacaaatttgtctccaccaatgagacaaagcttgtcaaggtctcgtacatgaaaactcagcgcaggttcttcatcattcctgatcaaagacatgcacctatgccaaaaccaacacaagaagctgcatctgctgctcctgtgaagatcttggggattctgaaacctgagggaatatctaggtacatggggaacaagattgaatccaccatgaaccaacatttcattacacactgggaaggaaaaaaagaagtgaaggtgtaccctttggtgaaggccttttcccttacacttggatgccaattcttcttaggaattgatggaccaaaatttgccagtgagtttgagaacttgtattttggtatctattctgttcctgtgaattttccaggctccacataccatagggcactgaaggctgcagctgctataaggaaagagatccaaattctgatcaaagagaagatcgatgctttgtccaaggggcaagttgtggatgacctaatagcacacgtagttggtgctgagcaggatggaaaatatgtgccaagacttgaaataagtaacatcatcatggggttgatgaattccagccacatgccaatagctattaccctggctttcatgatcaaacacattggacagaggcctgatatctaccaaaaaatcttatccgagcatgctgatattacaatatccaaaggatccggtactgcactagattggaacagcatacagaaattgaaatacacatgggctgttgcacaagagaccatgagactctacccaactgcaccaggtgcattcagagaggcaataacagatataacctatgaaggttttactattccaaaggggtggaagatcttttgggcatttattggaacaaataagaatccaaagtactttcatgaacctgaaagttttgatccctcaaggtttgaagggaatgctcctgttccatacacttggttaccctttggagctggaccaagaacttgccctggaaaagactatgtacggtttgtggtcctcaatttcattcacattctcataaccaagttcaagtgggaagctatacttcctgatgagaaggtttcaggttcttcgatacctatcccagcagagggaattcctatacgtcttcatcactactaa

SEQ ID NO: 44718 - DNA, 1722 bp, Glycine max
  Peptide Sequence Number=SeqID_161496
atgtctacgcttgaaattgaagctcgagatgtcatcaaaattgtgcttcagttttgcaaagagaattcgttgcatcagacttttcagatgctgcagaacgaatgccaggtttctctgaacactgttgacagcattgaaacctttgttgctgatattaatagtggaagatgggatgcgatattgcctcaagtttctcaactcaagcttcccaggaataagttggaggatttgtatgagcagattgtattagaaatgattgaacttcgagaactggatactgcacgtgctattttaaggcaaacgcaggtgatgggtgtaatgaaacaagagcagcctgaaagatatttgcgtcttgatcatctcctagttagaacttattttgatccaaatgaggcttatcaagactcaacaaaagagaagcgacgtgcacaaatagcccaagctattgcagcagaagttactgtagtgccaccatcccgattgatggctttaattggtcaggctttgaagtggcagcagcatcaagggttacttcctccaggaacgcaatttgatttgtttcgtggaacagctgctatgaaacaagatgtggatgacatgtatccaacaactctttctcacacgataaagtttgggacaaaaagtcatgcagaatgtgcttgcttttcaccagatgggcagtttcttgtatcatgctcagttgatgggtttattgaggtgtgggattacataagtggaaagctgaagaaagatctacagtaccaggctgatgaagtgttcatgatgcatgatgatgctgtgctttgtgtagactttagcagagattcagaaatgcttgcatctgggtctcaagatggaaagattaaagattttaggattagaatcccttcatccatacagataacccagccaccccaccctgtatttgtacctccttattcttccctcatcttttctggctaccaagtaccacccagcaacccgagtgttttctggccattggccaagcctgtccttttttttggcagccagaacttctgtactctggtctggcgtattaggactggtcagtgcttacggcgtcttgaacgtgctcattctcaaggtgtcacaagtgtttccttctcccgtgatggaagccagttattaagcacttcatttgacagcacagcaagaattcatggcctcaaatctggaaagatgttgaaagagttccgtggccatacatcttatgtgaatgatgcaatttttacaaatgatgggagtcgtgttattactgcctcaagtgactgtacaatcaaggtctgggatgtaaagactacagactgcatacaaacttttaagccacctcctcctttaaggggaggtgatgcttctgtcaattctgttcacattttccccaagaatactgatcacattgttgtttgtaacaaaacgtcatccatatatatcatgacacttcaaggacaggttgtgaagagcttctcatctggtaaaagagaaggcggagactttgttgcagcctgtgtttcacctaaaggagaatggatttactgtgttggtgaagacaggaatatgtactgctttagctatcaatctggcaaattggagcatctaatgaaggtccacgagaaggaagttataggtgtcactcatcatccccataggaatcttgtcgcaacatttagtgaagactgcacaatgaagtcgtggaagccatga

SEQ ID NO: 44719 - DNA, 252 bp, Glycine max
  Peptide Sequence Number=SeqID_161497
atgaagagagaaagagtggcgaagacttctgtgtgtgcagtccgtgttgtcgaaacgttagagggagagagaagagagactgacccgaccctgaatcaaaggaacaacaatacaatgaagcacgacacttcactcccttgtcgcgcgttgtcagacaccgacacaacacaacactctaccacgttgttctatattttagatattagagatgttcaggtgtccgtctggtgcttcatagcaacaatatcatag

SEQ ID NO: 44720 - DNA, 660 bp, Glycine max
  Peptide Sequence Number=SeqID_161498
atgagaggagagagaaaagatagagagagaaatagtgggtgggagagagttagaactaggagggagaggagagagagcaacaaagagagagagctagagagggtcaatgtctgcattttgccggcaacaagagaggacataaacaaggctacactcgagttcaaaggagtggaggatttggagcagttagagaagaagttagacaacattgtctttggagggctgaagatgtttgtcaaaatcccaaaatttggaagagatgtcaaaggaaagccacaaccagtaacttggggatgcccgtacactaagtcaaatgaggaggagagcagagatacgaacctgagagtgcagcaaagagggtacctggggaagaagagtggatcatatgcggaggcagtcaagagggaaaatacaggagcagaccaacggagaccagcaggcaaaagggagttatctggccattggtcacagtcagaggtgcacctagacatctccttgacagagcataaatggctcacagaagcaagggtagggcggttaaaaaacttgtcattgtttgataaagtagaggatgacattctatgggatttaggagctaatgtatcaccgaggtacatcggagacgatatgatattgctcttaggcctcacagacgactag

SEQ ID NO: 44721 - DNA, 2469 bp, Glycine max
  Peptide Sequence Number=SeqID_161499
atggggatatgtacctcgaatggaaggggaaagaatttgcatgagaaaggaaagatgagagtagaaaggaccattggggtggtggggaaggatgttttaaacacagacaagccatgtgaccaagaggcagaaaatacaaatgggctcatttcttctattcacacccccaccaagctaatagacaaaaatatcaatagcccatccacaagtcagaagggcccaaatacctcttccaaggtgtattatagaaaacgtgggtgcaacaagcaatctgtttcagttctggaagatgacatgggccaacaaataacaccaacaacacccaaaatgcaagggaatgtacacaaactggacaggaaccatgaacaaacggctcatcagctctcaacacagatagcagcaattgacaaagcaaaaatcattcaagttggaaaggaagatcaatggggttggctttataatgttggtggggaagtggaggcagaagacacaaacactttacatcatcaacatttattcacggttaacaattctagggagtttaatgattggattgcagaattggaggtaaaggaagcgtcgtgggttggaagaaagttcacatgggtcaggccaaatggaacaacatggagtaaattggatagattcctggtatctgcggagtggcttacaaaatggccgggaacatctcaatacacactggatcggaacttctcagatcattgcccattattgcttaggtccaaatatgttgattggggcccaaaacctttcagaattcttgattgctggttatttgacaactcatttaagaaaattgtacatgagagttggtcatctaaccagcacagaggatggggagggtatgtgctaaagcaaaaaattaaatctctcaagaacaggctcaaggtgtggaacagagatcagtttagagatactctcaggaagtataagaggattgaggaagacttaaacaagatgaagaggtctaggtggattaaggaaggtgattgtaattccggatattttcatctcctgattaatgcaagtcgcagaaataatggcctacaaggagtgatgattgatggggcctggagtgatgatccaaaaatagttaaagaggaactcaagaggaggatgaggtcaaaagggttgtgtggagttgttggagtgataaaagtggttgaagaagccaaacgatgtcacatgccatgcattgtattcaaggttgactatgagaaggcgtatgattcagtatcttgggagttcctcacttatatgatgagtaggatgggattttgcagaaaatggatcaaatggattgaggggtgcctaaaatcagcatatgtttcagtcttggtgaatgaggcactaaatggcctcatgtcacaagctcaggcacaaaggctatataagggatttttagttggctctaacaaggtggaaattagtacccttcagtatgtagacgacacaatcttctttagggaggcaacaatggaaaatgttagagcaattaaagcaatgttgagggcctttgaacttgtatcgggcctcaaaattaattttgctaagagtcattttggtgcttttggggtgtcggatcagtggaaaatcatggcagccaattacctcaattgtagtctgatgtcctttccgttcacatacctcggtgttcctattggtcatcagggggagttgtgggccagggtactggaatcaaaatacgggggttggaggaatctagatgatgcactgagagtcagtagggaatcaatatggtggagggacttaaagttggtgactcaacacccgcaacatgggcatatattgaacaattcaacattatggaaggtcaattgtggggataagttcgaattctgggaggacaattggttgggtggagcgggctctttactagacaagtatcttaggttgtataccatttcttctcaacaaaatcaaattatacagcacatgggaactgtcaaagactcagggtgggaatgggagttcaggtggaggagaacaatgtttgataatgaattagacatggccatatcatttctaaaagatgtggagagccataatattcaacagcaagagagagatcaatgggtgtggatggccgattccaatgggcagtactcgattagaagtgcctataatgtgctgagagatgatatagcagaagagatacatgatggagcttatgaggaattgtggaagctcaagatttgggttcatggttgcgcggagcacgattgcatggttggtggtgtgcatttcgtggaggttaggtatggtgtttgggtggtgggtgtggatctaggttcatggaggttggtggtgcgtggtgatgccttttttgggtttgtgtggaggttggtgatgtcacggggtagaaggttaaagaaagctaaaagaacaagggtagaaggtcaaagaaagctaaaagaacatgttgac

SEQ ID NO: 44722 - DNA, 153 bp, Glycine max
  Peptide Sequence Number=SeqID_161500
atgacaaatattcgacttacagaagcattggagcagaaaagtacagagcagaatctgaagccagagcagttggaaaagctagcaaaattagaagattggcatagggagttaaagctattggaagatgagaagggtgaaacaaccgtatcatga

SEQ ID NO: 44723 - DNA, 852 bp, Glycine max
  Peptide Sequence Number=SeqID_161501
atggcttccgcctccattgttttcgctccccaaaccttctcttccgctatctcttgcaagctcaccgacgacaaatttctcacctggatgcagcttgtcgaatccaccatcaaaggtcaccgcttgaaacaacacattgttggggattacgcgattccctcgcggtttctcaccaaagaagatgaagcaaccaattccgttaaccctgcctatgaaaacttcgagcagcaggataatcttctcaaatcttggcttcttgaatcaatggacaaccaatttcgcgttggcgtcgttggttgcatcgtagaaacccttggcgcaatcggctctcccttaacagatgaagaacacatcgatgcgatctttgatggtctccctgaagaatatgatggactcatcacctcgtgtctcacgcgatctgaaaccttcactgttcctcaaatcgaagcctccctcatgcatcaagaagaaagattggagtgtagatcaggaactcatggcagagggcgcggtggcaggtccacttccaccttttccactcaaggtcgtggtccaaagcttcaatgccaactctgtggccgtgttggttactatgcatttcactactggtaccgctttgatgaaaatcttatcgaaccaacaccctatgcgacccacaacccaaatgacaactccaacaaccactctgctcaggctatgcttgccactgcttccaatcaagttgatgattcccggtatcctgacactggtgccactcattatctaacacatgatcttggtaatctcatgataaagaatgcatacaatggaggaaacccagcaggttcttcttcaaggtcatctcaaggataa

SEQ ID NO: 44724 - DNA, 1245 bp, Glycine max
  Peptide Sequence Number=SeqID_161502
atggtggctcaagggttctctcaaagaccaggccttgattacaatgagacattcagtcttgttattaaaccagccactattcgcatagtcttgagcattgcagtcaccaaaaaatgggatatccgacaagtggatatcaacaatgcttttctaaatggaaccattcaagaggaagtctacatgcagcaaccagaaggtttcacttctgccaattctcatcttgtttgtaaactgaagaagtctatctatgggctcaagcaggcaccaagagcctggttttccaagtttgcatctagtctaatttcttttgggtttaagccaactaggtgtgatacatctctgtttgtgcatgctacaccaaaatttatcacctacattctggtttatgttgatgatatcattataacaagcagcttcacctttgcagtccaatctgtgatttctaaacttcactctctgtatcctctcaaagacctaggcaccttacatttctttctaggcatcgaagccaaatacaccactactggggctcttctcctatctcaatccaaatatatcactgatcttttagccaaagtcaatatgcataatgccaaacccataaagactcctctggcccctggttcaaaactgcatatggatggtacaaatgccttttctgacccaactctctacagatttgtagttggagccctacaatatgccaccatcactcgtccagatatagcttatgcagtaaataagctttgtcagtttatgcacaaccctcttgaaagtcattggaaagccacaaaacgtgtacttagatatctcaatggcacagttgatcatggaaacaatcttgtgtcatggcttgcaaagaagcaacagtcagtctctaggtccagcactgaggcagaattcaaaagtttagcaactctagttgctgaaattaaatggctccagtctctccttacagaattacatattgttcaagcaaagcctcctttgctatggtgtgataatcaaggtgcagtgatgataacagttaatccagttctgcactccaaatccaaacactttgaattagatctttggtttgttcgtgaaaaggctgccaatggtgaaataattgtcaagcacatcccctcccagtttcaagtagttgatctgctcaccaaggctccttcaagcaatacctttttaagccttcgactcaaactaaatgttcatcaactacccacactcagtttgcagggggtgtaa

SEQ ID NO: 44725 - DNA, 372 bp, Glycine max
  Peptide Sequence Number=SeqID_161503
atgaagttctttcataatggccacattattgaacttaaaggtgatgatgcctctacactccaccttctttcttcaactcagcttcgacgtcttgttcgtacggaaagttctagtgcatattttcacatcaccatgaatcccattaagcttccttcctcccaacatccttcaagttcattgctcctggaaattcaatctctgattaccaaatttactcccatgtttcaaccccatcaagccccaccaccctctcaacccatcagtcaccatatacacctcgttccaaactcagaacctgttaacgtctgcccatatcactaccctcatttccagaaggccgaaatcgaagctcaagttgactccatgctttag

SEQ ID NO: 44726 - DNA, 948 bp, Glycine max
  Peptide Sequence Number=SeqID_161504
atggggcctaatgattgtaaccactggactcaaaggaccaggcactggtcatttccaaccatgacttttaaaggagttgtgtctcgagtgagaaggcccaaaccggagaccaatgattcttggataaagctgtctagcgtatcgggaggttcgggtgcaaggcctaagtcgatatattcatcaaagcaactgaagcaaagaccatgctcgcatcgtgaagcaagttcctccggtgtcaaacgcttaagaggaactggtggaaggggcttggacaaagtgggtaacaacggaggcggcgaaagtggaactaatggtggaatggtcgtagaagtcgtagatgaaaaggaaacaccgcgaccacgaaacatctctgggctaagacccgagatgaaacaacttagaggaaacggtggtggcaagccaatgactctgttggccaagtctttgaactcagagagtgagttgaccattactggtcatccattgaaaccaggacaaagtgcgaccgtctatgtagaaggatgcaatggtcagcttctcgtggtcaggggtgttgtgatattcaaagaattgagttatcttgaatatccagcccaaaggatcgattttgtcaaaacgtggaacatccaacttcatgtggtgggaaggggattttggtgtggcgaggttggtgatgagctcgtcaagtttgagagtcattgtttgaaagttttcgctcaaagacaattggtgagtgacaagatcaaggaagctatccccccaagcaaccaactcaacaaaaacgattacacaaaatccttgagtcatcccagcgacgactccgtcgtgcccaccgtcacattgccttttcgaccaccaagaacaaaaaccctagccattgttctgaccaccaccacatatccgatctcgtgccctttggagtggtgtcgtgaccttgcttgtgtgaag

SEQ ID NO: 44727 - DNA, 510 bp, Glycine max
  Peptide Sequence Number=SeqID_161505
atggggagaaagcatggtccatgcttccattgcaaaattcatataactccactttggcgtaatggacctgaagacaagccagtattgtgcaatgcatgtggatcaagatacaggaaatgtggaagtcttgagaactatcttcccaaccattttcaaccagagtaccctgataaccttaaaatgctgaagcgtagaaaaactctgaagggtagaaaacatttgaagggtagaaaaaatcttcttgtttcaagctatgttacaggtggaaaaggtcgatatttatgcagccctaagattcctacgagaaaacgttcaccattggtacgcaagaagataacaccaatgaagaggttttatatgcaacttcaaaatatgtgggaagattacgggaactcgaatgagtcctcctcagaagaggtcttaattttcaataacgtcaataacttcatacctagtaatgaaataggccttggatgtattcctcttaaactagatgatgcttctgcatag

SEQ ID NO: 44728 - DNA, 465 bp, Glycine max
  Peptide Sequence Number=SeqID_161506
atggtttcatcagcttctccacattggcgtagtggaccagaagacaagtcagtgttgtgcaacgcatgtggactaagatacaccaaatggggaagcattggccttcagaactattttcccaaccattttaaacctgagtatcttgataaccttaaaaatctagagggtagaaacaatgttctccaaggttcaagctatgctacagattcaagtggaaaaatccatgttatgtggaatccttatgttccatcaaggaaacgttcacgcgtagtacggatgacaacatcaatccaaaggtttcatgaacaacttctcatgatgtggaaaaatgaagagaactcaaatgatcagtcatcccaagaatcagaagaggtcttattgattgataacgtcaataacttcataccttgtaacgaaatagggcttggatgcattcttcttaaaccagaagatgcttctgcatag

SEQ ID NO: 44729 - DNA, 435 bp, Glycine max
  Peptide Sequence Number=SeqID_161507
atggcgggactgcccacgttagcatgtcccccgccagtgccaatgacgggtctctctcctccctccctgtcccgccagcaccaatggcgccccttaaaggaaatttgccgatcttttgatacctttcccttgcatatactgtactacaacctgccaccaccaccagggctggagcttagtattagcttgctctcaaagtggaagtggagaactctcaatgataaggagtttctgtggtatcctttactgtgttataaatacggcaaagcagatgttatgtcgttatctagaagaagctggccaaatgcatcacaatggtggagggacattcaggatacgagttacaggtttgaaggtgtatatggatggttcgaggatcttgttcagaggaaggttgggagtggtaatcaaaccgctttttggagccacaaatga

SEQ ID NO: 44730 - DNA, 285 bp, Glycine max
  Peptide Sequence Number=SeqID_161508
atgaaattgatggagaaaggaaatgagaatcggaaccgagaggagggcttcgggaacgattctgcgaaagagatgaagctggtggaggcagagtcggtggaagtcggtgctgggaagcaccagtccgctctggcgctcgttctcgagctgctgggtgaattggacgggggaggtggaggctttgcgaatggcggcggcgactgcggcggcggaaggcacggtgaggcggagggcgtcatcggaatgggaggtagggttggggttgatggtttggaggaagcatga

SEQ ID NO: 44731 - DNA, 1365 bp, Glycine max
  Peptide Sequence Number=SeqID_161509
atgtggttaaggagctatgttgtttgctttgttcaggtgtatgttagaccagctggtagttatgtgatggatcggttggagctgcggcgggttgcactgtaccctggagatgcagaggcagagggcattgtcattcttgtgggtcattttaatattcctgcaggcttgcgtgctgccgaggccacgctttccaattcacaagttaatgttgtccctgaatgtaaggctgtggttcttccgatggtgaaacacccatttgttgttggtttcttggttgctgagcttccattggtggagcaggaacagtgtcagaaatctcaaagtgatgggccagaaaacctcatgtctgttgaggaaccttattcatttcctccctttttggatttagataagaagtcaagggaaattcagaatcttcaggtcaagaatgaggcagttggtatgcataacttcacttctgagcaaagatcaaatgctgtcaacatttcacagtctctagctatggcatatgtcatggatcagatttcacatgacattgttgaagacctcttggtgcaaggtgatcgtctgagggatgttctccaacaactacaggatgctgtttatttgacaaagacaaatatagtgcgctacaatgaagaagcaatcaagaaaatgaatggttctactcacatacttgctgaatcatcaagatctcagttgttagatagctctccaggtgatgtctctgcaaataaaatgaaaaaatctagtgagtcactatctctaagtgctgctgtccaagatatagagatgccactaccacctttggcccttgctccattgcaacatggaatcagatcatgcaatgtttctgaagtattggcagacttggttgattcagtgagaccacttgcccagggtcaaaaacgtgtagtagaactaagtgaactctcatcatcacctttgctagctgctgtagaagaacctgcattgcgccaggctttcagcaatcttattgaaggtgctttactacgcacacatgttggagggaaggttgaaattgtatctacggcagcaccagctggtggtacccttgtacttattgatgatgatggacctgatatgcactatatgactcagatgcactcactcacaccttatggacaagaactgttgtctgataatatgattgaagacaatatgacttggaactttgttgctgggttgactgttgcccgtgagatactcgagagttatggctgtgtcgtccgcattgtttcgcctcggattaaagatgctcctcttggagctgggggaactcgtgtggaactctggcttccttcatcaattgtacaatctgatttgagtagccacgcccaagag

SEQ ID NO: 44732 - DNA, 423 bp, Glycine max
  Peptide Sequence Number=SeqID_161510
atggagacaagctcaatggtaatatctggagctatgtctgtcctgaatgatgggcagaaagctatgacagtgctggaagggaatagtgagtggcatatttcggagcctagaaaagggaaagcactagccctcttgtatgcaagtcaatggtgtgctgagaggggtgtgcaacaaattatcttcaagactgatagcaaaaaggaaggctcaaaggtcgtacatcatcatgaacaacattgggcacttggtgaggaatgtcatcaatccaatatatatcatctaatacttcccccaagtgctctaaaagacagtatattttggaaagcccttaatgccaagttgaagcacttaggagcagtaggaactgttcacagcttcttccactaccttccctccttggacaacactttcaagagtgtgtag

SEQ ID NO: 44733 - DNA, 1146 bp, Glycine max
  Peptide Sequence Number=SeqID_161511
atgtcgaaaccctggggcaacatcggagcctgggccgccgattccgaacgggccgaggccgaggaggctgaggcccaggctgcggccgcggcggtcgagccccaaagctttcccagcctcaaggaggccgtgaactccaagcccaagaagaagaagggaaccaccatcacgctttccgagttcaaccgtggcggtttcgaccagggccttacgcgtgacgagatgctcgcccttcccaccggtcccaaggagcgttccgccgatgaaatgccgttcaaccgccttggcggcggtttctcctcctatgaccgctccggcggtcgctcgcgcgaccgagatggcggcaacaacgaaggttcgtggggcggaggaggcagaagatcctacggcggattcgacgaggagcgcaggggtccgaatcctagggtttcggaactcgatcagccgtccagggctgatgaggttgataattgggcgtctgtgaagaaatctctccctgccttcgattccggtcgccagaatcgctttggtggcggcggttatggcggttctggtggtggcggttttggtggcggcggcggcggtggcggttttggtggtgcgtctagggctgatgatgtggacagttgggcggctggtaagaagcctgttcctgttagatcttccaatttcggttctggttttcgcgattccggagtggagcctgatcggtggacgagaggcggtccgccgcgtgaggttgaccggacggagcgaccgaggctggtgttagatccgccacgaggcgatggtgtggtgaacgagtctccggtgaaggcatcgaataaggcaaatccgtttggcgcggcgaggccgcgggagcaggtgttggctgaaaagggtttggattggaaaaagatggattcggagattgagacgaagaagacgagccgtcccccgagttcgcactctagcaggccttcaagtgctcagtccaatcgctctgagggtcccgggttgcaggggaccgatgctgtggtgaaatcgaggcccaaggtgaacccctttggggatgccaagcctagagaggctgtgctgggcgagcgaggcatggattggaggaaaattgatcttgaattggagcatcgctctgttgacagtggatga

SEQ ID NO: 44734 - DNA, 1494 bp, Glycine max
  Peptide Sequence Number=SeqID_161512
atgccaaacgacgacgtttcggctctcgacggagctttccacttcggagccaccgccggagccggcaaggacttcggcgggatgaaatccgctaagcctctggcggttattcgccccgccgtcgccggtgacgtggcgagggcggtgaaggcggcgacgcgcaaggcgaacctcacggtggcggcgcgaggcaacggccactccatcaatggccaggccatggcggagaacggcctcgtcctagacatgcgcgccatggaggaccacttcaccctcctctccctcgacgacgggtccctatacgtggacgtttcgggaggggcattatgggaagaggtcctcaaacgctgcgtttcggagttccgcctggcgccgagatcgtggaccgattacctcggcctgaccgtgggcggaactctctcgaacgccggcgtcagcggccagtccttccgctacggcccgcagaccgccaacgtaacagaattggaagtcgtcaccggcaaaggcgaaactttagtctgctccgaatcgcaaaattcagaactcttcttcgccaccctgggcggattaggacagttcggcatcataacacgagcccgactcccggttcaacaagcccccgacatggtgagatggataagggtcctctactcagaatttgcccacttcacaagagacgcagagtggctggtcactctcccagagggtgacggttttgattacgtggaaggtttcgttcttgtgaacagtgacgacccttgcaacggctggcccactgtgcccatgggccctaaccaatacttcgacccgcttcggatcccttccgctgcaggcccgcttctctattgcctagaacttgcgcttcattatcgtaaccaagaccatccttccgctgttgatatggaggtggatagattacttggacggctacgattcgtcgagggtctaaagttctgcgtggatgtgacctacatggaattcttgctacgtgtgaagcgtgtggaggaagatgcaaaagccaatggaatctgggacgcaccccacccatggctgaatatgttcgtctccaagtccaacatcgctgaatttgatcgtgaagtgttcaagaaaatcctcaagcacggagttggtggccccattctagtgtaccctcttttgcgaagcaagtgggatagtcgacactcggtagtggtgccggacagcaacattttctacattatagccttgctccgatttattccaccacccccaaagggaccacctacagaactgttggtggaacaaaaccatgagattattcagttatgctacaacagaggctttgatttcaagttatatctccctcactaccagtcacaggagaactggatgcgacactatggagataagtggaccagattcgtcgagagaaaggccaattttgatcccttggctattcttgcacctggacagaaaattttttcccgaatccctcaaaccttgtctatcacataa

SEQ ID NO: 44735 - DNA, 1203 bp, Glycine max
  Peptide Sequence Number=SeqID_161513
ttggtagatcatccttcccctcgcgcgcttgattcgcgtggcgcgtttgttgtgcacgtgccctctgctatatacgtgtggattgggaaggagtgtggctccgcaatgtgttgcaatgcaagatcagcggctgctcaggttgttcggtatgagagagcaacgggggagattgttagtgtggttgaggatgaagagccgaaggagttttggattgctctttctaccaaggaagtggtggtggagattatggagattgatgtggggattcgtcccaggagagttgaggagtatgatttagattatgggatttttcataaggcgcttgctggtggggttgttccacctttttctttgtctaatgctggatccgaaaattgccttcccgctagagaaaatgggtgggggagattgactaggaagcttgctagtggtatcatgaaaggcttgtttacatcctctaagtgctgtgagtctagtgtgaacatcattgaagaggggaatcaacatatgaatgttgatcctcttccaccttcttccaacaatgtgggtggttcgcggggttcctttgagtgttttggctcggagaggggaaaggataatgttcaagtcagggatcagtttgttgtccctagtgttgttggttcatcaatgccgctgccaccatcgcctcatcatcgagcatccgattcttttgcttgttttctaaggagcagccccaaattcagttccaactccccaactctgtcgcccaccagttcggattatgcaagttcctttacattttcgccttcatcgactgacttgtcaattgtgtcttctcggcagctatccccttctggtctggaatcagctgaacccgctcatgtgaaagacgcatcttcctcagagtttcgctccttagttaagaaagaaggtgagacatttctggctaatcacaccttggtaggagcaaagtccagtttgcggcgcaaaggaacttccctctccattgcagagcgcagagggaataaccccccacctcgcatgttgctaccctcagccagcgaatcatcccgtgccagcaaggtccgggtaagatccaggtcattctcattgcctgtcttggatgatactttgatgaaggatctgttgagagtaaggttaatggcagaggatcattgtaatatggtactgtgtcatgttaaggtaggttgttatgcttga

SEQ ID NO: 44736 - DNA, 681 bp, Glycine max
  Peptide Sequence Number=SeqID_161514
atgagaaaatgcactgtgcaggcattgggactcgccattgctttcttccttttactcatcctcttaaccccgtccattcctcagcctcagagataccatgatttcgctgaaaagcgcgaattctttggccttcctaatgcacctaacgtggtagcaaatttcccattcatggttattggtctcattggccttgtgctttgccaccgtaggaactattttaacatcagcatcagtttgcaaggtgaactatggggttggacatgcttctatgttgctgtgacttcagttgcttttgggtcttcatactatcatcttggcccagatgatgcaggccttgtgtgggacaggttcccgatgtctgttgctttcgtgtctctgttggcaatcctcatcattgaaaggttctttggtgacatccgtttatatgttctggcccaaggtgcatcatgcattgccatacctctcatggctactttattgcctcctatgtacacgcattcaacatattggctctggacttcaggattttatcttctagctacgctgcaagaggctgccgatagagtgatttatatattgacttttcacattattggcaaagtctgcttaacacgtaaagcatttcccagacactatgatcaaagaaggcatttgagttgtggaatgatctcagcaatgtga

SEQ ID NO: 44737 - DNA, 761 bp, Glycine max
  Peptide Sequence Number=SeqID_161515
atgtatcagagctgcattggctcacaccgcctcgcataccgctctcagatatcgaacctggtcaaagccggtctcatcaaccaagccatccacctgttcgaccaaatgacccaatcaaattgccgcgtcttcagcgtcgactacaaccgcttcattggcgtcctcctccgccactcccgcctccacctcgcccaccacttctaccgccgccacgtcatcccccgcggcttctccctcctccccttcacctactcccgcttcatctccgccctctgctccgcccccaacaacattaacctccccctcatccacaggctcctgctcgacatggacgccctcggcttcgtccccgacatttgggccttcaacacttacctcaacctcttatgccgccaaaatcgcttagaaaccgccctcgaactcttccactccatgccctccaagggaagagaccccgacgtcgtttcctacacaattattatcgacgcgctgtgcagagctaaacgctttgacgaggctgctagggtttggcgtcgtttgattgacagagggttgaaccctgattataaagcctgtgttgctcttgttgtcgggttgtgcggtggggggcgcgttgatttggcttatgagcttgttgttggtgtgatcaagggtggggtgaaggttaatagcttagtttacaatgctttgattgatgggttttgtaggatggggagggttgataaggccatgaagatcaaggcgtttatgagccggaacgg

SEQ ID NO: 44738 - DNA, 345 bp, Glycine max
  Peptide Sequence Number=SeqID_161516
atgttgcccccaatgaatgttcagatcaactggaagtacagtagtgactactcgggcgagtttaggcagactcgcgagtttgtgacgagtccgcggctaagctactcctttactcgcgagtcgcgactccgtgctgtgctgaagctaagctactcatcgtcgttgttctgctttgaaagccctcagtcgcatcgtcattgctggccctcaatcgcggtcctcgttgtcgctagtccttcatcctccgtcatcgtcgctgcctctctggtcctcactcgcgctccaaactttgcttcatgtcacgacactaaggtaatttctcctctgagtcctctcctttcatga

SEQ ID NO: 44739 - DNA, 141 bp, Glycine max
  Peptide Sequence Number=SeqID_161517
atggtggagtttgttggcgtccaagtgtttggaacactttcgggaggatggtgtcacaatgaggtggggcaatgtggtggtgaggaaatggctaagtggtggcaatggaggctcacaaagggttttgaaatcatggcttga

SEQ ID NO: 44740 - DNA, 2902 bp, Glycine max
  Peptide Sequence Number=SeqID_161518
atggcattagtagcccattatgatttggagctacatcagatggatgtgaaaattgtctttcttaatgggaatttagaggataatgtttatatggaccaaccctcagttgaaggaaaggaacacatgggaaatactattaatcggtgtatatatctgaagactgcgcttgaatatgccacagacagttggaaacatcattgcccaagtccttcaagggtcgatgatgaagagaggatagcagcccgtaaacctcatgcacctgtaaaggcctcctccacaaaaagctccactccaagcgggtttacttggatgagaggggaagaagatcatcaaatttctatcaagaaaattgaaactaggttggtcaccgatggtcggttaattaaagaaggcatgataggagccttggaactaaccaagaagatgtttactacaacatgtgtggggaagaggaacaaaaatgaagatcaaagagagaaaccaacaagagctactatggtaggagaggtgtgtcaaaagcgtgatttagtcatgagtgagagagattcacaaacacctggtgtgggtagctttctttacttgcatccaagcgaaaatccagcggtatcacttgtttcaccagttcttgattcttcgaattatcattcatggagcagatcaatgatgactgctttgagtgcaaagaataagcttgaattcatcgatggaggtgcaccggaaccgctaaaggctgatcaaacttatggagcatggaggcgctgcaacaacacggtggtttcatggatcgttcattcggtatccatgactattaggcaaagtattttgtggatggataaggcagaggaaatttggaaagacctaaaatccagatatgcgcagagtgatcttcttaggatctctgatctccagcaagaggcagcttcaattaggcaagctcaaagaaagcttaaggatagagcgattcaatttctcagaggattgaatgaacaatatggaaatgtgcaatcacatgtcctcctcatggatccgctacctgaaatatcaaggatattttcctatgttgcacaacaggaaaggcaaattagaagcaatttgatagctgctaataacatagacatgacagttccttcaaataacagtgaaaggaacaagtccagcagccataggagtaggaaaatatgtacttattgtggaaaaatgggtcacactattgatgtatgctataaaaagcatggattcccaccacgttacaagttttcaaatccaaggagcagtgctaacagcttggtggcaggagatgatgcagccaccaatgatcaaacacagcttttagagtccaaggagattcgtttttcacctgagcaatacaaagcatattttgctttaatccagcaaccaactgatgggaactcaactaacatgtcatccaatcttaaacagatagcctcctgttctgttgacacaaccccagctcatgatagaagacctcctacataccttcacgactatcatgcatttctcacttcaactgctaatatcaattcagcttcagtgagccatactctcgattattcaacttcagtgcgtcatcctctcaattctgtactatcttattcgcgtctatcatcatcccacagacattttgttctttccattactacatctactgagcctaagacatatgctgaagcatctcaacatggttgttggcttaaagcaatgcaagccgagttacaagctttacaaacgaataacacttggacccttacagatttaccagctaataagaaagctattgggtgtcgttggatttataagattaagtatcatgcttatggctccgttgaacgatataaggctcgacttgtagccaaagggtatactcaaatggaaggactagatttccttgatactctttctccagttgcgaagctcacaacagtccgattattgctagcattggctgctattcatggttggcaccttcgtcagcttgatgttaacaatgcattccttcatgaagaattaactgaagaagtctatatgcagctgcctccaggaatgcaagtctcacaccctaatcaagtttgtcaattacaacgatcactttatggtttgaaacaggctagtcgacagtggtttcatcgtttgtcctcatttcttcttactcatggtttcactcaagcttcagctgatcattccctctttctttgtttcaatgatacctcatttactgcccttttggtgtatgttgatgatatagttctaacagggaatgatataatggctatcaatcgtattaccatatttctggaccaaaccttcaagattaaagatcttggcactttaaaatttttccttggcatggaggttgctcgttcccagcaaggcatccatctatgtcaaaggaaatatgttttagatattctctctgattctagaatgcttgcttgccgtccagcttcaacacctatggatagttctactcatcttcaagcaggcatcgaagatcctttatcggctgaagactcctcttcatatcgtcggcttgttggtaggctcatctatcttactaacactagaccagatatttcttacgttgtgcagaagttgagccaattcatggctaacccaactactgatcactcaaaagccgcctctcgggttcttcgctatctcaagagtttaccgggatgtggcattttctttcctacaactggttcaactcgtcttcaagcttttagtgattccgattgggccgattgtcgtgacacacgtcgctctattacatgcttctccatcttccttggtaattctctcatatcatggcactccaagaaacaatccactgtctcacgaagttcatctgaagcagaatatcatcctttagctaccaccacat

SEQ ID NO: 44741 - DNA, 318 bp, Glycine max
  Peptide Sequence Number=SeqID_161519
atgtggatgtatgatcttgatcttgctatattggaagagaagcctgctattattattgatgctagtagcaatgaagagaaatcctattataaagttttgaaaaaatctaacagactcaacctaatgttcatgagaatgactattgcagacagtattaacacaactctccttaagagcgataatgctaaagtgtttatggggttagtggaagagcgctctcaaacaactgataagtctcttgctgggacattaatgagttcagtaaccaccatgaagtttatggttcacgtactatgcatgagcatgtcattgagatga

SEQ ID NO: 44742 - DNA, 135 bp, Glycine max
  Peptide Sequence Number=SeqID_161520
atggcaaagaccatgtcaaaggtcgcagctccaccagatgttattttaaacactgttagcgccaaggaccagatttacggtgaagttagtatgtcatttgctgtcaagtgggaggacgtacttgacggcttatga

SEQ ID NO: 44743 - DNA, 279 bp, Glycine max
  Peptide Sequence Number=SeqID_161521
atgtccaaaggtatcacaaatgctaaggattttgttgatgaactagagaaacgctttgcaaaaagtgataaggcaaaaccaaatacattactacaacacttgatttccatgaagtataacggaaaaggaaacattaaagagtacatcatggaaatgtctcatatagtttctaagcttaaaggactcaagcttgaactatctgaagatcttttagtacatttggttttgatgtctcttcttgtgcaatatagtcaattcaaggattacttgaattactga

SEQ ID NO: 44744 - DNA, 774 bp, Glycine max
  Peptide Sequence Number=SeqID_161522
atggggtggccggcgtctgcgccggccggggcagggggcgcaatggacatgcaggcagggggcggattcgatccgccggcaaagaccgattcgcaggaactgacattccactggctctaccagcgggtgcagggactggttgagcacagcatctaccccaaggcgggcagggtggagacgtgggcgtttcgcatcggcgtgggtgcggcgatcatcggcattctcatgggtcagcttccggatcgatggctgcctcttggcgtagtgctccaggtggttgttgcctgcctggcaatcgaaataggagggttcattgtcggtggcgtcctggccgcccgcaggggcattcgccagttcagccagccgcggctctcgcacgcccgggagatggatgaagacttcgctcactggcaagcggtggtgaccgagcttcgcggattcccgcgcgtccagcgcgagcggcgactcaagttcgtcagcaccttgcgcacaaacatgatggagcgcatgggcatgatgtatggcggcctgcagcggctgggaccattcccactgttgattgccctctacctgcagttccgcggatggaaatggggcgactgggcgggcgctttcgatgttggcccgctgggtgcactactgatcttcgccatggtgctgctgtacctgctgggctggatgctgatcggccttcgcaccaggcttgatacctacgttgccttgttggagggctccatccacgaacccgagccctcccagcaaacgcctttgtag

SEQ ID NO: 44745 - DNA, 519 bp, Glycine max
  Peptide Sequence Number=SeqID_161523
atggtgaaagttggaacctcttacgtgccgatcaacgtctcatttcgccaaaaagttggcccagggcttcccggtatcaacagggacaccaggatttattttattctgcgaagtgatcttccgtcacagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgattgaaagcgtggcctatcgatcctttagtccttcggaatttgaagctagaggtgtcagaaaagttaccacagggataactggcttgtggcagccaagcgttcatagcgacgttgctttttga

SEQ ID NO: 44746 - DNA, 132 bp, Glycine max
  Peptide Sequence Number=SeqID_161524
atgaagggtcgtgcaggttcttacaaggaacacagattgcatggtgttttcactgctgaccattcaaagaagctagataaagatatagcaggcatttttccttttcctatagaacattgttattgttcatga

SEQ ID NO: 44747 - DNA, 198 bp, Glycine max
  Peptide Sequence Number=SeqID_161525
atggtgataaatttgcaaataggaatgatgtgcaaggttatcagacccgttgtaaaaatggtaacggtgcgcacagtgttagtcgtagcagccacacaagcttggaaattacatcagatggatgtgcacaatgcatttttacacggggaccttgaggaggttgtgtacatgaagccgcctcctggctttcttccttaa

SEQ ID NO: 44748 - DNA, 1044 bp, Glycine max
  Peptide Sequence Number=SeqID_161526
atgtctcgtcgagaaaccaaccctcatttttcaagatcatcacagcctgaatatatagatgatcgtgataccgaaccttatccacttgtgccacgccgaaaacgccgagaccaaccatccacacaagtagctccacctataccagttgcattgccagctgagcatgaagatcgtgttccattacgaacacgacctcagcatgaagaccatgttccattgcaacctcaggtagaagatcatccacacccaccaccacctattctccaagaacctcgccgtggcaagcaaagaagtccacgtagacagccaacaaatcaaggtttccggccggttaagtcaaaggtaaattttcaagaaccacctccctcggctgatgtccctccactgctgccaccgctgaactatccccccgagcatcggcaccagccacgccgcgatccccgcctcagcggtataaagttgcccaaggagcaaaagtctcaacccttgacatggttaggtgcttgcttgtgtgtgatattttggcttatcataatcataggaggcttaatagtccttatagtgtactttgtatttcgcccccaaagtcctcattttgatgtgtctagtgtgaccttaaatgctgcataccttgaccttggatacctactcaatgctgatctaaccatgctggctaacttcacaaatccaaacaagaaggtgcatgtggacttcagctcagtgatcatttatctctactatggaagtacccttattgccactcaatatgttgagcctttctatgctgcaaggcttcaatcaaggtttgcatatatccacatggtctctagtcaagttcagctgccattaagagagagccagaggcttgtgaaacaaatggaaggcaatggcgttatgcttgaagtgaggggagttttcagggcaaggtccaaattgggaaccatcttaaggtattcatataatctttatggccgttgcagtgtcatgctaacacgccctcctgatggtattttgctcaaaaagaaatgcagaacaaagcgctga

SEQ ID NO: 44749 - DNA, 777 bp, Glycine max
  Peptide Sequence Number=SeqID_161527
atggagaggagtggggtggagccggatttgtatagctataatgagctgttgaagggtttttgcaaggcaaatatggtggatagggcttatttgatgatggtggagaggatgcagaccaaagggatgtgtgatgttgtttcgtataatactgtgatcacggcgttctgtaaggcacgccagactaggaggggctatgagttgtttgaggaaatgtgcgggaaggggattaggccggacatggtgacatttaatgtacttatagatgcatttctgagggaaggaagtacccatgtggttaagaagctgcttgatgaaatgacaaggatgtgtgttcttcccgattgtatattctatacggcagtagttgatcatctgtgcaagaatgggaaggttgatgtggctcatagtgttttttgtgacatggttgagaatggggtaaatccagatgtcatctcttacaatgcacttgtaaatgggttttgtaaggcttctagagttatggatgccatgtgcctatttgatgaactgcagagcaaaggtttgtaccctgatggggtaacttacaagttgatagttggagggcttataaggggaaaaaagatttcactggcctgtagggtctgggatcagatgatggagagagaccagcttcttgtaaaggattcatacagaggactgtgctctaatggtttcttgctaccaatggaagtaatgctgcctattcaaatcccagttgttgtttcttcagatttcatattgagggtggctttgagttag

SEQ ID NO: 44750 - DNA, 561 bp, Glycine max
  Peptide Sequence Number=SeqID_161528
atgtccaaactagtccaagagtgcaatgcaataaggttggttaccactgctctttcacatgctggcctggaatcttctaatctcattgttggcattgattttacaaagagcaacgagtggacagggaagaggtcattcaaccgaaaaagtttacatcatataggaagtggtcaaaatccttatgaacaagcaatctcgattattgggaaaactttaagtgtttttgacgaggataacttgattccttgttttggatttggagatgcatcaacacatgatcaagatgtcttcagtttccattcagatgagaggttctgccatggatttgaggaagttttgtcaagatatagagatattgttcctcgcctgcgtctagcaggacccacttcatttgccccaattattgagatggccatgactatagttgagcaaagtggcggccaatatcatgtcctgctaataattgctgatggacaggtgaccagaagtgttgacacacaacatggccagctaagtccacaggaagagaaagacgaaattgatgctaattgtaaaagccag

SEQ ID NO: 44751 - DNA, 150 bp, Glycine max
  Peptide Sequence Number=SeqID_161529
atgacttatgaatgtgataactcactccccatgtgttgtttgtgtttggatcctgtgatgatctcaaactttgtgttcgtgggagtagatgacaaggtgaattgctttaaggaacctcatgctgaagaacgtcgagacataatgctctga

SEQ ID NO: 44752 - DNA, 183 bp, Glycine max
  Peptide Sequence Number=SeqID_161530
atggatgagagtgagaagagaaggagatcatggagtgcagtggcacatacatccacatgcttgttgcccattgccttctacgacgcatcgttagcagggaagatgagaatgaagtatttaaggaggcttgccgtaggaggtggaggcttgttggaagcgcttgaatgttgtcataaaagatga

SEQ ID NO: 44753 - DNA, 213 bp, Glycine max
  Peptide Sequence Number=SeqID_161531
atggtgcagctatggtttggaattagggtgaaagaacccggtggaccattcggtcctaaaatcaaatcttatttggagccccatgaatggattgtcattcatgcatcctccaccatcgagtccggagtcccacgaattgattgcctagcactgtttgtgcattctccaccatcaaagaaaggactagcaacattaaatgcttcaaatgtctag

SEQ ID NO: 44754 - DNA, 339 bp, Glycine max
  Peptide Sequence Number=SeqID_161532
atgaaactggccaaatacaggctaaaggcccaagtggagaaggacaaagcccccgagtggagaaggatgaaggcccaagtggagaaggatgaaggcccagaggcagagacactatcaagactattaattacttatcaaggtaatccttgtggcgtctatcctaacttatcttccttcaccggaagtggcgtctaccctgacttatcttccttcactggaagtggcgtcaaccaaaaactctacagcctgtatcaagcgatccgctcctactcaggttcacatcatctggtatcagagcttcggctcttgatacagtgggcctcaaacggacaaccgtag

SEQ ID NO: 44755 - DNA, 137 bp, Glycine max
  Peptide Sequence Number=SeqID_161533
atggatgattttagtgaggatggggatcaaaagttctttgatcacatcaatgaggatagcgatgaccaaagcaataacgagggtgttggcagaccaacgacacctccatcacctccattgcagtatcaccaacctag

SEQ ID NO: 44756 - DNA, 1293 bp, Glycine max
  Peptide Sequence Number=SeqID_161534
atgcaggaagaagaggagagacctcttataagaaaaagaaagttacctacgacttcgaccaagtttgctgaacaaacagaggcaggcaattcccaggctcaaatgcctaagaagaaaaagaaagtgaagcaggtcgagcctgaaccttctgtggctgtcgagggtggtgagccagccaagaagaaaaagaaaaagaccaagtcttcaaaagaacaaggtgaccatcaacctgttgacgtccaaccaccttcgaccgatattgacggcactgaggtaaaagctgctccttctattgctgagatgggcaaccctgtcgagcaaccgaactcaccacgagaacaacctaccgtcgaggtgcaacaaaatgtttctgcagaagaaataccctcatgtgcgcgaacatctcccgctcctgaggcggatgcagtgaatgttgaggaatggggtgaaggtcaaggcattggatccagtagtcctcatggttgggcagaggtcgatgaccctcatgagccgaaccagtcagataataccattcctcatgaatcgagtcagaaaagttcatctgaagaaaactttttcgatgaagacgccataaaagaggctgaagctggaggctcagacatttacccggtgtcctcaacatctaaactttccgctagtatagggatcgcagaggatacattcattcaaatgcaaaatgaagaccctgctgcagcccttcgactcctgctgaacacaagtcaagccaacacctcaagtgacaagattcctggtgcttcgtcctcatctgatgctgaaataaactcttcagtacgccaagattctctgctcttgaagttatcaatggaatacgcacggaaagatgtgcttgaatccattgaagagaacccctctgctgcctttgggcacctgaactttttgaagaaattgcacaacccccttacctctgatgagactctaggcaaagttatccaaatcgaggccatcattgaccaatttgcaagtgctgtgcagaaaaaacgcgaaaatggcacaagactagatgcccagaaacaggcacatacccttctgctcgagaaagcccgagctgctcaacatgaagtcgaacgtctcaccaaagaggcgaaagaagggtcttctgagatcaaagactgtgatgataacatctcctcctgggaggcaactattacggatctgctgcttcatatcgatgatctaaggcaaaaaattgtgacagagcaggccaaacgcaaggaactccaggagaaggccgctaactcgatccagaaacta

SEQ ID NO: 44757 - DNA, 201 bp, Glycine max
  Peptide Sequence Number=SeqID_161535
atgaagaggagcagtaggcacatagcagatataagagaatgcttaggaatgagaggttacaaaggtttgggtgcaaagcctgagatgcgaggcttagcgtacatcaagcttcaacttacagtgagtgattcaggcttagcgccactacctgtgctaagcgcacttccaatgacttcaaaacaaaatgatgttggtgcttag

SEQ ID NO: 44758 - DNA, 153 bp, Glycine max
  Peptide Sequence Number=SeqID_161536
atgtggttaaaaaggggtgaaaacccctgtgtatcttctgggattcatgatgaatgtgctaagcgcgcttactgcgctcagcctgttcatcgcaactacactaagcgtgcctgtgcgctaagcgtaaatggtatattgagatacccagtgtag

SEQ ID NO: 44759 - DNA, 883 bp, Glycine max
  Peptide Sequence Number=SeqID_161537
atgacacagcgtcatctgctggcggtgctgattagcgcggccttactgctacccggacaggccgcttcagcggctgatgatgacatgctgcgcgcgttcagcgaagcagcgcgcaccctgccgccggcaccggcagcaaaaccacagccacctgcaaaaccggccgctaaaccggcggcgaaaaccgtcagcaaggcagagaaaaaagccgcaacagtgcccgatcacaatgcggaactgacgcgtctgcgcgcccgtgtggcggagctggaaaagctgtctgcggcacctgcggtgaaagcggacgatgcgttaaaggcgcagctggctgccagcgacaaaaaactggcagcgctcagcgcggagaagcagcagcaggagaaaaacatcgccacgctgcagcaggcgctgaaagaggctcagcagcagcaaagcgcgggcagcgcccagctgacgaaacagctcagcgacgcgcgcgcggcggccacccagagcgccgacgcgctgaaggcgctgaaagcggaaaacgagaaaacgctggcggcgctgcaggcagacagcaaaaagcagctcagcgcccagcaggccgggaacgatagaaaactggcagcgctcagcgcggagaagcagcagcaggagaaaaacatcgccacgctgcagcaggcgctgaaagaggcacagcagcagcaaagcgccggcagcgcccaactgacgaaacagctcagtgacgcgcgcgcagcggccacccagagcgccgacgcgctgaaggcgctgaaagcggaaaacgagaaaacgctggcggcgctgcaggctgaaagcaaacagcagctcagcgcccagcaggcggcaagcgacaaaaagctggcggccttacaggcagaaa

SEQ ID NO: 44760 - DNA, 924 bp, Glycine max
  Peptide Sequence Number=SeqID_161538
atggccacaaacgaaatgccaccgtctaacatcgcgtcatcgctattggctaccagtaatgcaaatgacaagaaggagaacaatgaagaatgttggggttcagcatacccaacattccaacctggctgggacctagatgatgaaatccatgccacattcttcaaatgcatcagttggcaagtggaggaaaccttggatacaatcaattgcccttaccattatttctgtgacaaaacatacccttcaaactaccctcttgttgttgatatcttggtccttctctttacagcagcttcttacttggtgactcttgtcatattggtaatggacatgagttcaggaagaggcagaatctttttgggtcaatcaaaaagattccttctgccctcaggtcctatatccctccctctaataatcttagcctttgcaaagggtcctcaaatcaacacaatattcccactcaattgcattggtcctgcaattcttctaatggttctcatttctgcattgtcctttgacaatgcagctgataaggacttcaagtacactttttttgtggcatcaacagtgtctggcattttgcatgcaagcttgtatctggattctgttgtgctgccttactacacaggttttgatgcactcatgtcctcaacattttcaggtgagtgtgcatcttgtgtgtgcaggaaagaggccttggttgtgggagggaaactagtgaggattatgtgcaaaatctcaggagaaaactatgcagggaaatttttgttcatcaaagccttgatggaaaggcatttttcttttgattttccttcaagccctcaaagaggcatgcagccaaatttactcaatggcttatgtggcagaaagattgggatgggtatcggcatcattgcacacaatatgaagaaaaggcaattgtga

SEQ ID NO: 44761 - DNA, 267 bp, Glycine max
  Peptide Sequence Number=SeqID_161539
atgggttctaatgtggtgagatgcgatttggatgggaataggaatgatgtcgacttgaagttacagaatggccaccaggaacaatttgtggtggagtcacatggaggaggcccaaaattgttgaatatagtatcaggtcagtcttataaagagattggcaaagaaccagtatttgtatgcaaggagcttggagagtatgttagagaacaatggaaattgttgaattttgaagggtggagcacgtttgttttgaaagagaaattgtag

SEQ ID NO: 44762 - DNA, 441 bp, Glycine max
  Peptide Sequence Number=SeqID_161540
atgggacgtggaaagatagagataaagaggatcgagaacaaaaccacaaggcaagtgaccttctccaaaagaagatgtggcctcttgaagaagacaaaggagctttctgtgctttgtgatgctaagatcgggattatcatcttctccagcaccgggaagatgagggaatggtgcaccgaacccttcaggatggagcagatcatagagcagtaccagatatcaaaaggaacttgcatagcggaacgtggacgtgatcatccccgagaagaatttgtccataacatggcaatgctgaggcagaaaactattcgtcttgaattggaaattcaacgctatcttggagaggacacgaggggtttgcaatatgaggatttgactaagcttgaacaagaattggagaactctgtggcaagggttcgaaaccgtcatgcttcctggtaa

SEQ ID NO: 44763 - DNA, 242 bp, Glycine max
  Peptide Sequence Number=SeqID_161541
atgttctgggtcaaacacccacatcactacatgaaagtgctgagagcatttcgagttttacaaagggacatcattttgaaattccgatcacgccaatgtgaccggggttcagtgaaggtcacgaaaatagcacctatttcagaaaaggataacttttacaaagtctctttgctctggggtgtttttttcaaaggaagcttaaaacatgcaatggcagtttccaaactcagaatgatgcaaag

SEQ ID NO: 44764 - DNA, 168 bp, Glycine max
  Peptide Sequence Number=SeqID_161542
atgcctacatctccggaaagggcacagatgaccatattggcctccgcttatcaatcacactcgagctcttgggtcatggtaacagaaagcagtgtggtcgacaaaagcgaggcttttgctcctatgtatcctccaatgaggaactcagacctacgtagttctggataa

SEQ ID NO: 44765 - DNA, 402 bp, Glycine max
  Peptide Sequence Number=SeqID_161543
gtggtggaagatgtgactttcccagatggaacagtgctattgaaggggacaaaagtgatatattcaatttatacaatggggagaatggagagcatatggggcaaggattgcaaagaattcaagccagaaaggtggctaagagagaatggacacttcatgagtgagtctgcttacaaattcactgccttcaatggagggcctcgcttgtgcttaggcaaagactttgcatactatcaaatgaaatatgctgcagccagcatcattttccgctaccgtgttaaggtgctggagaaccaccctgttgtgccaaagcttgctttaactctatacatgaagcatggcttgaaagtcaaccttcaaaggcgtgatgcagcagaaattgacaagtacttcaaagtttag

SEQ ID NO: 44766 - DNA, 1248 bp, Glycine max
  Peptide Sequence Number=SeqID_161544
atgcatcacaacatctccaacaatcattccttcattgtgaccaaattagccaccaacaacatcaccaccaccaacatgaactttttctccctcatttttttcctcttgcaacacgtccacatctttgaactcaccattgcaaccgcaatgttcatagcccttagagcttggcgttctaagaggcaccatggcctacccatttggccaatccttggaatgctcccttcccttctctatggaatcacaaccaacttgtatgaatggctcagtgaagtcctcatccgccaaaatggaaccttcacattccaaggcccgtggttcgctagcctcgactgtgtcctcacctccgaccctcgcaatctcgaatacctcctcaaaaccaagttctcctccttccccaagggaagattcttcaggtacacacttcgtgacctgctgggaaacggcatattcaacgcagacaaggaggcatggcagcggcaaaggaagacggtgagcctggagttccactccacaatgttcagaaacctaaccgcagagtcacttttggagctcgtccacaaaagactcttacccttgctagagtcatgtgtgaacaaatcacgtgtcatagaccttcaggatgttctactaaggctcactttcgacaacgtgtgcatgatagcttttggcgttgaccctggttgctcacagccccacttgccagatattccattcgccacagcttttgaggatgcaactgaaacctcaatgaggaggttcatcaccccggtgtggatgtggaagttcatgaggcatctcaatgttggtgtggaaaagaggttgaaggagtcaatagagaaggttgatgagtttgctgagagtgttattatgacaaggaaaaaggaacttgctttgcagcatgacaagtctgatttgttgactgtgttcatgaggcttaaggatgagaatggaatggcttattcagataaatttttgagggacatttgtgtcaacttcattttggctgggagggacacttcttctgtggctttgagttggtttttctggcttttgcatatgaatcctcaagtggaggagaagattttggctgagatttgcagggtggtgcttagtcaaagggaagggttaaagaaggaagaggttgttgttgggagttgtttggcatttaggcctgaggagataaagaagatggattatttgcatgctgccctttcagaagctctcaggctatatccttctgttcct

SEQ ID NO: 44767 - DNA, 1230 bp, Glycine max
  Peptide Sequence Number=SeqID_161545
atgtctgtatacgatgatctcgctgcggcgtcactctacccttccaagaacatttccagcctaaaaacactccattttgcatcgaaagcgcattttattgtgaatagttccgtctctttcatccagttattgatggctcttttgttccagaaatttcaagaggctgtgaaaaccctggcaaagcgcccttctttcactaaggatcctagacaactacaatttgaagctgacattaaccgcttgttcctatatttgagctataatcatctagggaagaatgctgatgaagcacatgctgaagagattattgaaatggctagtaaagcctcatttgctgatcaacaaatgcaagtacaagaaaatgttcattcacaaattaaaacattttgcactttcatggatgaaattctacttccaaatgaaaagatgccacttgcttttggagcagcttcccccaagacaagaccattaagccaagctgtagtttctcaaaatttaaaagatcaacttggctacacagttaatgtcacaccttctcaaatacctcacaaggatgctggccagggtctttttttagatggcacagtagatgttggtgctgtagtggccttttatccaggcatagtctactctccagcttattaccgttacattccagggtacccaaaggttgatacactgaacccctatttgattacaagatatgatggaaatgtcatcaatgctcaaccttggggttctggaggtgacaaccgagaactgtggaatggtagaaaaaccggagaaatcaagcctgatgtaaaaggagctgagcctgagaaagttcagaaaggctaccaaggaggtaacaatgaagtgattgagcgtagaaacccattagccttagctcattttgccaatcaccctccaaaaggggtgcaaccaaatgtcatgatttgcccttatgactttccattgaccgaaagcaacatgagagtctacattccaaatgtgttgtttggaaacgcagaagtaaatatgaggagatttggcagcttttggttcaagtctggtggagggtcaagaaatagtggatcaaatgttccaacactaaaaactcttgttttgattgctactaggcctctccaagatgaggaactcttcctgaactacaggctgagcaatactaagcgcaggccggaatggtataatccggtggatgaagaagaggataggagaagatggagctag

SEQ ID NO: 44768 - DNA, 2205 bp, Glycine max
  Peptide Sequence Number=SeqID_161546
atggcaccccttgattttgttgcccttaaagacttgcacaattcagcaaacaaccttctccattcaccaatggttcaacaagcacttgtccatcaaagagaagaaaaatggtttgatgatgtgtcagagtcatctctgaggatgttggaggtgtgtggcatctcaaaagatgttctcttgctagtaaaagagcacctccaagaacttcagttcactttgcatagagcaagcattggtgatccaggaattgaggaaaaaatcgaagcctacaattgctataggaagaaactgaagaaagaaacattgaagtggttgaagggtatgaagagtcaaaccgccacaatgcaccctccaattaatgagcaaaagctagtattggttgttgatgtgctaagagaacttgtgcgtgtgagtttgcattattgctcagatgatatgatctattatgatgccatggtgcttcaaagtgcaaacaaaaggttagcaggggttaggatggctatagaaggtcttgaggacgaggacgctgacgtcagcaccgaggtggttccgatgtacagccaagccattgcaatagatgaagaagctgctacaccatttatcattcactttgttgcaccttcccaaatcactaagcagcaatgtgaaatcgattacgcacgcaaggtgtttgaggaaatgcctgaacgggacattggtctgtggaccacaatgataactgggtacttaaagtgtggcatgatcagggaggccaggaagctgtttgatagatgggatgccaagaaaaatgtggtcacttggacagccatggttaatgggtacatcaagttcaatcaagttaaggaagctgagaggttgttttacgagatgccactgaggaatgttgtgtcttggaacacgatggttgatgggtatgcgaggaatggcctaacccagcaggctttggacttgttcaggagaatgccagagaggaatgtggtttcttggaacacaatcatcacggcgttggtgcaatgtgggaggattgaggacgcacaaaggctttttgatcagatgaaggatagggatgtggtttcgtggactactatggttgcaggtttggcgaaaaacgggagggttgaggatgctcgggcactctttgatcagatgcctgttcggaatgtggtttcttggaacgcaatgatcacaggttatgctcaaaacaggaggttggatgaggctctgcagttgtttcagagaatgcctgagagggacatgccttcgtggaataccatgatcacaggtttcattcaaaatggagagttaaatcgtgcagagaagttgtttggtgaaatgcaagagaagaatgtgattacttggactgcaatgatgacggggtatgtgcaacatgggctaagtgaagaagcattgagggtatttatcaaaatgctggctaccaatgagttaaaacccaacactggaacttttgtgactgtgttaggagcttgtagtgacttagctggtcttactgagggacaacaaattcatcaaatgataagtaaaacagtttttcaggatagcacatgtgtggtatcagcgctgataaatatgtactcgaaatgtggtgagttgcatactgctaggaagatgtttgatgatgggttattgagccaaagggatttgatatcttggaatggcatgattgctgcctatgcccaccatgggtatggcaaggaggcaattaatctatttaatgaaatgcaagaattaggtgtttgtgctaatgatgtcacctttgttggacttctgacggcttgcagtcatactggtttagttgaggaggggtttaaatactttgatgaaattctgaaaaacagatcgatacaactcagagaagatcactatgcatgtttggttgatctttgtggtcgtgcaggaaggctgaaagaagcttccaatatcattgaggggcttggggaagaggtgccattgactgtttggggagcgctccttgctggatgtaatgtgcatggaaatgctgatattgggaagcttgtagcagagaaaattttgaaaattgaaccacagaatgcaggcacctattcattactttcaaatatgtatgcttcagtagggaaatggaaagaagcagcaaacttggtgataaaccacactctcaatatgagcccctggggcatttacttcatgatctacatacaaaaatga

SEQ ID NO: 44769 - DNA, 1231 bp, Glycine max
  Peptide Sequence Number=SeqID_161547
gtatggagatatattcaagacaaacatattggggtgtccttgtgtgatgatatcaagccctgaggccgctagaattgtgcttgtgactcaagcacatctcttcaagccaacataccctccaagcaaagagaagttgatagggccagaggctgtgttctttcaacaaggtgcctatcactccatgctcaagaggttggttcaagcctcttttttaccctccacaattaagcactcagtctctgaggtcgagcgaattgtcatcaaaatggtgccaacttggacctacaaaactatcaacaccttgcaagagatgaaaaagtatgcatttgaagtagctgcaatctcagcttttggggaaataaaggagcttgaaatggaagaaatcagggagctctatcgttgcttggagaagggatacaactcttatccattaaatgttcctggaacttcctattggaaggcaatgaaggcaaggaggcatttgaatgagagcataaggaggataatagagagaagaaaggaaagttcaaattatggtggggggctattgggagttctattgcaagctcgaggtgagaagaacaacaagtactatcagcagctcacagattctcaagttgctgataatctcattggtgtcatctttgctgcacatgacaccacagcaagtgctctaacatgggtcctcaagtacttgcacgacaacgccaatctattggaagctgtgacgaaagaacaagaaggaataaaaaacaaactagctatggaaaatcgtggactttcgtgggatgataccaggcagatgccgttcactagccgggtgatccaagaaacactgagaagtgcaagcattttgtcattcacattcagagaagcagtaacagatgttgagttggaaggttacactattccaaaaggttggaaggtccttcccctcttcagaagcattcatcattctgctgacttcttccctcagccagagaagtttgacccttcaagattcgaggtgccaccgagaccaaacacatacatgccttttggaaatggagtccactcttgtccaggcagtgagctggctaagcttgagcttcttgtcctccttcatcatcttaccctttcttacaggtggcaagttgtgggaaatgaagatggaattcaatatggtccttttccagtgcccaaacatgggttaccagtgaagataaccccgaggaacaagatatttacgtga

SEQ ID NO: 44770 - DNA, 153 bp, Glycine max
  Peptide Sequence Number=SeqID_161548
atgtcgtacctgttgcctcacttgcactctggatgggccgtcgatcaagcaatcctcgccgaagaggagcgtctcgtcgtcatccgtttcggccacgactgggacgaaacctgcatgcaggtaattgtggaattgatggttgctggaagatga

SEQ ID NO: 44771 - DNA, 570 bp, Glycine max
  Peptide Sequence Number=SeqID_161549
atgacattgctacttagcaacattctgcccagcgaccgcaatgccaatctccccctgcaaaagtatcagttggtctgtgtcgtcccgacatggggatcacacccacaaagacacccagtggacctgaagaagtccaatagggccctggggtttccagctctggttacgggcctctgtcggccctacagggcgcccgttccccccagcaagttcatgtcatcgtggcatagacacctagtggaccccgaagaaggccaacagggtcttggagttgccagctctaaatacgggtctttgtcagttctagggagtgcctgtcgcccccagcaaggtcatcaggtcccccctaccaatcgagctttcatcaagaagttctgcgtctccaggcaggcgcagggcgaaacaccacagcagcctggcgatggtcggcagcgggcaacagacgcaccgccatcacctctagagttcgcctctgctcatccacaaaaaggtttgagtattgcctacaccacatggccgaccaataggcgaccaagtccaaagccaaaggacgcacctagttgctcatga

SEQ ID NO: 44772 - DNA, 210 bp, Glycine max
  Peptide Sequence Number=SeqID_161550
atgccagccgacgtcggccaggaaaagatgacagatcgaggtctcaagaagaagcatgaccggatgactccgatcgaacatttccaaatcgacatcgtccaaccaacattgcgcaatttctttcacaaacgctggccgataatatttctttacggtaaaggtaacggatgctttcgttgtacggtgtcgcctatacaattctcaatgtag

SEQ ID NO: 44773 - DNA, 270 bp, Glycine max
  Peptide Sequence Number=SeqID_161551
atgctcaagtatttcaaccgaggtcgggacagccccgccgccgacgcgtcaccgtcctcccacgcgcctgcgacgccgtcgtcttcgttgccgtcggcgtctccggtgaccggccccgcgaggcccattcgcctagtctactgcgacgagaagggaaagttccagatggatccggaagccgttgcaacgctccaactcgtcaaggagcccatcggcgtcgtctccgtctgcggccgcgcgcgccagggcaagagtttcatcctcaaccag

SEQ ID NO: 44774 - DNA, 564 bp, Glycine max
  Peptide Sequence Number=SeqID_161552
atgcagcttcaggacccggagcgaaccaaagtgctgctggttacgcttccggaaaccactccagtgctggaggcagcgaatttgcaggccgatcttgaacgcgcggggattcatccgtggggctggattatcaataacagcctttctattgcggatacgcattctccattgctttgccagcgcgcccggcaggaattgccgcagattgaggcggttaagcatcagcatgctgaccgtatagcgcttgttccgctactggcgtcagagcctgccgggcggcagacccgccctgtcaggaggttttatgttactggcaggcgctatttttgtcctgacccttgttttggttatctggcagccgaagggggcgttgtgcatttaggcgatattccggtggtgtggaatatcgtctggaacgcgacggcaacgtttattgccgtcattattattagcctgctgcttgatgaatccggctttttcgaatgggcagcgctgcatgtatcgcgttgggaaacggtcggggccgtttgctctttagctatatggttctgctcggcgcagcag

SEQ ID NO: 44775 - DNA, 176 bp, Glycine max
  Peptide Sequence Number=SeqID_161553
atggcctttgtcgcccatttttttggcaatttcgcggtgataagccccggttgcatccagcagcaacagcgtatgccccgtgggagccgtatccatcaccacaaaccgcttacctgcttcgcggatcacgcgagaaaatgcctggaagacggcgatctcttcagtacagggggaac

SEQ ID NO: 44776 - DNA, 1116 bp, Glycine max
  Peptide Sequence Number=SeqID_161554
atgagacatacatggcgctggttcggtccggtcgacaaggtcacggttcaggatgcggctcaggcgggcgctgaaggcattgtcagcgcgttgcaccacatagccaccggcgatgtctggccggtggacgaaataaccaggcggcatgaggccatcaaggccggcgggctttattgggacgtggtggaaagcgtgcccgtctccgaggacatcaagacccagacgggcgactggaaaacccatatcgccaactggcaggaaacgctgcgccgcctctcggcgtcaggcatccgcaccgtctgttacaacttcatgcccgtgctggactggacccgcaccgacctgcgctgggaaacgaaacacggcgcgaaagcgatgcgcttcgaccttaccgatttcgctgcctttgatattcacattctcaagcgcccggacgcgacgcgggattatcctgactggttgctggaggatgcggcaaagcgattcaccgagatgcccgacacaaaaatcgtcgcgctatcgcgcaatatcggcgctggcctgcccggctcggcagatggttataccctgccggaactcatcgaaaagctgcgttcctaccatggcgttaatcgcgaaaggctgcagcagaacctgatcgactttctctccgaggtgacgccggttgccgaaaacgtcggcatcaacatctgcgcccatggcgatgatccgccctggccgcttctcggcctccccgcgtattctctcaacggaggcggattacgcccatatgctgtcgcagatcgaatccatttcgtgcatctgcgcaacgtgacgcgcgacacggacaccgtgccctgctccttcttcgaggacgaacatctggaaggcggaaccgacatggtcgccgtcattgccgccctcatcaccgaagaagcccgtcggcgagcggagggccgtgaagaccacaccattccgatgcggccggatcacgggcaggaaattctcgacgacctcacgcgcggcgcccagcccggttaccccgccattgggcgattgaaggggctggctgagctgcgcggcatcgagcgtacgctgtcacacagccacttcggtctcgcgaatgggaatggctaa

SEQ ID NO: 44777 - DNA, 849 bp, Glycine max
  Peptide Sequence Number=SeqID_161555
atggagacagtgagaattattactgctatagcaagtcaaaaagagtggcatatgcaccatatggatgtgaaatcagccttcttgaatggtcctctagaggaggaggtttatgcgcctagagcctggaacagacgcattgatggctttctaatgaagcttggattcctcaaatgcacaactgagcgtggtgtttatataaagggaaacaatactactaacttgactgtagtgtgcttgtatgcagatgacttgcttgtgataggaaataatgagactgagattgctaactttaaaggagagatgatgagagagttcgaaatgactgatttggaccttatttcttattttcttggaattgaattcaagagaactgatgaggaagtgattatgcataaagggagacacacccactgcactggtgtgaacttggtgaaagatcctaatgaagaagaagtagatgtaacattgtatagacaaatggtgggctcagtgagtagatatatggggaatcctaaactttctcacttatgtgctaccaagagaataatgagtaattgtgctgccaaaaaatataatgctttgggatatagtgattctgactggtgtggagataagagtgataggaagagcacaacaggttatgtgttcttctatggtgatgctccaatcttgtggagctcaaagaaggaacaagtgatagctctttcttcatgtgaggtagaatacattgcagctgctatggcaatgaaggtaaagggtgctattacactgatggtggacaacaaatctgcggtcaatctagctaaacacccagttgctcatgggaggagcaaacacattgaaacatga

SEQ ID NO: 44778 - DNA, 210 bp, Glycine max
  Peptide Sequence Number=SeqID_161556
atggctcggaccagtctttcttctttatcaataccttttcttattctgctgataataacctttactttctttgcacagcttgctccagttagtgcagatttgcaaatgagaaaattgggtcccatgcgaagtccacctcctccacctaagtttcttcttggacctggtccaggtcgaagcggaaacgacgctcctcctccacctaggtaa

SEQ ID NO: 44779 - DNA, 213 bp, Glycine max
  Peptide Sequence Number=SeqID_161557
atgataattaagaaggacttcatggtcgggcaaaaagtgttattgtataattctaagcttggacttatgagtgttgaggtcaaaagcgactccacaaacaagagcttcaagttcaatggacaccgacttaagccattcctcacaaacccttctttagtggacgtagtggtggaagagacttccttactccaccctactcttcctccaccatga

SEQ ID NO: 44780 - DNA, 507 bp, Glycine max
  Peptide Sequence Number=SeqID_161558
atggacgaggtgttggcgtcagtggcggagacgataaagaactttgcggtgatatacctggtggacataacggaggtgccggatttcaacaccatgtacgagctctacgacccttccacggtgatgttcttcttcaggaacaagcacatcatgattgatctcggaaccggtaacaacaacaagatcaactgggctctcaaggacaagcaggagttcatcgacattgttgagaccgtctatcgtggagccaggaagggacggggtctcgtcatcgctcccaaagattactccaccaagatcattggtgatcaagatgctctaataacaacaatatcacttggttcaacaccctacccatatactgcaggacctctcggatttggtttggctcgtaaggtttggagtttgattcctagcttaaggcatggagtgacaaccggagatattactttatctaaaaaatggacctatccggtgggaggaggggttacacctcctggttattaa

SEQ ID NO: 44781 - DNA, 524 bp, Glycine max
  Peptide Sequence Number=SeqID_161559
ccatgaagaagttgtctttctccatccccaccgcaaaaccccaatcggtggacacttccaccacccgaaaggacgacgacagcgacggaaccaaacagtacatcaccgaattcgacccttccaaacccgcaaaccccaaaatcacaatccccccaatccaaaaccagtggaacccccaacaagacaacgaacacagcaccacgcggtggcgccgcactccggaggagaccgagctgctgcgtaagctgaaactggaggaagatctgcagaggttgccggaggaccaggggttggaggagttcaaggatgtccccgtcgaggttttcggcgaggcgttgctcgctgggtatggctggacggaagggatggggattgggaagaaggccaaagaggacgtgaaggtggtacagagatatgccgtacagaatcaagggtctattggttacaatagtattattctctctttctctaatcatagctctccaagttctcttttctttgggtcaatccctatggaagcttga

SEQ ID NO: 44782 - DNA, 1341 bp, Glycine max
  Peptide Sequence Number=SeqID_161560
atgagaggcagaaaatatacatatcatgattttgaggttcttgcaaacaaggccttttttagtagatttcacagttctagagaccttccctcttcttatgtggaaaaggaattctggcatgagatggctcaaggagaaaaaggaacagttgagtacggagtcaatgtcgaaggtagtgccttttcatgtgatcctaatgacaggcttggaacaagcaaatggaatttgaagaatttttcacagcttccacaatccctgatacgtttagttgacagggaaattcccggaataactgatcctatgctttacattgggatgctgttcagtatgtttgcgtggcatgttgaagatcattatttgtacagcataaattatcatcactcaggtgcaaataaaacttggtatggcgtgcctggctatgcagcatcacaatttgaaaagacggtcttacaacatgtgtattgcaataagatcataacaaaacatggagaggatggagctttcaagtttctagcacaaaaaacaaccatgttcccaccaaatgtcatgttacaacatgatgtggcagtttacaaggctgtacaaaagccaggagagtttatcatcacctttcctagagcatatcatgctggatttagccatggttttaactgtggagaagcagtaaactttgcaaatggagattggtttccacttggggctgcagctagcaggcgttatacacatctcaaaatgatgcctttaattccatatgaggaacttctttgtaaagaggcaatgttggttttcaagtcctcaagagtcagaagttccaagaacaaacctgaagacacaacatcttatcaagctattatgctgcctttcatgcatcttatgcaatcttataagacctccctcttgcgactgaacagttcaagaaagttgcatagttcttcaaatacaacagacattgcaccacagacttgtttatgtgggagagattatactattttcaaaaggaatgacattttcgcactggaagaagctgcaaaaagttttcaacagggaaaagaatgtgttgacaaattctctctatcaagtatattctcctgtaacataaatgattgcatcaaagttcctgagaataatccttggcagagagaaaaaagtgtaagaggtactagttttctaggggttgcatctaaaccgaaaacaaaagtggctgacagcaccaagcacagtgatgaaaggaataagtcaacaacgaagcattggagaaacaatgggcttccatccgtgaggggtgccgaaaggccaggaatcatttataacttgagaaaacgcaaatcaaaattgatttag

SEQ ID NO: 44783 - DNA, 2097 bp, Glycine max
  Peptide Sequence Number=SeqID_161561
cgggagctgcagaacaaggatgtcaatgttgtgctgcaggcggttatgagccgctggcttccgctttcggaggcggttttgtcgatggtggttaggtgtttgccggacccggtgacggcgcaggcatttaggatatccaggttgattccgaagagggaggttgttggggatgtggaggaggcggagttggtgaggaagtctgtggaggagtgtgattgtagggacgaggctccttgtgtggcttttgtgtcgaagatgtttgctgctccggttaagatgctgcctggacacagggtggaggttggcaatggttatggtgatgaaggagagagtgagtccgatgagtgttttttggcgtttgctaggatttttagtggggttttgcatgctgggcaaagaatttttgtgctttctgcattgtatgatccggtgaaaggggagtcgatgctgaagcatatacaggaggctgagttgaaatccctgtatttgatgatggggcaagggttgaaagtagtgacatctgccagggcagggaatattgttgccattgcaggccttgggcagcatatattgaagagtgctactctttcttctactaagaactgttggcctttttcgagtatggcattccaagttgctccaactttgagagttgcaattgagccgtctgatcctgctgatgtgggtgcattgctcaaaggcttgaggcttttgaatcgagcagatccgtttgttgaggtcaccgtgtctggaaggggagagcatgttcttgctgctgctggggaagttcatcttgagagatgcataaaggatttaaaggagaggtttgccaaggtaagcttggaggtctctccgcctctcgtgtcctacaaagaaaccattgagggagacgcattgaacgtgatggaaaatttgaaagttcttagcaggagatcatcagattatgttgaaaaaacaacacccaatggaagatgtgttgttcgggtgcaggtgatgaaacttctaccttctttgacgaaggtgctcaatgaaagctctgatttacttggagatattattggagtaaagtcgaggcagagaccgagtattcttgaaaacgataacccagttgaggtgctaaaaaaacgcatattggatgcagtggggggtgatattttgagcaggaatgaaaatgacaaggaccatgctgagaaatgtaaattgaagtggctaaagattttgaggaggatatgggcacttggaccaaggcaaattggtccgaaccttctctttactcctgatattaaagcacaaagcaccgatagctctgtcttaatacgtggttctcctggcatatcagaaaggtttggctttgtggccgattctagtatcaatgactcagttactgagacgtcttcaaatgcaaactcggctttatacatggatgccgagcaccttgagagtagtgttatatctggtttccaattggccacttcagctggacccttgtgtgatgaacctatgtggggtttggcatttgtcgttgaggcacggttatctccatttccaggacagcatgatgaatctgaaacgcaccaacaatcagagcagtacggcatctttgcagggcaggtaattgcaactgtcaaagatgcttgtagagcagctgtggttcagaataaaccacggctggtggaagcaatgtatttttgtgaattgaatacacctactgaatatttgggtcccatgtatgctgtactttcccgaagacgggcccgagtattgaaggaagagatgcaagaaggttcccctttcttcactgtgcatgcgtatcttcctgtttctgagagctttggttttgcggatgagttaagaaggtggacttctggcgccgcaagtgcacttcttgtccttagccactgggaagcacttcctgaggatcctttctttgtacctaaaacggaagaggaaattgaagagtttggagatggttctagtgttcttccaaatacggcaagaaaattgattaatgcagtcagacggtgtaagggccttcctgtggaggaaaaggtagtgcagcatggaaccaagcagaggacactggctcgtaaagtctga

SEQ ID NO: 44784 - DNA, 462 bp, Glycine max
  Peptide Sequence Number=SeqID_161562
atgtctcttgcgactttatttggaaaattgcaggaacatgagatggaactccaacgtcttaatcaaaatgaagaaaatgacaaaaagaagagaagtatagcccttaaagcctcatcatcaatgcaagaagaaaatgaagaagaagattcagatgatgaagaagacttttcattctttgtgaagaaatttcagaaatttatcaagaaaaaaagaattgacaggcgtcagaacttcaacaatggaagaaaatcacaagaagattctcaagtcctcagatgttacaaatgcaatcaaattggtcacatgaaagccaattgtccttcaaatgaagaatggcctgagaaaagtgataagaaaaggtatgatgaaagaaggaccaagaaggcctacattgcatgggatgacaatgattcatccgatggtttagaaaaaggagatcaatcttctaaccaaggattatga

SEQ ID NO: 44785 - DNA, 237 bp, Glycine max
  Peptide Sequence Number=SeqID_161563
atggatgccgtgacaaaatgcgcttggctcaggaaagctcggcttagcgtgcgtctatcaacaaaaaatatgattaagttacatgggcttagcgattcagcctcgcttagtcacaggcatctcagcaagaggatgagtgttcatcctccaaagatgaaatcacttagcgtggtaggcgcgcatagtgagttcttcagagaacgcctatattcaatgagtactgatgaactcgcttag

SEQ ID NO: 44786 - DNA, 765 bp, Glycine max
  Peptide Sequence Number=SeqID_161564
atggagaaaaccaaggcgacgccggccgccatcgcaacttacatgaaagccaccggagcaccgtggtccgtcgccatccggcaattagagaaatacggaggcaatctaacggaagctattaatgcgcatttttttggagaagatacgcacgaatcattggatgaagaacagcaaaatcttgcagcttctgcctcacaacatgataaccctggtgcaagtaatcaagaccctttagctgagtcaagtgcctcacatgttcctgatgttggaaaagaggaagaaatggttgaagcagcgatggaggactcaaaaaccgacacggcagtagcttcctcatcgcagcaaatggatattctccaagattcatctgatcatgagcttcctcaaagtcattctcaacaagactatcaatatgatttggaacgtgcaattttgttatccttaaaggaccttgacgatccagcgtcaccggtagctgaggaagcaaacatgttgagttctctcagtgaagccgaaaaaatagagttaaccagaaagatacttagggaatgtagggaaagggctcaagcaattactattgctgttcatatgccagatggtcgtctcatttgtcgtcactttatcaaaactgacaaacttgaggtacagcatttcccgcgtcgtgcttacggtattgaagatttctcgtcaaccttcgatgaagttggccttagcaacaatgaaactttgtatgtggagaagatttcggccccaagaaaactttga

SEQ ID NO: 44787 - DNA, 1392 bp, Glycine max
  Peptide Sequence Number=SeqID_161565
atggccacgccggacgccgtcgcagccttcatgcgcatcaccggagcaccggagttcgtcgccgtccggaaattagaggaatacggaggcaatttaaatgaagctatcaatgcccattttcttgaggtggataggcacatagtttgtatgattcttgtgactagattatcaggtcaagggcaaaattttgctgctgccccacaatatgataactttggtgcaagtagtcaaaaccgtggtggtggatcaaatggaattttaccttttctcaatgctgctagaagatttcgaccttcactattacttgatccaaattataggaaagaacttagagatctatataatgggattggtggttctacttcattcacgagtcgcccaccacctcttacttcccatccagcggaggtgacggaagttcctgcagggatcaatagtgcattcaatccacaatatcaatcaggattaagcactacaggtgcagatatgactggtcatttatcatctcacggtttaggagttcgtgggacagatggttatcagaaccaataccctttagctcagtcaaacgcctcacatgttcctgatagtgaaatagaggaagcaatgcttcaagcagcgatagaggcctcaaaaacagagaggagaggaggttctttatgggagcaaattgatgttcttaatgattcatctgatggtgggcatcctcaaggtcattttcagcaagaagatgatgatttggttcatgcactttcgttgtccttagagacagcagagcacgagaaagcaaagcgtgaccttctagtagcagaggaaaaggaagggcttggagttcataatttactagacaagggaaagaaaaccagcactaacagaagccaaatagagtggggtggtatttcttctgaagagcttaatgaagctttgttagctgaaactgcactttttggtgaaatttccaatcacagttctcaaaatttttcatccttgcctaatctgcaacatcatccagaacaaaatgtggatcccaagacgcaatgcctgtccacttccatgtcacaattattaaatgactctcgcttgctgaaacaacaacaggatgctgaatatctagagtcactacgagctgataaacaaaaggaattgaattctctcaataaaactgaaagccattcctcaaaggaagaagagtcatgcaaaaaaatgcttgaagaaaagggattggggaaaatgcttgacaagaaagaagttgggcttcccaaagaaccgccgttatctgatgaagtaattactatcgttgttcggatgccagatggtggtcgttgtgaacgtcgctttctcaaaactgacaaactagaggtaaaattagcattagaatatgatgaaaattaa

SEQ ID NO: 44788 - DNA, 1182 bp, Glycine max
  Peptide Sequence Number=SeqID_161566
atgtcatttgcaccaagagatactcatatatcccaggttcaatttgctcttgaacgaggtattcctgcattgattggaattcttgccacaatcaggcttccatacccttcaagggcctttgacatggctcattgctctcgttgcctcattccttggggccagtatgatggagtatacatgactgaaattgatcgagtgctacgtccaggggggtattggattctatcagggccaccaataaactatgagaaacactggagaggttgggaaaggactcatgaaagtctcaaagaagaacaggatggtattgaggatgtagctaagagtctatgctggaaaaagttggtgcaaaaggacgaccttgcagtatggcagaagccaaccaatcatgcacattgcaaactcaagcgaaagatcttcaagagtggtagtagacccttatgtggtgaggcacaggatccagacacagcatggtacactaagctggatacatgcttgaccccacttcctgaggtaaagaacatcaaagaagttagtggcggtgggggattggctaactggcctaatagactaacttcaattcccccaaggattagaagtgagagtttggaaggaataacggctgagatgttcacagaaaataccaagttatggaaaaagagattggcatactacaagaaactggatcatcaactagcggagcgtgggagatacagaaatctgcttgatatgaatgcttacttgggaggctttgcagctgcactagttgatgatcctgtgtgggtcatgaacattgtccctgttgaggctgaaatcaacacccttggtgttgtgtatgaacgtggattgattggaacctatcagaactggtgtgaagccatgtccacttacccgcgaacttatgacttcatacatggtgattcggtttttagcctctaccagaacagatgtgatatggtggacattcttctcgagatggaccggattttgcggccacaaggcagtgtcattttgagagatgatgtggatgtgttgacgaaggtgaagatcattgcagatgaaatgcaatgggatgccagaattacagaccatgaagaagggccttatgagagacagaagattctggtagcagtaaaagagtactggacatccccaccaccagagagaaaccaacacagctag

SEQ ID NO: 44789 - DNA, 2172 bp, Glycine max
  Peptide Sequence Number=SeqID_161567
atgcctcacctcaacctcccagcctccaagcgcgttcggcagtggcgcgtgctggacctcatctcggcggcgttcttcggcctggtgttcctcttcttcatgctcgtcttcactcccgccggggactccctcgccgcctccggccgccagacgctcctcctctccgcctccgcggatccaagacagcgcctccacgtggcggcggccatagaggccggtcagcagtcgcgcgtgatcgatgcctgccccgccgacaccgccgccgaccacatgccatgcgaggatccgcggctcaacagccagctcagcagggagatgaattactaccgcgagaggcactgcccgccgctcgagacctcgccgctctgcctcgttccgccgccgaagggatacaaggtgccggtgcagtggccggagagcttgcacaagatgttttctcagtcaacattcttacggggaacaacaacaacaacaacgccttatcccactaggtggggtcggctacatggatcaacttccgccataatattctatcaaaatgacaaagcaaaagtggaaagtttttatgaaaaagtgttgctaagacttcaagccgtgatttttaatataacgaaattaagctcagccttagtagaagtgggtagcagcactgggtggacacccttaagtggtattaccagccattctggaggagcagttgattcagcaatttctagtcttcatctatctggtgtttcatccattttaggttctatcaattttataacaactatctccaacatatggcacagcaacatgccatacaacaagattgctgacaggaaaggtcaccaaggatggatgaagcttgatggtcctcactttatattccctggaggtggcacaatgtttccagatggagcagagcagtatattgaaaaacttggtcaatacattccaatgaatggcggtattctgaggactgctcttgatatgggatgtggggttgccagttttggaggatatttgctagctcaaaacatattaaccatgtcttttgctccaagagattcacacaaatcacagattcaatttgcacttgaaagaggagtaccagcttttgttgccatgcttggtactcgcagacttccatttcctgcatttggctttgacttagtccattgttcccggtgtttaatcccttttacagcctacaacatcactgccctaatgcagaaaccttgccttgcagatgcatcttatttcattgaagtggacagattacttcgccctggtggatatttagtcatttctggtccccctgttcagtggcctaaacaagataaagaatggtctgatctccaggctgtggcaagagctttgtgttatgaattgattgccgtagatggtaacactgtgatctggaaaaagccagcagtggagatgtgtctccccaaccaaaatgaatttggtctagacttatgtgatgattcagatgacccaagttttgcatggtacttcaaattgaagaaatgcatcactaggatgtcttctgtcaaaggtgaatatgctattggcacgattcccaagtggccagaaaggctaactgcttctccaccaagatccacagtcctgaaaaatggtgctgatgtatatgaggcagacactaagcgatgggtaaggagggttgcacactataagaattccctaaaaataaagttggggactccagcagtacgcaatgtcatggacatgaatgcattttttgggggatttgcagcagcactaaattctgatcctgtgtgggtaatgaatgttgttccatctcacaagccaataactcttgatgcaatctttgacagaggtcttattggagtctatcatgattggtgtgaacctttctcaacatatcctcgcacctatgatctgattcacgcgacaagcattgaatcacttataaaggatccagcttctggcagaaacagatgtagccttcttgatttgatggtggaactcgatcgaattttacgcccagaaggcactgttgtggtgagggatacccctgaagtaattgagaaagtagctcgggttgtgcgtgcagtgaggtggaagcccaccatatataataaagaacctgaatcacatggcagggagaaaatcctagttgcaaccaagaccttctggaagagctaa

SEQ ID NO: 44790 - DNA, 228 bp, Glycine max
  Peptide Sequence Number=SeqID_161568
atgcggataaacccaagtggttatccgtacaaacgatttatgttaatcctcacccgtgaagtcaggggcaagcaaaagactaacgtcgtcatctgcaccctttgtcaatcaggggcaagcaaacccgttggcacacggagactaacgtcgtcttctgcacctttgtcatccagagacagcgagtctgatgacatgcggatatacccaagtggttatccgtacaaatga

SEQ ID NO: 44791 - DNA, 1203 bp, Glycine max
  Peptide Sequence Number=SeqID_161569
atgggagaaatagaggagatgcaagaacggatgaaggctgacatggaggccatgaaagagaaaatggccacaatgatggaggccatgatgagcatgaagaagataatggaggtcaatgcggctgcagttgccgctaccagcgccattgctgaggtggacctgactcctctatctggcctcaatcaaataaatcatccaacctcggatagggtaggtcaaggaagcaaagagttgggaagtatgggcggcccccattgtgtgcaaattcaaaaaaagtatgccttcccgccatatggcttgcctctcaactatacaccacccaatgttgcacgcgctcccgatgggaatgttgacaaatccgctcccatactcattgagagccaacaacctcaatctgatcatgcacctgtctctcaacccatgggggaaacacatgaagtaccccaccacaatctagccgacctcgagcctcgcctcggatactccattgaggggcaagcagttgagagagtccctcctgctatggtggaaagggagaaattggatcatatagaggaaaggctaagggccattgaaggaggtagagatcatgcttttactgacatggcagagttgtacctagtgcctaatgtcatcatccctccaaaattcaaggtgcccaattttgataagtacaaggggactgcttgccccaagaatcacctaaaactgtactgtcggaagatgggggcatacgcgaaagatgaaaaactgctgatgcatttcttccaagagagccttactggggcagtcgtcacctggatgcagctatatagcatgtgtaaaaaggggcatgaatctttcaaagaatacgtccagaggtggagggacttggcagctcaagtggtacctccaatgatggaatgggagatgataacaatgatagtagacacattaccggtgttctactatgagaaaatggtgggctacacaccttcaagctttgcatatttagttttcgccagcgaaaggatcgaagtgggtctgaaaagaggcaaatttgattatcctgctttgatgaatgagaagcctggggcaaatggagagaatgaggaagaaggaggaacccatgctgtgactgtcattcctacatggccaaatcaagcatgtcaatactcaaccaatattgacccttctcattacccaccacccaatcaaccataa

SEQ ID NO: 44792 - DNA, 333 bp, Glycine max
  Peptide Sequence Number=SeqID_161570
atggcttcagaaaaagctgtgggatggtcaatgtcatcagatataggggatcatcaacctcatgatccgacctatctgcaggttgggttggacatgaaggatgttgtgtgtgataggaaccttatagaaaatatggtcaatgatctcatgggtcacaggaagaaggagtttctgaatttggcacgggaagtggctatgttggctaaccatagtgtgaggatagggattggaaaggtgatgacagacttgctttctcctcaaattaaggaagtgagaagaagcaatggagtgaaagttcctatatggtacttctacctatggaaatctaattaa

SEQ ID NO: 44793 - DNA, 213 bp, Glycine max
  Peptide Sequence Number=SeqID_161571
atgactcatagattatgttttgaagctttggataaaaatctaagggacatcatgagagttgacaataatccttctttaatctttggaggaaaagttgtttttggaggagattttagacaagtgatgaaagaaaatatttatcatcagactcaattgacaagtcatataaagttgaaagccaaatctttgaggcaattacacctgaatttctaa

SEQ ID NO: 44794 - DNA, 678 bp, Glycine max
  Peptide Sequence Number=SeqID_161572
atggggagcttcacagattcagcatgggaatggaacctttcttggagaaggcccctatttgacaatgaggtagcctcgactgtaggttttttggaagatatatctcacactgcactccaacaacatgcagcagacaactgggtatggaaacctgaatccaatggatactattcttctaggagtgcctacattctgctgcaagggaactcagaggagggaaacatggatgatatattcaaggacttatggaagctaaagatcccagctaaagcatcaatttttgctgggaggaggaaactgcatctcatcttttctttgactgcagcaaaacacaacattttggtgggaatccctatcatggataggcacctcgggggcctatcctataaatccaaggctccactttctgcagcacaacaatgggatgaaagatgcactgtttttggcatggacaagttcagaacaatggagaaaatttttacaatgcatttcaactattggtctagcaatctagcagctgacttccaagaacagtgtagggggttctgtgggttcaagcgaggagaatgtgggttttccggcagtgtagggggttctgtgggtttgagcaaggacaatgtgggtgtcgagggagcggtttccggcagttttcaggctggaggagaaagagaagagtga

SEQ ID NO: 44795 - DNA, 384 bp, Glycine max
  Peptide Sequence Number=SeqID_161573
atgcaactaaagtacttcaatcaagtacttattcaagaagaaggatcaatcgaagaggttattgatgagatcaaacattatcttgattgcagtgaacaacctatttattttaatgatcatcaagacaatgtgcttggtaaaccaagcatgaatgtttccatgttcacatcttggatggatgcaaacaaaatgtacaatgaagacttgcaactaagcaatacagatttgcaaaatttaactttgatggagattgagaaaatattggatgcaaacagaaaaagcctaaggaactatcctacaatgccttatccaaatgcttatgtgacaagtcaactaggaaataggcttatatattttgaacttgactatgatattgacgaatag

SEQ ID NO: 44796 - DNA, 153 bp, Glycine max
  Peptide Sequence Number=SeqID_161574
atggacaatattaatagaacgacaatttgtccagataacttgggaagcactgtagcggattgcttaaggaagagatggtttggatcaggtcttgtttcaatggtgcaaatagagaataaagttttaggatattgtggagggattgattggtga

SEQ ID NO: 44797 - DNA, 435 bp, Glycine max
  Peptide Sequence Number=SeqID_161575
atggatccaaatccatggttaccaatcctgaaaggtgaaaaaggcagtccagggcctccccctcaacaacaagaggaacctatagatatctcttctcaaaaggagcatatgggtcactatgaagaaagcataatagtggccaaccaacctggagtggatgatagtaacctttggacattcaaggtccagcaagatttcaagactctctctaagttctgggcagatgaagtggaagattccatggaggaaacaacaaatgtcgggatggagatattcaccatagttatttctaagaataacaagaagaaattgaagggaagcaaaatgcttctcttagcaagattgaaaagaaccgtgttgcagttggaaagaaaaaatcatcctcatgaaagttctatactagaacatctagggtctctagacccaaatttttaa

SEQ ID NO: 44798 - DNA, 249 bp, Glycine max
  Peptide Sequence Number=SeqID_161576
atgggtgttctaacccctcccacaatctcaaaaagtagcttaggacaccaatattctcgcgggaggtctgagattcatatccaacattgggcatgggacacatgcatgctgttggggttgacgtcaagagtccacaacgagttacaaatcatagcggaagatggtgtttgggtgaaggagattggaggaatcccattggtagatagggtcaggtttgcccatggaagaccaggggtgagacactactag

SEQ ID NO: 44799 - DNA, 363 bp, Glycine max
  Peptide Sequence Number=SeqID_161577
atgaagaattatttgaaaaaaagttggtacgttgatagcggatgctctaaaaacatgatgttcggccataacccatgcctacgttcagtccccaagcaaccaccggttcttgagatttccaataaccttgtaaaatcctttacaagcaaagatccacaagggatgtaccctcccttgttctctttgaacaaccaagtggatgtacgctccacaagagatgtaccctctcttgttcttagtattacaacccaagtagatgtacgctctacttgtaccacaaaggatgtacgctctacttgtaccacaaaggatgtacgctccaatgtgtcaagacaaagaattcttaggcggttagtcccttga

SEQ ID NO: 44800 - DNA, 291 bp, Glycine max
  Peptide Sequence Number=SeqID_161578
atggagaaggacgaagaccgaagtggaaaaggacgaagtcccaagtggagaaggatgaagacccaagtggagaaggacgaaggcccaagtggagaaggacaaaagacccaagaagtggcatcatccaaatctccgcagcctgtatcaagcgatccgctcctagtccggattacatcatctggtatcagagcttcagctcttgatacaggagctggtgatggtggtggtgattatcatcaactggatggatctcagcgtttgttattggacgcaatgactacacagatgtga

SEQ ID NO: 44801 - DNA, 1383 bp, Glycine max
  Peptide Sequence Number=SeqID_161579
atgagttttgggggtcttttagacaacaaatcaggtagtggcggtgccagaaacaacgtttcagatattccttacaacaacaacaacgttaccaataccaccaccaccaacaacgatagaatgccctttggtgcaatctctcagccacgcctcgtgaccaccactcccactttggccaaatccatgttcaactcatcagggctatctctggcacttcaaaccaatatagatggacaagaagatgtgaatagaatggccgagaatacctccgaaccgaacggtttgagaagaagccgagaagatgaacatgaaagcagatctggcagtgacaacatggacggcgcttccggcgacgaacacgacgccgccgacaaccctccgaggaaaaaacgctatcaccgacacacccctcagcagatacaagaacttgaagcgttgttcaaggagtgtcctcatccagatgaaaagcaaaggcttgaactgagtagaaggctgtgtttggaaactcgtcaaacccagttggagcgacacgagaatacgttgctgaggcaagagaacgacaagcttcgagcggagaacatgtccataagggacgcaatgaggaaccccatgtgctccaattgcggtggcccagccatcatcggcgagatttctctggaagagcagcacctccgcatcgagaacgcgcgcctcaaggatgaactcgaccgcgtgtgtgtactcgcgggcaagttcttggggcgccccgtttcctcattaccgagttccagtttggagctcggcatgagaggaaacgggttcgcaggaatacctgcggcaacaacgttgccgctgggacaggattttgacatgggtatgtctgtgtcaatgaataataatgcgttggctatggtgtctccaccgacgagtgctagggcggccgcggccggattcgataggtcggtggagaggtcgatgtttcttgagcttgccttggctgctatggatgagttggtgaagatagcgcagactggggagcctctttggatgaggaatgttgaaggagggagggaaattttgaacaatgaggagtacgtgaggaccttcactccttgcattggtttaagacccaatgggtttgtgtctgaggcctctagggaaaatggaatggtcatcattaacagcttggcacttgttgagactcttatggactcgaatcgatgggcagagatgtttccttgtatcattgcaagaacctccaccacggaagtgatatctagtggaataaacggaacaagaaatggggcacttcaattaatgcatgctgaacttcaagttctttcccctttggtgccggttcgtgaggtgaatttcctgcggttttgcaagcaacacgcagaaggg

SEQ ID NO: 44802 - DNA, 564 bp, Glycine max
  Peptide Sequence Number=SeqID_161580
atgagtggtcacacacatggtggtggacatggatttgaggtggagtgcgtgactgatggaggtggtggggagatgatgaaggtggtgggagagatgatgaagaaggataaaaggggaatatttgaaaattatggggtgcaccaagcaaaaaataagattttcgtcgttcgaaccctagaatgccgaagcgtgatagaaccaagaaaaccgcgaaagcaaccgaatcagtacccgaacctcaacctcaactgcagccaccacaattcatcgacctcgaaatccaagcggggattaaaaatcatgaccccttcttatcactcccaaccaccaaaccactctctgactcccgttttgagttcggttgaacttcggtgcagcgatggagcgacaaattggcgcgatcagggcggttcgcgacgtggagatcgagcacctgctcacggagctgcggttcctgcgctcgcggttcagcagcgaagagctccggaagcccgtgctgcaggttttcgaagaaaccctaccgaatctcgctgtcgtgaacgacgagcgcagcaagaagcttga

SEQ ID NO: 44803 - DNA, 531 bp, Glycine max
  Peptide Sequence Number=SeqID_161581
atggtgactagtgtgacgcttgccggagatgtatcacgtatcttgactgcgcacgtggatggtgtggcggtcttcagcgatgggcgtcagtggtcgaagatgagcttcgacgaaaaggcatcgggaagtctggcaaccatgggcagaacaggcatgagggtcatccgtaagaaaaatgctctaattgacgcgaaattgcaagggtggggtcatgtgggagggcgaccacaacactgcaaaacgcagtcagaaaaggcggctggtgctatcagccccatgacgagtccaatggtggtggtgttggccggaaagctcgctggatatgcagcggtggcgattagaagaagtcaccggaaaactgaaaacaagttgctggaaagaggcacaaggagaaagggtccaccaggacaatggggtgccacaaaagtgtcatcgactgggaaaggacaaagggttgttggaaagcggaagcaggtcgccagaataagtgcaacaaccataaagatccactggaatgtggaaacagagtga

SEQ ID NO: 44804 - DNA, 1968 bp, Glycine max
  Peptide Sequence Number=SeqID_161582
atggggggtttcgcaatgggttataccttcgattccaaatctgggctgacaatggctgctttgcttttgatgattgtgtccttctatgctggcatcctttttggcaacaatgctcccctttacgtctctcagcttgtttctcattcttcatcttcttcttctcctcccaacaatgtctcatccaacggtactaccaaatttactaacaaagttgctctgacttactggaaaaccccgcttgtaattccagaaactgggatggatgtgtgccctttgacgttcaatgagtatattccctgtcatgatgtttcctatgtggcaacattggccccaagtcttgatttttctagaaaagaagaacttgagagacactgtcctcctcttgaaaagcgcttattttgcttggttcctccgccaaaggattataaattacctatcaaatggcctcttagcagggattatgtttggcgaagtaatgtgaatcacacgcatcttgcagaagtcaaaggaggccaaaattgggtgcatgagaaggatcagctctggtggtttcctggtggtggtacccatttcaagcatggggcttctgattacatagagaggttaggacatatgattaccaatgaggctggtgatctgcgttctgctggggtagttcaagttctggatgttggctgtggtgtggccagtttttcagcatatcttcttcccttggatatacgaacaatgtcctttgcccccaaggatggtcatgaaaatcagattcaatttgcattagaacgagggattggtgcaatgatctctgccttgtccacaaaacaactaccgtatcctagtgagtcatttgaaatgattcactgttcacgatgccgaatagactttcatgaaaacgtgttgatggaggtgaggtgtatctacaaagacattttgatgcttaggttagcaaaggggctgcaaatgtttataattgagagaggctatggtaggattatcacacttgggaggactaatcataggactaatgcacaatcggtctgcatggatgctggggttgtgaagcgtggtgagatgttaggatccacttgcaagagggagagaaatagattaatagagagggatataggaagaaatttctcaaatgggattttactgaaggagttgaatcgccttcttcgcttcaatgggtactttgtttattcagctccccctgcttatagaaaagacaaagattatcctgtaatttgggataagttgatgaatttgactacagcaatgtgctggagactcattgcacgacaagttcagacagcaatatggataaaagaaaataaccagtcatgccttttgcacaatgtagaaaaaaagcacataaacctctgtgatgctgttgatgattctaaaccttcatggaatatccaactaaagaattgtgtacttgttagaaattctaaaacagattcttacaagcttcttcctactcacgagcgccattcagtgttttctgagaaccttaacatgataggtataaatcagaatgaatttacttcagacactctcttttggcaagaacaaattggtcattactggaaactgatgaatgtcagcaagacagaaatatgcaatgtgatggatatgaatgcttattgtggtggatttgctgttgcactaaataagtttcctgtttggataatgaatgtagttcctgcaagcatgaagaacaccttatctggaatttatgcccggggattgattggagcttttcatgattggtgtgaaccattttcaagttaccctcggacatatgatcttctgcatgccaactacctcttttcccactacaaaagaaaaggggaaggttgtttattggaggacatcatgctggagatggatcgactaatacggccattggtaatcacttttcgaaactgtcatctttcatggttatctgcatatatgagaccaaagtaa

SEQ ID NO: 44805 - DNA, 945 bp, Glycine max
  Peptide Sequence Number=SeqID_161583
atggcttttcctccttctcacaccttcatgttccaaacccatgaagatcatgatccccaccagctccatctgcgttcaacttcaacctctctcaacgctttcccctctttcccacctcatcactttcaagtagaagaactctcaaaatcacttgtggcgtgtatcccaaacaggaactatactatagaatatgctggtgcaggaggtttaatgatgaagcgttcgatgtcgttttccggcatagacaacaacaacaacaacaacaagtgcgatgaatcgcacggggacgacgagttatcggacgagggatctcagctcctaggggagaagaagaagaggctgagtctggagcaggtgaaggcgctggagaagagcttcgagctcgggaacaagctcgaaccagagaggaaaatgcagctggccaaagccctagggcttcagccgaggcagatagcgatatggtttcagaacagaagagctaggtggaagactaagcagcttgagaaggagtatgaagttctcaagaaacagtttgaagctgttaaggccgataatgactccctcaagtcccagaaccagaaactacatacagagttacaaactctaaaaagaagggactgcaatgaaactggaactgtaattagtctcaagaaagaaactgatcagggttcttggagcaatggcagcaacaacagttcagagatcaatttggatctctcaagaacaccagtgatgaacactagtcctgtgtcttctcagaatggaaaatcccttttaccaacaacttcttctaagcctacaagcataactcaactcctccaatgctcatcaagaccagatctccaagatgagagcttctgcaacatgttccacatcattgatgagcagcagaatttttggccctggcctgatcatcagcagcagcagcaacaccagtttcattaa

SEQ ID NO: 44806 - DNA, 207 bp, Glycine max
  Peptide Sequence Number=SeqID_161584
atgacccctactcatgatgccctgctatattacaatgggaggtggaacatgccacaccaaaatgagtttgttggttactcgttcataggaaaaaatcccaaaaagtttgacattccttccaaatgtaccatggatgaactgaaggatttgatcaagcaagttgtgcttcatgggattcccccttatggtattcatgaaacacaaacg

SEQ ID NO: 44807 - DNA, 261 bp, Glycine max
  Peptide Sequence Number=SeqID_161585
atgggtcgagtcgggagtagatttggctctctccatcctggccgttcttataaaatgagggatgggcttgaggttgagtttttaaaaggcaaggacaaaaagattaaaccaaatctcattccatcaagtttcatcgggtttgaagaatctcgaaagaaacacgtttccattaagtattgcaaatatgttttcaatacagatatgtgtgaacctatatcaatactaaacaataatatggttaaaagaggaaacaggagatga

SEQ ID NO: 44808 - DNA, 267 bp, Glycine max
  Peptide Sequence Number=SeqID_161586
atgcgaacaataagtggcgtctcctctctcttttccttctgcattccgctgccattcatcttccaagaagcaaaggaatccattgatgaagaagatcctaggcctacaagctccaatggagcttacataagttcatctaccccatctttctctgttaattacaatgacttatattttattgtcgttggaggtaaaaatgccaaaggaaatgtgtacgagctaggtgcattgagcaaaatgtgcctaaccttctgccacttagcctaa

SEQ ID NO: 44809 - DNA, 276 bp, Glycine max
  Peptide Sequence Number=SeqID_161587
atgtcgatggaagctctcttcagaaaattgattgggtatgaacatgagttgattcaaaaatctcagatttatgtggggggaaagggtgtcacaccactcacaaaacaacaccagcccatccctcaacatctaagacataaaacaacacaatggaatcgagattttgttgaaaaaaaatacatagaaaaaatccgagaagaagtgttgggcgaggagaagggaacaagcaaaggagaagggttttgggcaaccgaaatggaaggagaagggaagtga

SEQ ID NO: 44810 - DNA, 444 bp, Glycine max
  Peptide Sequence Number=SeqID_161588
atgaagactatagtgtgtgagggtttggttcgcaagagcttaaatccttgtgctttattggtgcctaaaataggtattattaggcaccaaatccctatgataggtggtatgatgaatgtgttgagtggtgcaacactcttttgtaaaatcactcatgcacccaacatcttcatgatttgtgtacatagggactcattaggtaggaataatcaacatgaaaataaagaaaaagttatgttttattccattactttccttaactttttaaataatgatcaagggcttcctatggaccctaagagaataaaggtcattcctgagtggcctactccaccaagtgtagaggaaagaatccatgagtttcatgaacctctggatttgaggtcaaatccttttcaagtgagaggggatgatgcaatcctaccccccaagggcattggatag

SEQ ID NO: 44811 - DNA, 501 bp, Glycine max
  Peptide Sequence Number=SeqID_161589
atgggaagcattaccacaagaaaatctaagggagagagaaacaacaaaaatgttgttcaaggaattactcaaacttactcaagacttaggataaaattgaggattttactaggctgcatgcttccaaattccaaaagggaacagtcctccgctgacaaaagcaacgaaggaagggaagttataaaagataatgttagacaacaaccggttactccaagatcctcatccaccataagattaagaagtcgtggaagatcatatactcccaaccaggaattaattgcagcttcttcccttcttcgaaggttctcctttaatgaccttaagttggcaacgagtaactttaaatatgacaatttacttggtgaaggggggtttggatcagtgttcaaaggttgggtcgatcaagatgagaactatgcaacaaagcctggaatagggattccaattgcagtgaagactctcaacctaaatggattacagggtcataaggaatggctt

SEQ ID NO: 44812 - DNA, 150 bp, Glycine max
  Peptide Sequence Number=SeqID_161590
catgatggagttacccttcctttgaagttgatgatgccggaagagacggaagaagctgttttctgcatagagaaagaaatttggatttggccgattctcccttctattgacaaaacaacaaaagaagaagaagccaacactgaacttgag

SEQ ID NO: 44813 - DNA, 395 bp, Glycine max
  Peptide Sequence Number=SeqID_161591
atggaacctaccaggcaccctctggacccagataagtccaacagggccctggggtttccggcgctgatcacgggcctctgccagtcctacggagttcccgtcaccccaaatgcaccgccaccacctcggcaggccgatccacctgggtcactaggcatggagcgttatctacagcatttggttcgccaacaggcggccaaccactatgggaagggttccgccccttttgcatgccctactccggagcagtttggggctgaggtcgcatggcctggagactggcccgatgcctgggcagtggaggagcctgcaggatcccccgatgagccagatgagtcccatatggatgaagatatgactgacttgctcggtttcttgggagggagcagagccac

SEQ ID NO: 44814 - DNA, 495 bp, Glycine max
  Peptide Sequence Number=SeqID_161592
atggcctctggtaatcgattaccaatggtttccatgtgcagaagttgtgtaactcgagtttgggcactgatcgcgatggcagcgcaattaatccatgatcgcgtggtgatggagtgcctagagggagtttgggagactctcgaaggcaatgagaggtgccgatttcgtggcacgattcgactcactgctacttcattagtacatccgaaggaacccgcacacacacttcagcagactgtggagtgggtactacctacacctactccggagctagttcaagtgatagaggtgtcatcctctgaagaagaccctgaagaggacctagaggagttacctcttgagcttgctgtggatgctcttgactttccagaggatgatgaggacccaatccctgatgtggattctccagaggatatcatgtcagcatctgaggcagactctacagaggagaacggctctggagggacaacgagtagtgaagactcttcatcatag

SEQ ID NO: 44815 - DNA, 519 bp, Glycine max
  Peptide Sequence Number=SeqID_161593
atgaggaaggatcttagaataaattactcgtgcccattcatccataaacaagaatccggacactctcaaagcctgtctaaaacattccagaaccttctccgcttcctcggcgcccagcccctcgagctcctcagtggcgtccagccgcaccatggtgtttccccattccatcatgggcaccctccccttggcgaactcgatgagctccatgacggcgccgcggagggcatcgggggcggcttggaagccgggggaggcggcggcggagtgggcggcggcgaggagggctcgggcggggccaaggaagtggaagacggagagacggagggcgtgggggccggcgcggagggcgagggcaaaggagtaggggcgggagtcggcgaatttgggggaggagtagagttggagggcggtggagaagaggtagaagaggaagggggcggtgaagaagaggagggcgaagaagaacaagaggcatttggcgttgtggggtttgttgttgggatttggatattttag

SEQ ID NO: 44816 - DNA, 201 bp, Glycine max
  Peptide Sequence Number=SeqID_161594
atggggcttaaaaaagggcttcctgtccgcgaagacgcacttagcgccattcttgtactaagcgcaaaagagacaaccatctcgcttagcgagctgcatacgcgttgggcgcgaattgaggataagcctgaagagagttcttcagccttatcctcagttgctaagccactgccgtctcgcttagcggtttggtctcgctaa

SEQ ID NO: 44817 - DNA, 297 bp, Glycine max
  Peptide Sequence Number=SeqID_161595
atggtggaagaaggatttgttgtgaacaaggctcccatcttcaagggaactaactatgactactggaaggaaatgatgattgccttctttgagtccactcacactgatatgtgggatgttgtagaaaaaggcaatcacattcccctagatgctcagaagaatgagatccctatggacaaatggatggatggtcacaaatctagatttcttcttaactcacatgcaagaaatgctctattatgtgctctatcacaagaagaatattccaaggttcacagcttcagaagcgccaaatag

SEQ ID NO: 44818 - DNA, 918 bp, Glycine max
  Peptide Sequence Number=SeqID_161596
atgactcatgaagatctcgttaggattcttaaagtccatgagcaagagcttgctcaagatgaaggaacaaagaaaggaaagtcgctagcccttacgactcaaagaccaaaatgtaactctgcgtccaaagagtcatcttctatagcccttgcggaaaataagaactcctttaagtttgacggctcatcccgaagatcctttcataaggagaaaattccaattataagctataagtacaagaagccaggacacttcaagtcagaatgtcctaaccttggaaagtcaaaggataagaagaataaattcttcaagtccaaaaagaaaagcctcatgagcacttgggaggacctggatgattcatcgttggatgagaacaatgaggaagaagtcaacatgtgtctaatgactaatgcgtccaccagtaaagtaaaaccaacactggatgctagctcagatgatgagagtcctcagcctgatggcactatcaactatgatggtgaagaggtaatattcgaatctagagaagatttaattaaagggtacaatcaacttttgtttggctctgctcgtgtctctaaagcttataggaaactaaacaaacattttcaacatcttgaaagaaagcatgaggatctcaagaaaatccatcaagctcatttagttgattttgtcctagaaaccactttacctagtgatgtacaagacaactttgtttgtgagaaggtcaaagcattactggacaaaaatgtatccagtggacaaaagattcttcttaaggattttcaagactcgaaaaaaagggtgaaatccttaaccacaagttttgaagattcagaagaagagcccaaggaaatgcttaagcaaaagctcttactacaaaaagaatgcacccttctaataatgagcttgatgagttga

SEQ ID NO: 44819 - DNA, 339 bp, Glycine max
  Peptide Sequence Number=SeqID_161597
gcattacgggccaatgcacctctcccttaccctcaattgataactttgtttctacgtcattttcaaattccgcttgatgatgaaccatttgttcaagtcaagcattcctttgcaattggtgttggtgcagtgacttcctatggatactgtaaggatcagaatgcactcatgactgaagttctttccgaattacggggtcttcgctcttatgttggtgaacgtttcgactcactggatacacattttgccggaatggatatttgcctcacacagcttgaagaggatgtgggttacattcgtcagagtttcgatcttccaccaccacctccaccttcttag

SEQ ID NO: 44820 - DNA, 300 bp, Glycine max
  Peptide Sequence Number=SeqID_161598
atgggaaacgccattgttgatggcgccttcagcaggagtttggcacgtggctatggaaacgccattgttgatggcgccttcagcaggagtttggcacgtggcaatggaaacgccattcccagcagcgcttccacttttgctgatgtggctttggaagcgccagcagtgttggcgagttgggaagcgccagtggctcttgcgagtttggaagcgccaatggctcttgcaagtttggaagcgccattggtacctgcgatttgcatgaaaacgccaatggtgatggcgtttgaagctgtttaa

SEQ ID NO: 44821 - DNA, 408 bp, Glycine max
  Peptide Sequence Number=SeqID_161599
atgagttgcttctatctttggcatcatcaaaacctttatacatatgcaatcacaaacgggatcaaacaaacatggattgtgacatgttcgggagtgacaacagagggtgaattacatggtgcttctctatttattttcactttatttatgagagaaaaacctccttgtaatgcaactgttgtatttgtgtatgtcactactcaacgttgctgcatcactacaaggaatggagacaatgaggctgaaaaatcaattgggagtaagggtgaatctcaaaaagaacattctttagaggtaccattgccaaccaatatgggttcactcagggtggaaaaggataaagtagtggttagggatctctttggtgtaacaaccttggatgatgtggtggccacaataaaggtttga

SEQ ID NO: 44822 - DNA, 387 bp, Glycine max
  Peptide Sequence Number=SeqID_161600
atgctgaaagccatgtgcaacttggttaaacaagactacaaccagttagccaaagacgttgccgaggatgcagcaatgaatggggctcgcaatagttccacctatgatgaaacattacgttgtggaaatcctaataaggcgatgtccaaggcgactgccaggtgtggcacaaaggaagcatataggaaatgtagagtggatctgaaaaatatagaaaccatcttcatcctagggggcgatgatgatgactttccaatgctgaaaaataatgcagtgaaggcaaaattcctaggccaggaaaataataacaaatattcctatcccgagatagtgaacctgtcaaggcccaatgaggtgaagaccatagatgactcatccccacaatag

SEQ ID NO: 44823 - DNA, 213 bp, Glycine max
  Peptide Sequence Number=SeqID_161601
atggcgcctagaaagttgccattcccccatcataactctgttagtcagacctccaagaagccaaaaattgagaagcaaccacatatttcgaatgcgccaaaattcaaatacaccaaaggcgcttcctcgggcaacatgaacaaagcaagccaaatctttgaaaggcctcgaaccaattccagaaatgccctacagcttcaagccaacaattaa

SEQ ID NO: 44824 - DNA, 211 bp, Glycine max
  Peptide Sequence Number=SeqID_161602
ggaaggattaggtggtgctggtgggtcaccggaagtgtcgtggcggcgttgtcctacagtggtggttgtggaggttgagccttttctctttttagatggttctgccatttgggcgccgtcaaggagaaggaggaagaaaggattctgcgcagggagggagaaagagcagaatttatggacagggatgagctgtaatcggttacagctcatg

SEQ ID NO: 44825 - DNA, 378 bp, Glycine max
  Peptide Sequence Number=SeqID_161603
atggctccggataggatgcagctacagagcatgtgtaaaaaagagaatgaatctttcaaagaatatgcccaaaggtggagggatctggcagctcaagtagcgcccccaacgacagaaaaggagatgataacaatgatagtggacatgttaccggtgttctactatcagaagatggtgggttatacaccttcaagctttgccgatttagttttcaccggcgaaaggatcgaagtgggtcggagaagaggaaaaattgattatcctgctttgatgaatgggaagcctggggaaaatggagagaataagaaggagggaggaacccatgctattattgccattcctacacagccaaatttcccaccagctcaacaatgttaa

SEQ ID NO: 44826 - DNA, 309 bp, Glycine max
  Peptide Sequence Number=SeqID_161604
atgggttacgcgagctcgaagaagacagttaccagagccggcagctctaccccggaggggccatgcatggcgtgtttgagttcgcaaagatggagcaagaatgagtcagggtttgttgtggctgagcagaatgcggctgggtggccaccttggcttacttttgttgctagggaagccatacaagggtgggtctcactcataacagattcttttgagagattagataagcttctagagcttcagtccctgttagctagtagcttttttcttgcaatagtgattgattttatttacttgacgacattttga

SEQ ID NO: 44827 - DNA, 429 bp, Glycine max
  Peptide Sequence Number=SeqID_161605
atgcagttgagagctctaggccgctccacctctcaccgctctggtcccaccactgcagatccatcctcatttcctgcgattcctccaagtgatgagaaaaatgaaatagagaatgaagccattgatgacaatgttgatcttcaagaagttatttctaagggctctttagattttgacaaatggactttactgatttcagagattgagaaaggtgtaagtttgattccagtaactgaaaatggaatggtcttgatgttgctggtaagaccactatcctctacaaggtcaagcttagagagatcgttattacaattcctcctattgggttcaatgttgagactagaatacaagaacactagcgtcactgtttgggatgttggtggccaggataaggtgaaaattttgattctcatgcatcccttaaaataa

SEQ ID NO: 44828 - DNA, 606 bp, Glycine max
  Peptide Sequence Number=SeqID_161606
atggataatagatctgaaagggaggaagagaaatgtgcacctgtgggatgtttgttgttagatttagaaaaaatagggggagacacagggatcgccataaatttccgagtgttgtgtcgtggtgtcaaacaaaaagatggagacggagaaatgaggttaagaagcttcctagctcaacgacgtgaccttaagtcaccactgacatcacggtcacactttcctttatcccctctacaacttgcactcactacttttgtgctcttcaagccccaacccctcgcttcaatcgaaatcttgccacttccagagaggcaccagatgctagtggtcggtgccgtggaggaaagccaagagaattttgaacccgaaccgaaagcagagttagcattaaaactgaagaaggcaatgacggagaggaaggagaaattaaaagatgagaacttgttgagcagagtggcacatgagatcaatgagattgaatggccacgtttgggaaggtattgggtaccaccgttgttttctccaacattattttttggttcaagcgtcattttgctcaccgtcaacggagttttggccaagctttctaatcgggttcactattaa

SEQ ID NO: 44829 - DNA, 390 bp, Glycine max
  Peptide Sequence Number=SeqID_161607
atggctcattttattccttgtaaaaaagttgatgatgctttctatgtggctgatttgtttttcaaggagattgtgagactccatgatttgccaaggagcattgttagtgatagggactctgtgacatcctggaaatttctatccggaattttatttttagaagctttttcctcatctcccacgttgcttttcttctccctttctcctccaccattgttgcccattaaagctccaaactttgctcatcatttctactccaaattgcaaagggaagccattttcggagtcgtgaagcgcacctctacgttgtgggacttcgaatttcagaaagctggtagagatgatggggagagtaacctagggttaaatgtgagaatggtagtgatgtga

SEQ ID NO: 44830 - DNA, 1085 bp, Glycine max
  Peptide Sequence Number=SeqID_161608
tgctgctccttgcagctctcattctctcccctcaagttcttgccgatgacagcaagttcccaggagaggaacaaccagtttacaagttcccacttgatgagaagatacctgactacaaaccctcgtcttataatccacctgattacaaatcaccatcttacaatccaccaggttacaagtcaccatcttacaagccaccttcctacaatccaccagtttataaagcaccatcttataattcaccagattacaagtcaccttgttataatccaccaagttacaaaccaccagtttacaacccaccttcctacaatcctccaagttacaaaacaccatcttataatccaccagtttacaagtcaccttcctacaatccaccaggttacaaagcaccatcttataatccaccagcttatgagtcaccttcgtataatccatcaggttacaaagcaccatcttataatccaccagcttacaagtcaccttcctataacccaccaggttacaaagcaccatcttataatccaccagcttacgagtcaccttcctataatccaccaggttacaaagcaccatcttataatccaccagcttacaagtcaccttcctataacccaccaggttacaaagcaccatcttataatccaccaggttaccagccaccttcatacaatccaccaggttacaaagcaccaacttataatccaccagcttacaagtccccttcctataatccaccaatttacaagccaccttcctacaatccaccaggttacaaagcaccatcttataatccaccatcttacaagtcaccttcctataatccaccagtttataaagcaccagtttacaagtcaccttcctacaatccaccaggttacaaagcaccatcttataatccaccagtttataagccaccttcctataattcacctgattacaagccaccttcctacaatccaccagtttacaagtcaccttcttataattcaccagattacaaaacacctgattacaagccaccttcctacaatccaccatatgggaagtcaccttacccaaagtaccctccaggatccaattga

SEQ ID NO: 44831 - DNA, 600 bp, Glycine max
  Peptide Sequence Number=SeqID_161609
atggcacctgagatgataaaaaagaaatcttatggggaaaaggttggtgtctacagctttgggcttatgatacgggagatgttgactggaaggataccatatgaggatatgaatccaacacaggctgcttttggagtagtaaataagacctttttgaatggtcaacatggaagagtagtgcaaactaagcttcttagaatcagtcattcatttggcttgaagctagtcatggcaatgacgaaatcaaataggagatttagaacctacaattctgatttaggaaagataacaatcgactacgacacatttgtgagcttcgactcaaaagatatcaacaaagagaaaaacatgactatgctaaggattaacgaaaggagcaaaaagctcttacattttgccgaactcaagcacaactctatatctttcttcaacattgagaaacatgaaactgtcatttccagttggtctagagctacaaccagagctgccaaggttggaaatggtttatcaaaagatgacaaagctcaaaaacttgctttgcagcactggcttgaagcagttagtcatacacccttccccctcaaaaatcaatcaagatag

SEQ ID NO: 44832 - DNA, 174 bp, Glycine max
  Peptide Sequence Number=SeqID_161610
atggaagaaaaaattgggaaaaatgataaaaagaaaggagaggaggagttctcaggctttagctaccgaagtggacttgggccttcaaatgctcgcttagtgcgccttgcctcgcttagcgtgtactgcgcgcttagcgcaactgctagttctcgtgctgctagctcagcgtga

SEQ ID NO: 44833 - DNA, 309 bp, Glycine max
  Peptide Sequence Number=SeqID_161611
atgctcaagaaattcgagatgtacagttgcaagccaattggaacaccgatggactgcaaaatgaagttatcaaagtttgacgaagcagaaaaggttgatgctacaaatttcaagagtttgttaggcatgtcacaagaaaagccaaccaagatctttgtggataataagccagccgttattctagcaaagaatccagtgttccatgatcaaagcaaacatattaatactcgttaccactacataagggagtgcatagcaagaaaggatgtacattgcagaatatgtgaagtctcaagaccaagtagctga

SEQ ID NO: 44834 - DNA, 468 bp, Glycine max
  Peptide Sequence Number=SeqID_161612
atgcaatcaaatatttatacaggattagacgaaacatacctacgtgaggtggcgaaggagaaaaagtacagacttgtgacgatgctcgaatggagaacagacagcttcaaggtagatggagaacaaagagagcaagaaagcttagatggagaagaagatagagagaaggagaagacagcgcgaaggagacgaagcatacctaggtatggtggcgaaggagaagaagcagagacttgtgatgatgctcgagtgcgacgaacacgatgctcgaccttagacaaaacgatggtcagatggagaacagacagcttcaaggtacatggagaacaaagagagcaagaaagcttagatggagaagaagacaacgagaaggagaagacagcgcgaaggagacgaaacatacctaggtatggtggcgaaggagaagaagcagagacttgtgacgatgctcgagtgcgacgaacatga

SEQ ID NO: 44835 - DNA, 705 bp, Glycine max
  Peptide Sequence Number=SeqID_161613
atgcaaggctcagtttttcatgacttggatttcccccctgcaagtttatttggagggagagaattgcttcctgtggaaagcattttcaagaaccatcctaaggcatgtctgacaattctatcaagaactttggacaccaagcatggctacaggatcctgaaaccactgcttgatcgtaggttcaaagtgcaggcaatggccccagacttgccatttttggtcaaggggactccggtcgaagcttggtttcgtgagctaaggaagggtagaaaggaccccagtgagattcctttgtctcagaatctatctaatctgataagacttgcagttctgtacaaatatggtggtgtctacatagatacatactttatactttatagttctaaaaccctttctaacagggttaaagaattctattggggcgcagagcatgaattcagattcatcaatgaatttgccttgactttcaatggaaacaaatgggggaataatggtccctacctggtttccagagtgattaagaggctgtttaaaagacatgatttcaactttacaatcttgccgcctatggccttttatccagtggattggaacaagataagtgggttctttacaaaactgaaaactcagggaagaatcaagacgggtagaagccaacctgcttcagctcagtgggaagacttatgggattcatctatggaataa

SEQ ID NO: 44836 - DNA, 180 bp, Glycine max
  Peptide Sequence Number=SeqID_161614
atgacggcgacaacgacgaagactatttcattgaagcctttgggaagagacggcaccgtcaggcgccatttggtggaggagattctaattgtggtgcctaggtacgctgtcaagcatatggtgacggtggcattggaaagcacggaccaaagctttcaccttgacatggcagaggtttga

SEQ ID NO: 44837 - DNA, 1023 bp, Glycine max
  Peptide Sequence Number=SeqID_161615
atgccctcacctttagaggactacacgtcctcgccttcagaggactgcacgtcctcaccttctgagggctacacgccctcgcctttagaggactacacaggactgcacgtcctcccctttagagggctgcacgccctcgccttcagaggtttatacatcctcaccttcagaggactgcacgtcctcacctttagaggactacacgtcctcgccttcagagggctacacatcctcgcctttagtggactacacgtcctcgccatcagagggctgcacgccctcgccatcagagggctacatgccctcacctttagaggactacacgccctcacctttagaggactacgcatcctcctcgccttcagagggctacacgccctcgccatcagaggactacacgtcctcgccttcagaggactgcacgtcctcgctttcagaggactgcatgtcctcgccttcatagggctacacgtcctcaactttggaggactacacgtcctcgccattagaggactgcacatcctcaccttcagaggactacacgccctcgccatcataggactacacgtcctcccctttagagggctacacaccctcgccttcagaaggctacatgtcctcacctttagagaactacacgtcctcgcctttagaggacttcacatccttaccttcagaggactagacgtcctcgccttcagagggctgcatgccctcgttttcaaagggctgcacgccctcgccttcatagggctacacaccctcacctttagaggactacgcgtcctcgccttcagagggctacacgccctcgccatcagaggactgcacgtcctcgccttcagaggactgcacgtcctcgccttcgtagggctgcacaccctcacctttggaggactacacgtcctcaccttcagaggactacacgtcctcgccattagaggactgtacgtcctcaccttcagaggactacacgccctcgtcttcagaggactatacgtcctccccttgagaggactacac

SEQ ID NO: 44838 - DNA, 1831 bp, Glycine max
  Peptide Sequence Number=SeqID_161616
atgggaagtctattacacaacaagtcatctgttacggaatggaaaagcatattgcagagcgagatatgggaattttcaatagagcgtagtgatattgtacctgctttagcactaagctatcaccatcttccttctcatctcaagagatgttttgcttattgtgccttattccccaaagattatgagtttgataaggagtgcttaatacaattgtggatggctgaaaaatttctacaatgttctcaacagggtaagagtccagaagaagttggtgaacaatacttcaatgatctattatcaaggtgcttctttcaacaatcaagcaacacagagagaacagattttgtcatgcatgaccttctcaacgatttggcaagatttatttgtggggacatttgtttcagattggatgggaatcaaacaaaaggtacaccaaaagcaacccgtcattttttaattgacgttaaatgttttgatgggtttggaactctatgtgacacaaaaaagttacgtacttatatgccaacaagtgacaaatattgggattgcgagatgtcaatacatgaattgttctccaagtttaattacttacgtgtcttatctctgtctgtttgtcatgacctaagagaggtgcctgactctgtgggtaatctcaaatatctccgttccttagacttatccaatactggaatagaaaaactacctgaatcaatatgttcactctacaacttgcaaatactgaagctaaatggttgtgaacatttgaaggagctgccctcaaatttgcataaactcactgatttgcatcgccttgaattaatgtatactggagtgagaaaggtaccagcacatttgggaaaactggagtatcttcaagtattaatgagttcgtttaatgttggcaaaagtagggagttcagtatccagcagctaggagaactcaatcttcatggaagtctatcaattgagaacctgcagaatgttgagaatccctcagatgcattggcagtggatttaaaaaataaaacacaccttgtcgagctagagttagaatgggattcagactggaaccccaatgattcaatgaaaaaaagagatgaaattgtaatcgagaatctacagccttccaaacacttggagaagttgaagatcaggaactatgggggtaaacaatttccaaggtggttattcaacaattcattattgaatgtggtgtccttaaccttggagaactgtcgatcttgccaacgtttgcctccccttagactctttccatttctgaaggagctttcaattggagggtttgatgggattgtgagtattaatgctgatttttacgggagtagctcttgttcatttacatccttggaatctttaaatttcttcgatatgaaggaaagggaagaatgggaatgtaaaggtgtgacaggtgcttttccacgtcttcaacgtctttctatagtggattgtcccaagctgaaaggtttgcctccccttggacttttgccatttctgaaggagctttcaattaaagggcttgatgggattgtgagtattaatgctgattttttcgggagtagctcttgttcatttacatccttggaatctttggagttctccgatatgaaggaatgggaagaatgggaatgtaaaggtgtgacaggtgcttttccacgtcttcaacgtctttctatggagcgttgtcccaagctgaaagggcacttgccagagcaactatgtcatttaaattatctaaagatttctgggtgcgaacaacttgtaccttctgctctcagtgccccagatattcatcaattaaccctaggagact

SEQ ID NO: 44839 - DNA, 249 bp, Glycine max
  Peptide Sequence Number=SeqID_161617
atggtgcctaatgcattgttaacaagaaagggtggttgccgaagtattgacaatcaaaatttctattccttggaacatggggtcgaaccaagtagtcttttaagaaagggttttatcaagtcaaggtcaaagtatggaagtagacaactcttgaaagttggggcagaagatggatcaggtttacatagcctctttgactactgccaacacatgattgagctagtgactttcataattaagaaccactga

SEQ ID NO: 44840 - DNA, 390 bp, Glycine max
  Peptide Sequence Number=SeqID_161618
tctgctcggccgcggccgaaaatcgccgcggcggcgctgttggtgcgacgacggccggatcagcgccgccaaggctcgcttcaccaattcgccttcgacgccgcggattctcacgagcgagttcgtcatcgccgaccgccgcgcgttcagccggtccgcttctggtggtggctatgcctgccggcacccgcgacggagatggaagagttcgggagctggaacggttctggaagaaagcggtggagcgtgcggagaaggttgaagttgaggacgcgaaggcggtggtcgccggcgatggccgggaattgcgaaaccttcccgccggcgagagtgttcggaggactggcccgcttgatcttctagaagcagccgccattttagagagagaaa

SEQ ID NO: 44841 - DNA, 204 bp, Glycine max
  Peptide Sequence Number=SeqID_161619
gggattgttgttcttggtacttggtggcatagtagcatgaaatttgttttggacacgtataactatgtagggacaaagagctataagtgtgactataagtctcaaattgaggataagtttcatagctggcccaaaggtcttaaagcttataaggatatctcggggttttactggggagcaaaggatcctaattacagtggttga

SEQ ID NO: 44842 - DNA, 225 bp, Glycine max
  Peptide Sequence Number=SeqID_161620
atgactaattctacacccagaatacaaccttgtcagcatttggtcactagacctgtgataggtgttgaaccattcaaacctactccaattcaatttggtactgtacaaatggttaggtgcccacctaatgtctcaggtgttattagacttcctccattactctcaatggcttccataccagtgtactatccatcacaagggtatataggaggaggccagacatag

SEQ ID NO: 44843 - DNA, 336 bp, Glycine max
  Peptide Sequence Number=SeqID_161621
atggcagaaaagatgttgaccaaatttgataaatattgggatgtgattcatgatataatgggagttgttactgctttggatcctaggaagattagacagttgtgttatgacttggtttctgattatcaagtgaagatgaataatgaatcttttggtagctctccaatacctggaggtggtaatgttggaggtgatgaattatgttctttgaaatctaaaattattgaacaaagtagtactttggtgaatgagatggcttcagatgatgaaggtgaaacatcaatttatgcaagtgaaatgatgggaagtggccttactacccacttggagcaatga

SEQ ID NO: 44844 - DNA, 291 bp, Glycine max
  Peptide Sequence Number=SeqID_161622
atggagaacagcgatggtttgtggtggctaatagtggctgtgggtgatggagaaagtgcttgggacaaatgctctcgggaacggaagcttcgagcacactccaaacatcttctcaaagatcccaacggtcagatcgtgtacaattgtcttatgaagctgcagaccaaatttcgagaagagccaacgattaacgaaggctgggcagcgtttttactgaggcagcttcatgtagcttcctcaagaagcttcattaagaggcttcctcaagaaacttccctgtggcttctttga

SEQ ID NO: 44845 - DNA, 770 bp, Glycine max
  Peptide Sequence Number=SeqID_161623
ggcgttgaggaaaggccatgtggctgtcggacatctcgcgcatgaagtagtcgaagatgacattcggcgattcgtcgatggacgaggcgctggattcccattttttaatgcggtagtggcgttcggttgccgagatacgttggctggtgtagctgaatttgacgtagcgctgcaggtagagccagccggcggcggaatcggtatagccttccaccaccatcgaaccgttgccgttggcggcaaaattaaaatggatattgccgttcacattctctttttccatgttttcaaaacgcatgatcgctttggtggagcaactcatcacgccatcgttggcatccggcagcagacgccaggcgctaaagccggcggcggcgataaacgcgagggcggagagggcgaaaaagtgggcgagaaatacccggcccaggccgttagtctccagccggtcgccgtagaagaaaacgaaacgctcccccggtttgcaactgagtttcagccgctgacgcacctcatcaaaattcttaccgtaggccgtggcggagaccgaacgcagcatttcatcgctggccagcagttcgcactggctgtggctcatcagcgtcagattgattggccgggcggtagaagcggtgggcggcgttggcgccgtagcgggggcggcttcatcaggcgtagcgcatgtgagaacggcatcggcgggcgtcgcttcggcgtcgagcagttcgatgctgagatcctgattcagctgcagcatgccgtgcgacacg

SEQ ID NO: 44846 - DNA, 1083 bp, Glycine max
  Peptide Sequence Number=SeqID_161624
ttggagcgcgcggtgaacgcacgcacggcggcgcttctgtatgtgaaatcgcaccattgcgtgcaaaaagggatgctcgatattgacgatttcgtgcaggttgcccgccagcataatctgccgctgatcgtcgatgccgccgccgaagaagacttgcgccagtgggttgccagcggcgcggacatggttatctacagcggggcgaaagcttttaatgctccaacctcaggctttattagcggcaagcgcacctggatcgccgcctgtaaagcccagcaccacggtatcgcgcgggcgatgaaaatcggcaaagagaatatggtcggtctcgtctacgcgctggaccgttaccggacggcggcgccggcgcctgacgccgccgcgctgcgtccattcgccgaggcgatttccgcgctacccggcctgtgcgccgatatcgagcaggatgaagccggtcgcgccatctggcgcattcgggtcagcgtcgacgccaatgaactgggactcagcgcccgtgaggttgaagctcagctacgcggcggcgatatcgctatttacgcccgccgctactatctgcatgagggccattttagccttgacccccgcaccgtcggcgaaggcgaaatgagattacgcagcatgcagcggattaacttttatcgccaacgagtggcgattaatgtgctggccaaggacatcgccaacgcccgggaaatctatgacgctgctgaagggcacgcggtgattggcgtactctcggcgcaatttaccagcgtcgaacaaggcgttgcagaagtgcgccgctggatggcggaagtgccttctatttccgtcggtctcggcgccggcgatccggcgcagttttacaaagcggcaatgatcgccgcgcaggtccaccccgctcacgtcaaccagaccttcaccggcagcggctttgccgccggggcgctggcggcgaccggaggccagcaaacctttattaatgcgctggtcagccccagcggcacgcccggtgaagtacgtatttccaccggcgtgcgcagcgccaagggcatcccggcccaggtttcctgcgatgcggcg

SEQ ID NO: 44847 - DNA, 414 bp, Glycine max
  Peptide Sequence Number=SeqID_161625
atgaaggtgcttcctttccgaagaccaccaaggcactcccgcattttggccgttgaagacaaaggtggttcctttccgatgaccagcaatgtgctctctctattacttttcgatagccacagtggaggtttgcattttcgtcctctatatcgcactgtcaggatgagtagtgaaatcactcttattttgcaccgcaatagtaaattgatacaaaatgcaaatgtggcactggagtatgtcagtggtgaattttgtgtaaggggggattttggaatagatttggttaatgtgtggacaacccacgaattgtgtaaagcttgctgcaactgtatgaagtttgcttcagtttattatttggtgcctggtagtggtttacagaggttggaaaatgatcgtgatgtgttgcctatgtga

SEQ ID NO: 44848 - DNA, 216 bp, Glycine max
  Peptide Sequence Number=SeqID_161626
atggctaaagaaattgcaccaacaattccaatagggagctttgaattggtgtctgggctaaaaataaatttccataaaatcaagttggcaactattggtggggatggtgactttatatcaagggcaacaacttacttgaattatggcttggtggagggaccctatgtctaccttggtatccctattagtgcaaatcctagaaatgaagctatgtga

SEQ ID NO: 44849 - DNA, 357 bp, Glycine max
  Peptide Sequence Number=SeqID_161627
atgaatctcctaagctccaattgtttcccagatcgactggcaagcctaggaagaaaactcactagtcgacaacactccaaacttcaacctcaagatcaactcataagtgttagcgcaacacttctacagtctctacataggaccaaaacggctaagaaaatgggtcccaacagccacaaagatactccaactacaactactggatcagccaattctctccctgtcctcatgaagcctttaataccagatgaggtcttgtctgagtatttccagtctcctatgactagtcctctaattccccaagatggctctccatttcttaagaacaagaaatatgtccaggataccttggtttag

SEQ ID NO: 44850 - DNA, 626 bp, Glycine max
  Peptide Sequence Number=SeqID_161628
cactgttcatgtgtcctccaccttcgagtgtggagccccgcgaattgattgcctagggctgttcaccaattctccattctccaattttattcggagccccatgaattcattacctagcgttgttcatgtgtccttcaccttcgagtctggagccccgcgaattgattgcctagcattgttcgccaattctccattctccacttttattcggagccccatgaattcattgcctagcgctgttcatgtgtcctccaccttcgagtctggagccccgcgaattgattgcctagcgctgttcgctaattctccattctccacttttattcggagccccatgaattcattgcctagcgctgttcatgtgtcctccaccttcaagtctggagccccgcgaattgattgcctagcgttgttcaccaattctccattctccacttttattcggagccccatgaattcattgcctagcgttgttcatgtgtcctccaccatcgagtctggagccccgcgaattgattgcctagcgctgttcgccaattccccattctccaatcttattcggagacccatgaattcattgcctagcgctgttcatgtgtcctccgttatcaagcgcggagcctctg

SEQ ID NO: 44851 - DNA, 1920 bp, Glycine max
  Peptide Sequence Number=SeqID_161629
atggcattagaatgcgttggtggtgctgttctttcttctatcctcggtgctctatttcagaagctagcttctcctcaagttctggatttctttcgtggaacaaagatcgatcagaagctgcggaaggacttggaaaacaagctcctctccatccaagctgtgcttgatgatgctgaaaaaaaacagtttggaaatatgcaagtgagagactggcttattaagctcaaagttgccatgcttgacgttgaagatgtcttggatgaaatacaacactccagactccaagttcaacctcaatctgaatctcaaacctgtacttgcaaggtacccaatttcttcaaatcttcccctgttacttcctttaacaaggaaattaattccagcatgaaaaatgtccttgatgacctagatgatcttgcaagccggatggataatctaggtttgaaaaagcctagtgatcttgtagttggatcaggatctggtggtaaagtgccacaatcaacatctttggtggtagaaagtgatatttgtggcagagatggtgataaagaaatcatcattaactggctcacttctaacactgataacaagctgtcaatacttactatcgtgggcatgggcgggttgggtaagaccacgcttgcccaacttgtatacaatgacccaagaatagtgagtaagtttgatgtcaaagcttggatctgtgtttcagaggaatttgatgttttcaacgtatcaagagcaattcttgacacgattactgattcgactgatcatggtagagagctagaaatagttcagagaagactaaaagaaaatttggcagataaaaaatttctcctcgttttggatgacgtttggaacgaaagcaggcctaaatgggaagctgtgcagaatgctcttgtttgtggagctcagggaagtaggatccttgtcacaacacgcagtgaggaagttgcttctaccatgcggtcagaaaaacacaggctggggcaattacaagaagattattgctggcaattgttcgctaaacatgcattcagagatgataatcttccacgagatccagtatgctcagatattggtatgaagattcttaaaaaatgtaaaagacttcctctggccttgaagtcaatgggaagtctattacacaacaaaccagcctgggaatgggaaagcgtattgaaaagcgaaatatgggaattaaaggacagtgatattgttcctgctttagcattgagctatcaccaccttcctccccatctcaagacatgctttgcttactgtgctttattccccaaggattatgtgtttgacaaggagtgtttaattcagttgtggatggctgaaaatttcctaaactgccatcaatgcagtacgagtcctgaggaagttggccaacagtacttcaatgatctactatcaaggtccttctttcaacaatcaagcatatataaagaaagatttgtctttgctgagcaaaaaaagaaggaaggatttgtcatgcatgaccttctaaatgatttggcaaaatatgtttgtggggacatctatttcaggttgagagttgatcaagcaaaatgtacacagaaaacaacccgtcatttttcggtttcaatgattaccgaacgatattttgatgagtttggaacttcatgtgatactaaaaaattgcgtacatttatgccaacaaggcggagaatgaatgaagatcactggagttggaattgcaatatgttgatacatgaattgttctccaagtttaagttcttacgtgtcttatctctgtctcattgtttagaccttaaagagctgcctgactctgtttgcaattttaaacatcttcgttcgttagacctttcccatactggcattaaaaactacctgaatcccatgttcactctacaattgcaatactga

SEQ ID NO: 44852 - DNA, 588 bp, Glycine max
  Peptide Sequence Number=SeqID_161630
atgggcccgaaatctaccataaggctcatgagaaccctagggccttctcttgcatctctggcccaatcttcttggagtgttatatccaatgcccttgtggggaaggattgcatcaggaaggacctaatggtttccttcattaggaagtatcagtataattcagatatggctttggatagaatgcaactacagaacatgtgtaaaaaagagcatgaatcttttaaagaatatgcccaaaggtggagggatttggcagctcaagtagcgcccccaatgatggaaagggagatgataacaatgatagtagatacgttaccagtgttctactatgagaagatggtgggttacacgcccttaagctttgccgattttgtttttgtcgacgaaaggatcaaagtgggtctgaaaagaggcaaatttgattatactgctttgatgaatgggaagcctagggcaaatggagagaataagaaggagggaggaacccatgctatgactgccattcccacatggccaaatttcccactagctcaacaatgtcaatactcagccaatatcaacccttctcattacccaccatcctattag

SEQ ID NO: 44853 - DNA, 471 bp, Glycine max
  Peptide Sequence Number=SeqID_161631
atggcattaatggttgattctttattgctagctgattggtgcaataactctaccattagtgttagtgacattttggttgctgaaccaactgtgagtgatttcatcactatgcttggctttagaggaggaaaaaggagaaatgtgactgagccgggagttgctacgtgcacccagcattattgctggggcacccagcaaacagtgaagtggcgaaactgcccttcagcaattattcttccggaagaagacaatttccggaagaacgtcatccggaatgtttccggaagaagcttcttccggaagaattccattgtcttccggaagaagcttcttccggaagctgtgttttactgcgctttctttctttcttcttccgtttgctttgtttcttcttccgtttgctttgtttcttcttccgtttgctgttgtttcggtggtggtcccttcagcagtctgttggtggtcccgtga

SEQ ID NO: 44854 - DNA, 309 bp, Glycine max
  Peptide Sequence Number=SeqID_161632
atggcctttggaaccatggcagctcgcccaggcgagctgatgcttcatcctaaagtaagttggcacgcccaggcgagatggttccttcaccctaagcaatttgggggcccaggcgagccagaggctagtctgggcgagctggggtccataaaactccctgaaatgacccttttgcccctcacttttggtatctttcgcattcttgatcaaaacaatgaaggatcatctgttttgcactgtaactggcattcaacacccatagaagcagaggacgtcgagtcctatgaagcacaaagaccaggacattga

SEQ ID NO: 44855 - DNA, 734 bp, Glycine max
  Peptide Sequence Number=SeqID_161633
tcgatcaggacggtgtggacgacactgtctatgagaaatatgacataagcaaggaaaaatgggcccagttttgccagactcgtagagacccttcttgggaggatgtgcgaaaaaaggcacagaccatccagaaacaaaacactgcccctcacgttttgtctcgtgggggttatgaatatttggagcagaagctcctagctgagaagaccaagaagaagctagaggaagctgcacaatcaggaatcgttgatggcgtcatcgacccttcatcccccgtcaaacaacacatgaagtggaagatggcccgcaccaagaaaataggggagatgacgactgaggccgcaaaggaaatcactgagaagatcataagtcattttcaactaaccattagaattatttttttttattttgtgaatgccatgtacaaatgtgtcatttttgggcaggattcctttgaggagcaggcgccacagggatccttcatcccatatggacgtcaagatgttctcaccgctactataggacatccagagcaccctggacgtgtccgtgctgctggagccggtgttaccatcaagcaatactttggatcggctccacggacgtccctgctgccttatgaagaattgcagctgctgacccaacaaatcagggaccagctagaggagtcgatcactgaaaaagtgactcggcaactcatggcatcgttcagccagatgcaaacccagttctag

SEQ ID NO: 44856 - DNA, 546 bp, Glycine max
  Peptide Sequence Number=SeqID_161634
atggaacttatgagactccatcaacatgaagagaatgataacaagaggaaaggaatatcactcaaagcctcatccttttctattcaagaagaaagtgataaagaggacttgaatgaaataaaagaagatgatgatttcagattttttatgaagagattcaatatgtttttgagaaacaaaagaaatcaaaggaaatcaaacatcaatccaaagaagaaaggagaagattcctccttagccccaaagtgctataaatgcgatcaacatgggcacttgagatttgattgtcgtgtctttaaaagaagagtggaaaaatttgacaagagaaatttcaaagaaaagaaagcatacatcacttgggaagataatgacatggattcttcaagtgattcagaaaatgaaatcataaatctgggtctcatggtcaaagactatgaaagcgaagaagaggtaatgtcttctaactatgacttatctatttcttttgatgaactacaagatacattcaatgatttgcataaagaatctgttatccaggaactttaa

SEQ ID NO: 44857 - DNA, 438 bp, Glycine max
  Peptide Sequence Number=SeqID_161635
atgattgaaaaatcgtcgtggaaagtgttcacttttcacgacgacgacttcaaagacgattttagaatcgtcgtggaatgtgctaaagaacttacatggaaaacgttgtttctagtagtgcttgaaaatccttttaaacaattattagtagggaggggaggagaaaaggaaaattcattgggtgaatggagtaaggataaggaggctaaggttggatgtatgaagcattggttggatgttgtacccttgtggccatggaggtggcgaaggcaactgcttgaatgggaaaaagatttggtacaagaacttgaattgctcctaggacaagtaacactcaaagaaaatgtgaaggacaaatggatttgggaaggggatcctataagtattgtcctagcaatggatatcttgcaaagaatgttaaacaagtggcctcaataa

SEQ ID NO: 44858 - DNA, 162 bp, Glycine max
  Peptide Sequence Number=SeqID_161636
atggacttttcacaacagcctccttgtcaagagttaatctcaagggatttgcatggtaatgagtggaaattcagacatatcttccgtggccagcccgaaaggcatctacttacagcaggatggagtgtgtttgtgagtgctaaaagactatctaattactga

SEQ ID NO: 44859 - DNA, 576 bp, Glycine max
  Peptide Sequence Number=SeqID_161637
atggcggaaggaaacaaacaaagaaagccaatggaggaagaacccaatggaggggaagccggggataatgaaagccaacacggaggagaagaagccagacgagaagaaacgaatggcgcggaggaagaagaagccaaacgggaagcaaatttgaaatggaagattgctgggtgcacgggcaacggaggaaaacagaggaagaagaaagttggcgcggaagaaaaagaaaggcttttttttaaatatattatcttctattttttaaatgaaggcgatggccaaagcatcgatatattcatttacatactcgtcgcagtggcacaacgagagtatgatccttcatgtctgtgggagtttatgttggaaatccttggcagaagttccccttatggaaatgctggattacaaatacttgataggaactggggagctggttggcaccttttattgttattgcttgctactaaaccttctctaaggataagctttctgcaccctgctgacagcaaaaatcctaagcttcatcaatggttgtgcaaggaggaagtcagtgtgatacaaaacataaagcactaa

SEQ ID NO: 44860 - DNA, 1002 bp, Glycine max
  Peptide Sequence Number=SeqID_161638
atgtggtgcttgaggttgaagacgaaggttcttccgtggagaagaaccttcttccgcgcgtgtgaaagtggattgttggtattcgagcggaagaaggtgttcttccgcgggatccagcggaagaaggttctgcaggttcttccgcgggatccagcggaagaacgttgtcttccgcagatgcctgcgccttctcgcggaagaacctgcggaaccttcttccgtaggctacctctccttctcgtggaagaacctgcagagccttattccgcaggctacctgtccttctcgcggaagaacctgcagagccttcttccgcggaccataacacgaggtttaggtcgtgcgttaggaactggtagaggtagaggcattagtgaggatgtgcatcacgctgatgttcctcgacgttgcatgcctactgcttcagcacgcaggcaacgggttcatgtgcgtgaggacgttacagagagacctgaggatgtgcctcagttgcatgaggatgttcctcatgtgtctgatgctaccccagagatgacaggtgccgtcgatgttgttcacacagagggagtgactactgatgggagcttggggtcacctgctgcagatgagggattccccggtgggccacgcgacccatcggaacgacccgatctgaagttagtctcccatggtagaaaagtagataaaattgggagaccagcgcctgagatcgaaggcatgattgctgccaccggattgagtccactgatcaggtgttctgttatcaccactgatcctggactcatattcgccttcgtcgagaggtggcatcgtgagactagcacgttccacctgccagttggcgagttgacgatcacgctggatgatgtggcgtcactcctacacgttcccatcactggcgcgttgcataagttcgagccgctgattacttcatacgcgattggtctactgacgaagcttcttaaggtgagtcatgaggaggctacagctaagacccgatag

SEQ ID NO: 44861 - DNA, 201 bp, Glycine max
  Peptide Sequence Number=SeqID_161639
atggctcatgatggccaccggtcgtcgtgggtggtggagaaggagtttatagcaacccctctcaagttgacatttgtgctaagcatgacattttgcgctgagcgcaattcctctctggttagaattacacttagcacacttgtctcgttaagtgagatgtcgaaaagtgttattttgcaaatctcaacggtcacaacgtaa

SEQ ID NO: 44862 - DNA, 525 bp, Glycine max
  Peptide Sequence Number=SeqID_161640
atggatgttgatggtgctaacggtgtggctgaagttgttggagttgaaactcaagttaataaaggtgcagatgctgatgaagttaaagaacatgatgaggattttgacttttctaatcattctgaaagtgacccaaactatgcatatgtgtctcgagaagatgatggaaaatcaagggacacaattgtaagagagtatgccatttttcatgatagagatctcaaatggtcaaaaattgacaccattcaagctagagcacgctttaaacaaattaaatgtccatgggagattttttgttcatggtttgaagttacaagaagttctcaaatcaagacttttttggaggagtacatatggggaagggtcttcaaaaataagcaagctacaatgaaatgggtggctaataagcttagggttcatccaaacctaaatcatgttgaggcacacgaacatcttacacaacaatatggtgtgcacattgatgaaagaaagatggttgagggaagtatcttgttagaaaattaa

SEQ ID NO: 44863 - DNA, 843 bp, Glycine max
  Peptide Sequence Number=SeqID_161641
atggtcattgaccaatccctgttctatgacttgacccaattatctagagaaggtgtaccatttgaaggtacactgaatgatgattggaaatttgatttctctgtacatgatgtccgccggttggtttgcaccaaccaagcggatatgaccggaaggctgcttgctggccgacaaattgattgggcacacttagtccgatatcgcatgcataaggcattgcgattaaatgctcctttgccatatccacaccttgtcaaacttctccttcaacattttaacatccctcttgattctgaaccttatgttccaattaagagatccttcttgatcagtgctgttgtgatagcatcttttggttaccgtaaagagcatgatggctcttgggtgaaaaagggattgatggtcttcaaacttatgttggtgaaaggtttgatgctctggaactacaagtggacatgcgatttgacgagatggactcaaggatcactaagggttgtcatcatcaaaaagggggagatggtagaagcaagcttcatgatgatgaatcaagttgattcaagtatttttgatgatgacaaaaagctcaagaaaatgatttcaagattaagtcaacaaggtacatcctttgtggtacaagtagagggtacatctacttgggttgttgtaactgagaacaagagagggtacttttcttgtggatcagttcaagtggagggtatatccatttggttgttcaaagagaacaagggagggtacatcccttgtgaatctttgcttataaaggtttttacaaggatgaaaataaatctcaaggaccgcaggttgcttggggactggatgtag

SEQ ID NO: 44864 - DNA, 384 bp, Glycine max
  Peptide Sequence Number=SeqID_161642
atgtcgcgggggtcaggagaccttggagacgttaggcgagctcctggcagtcaacagataaaaggaacaaagaccacaaagcaaggaggcttgtggtggctggccagctgtggattttgtgtgatatgtggagtatggcctctgagggatgggtcactggtaatcgattaccagatcgggatggcggcgcagctaatccgtgatcgagtagagatggagtgcctagagggagcttgggagaccctcgaaggcaacacgaggtgccgatttcggggcaccattcgattcatggctacttctttggtgcatccagatgaacctgcacggacgcttcagcgcacggtggagtggacagctccttggattagttttgtgtatttttga

SEQ ID NO: 44865 - DNA, 498 bp, Glycine max
  Peptide Sequence Number=SeqID_161643
atggctccaaagaagcttccagctaagatggtaaggaaagatgccgctggagaaggttccagcgcagtcccacaagtggatgtgaagtttgatggacattggttccgaagcgaggaacaccagcgccgttttgaggcaattaagggttggtctttcctcaaggagaggtgggtccagttcagggaagaggaatatgccgagttccaggaggaaatcaccaggaggcagtggactcaacttgcggcacccatggctaagtatgacccagaaatagtcatggagttctacgccaatgcatgggccacggagggtgcgaaaaagccgaaacaatgggccaaagcatttgtcgccaccaacgtttatttgagaaaaattctagaaaaaccaaaaggcgaaggtttgcgtattttgaaaatgagggttcgggagttatttacgtataggaaaggtattagcaccccacgcgcccgtcacaagggatggcagccttttaattga

SEQ ID NO: 44866 - DNA, 240 bp, Glycine max
  Peptide Sequence Number=SeqID_161644
atgcagtgcaaaggggagcatctcgtaccaatccttattggtcgcattatcaattataatcttcatgggcaacccatattgtcaaattatctccttttctatgaacctaaccaccacatgatgaaatcctacaccgcaagggcattggatagaagactccaagaagattgggctagtgatgcaagaaaaggccctagggttctcatgagccttagggtagatttcaggcccatgggctaa

SEQ ID NO: 44867 - DNA, 1041 bp, Glycine max
  Peptide Sequence Number=SeqID_161645
atgaatatgcaaatcgaaaccaccatgaaagccgcgattgtgaaggcgtttggtgaaccgctggtgattgagcaggagccggtgccgtccgttgggccaggacagattctggtgaaaatcgccgccaccggcgtgtgccacaccgacctgcacgctgccgaaggcgactggccgattaagcccaatccgccgtttattcccggccatgaaggcgtcgggcaggtggtagccgtcggcgagggcgtcaaacatctcaaactgggcgatcgcgtcggtgtgccgtggctttactcggcgtgtggccactgcgagcactgcctcgacagctgggaaacgctgtgtctgtcgcagcagaatgccggctattcagtcaacggcagctttgccgagtactgcctggcggatgccaattacgtcggcatcattccggataacgttgagtttaatgaagtggcaccgattttgtgtgccggcgtaaccgtctacaaaggcctgaagatgaccgataccaaaccgggtgactgggtggtggtttccggcatcggcgggctgggacacatggctattcagtatgcggtggcgatggggcttaacgtggcggcggtcgacatcgacgatgataagctggcgtttgccaaacggctcggtgccagcgtggttgccaatgcgaagcaggtcgatccggcgaaggtgtttcaggagagctttggtggtgcgcacggcgtgctggtgacggcggtctcgccaaaagcgtttgaacaggcgattggcacgctgcgtcgcggcggcaccatggtgcttaacggcctgccgccggggaaattcgatctctcgatcttcgacatggtgctggatggcattacggtgcgcggctcaattgtcggcacgcgtaaagatctgcaggaggcgctggattttgccggtcgccataaggtgaaagcgaatgtcgcggttgagccgctgactaacatcaacgatatctttgcgcgcatgcacgccggcaaaattgaagggcgtattgtggtggatatgtcgctgtag

SEQ ID NO: 44868 - DNA, 276 bp, Glycine max
  Peptide Sequence Number=SeqID_161646
atggcgctcagagacatattatggtcattctgcgcctttccgtcctgggtcgatcgtgtccgatggcacgcagagacaaattatggtcattctgcacccctttgtcatctagaggcggcgagcccgatgacatgcggagacaaactatggtcattccgcacaccttttcaccattcagaggcgatcgtgtccgatgagacgatcatgctcgatgacatgcagagacaaattatggtcatccgcacgcttttgctatctgtaagactcgatgcctga

SEQ ID NO: 44869 - DNA, 162 bp, Glycine max
  Peptide Sequence Number=SeqID_161647
atggagatgaaaggctccgaacgcgggacgtcaggatgtatgtggtttataggcgttcagaatccagacgatgtcaaatccagagaggttgatccacggagacaaaaagatgaggagatgaaaaaacgtgaagaatggagtcagaagagtgagatacgttaa

SEQ ID NO: 44870 - DNA, 132 bp, Glycine max
  Peptide Sequence Number=SeqID_161648
atgttacggcgccagtacgtattggtcaatgggttcaaagatggttctagagatcctagacctgttggccatgctccttttgatctcctcagaagtggcagccaggaatttaaaagagggcaagtcttataa

SEQ ID NO: 44871 - DNA, 207 bp, Glycine max
  Peptide Sequence Number=SeqID_161649
atggttaagcgcgcgatctcgctcggcgtctgcaaggtcaacgtcgccaccgaattgaaaatcgcctttgccgatgcggtgaaaagctacttttcacagcacccggatgccaatgacccgcgcaaatacatcgtccccggcaagctggcgatgaaagaagtggtggcggaaaagatccgcatctgcggcagcagcggtatgctgtaa

SEQ ID NO: 44872 - DNA, 180 bp, Glycine max
  Peptide Sequence Number=SeqID_161650
atggcggatttcggacatgctgatgggcaaccgcagggttgcccaaatagccggctcagggccggggtggtaatggcgccggtgaagcgcacgacgccggaggcgacctggctgccggaaagcggttttgcttgcagagcgaagggcagaatgaccaatgcgcttaatacggctaagtaa

SEQ ID NO: 44873 - DNA, 2043 bp, Glycine max
  Peptide Sequence Number=SeqID_161651
ctgggcgtctttgccatgaccgagcagggcatgcgcgaagtcagtaacccgtctgctatctttttgtcacgcggcgatgagattacctcgggcagttcggtgatggtggtctgggagggtacgcgcccgctgctggttgagattcaggcgctggtggaccattcgatgatgggcaatccgcgccgcgtggcggttgggctggagcagaaccgtctggcgattctgctggcggtgctgcaccgtcacggcggcctgcagatggccgatcaggatgtatttgtgaacgtggtcggcggcgtcaaagtcaccgagaccagtgcagacctggcgctgctgctggcgatggtgtcgagcctgcgcgatcgcccgctgccgcaggatctggtgatttttggcgaagtcggactggccggggagattcgtccggtgccgagcggccaggagcgcatttccgaagcggccaagcacggctttaagcgcgccattgtgccggcagggaatgcgccgaagaaggcgattgacggtatgaaggtgtatagcgcgaagaagctggcggacgcgctggcgattctggacgagctggggtttggcttgtggctccaccttttccctcaccctaaccctctcccgcttgcgggagaggggaccgatcggagaggcgggaagtacggcgttgttctgccatttaccgctctattcaggattttcctcctctcccgctgggcgggagagggaactgatcgaagcggcggaaagtacggcgttaatctgctatttatcgctctgttcaggattttcctcctcgcccgcttacgggagagggaaccgatcggagcggcgggaagtacggcgttgatctgccatttatcgctctgttcaggattttccccctctcccgctggcgggagagggccggggaggcaccacatgtcatcgtttgactatctgaaaaccgcgattcgccagcaggggcatacattgcagcaggtggctgatgccagcgggatgaccaaaggctatctgagccagttgctgaatgccaaaatcaaaagcccgagcgcgcagaagctggaagcgctgcaccgttttctcgggctggaattcccgcgtcgcgacaaaaccgtgggcgtggtgttcggtaagttctatccgctgcacaccggtcacatctacctgatccagcgcgcctgtagccaggtcgatgagctgcacatcatcatgggccatgacgatccgcgcgatcgccagctgtttgagaacagcgccatgtcgcagcagcccaccatcagcgatcgtctgcgctggctgctgcagaccttcaagtatcagaaaaatatccgcatccattcgttcaacgaagagggcatcgagccctatccgcacggctgggatgtgtggagcgctggcgtgaaaaccttcctcgcggagcagggcattgagcccgactgcgtctataccagcgaagaaccggatgcgccgatgtatcagcagcatctgggtattccggcggtggtgatcgatccgcatcgatcgtttatgaacatcagcggcagccagattcgtcaggatccgttccgctactgggagtacatcccgactgaagtgaagccgttcttcgtgcgcaccgtggcggtgctcggcggtgaatcgagcggcaaatcgacgctggtcaacaagctggccaacatcttcaacaccaccagcgcgtgggagtatggccgcgactatgtcttctcgcacctcggcggcgacgagatggcgctgcaatactccgactacgacaaaatcgcgctcggccaggcgcagtacatcgattttgccgtcaaatacgccaacaaagtggcgtttatcgacacggacttcatcactacccaggcgttctgcctcaagtatgaagggcgcgagcacccgttcgtgcaggcgctgatcgatgagtaccgctttgacctggtgattctgctggaaaataatgtgccgtgggtggccgacggcctgcgcagcctcggcagttcgatggatcgccgcgagttccagtcgatgctg

SEQ ID NO: 44874 - DNA, 246 bp, Glycine max
  Peptide Sequence Number=SeqID_161652
atggcaatatttctaagactaaaaataaaaatttcaatccaaagaacaataataaaaccaagctatcgaggttaccttaagaggcaagggatgactcctggtagtgcacgaactcaggccaccaaaaaacccaaccacactacgtcgaactcaagagggatgactgctggaacacacgacagacggcgagacacgagacacaagccgagaggcaagattgaaagcttttcgggtgcggttcagtag

SEQ ID NO: 44875 - DNA, 207 bp, Glycine max
  Peptide Sequence Number=SeqID_161653
atggctttagagagtggaaaccctcgttcttcatttgcaacctgccgaatgggaaaagcgcctaacagagtgctgtttttggtcccaaagggagtgcaaatcagtgttaaaggtccttattctgctcagtctcaccctgccacaattcttagaacttgcaaatgcaggattaatttttacccaaactctagggaagactatggttga

SEQ ID NO: 44876 - DNA, 159 bp, Glycine max
  Peptide Sequence Number=SeqID_161654
atggttgaagaactggagcagctcgctcagcgcatcaacaatcgctcaatgcgaggagccaacttggaggtcaggattatggaatcaagaaatgccaagtttcttgaaaatgacttgatcagtgggaatgatcaattgagagacttaattaggttctaa

SEQ ID NO: 44877 - DNA, 766 bp, Glycine max
  Peptide Sequence Number=SeqID_161655
gtcgactctagaggatcccacgttgtacaccggtaaactcatatggttggtttcacacctttttccgccaagaggtgagacacgtttgcccgctagaaggccactgctcatgcaccgagaagaaggaggcaaactgggaccgactcttagcaagcaaagaagaaccgtctgtcagttggttccccgatggaaagaaggaagaatcgggattcttattttatgcggaggatttccaaatgttccgttgatggggacaaggggttgcattaattacaatcccgtcctcaccataagacaacttggctaccctatgaggggggcaccattagaggaaggcctcacaccttttattgcgcaaggtttcaatagcaccaacacgggggtgcttcagggggtccgcaaggcatgggaaatggtgcaaaagaaggacaaagaacttaggggaagtagcaacgggcccatcagcggttaccataagtggttgaaagcctacgcacaaggtctggattggctcccgaatttgagagccactaaagaggtggagggtgaagctccgaaagaagacaaagagttacaagccctcaaaataaagcttgagaaagcccaagcagtaaaagaaaaattcaagtcagcagccgttaggatccgaaaagagaacgccgaactgagagacgtcaacatagccacaaccaaggccttggagcaaaagaccaagagggcccgcaaggaagaacatggttggaacaagttccaaggggctctgtga

SEQ ID NO: 44878 - DNA, 988 bp, Glycine max
  Peptide Sequence Number=SeqID_161656
ttgatggcgatgacacggtacgcgtgcacctggccggcgatgaacaaccggcgccgatcgcgctgaacacgctgctgccgcagatccgctacgccgcggcgctgcgtccggtgacggccgccaaagatagccgtgtcgatcgctatctcgccacggtcaggcccgactggctgcgccgtctggtgctgcacgacatgcgtccttacggctacgtgatgctgggatcgttcctgatcaacctgctggcgctggtcggcatcatcttctcgatgcaggtgtacgatcgggtgatcccggcacagtcgtaccccacgctgtacgtgctgtatatcggggtgatcctctcggtggtgttcacctatattctgcgcgtcggtcgcgatcacgtcaccgatctgctcggcaagcgcgccgatatgcgcgtctccgatcgcgtgttcggccacgcgctgcggctgcgtaacagtgcggtgccgcgatcgaccggtacctttatctcgcagctgcgcgagctggaagcggtgcgcgaaatggtgacgtcgaccacggtgacggcgatcgtcgatatgccgttcttcctgctgtttatgctggtgatggcgatcatcgcgccgcagctggcgtggatcgcgccggtggcggtgctgctgatgatcctgcccggcgtgctgagccagaaaaaactggcgaagctggcgcagcaaaacctgaaagagtcgacgctgcgcaacgcagtgctggtggagagcgtgcaggggctggaagatatcaagctgatgcaggcggaggatcgctttctgcagcagtggaacagctatatccgcatcaccgcgcagtcgggcgtcgagatgcgcaaagtgatgcatgcgctgattagctggggcgtcactattcagggactggtgtacgccagcgtgatcgtggtgggggcgccgatggtgatcaacggcgatatcaccaccggggcgattgtcgccgcgtcgctgct

SEQ ID NO: 44879 - DNA, 213 bp, Glycine max
  Peptide Sequence Number=SeqID_161657
atgtggtggaaggaaaggtccttagctaggttgcataggctagaagcagggaatttaatttggaggaagttctttctctttggaatcggattctctggaggctatgaggttagtccagaaggggtagaatccgtagagattacgttgggcaaatgtcatgcgtgtgtgtgtgttaaagggtgggagtgtttacatattagaggcgtaatttaa

SEQ ID NO: 44880 - DNA, 321 bp, Glycine max
  Peptide Sequence Number=SeqID_161658
atggacaccggccatgacacagtgacgtggacacctgtcaaacatatcaaactcaatccggtacgggtgtcggtgtcggtgtcggtgacactgcaaggggctggggatgggaatgaagtttttttcaggatcaagagaagcactcaattgaagaagcttatgaatgcttactgtgaccgacagtcggtggatttcaactccattgcttttctgtttgatggacgccgcctccgagctgagcagactccagatgagttggaaatggaggacggggacgagattgatgccatgcttcaccagacaggaggttctgttgtctga

SEQ ID NO: 44881 - DNA, 228 bp, Glycine max
  Peptide Sequence Number=SeqID_161659
atgtcatggaacttcacggattacctaacgatcggtgttaagtacctcgaagtggtcaagcgaaggtcgcatcccaacaaacagacggtcccggacgaaattagggtgcagaatgaccataatttgtctctgcgtgccatcggacacgatcgtatctggatgacaaaaggtgtgcaaaatgaccataatttgtctctgcatatcatcgggctcgccgcctctggatga

SEQ ID NO: 44882 - DNA, 728 bp, Glycine max
  Peptide Sequence Number=SeqID_161660
gagggcaacagctccgggctgtccgccggcgaagagccgttcctggtgccgctggcgatcccgctggtggccgggccgtcgattctggcggcgctgatgctgctgtcgcaccagtatccgcatcagctgccccatctggtggcggcgctgttgatcgcctggggcctctctgcggccattttgctgatgtcgaacctgttcctgcgcctgctgggcagcaaaggcgtcagcgcgctggaacggttgatggggctgattctggtgatgctgtcgacccagatgttcctggacggcgtgagggcttacatgaagctgtaggcgcctggcggcgccgacgacggcccgcgctcagcgggcgaggaaatgcaggttgcgattgccttcgcgcaggcggtcacgatagctttttttcagcgccgaacacaccagcagcgacaccggattggtgcgttgcatggcgaagatggcgtcgttcaaggccgccagccacgaggcgcgatcgttgtcgtccagcgcgtgcccggcggccatttgttgatgttggcgcgcggatgcaggtaatcgccgtccagcatggcggcatcggcctcgcgggcgacggcgctggctacggcggatttgccgctgccggatacgcccatcaggataaatacgtgattctgcggattactcattgtgtcatgcccttatgggaactggcgcgagcgcgccaaatgcgtcccgactga

SEQ ID NO: 44883 - DNA, 245 bp, Glycine max
  Peptide Sequence Number=SeqID_161661
cccatgggcccaaaatctaccctaaggctcatgagaaccttagggccttctcctgcatctctggcctaatcttcttggagtcttatatccaatgctcttggggggtaggattgcatcaacctgctcctgaggagacccagccatctaaaccagtcatggagccagagcagcctatccaggattcatcagcagcttcagcactggatcttaatgaagatcagccacaggatgagcaggacatttaa

SEQ ID NO: 44884 - DNA, 802 bp, Glycine max
  Peptide Sequence Number=SeqID_161662
atgcaacaacctgggaaaggatttttagtgtggctgggcggcctgagcgtgcttggctttctggccaccgacatgtatctaccggcctttgccgccattcagcaagacctcaacacctctgccgcatcggttagcgccagcctgagcttattcctcgcgggcttcgcgctcggccagttgttctgggggccgctgtcggaccgctatggccggaaaccgattctgctcgccgggctggctatcttcgctcttggctgccttgggatgctgtgggtacgcgacgcgacgctgatgctggtactgcgttttgtccaggcgatcggcgtatgcgccgccgcggtgacctggcaggcgatggtgaccgactactatccggcccagcgcaccaaccgcattttcgcaacgatcatgccgctggtcgggctctctccggcgctggcgccgttactcggcagctggctgttagtccatctggaatggcaggctatcttcgccaccctgttcgctatcaccttactgttgatgctgccggcttttcgtctgaaggcggtcgtcaaacctgctggcgaaacccagcagaaacttacctttatggccctgctgcgttcacgtgaatatagcggtaacgtactcatttatgcggcgtgttccgccagcttcttcgcctggctcaccggttcgccgtttatcctccatgaaatgggctatggcccgacggtgattggtcttagctacgtgccgcaaactatcgccttcctgatcggcggttacggctgccgcgcggcgctgcaaaaatggcagg

SEQ ID NO: 44885 - DNA, 2197 bp, Glycine max
  Peptide Sequence Number=SeqID_161663
caaacgcggtggaaacatcggtttgtgtgaaaccaaaagccaaggcatcgcggctaacattggaccagttctgctcgcagcaggccaagtctatagagaaccgtgaatacagtgtaggtggagtacgcctagggcaacacgggcaaaactctgattttcttgtcagattaatctggcaagccgctaccaataagggtgccaagccgccattcgcaggactcgacctgctagcagcgttatgccttaaccagccaaacgtcaccaataacactcaacatccgcatttaaaggcatccatgaataactccgactttttagtacaggcagccatttaccttgcttccgccatcattctggtgcccatttttaaaaggctggggctgggatcggtactggggtacctgattgcgggcatactgataggcccctttgccttaaagctcatcgccgacccggagcatatgctgcactttgccgagtttggtgtggtgctgatgctgttcctcattggcctggagctggagtcacaaaaagtctgggagttacgcaagctgctgtttggcctgggaggcatgcaggtcacgctcacgattgcactggtcaccgtcattgcccatggcttaacgttttcatggcctgaagcgctgattattggcatgggggtcgccatgtcgtctacggcgattggcctgacggcactgattgaaaaaaagcagttacacacccaaggcggccaggccgcgtttgcgaccttgctgttccaggatttatcggtgattccgctgtttatggtgctggcgtttattgcgccacataaaacggcttccgggtttgatctatgggcggtgacgcagtccatcgcggtgattgccgcgattgtgctggcaagcaaaaccattttacggcccatcatgcgcatcgtcgcccaaaccgggatcagggaagtgtttgtcgctttttcattattgctggtgattggcgtttccctggccatggcctcagtcggcctatcgatggccctggggcctgctgttggggttgttctttatttcggtcggcatgaccgtcgacctggccttggtcgccaaccagcccatgctgatttttggctttgccttgctggtggtggctaccaaactgttggtgctgattggcctgggctgattggtgaatttgcctttgtgatttttggcgtggccttaacccaggactcgatctcgcgcgaaacctacaatatcctgaatgcgattgtcgctgtctcgatgctggtgacacctatcctgttgttgctgtatgaccggttcctgatgttgcaatgcggcgaacggccgcaggatgcgatcccggaaaataacagtgtcatcattgccggctttggccgctttgggcaaattgtaggccgggtactgattgccaaaggcatcacgcccaccctgattgataatgacccgaaccaggtggatttgacgcgcgaatttggctggcgttgttattacggcgatgcgtccaggctggatgtgctcgaagaagccgggatcgccgaagccaaactattggtgattgccgtcaacgatgccgcggccacgctggaaatggctaaactggtgaaggagcgctggccacaggtgaaaatggtgatcagggcgagaagcagaaccgatgcgtttgatttgcgcgacctggatttaaacccggtgcgcgaaaccttttattcttcactggaagcggcccggcaagcattggtgatgataggcgaaacttccagtgctgccgccaaaatcatcaagcaatttgaaaagcatgatattgagcaactggaaaccacccgcaagatccggcatgaccgcaaagccttatccagccaaatggagcaagggcggcaggatttgaaaaccttgctggaaatggaaagcacctctccagagacaaagcacgcaaggcaatcccttgtcagggtgggtcgtgctggagacgagagggcttctgcggaagcctctctttatgccaacctggatgttgtcaccattaatgacgccattgtcggtgagtttattactgatgtgagtaatcaatcctttttgtttgtgcctgccaaaggtgaccgcatattgctttcccgcgtgacttacgaagaggcgtgtaagctagtgggtgaggagcttacacagctatatgcgcatcgttgcgcgatggcggc

SEQ ID NO: 44886 - DNA, 744 bp, Glycine max
  Peptide Sequence Number=SeqID_161664
attttagaattgctagagccagttgaggcgcaattgcaacgcaagattaaccccacgatttatacgccaagtgagtttgctgagcgtttggcacaggggcaaaactttttaagcaagggtttaagcgaagacagtcagtttgctttggcttatggcgcagcgcatgctttttcattagcggctttgcgttggcatggctaccgcagtgataatcaaggctacaaccgtgagctggctttgtatgctgaagatgtgcttggttttgtgcaagacacgcaagacgagcagtggcaaaagtttaaagcactttaccccactgatactgagcaaaggtttttggagcgcgttgcaacacagctgaataaagctgacccgaatgcagccaataaagaaatgcgtacctttggtactttaggcgtattgcgtcatgaactgcgtgaccgcgaacctacccgtgaagaaattaataccctgacaggcgccaccatgcttgagtttggcgccagctggtgcggctactgcaaggctgcgcaacctacaattacctctgagttaagtcatttccccaacatccgccacattaaaattgaagatggcaaaggtcgcaggttgggcaggtcgtttcaggtgaagttatggcctacgctgattttgatgaaagatggtgttgagttgaagcgtttggtcagggagattgacgcgggggagttgaaagcggggttagcgttgatttcagcgcaccag

SEQ ID NO: 44887 - DNA, 1093 bp, Glycine max
  Peptide Sequence Number=SeqID_161665
cagttagcgccgctgaatggttatgtggctaacaattacggtgcgtttctctgcggtttgaggcagtatgacgaagcgcatcaacagtttaagctggcaactgaagcgcagcacagcgacgccgctcaggatgccctgctgttttcgggctattgttacctgcaggcgggagaggatcgcgccgcgcgccagcagttcgatctcgcgctggatgccgcaccggagcagggcagtatgctgctgacggaagtggaacgacggcttgaacagcagcagtgggcttcagtgccgctgcttttagaagtttaccatcagcatttgccggcaacggcagagagtctggggttacagatacgtttcgccgcgcaacagggaaacgctgctgacgttacacgtgaacgcctgcgtctggcccgtgagcagatggggctgacccagcaaaacgtcgctgagcgcctgtgcctgaaactttctaccgtgcgtgatattgaagaggataaatccccggcggatttggcctcgaccttcctgcgcggctacattcgctcttatgcgcgtctggtgcatgtacctgaagatgatctgctgccgatgatggcaaagcaggctccggtgcgtgcggcgaaaattgagccgatgcagagcttctcactgggtaagcgtcgtaaaaagcgtgacggctggttgatgatcttcacctggctggtgatttttgtggtggtcggcctgaccggcgcctggtggtggcagaaccataaagcctcacaggcggatctggtgtcgatggctgaccagaacggcagcagcagcgacaacagccagtcgattccgctgggtgataacagcacggacagcactaccgacagcgacactaacgcggccggtacgccgattgacaccggtgccggtgcggtcagcacgccagacaacgcgggcagcactaactctgcgccagcagcgaccagcagcaacacggcaaccagcagcgacaacgcagtggtgtcgccgagccaggcgccgattgataacgcaccgccagcggccacctcaccggctccggccaacagcgtgccggcaggctcaatgccaaccg

SEQ ID NO: 44888 - DNA, 732 bp, Glycine max
  Peptide Sequence Number=SeqID_161666
atgaaaattgcaattgatgctgctaatggccttgcatttttgcatgaggaagcttcgaggcgagtaatatttcgagacttcaagacatctaatatcttattggatgagaactacaacgcaaaactttccgattttgggcttgcaaaagatgctccagtgggagataaaagccatgtatcaacaaaagtgatgggaacaaaagggtatgtagcccctgagtatatgttgacaggacaccttacttccaagagtgatgtctatagctttggggtggttctacttgaaatgctaacaggaagaagagccgtggaggaaagaatgcctaggaaggaacaaaacttggtggaatggttgcgccctcgtcttagggggaaagatgatttccgctatctgatggatccaagacttgaaggtcaatacccaatgagaagtgctcgtagggcaatgtggttggccactcattgtattcgccataaccctgaatcaagaccccttatgagtgaagtggttcgtgagttgaagtctttgcctctttttgatgatgatgatgacatggcttctcatcagcctggtcccttagcctcatcaataccctcaacctcacttcagagactgcacgtaggtccttccaaccatgctggttctaacaagtatggcctcaaaactggtcaagcaccaaatgttccaaggcactatcaagcctcccctcgatctacctcctctaaatcctga

SEQ ID NO: 44889 - DNA, 288 bp, Glycine max
  Peptide Sequence Number=SeqID_161667
atggttcgggttcgggtgaagcatcttatctttcccgctgacttcgttgtaatggacattgaggaagatgcagatattcccttaattttgggacgtccatttatgtctattgcaagctgtgtagtggacatggggaagaaaaagttagaaataggtattgaagaccagcagatcaactttgatctatttaatgaagaaagaaaattgatggaccaaaatgtttgtttacagatgaaggagtttgatgagaaggttctgaaggagagaaccaagattgatctaggataa

SEQ ID NO: 44890 - DNA, 864 bp, Glycine max
  Peptide Sequence Number=SeqID_161668
atggtgaaagtctttcatcttgattgtgcagcagcaactaagcaccttacatggcctgtcagaattaaaattgcaattggtgcggctaatgcccttgcatttttgcatgaggaagcttcaagaccagtaatatttcgagatttcaagacatctaatgtcctattggatgaggactacaatgcaaaactttccgactttgggcttgcgcaagatgctccaatgggagataaaactcatgtttccactgaagtaatgggaacacaaggctatgcagcccctgagtatgttatgacaggacaccttacttccaagagtgatgtctatagctttggggtggttctacttgaaatgctgacaggaagaaaagccatggatcaaagaaggccaaggaaggagcaaaacttggtggaatggttgcgccctcgtcttagggaaaaagataatttccactatctgatggatcctaaacttgaaggtcaatatccaatgaaaagtgctcgtagagtaatgtggttggccactcactgtattcgccataatcctaaatcaagaccccttatgagtgaagtggttcgtgagttgaagtctttgcctctttttcatgatgataatgacatggtttctgatcatccttgtcccacaacctcatcagtttcctcaatctcaatttcctcaagctcacttaaaagattgcatgttggcccctccaaccatggtggtgcaaacaagtatggccccagaactggtcaatcaccaaacgttccaaggcactttcaagcttatcctctacctcttccaaatcctggtgttggatcttcatccaatcctactgttgcatcttcttcatccaacccaagattttaa

SEQ ID NO: 44891 - DNA, 1329 bp, Glycine max
  Peptide Sequence Number=SeqID_161669
atggcagtgttgtctcatgtttgcagttgcatctcacactccactctcttcacttcaactgcaccttcttcatctctatctgtttcaccaaccactttccttcaattgtcttcgttctccaccgagtcaacgtggaacaacattcgtagaacaaacctttgttccaacgttaattctcttcgttattctgggaagacccttttgcggcataggcataaatattacaacccttgttcttcaatggcttcatcgttggatgagagtggtaaacgatccaagagagtttggatatggaccagcaacaagcaggtcatgactgcagcagtagagagaggatggaacactttcgttttcccatcacaccatcgacaacttgctcatgattggtcttccattgcggtaatatgccctctttttgttaatgagggagaggttttggatggacagaataaaagggtagccacaatttttgacgtttcaaccccggaggaactagaggaacttagaccagagaatgagcaggcagagaatattgtagttaatttactagattggcaggtaatacctgctgaaaatataatagctgcatttcaaagaagccaaaatactgtgtttgccatctctaataatacatctgaagctcaggtgtttcttgaggcacttgaacatggtttagatggcataattatgaaagttgaagatgttgaacctgttctcgagctaaaggaatatttcgacagaagaatggaagaaagcaatctactgagcttgaccaaagccactgtaacacatattcaagcagctggaatgggtgatcgcgtttgtgtagatctctgcagtctcatgagacctggtgaaggacttcttgttggatcttttgccagaggattatttcttgttcactcggaatgcttggagtcaaattacattgcaagcaggccgtttcgggtgaatgcaggaccagtgcatgcctatgttgctgttccaggaggcagaacatgctacctgtcagaattaaaatcaggaaaagaagtgattatagttgatcatcagggtcggcaacgaattgcaattgttgggcgtgtaaagatagaaagtagaccactaatccttgtggaggcaaagatagaatcagataatcaatctatcagcatccttttacagaatgctgaaacagttgccttggtttgtacaccacaaggaaatacactgttaaaaacatccattcctgtgacctcactaaaagttggagatgaaattctgttgagagtacaaggaggtgctcggcatacaggaatagagattcaagaatttatagttgagaaatga

SEQ ID NO: 44892 - DNA, 363 bp, Glycine max
  Peptide Sequence Number=SeqID_161670
atggtggagacagaggcaacgaggaatgtgattttggaggagttggaggggaagggtgaggagggggatacggtgggtgaaagggaggttgcggcgagtgttccgatggtgatgctgaggattggggaggtggcggaggcgagtttggtggtgttgttgccggtcttcgcggtggaggaaagggagattttggaggcatgcaaaatatgcagacaaatatccctttggaatagaccccctccatacagccttttgtacggctccatgtcacaacctacccttcggcgggagggcgacgcggggctcgtgggtgcatcttccatgggaggaaaatgtgcggaatcaccaccaacatttatttga

SEQ ID NO: 44893 - DNA, 689 bp, Glycine max
  Peptide Sequence Number=SeqID_161671
ccggtgtgatgagcggggcggccggtctgcgcggccgcgcgacaggcatcgtaatagccggtgccgaccaggtccggacagctgtcccacaggccgtggcccaccaggtcctgcctgctgcgccgcagcagccgttcggcgcccggattgagataagcgacgcgccagtcgcggtccagcgacaggaaaccgtcggccagggcatcgagcgtggcgccgtcgacgccggccgccaggcgcgccgccgcgccggcttccttgaccacgcgctgccacttgtcgatctcggcgcggcggaaggtgtccagctcggccggcgtggagccgatcggctcggcgccgatgccttcgagctgttcggcgatctgcgggtccttcagcaccttggccagcgcctgcgacactttgttgacgatttccggcggcgtgccggcgggcgcgaacaccgcgttccattcgtaggtttcatagccgggcacgccggattcggcgatggtgggcaggtccggcgcggccttggagcgttgcgcgccgccgacggccaccgcgcgcagcttgccgttcttcacgtgctgccaggccgagcccatgctcgcgaacatcaccggcacctggccggacatcacgtcgatcatggccgggccgccgcccttgtaggcgacgtgctgcagctgggtcttggccagcag

SEQ ID NO: 44894 - DNA, 240 bp, Glycine max
  Peptide Sequence Number=SeqID_161672
atggtcaaaagtcgagacgagttgacggcagaaatcaaccaaggtaagataatgacccggtcccgattggccgcacattgtttgctccctacttgcagtaatcgacgctgtcgcaacatgcccttttgcgggcgagtgaaggcaaggctcacgggtgcgctttccaaaggaggaaagatgcgcggagtcgccaccaacgtttatttgtggaaaacgttcgggaaaaccgaaggaaactga

SEQ ID NO: 44895 - DNA, 1006 bp, Glycine max
  Peptide Sequence Number=SeqID_161673
atgaagctcaatgtgatttgttacgccctgctgggcctggcgctggtcgccagcctgttctcgctgcatccggtgtggatgtggttgctgctggccaacctgctgacgtttctgatctacggcggcgataagctggcggcgcgcaaggggtggcggcgggtgccggaggcgacgctgttgctgttcggcgcgctgggcgggtggttgggcgcactggcggcacagcagctgtttcgccacaaaacccagaagcagccgtttaaaacctggttcatcctcagcgtggcgctcaacctggtggcgcagcagcggcagggtggcgctggcggtggcctgcatcgcctgagcgtaggcgggatcgcgccgagccagttcggcgatcatcaactccaccagcagcatggcgccgaccttggccggcagggcgccggcggtcagcggcccttccggtttggccgccaccagcagcgtatccgccagcttggccagcgggctgcgttgggtgttgctgacggcgatcacgcgtgcgccgcgccctttggccaatgccaccgcatgcagcacgtccttggtggagccggagctggagatgacgatcagcagatcccgctcactcagcgaggcggcgttcatcgccgcccggtgcatgtcgctgaacagctgcgccggtttgccgaggcgcagcagcttgtagtgcaggaaatcgccgatgatggcgctggcggcgacgccgtaaatctgcaccgaagcgcaacgctgcaggctgtccgccgcctgttgcagcgcctgcggatccaacagtgcgccggtatcccgcagcgcctgaacgctctcttccagcaaattttccgccgcgctttgccgcgtcgccgcctccggctggctttgttgcaggctgagggccagcgccattttaaattcggtatagcctttgcagcccagatggcggcacagccgcgtgacgctggcttcgctggtggcgctttcacgcgccagttcggtgatg

SEQ ID NO: 44896 - DNA, 493 bp, Glycine max
  Peptide Sequence Number=SeqID_161674
atggccgacgcggcaaacccgcgtcggcctggggatcgcgggttactggttttccaacacctggcgcacgctgccgttggtggcatgcgctggaacattcaggtagcgaatatcatcaaccacccagcaggtgccttcgcgcaccatcagcacttcgtcctgccagttcacggtgctgttggcgtctttttggtagctcaagtcgacgcgcagcgggatgtttttcgcatcggtgttaggaatggtcgaggcgctggcgacggacgcgctgcctggcccctgcgcattgccggagaacaagtcgccggtgatccgatgcttgcccgggttctgggcggcgctgaccagatcctgatacagcactttgctcaggtaaggctgcagctgcgccaggcggttactgtccggcaggccagcgccctgctggatgcgcaggtcatagaacttttgcgtgaccgtatccgggccgccttccacacagctgccgctgcgg

SEQ ID NO: 44897 - DNA, 982 bp, Glycine max
  Peptide Sequence Number=SeqID_161675
cgtgcgccaggtagtgggctccctgcgcggcggggcgcggtcgatcgacatgctggcgatgcaggcgaagccgcacaggtacagcgccgccgccacgcagtagacccacccggcccccagcccgtagccgatgccgcccagcgccgggccggcgatctgcgcgatctggccgccggaggacgacagcgcggtggcgcgcggcagccactcgcgcggcacgatggcggggatcagcgtggtcagcgtgggcgcctcgaaggcgcgcgccgaactcatgatgatgagggtggcatagatcagcgtcttgccgccgacgccatgcagcgcggcgatggccagcagcagcgtggccagggtctcgaccgccatgcagatggcgacgatcttgcggcggtcgtagcggtcggccacgtggcccaccaccaacgtcagcgccgccatcggcaggaactgcgccagcccgatcaggcccaggtcgagcgcgctgcccgacagcgcatagacctgccagcccaccgccaccgagacgatctggaaggccagcgacgcgccgatgcgcgcgaacaggaagtgcaggaaggcggggcgggaataccggctgacgggaaactaagagtcgattcccgccaggcggccggtgctcgggcgcgaacgctaggcctttggccagtaggtgccgaaataccagagattgccctcggggtcgcggcaggcgaagtcgcggctgccgtgcggcgagtcatagggctcggccacgatggtcgtgccgcctgccttcagcctggcgtgcagggcgtcgggatcgtccaccgccagatacagcgcgtcggtgcggcggccttgcggatcgccgacctgtttgccgtagtcgtcgtcgcgatgctgtcccagcatcaggatggaactgccacaggccatttcggcgtgttgcacgacggcgccgtcgcggtagacggccagttccgtgaagcccagcatggcg

SEQ ID NO: 44898 - DNA, 405 bp, Glycine max
  Peptide Sequence Number=SeqID_161676
atggcgcacatgccgccgctctggctgatgaccgccaccggcccgtcgcccggcgccacctccaggaacatggtggagaagctggcgatggcgccgttgccgaagttggccaggccctgcgagttggggccgatgatgcgcatgccggcggcgcgggcgcgcgccgtcatcgcctcctgcagggcgcggccggcttcgccggtttccgagaagccggccgagatgacgatggccgccgccacgcccagcgccgcgcagtcatccaccgcccgcaccgcctgctcgccggccaccgccacgatcgccaggtccggcgccgcgggcaacgcggccaggctgggccaggcgcgttcgccctggacctcggcgcgttgcgggttgatcgggtacagcgtgcccgcatag

SEQ ID NO: 44899 - DNA, 1083 bp, Glycine max
  Peptide Sequence Number=SeqID_161677
atgccaccggcaacgaggccgacgtgtcggtcgccgaactggcctgcgcgacgctgcgcgatccggaagtcgggctgcgtgctgctgtacctggaatcgctgcgcgaggcagggccgctggccgaggcggcggcgctggcgcgggcgcgcggcgtgccgctgatcgtggtcaagtcgggccgctccgaggccggcgcgcgcgccgcggcctcgcacaccggcgcgctggccaacgaagaccgcgcggtggatgcctttcttcgaacaccacggcatcctgcgcgcgcgcgacccgcaggaactggtgcgctacgccgagctggccctgcgcagccccttgccgcaagggccgcgcgtggtggtggtcagcaactccggcgccagctgcgtgctggcctcagacgcggccgccgagcgcggcctggagatcgcgccgctggccgacgccacccagcaggcgctggccgagcgtctgcccggctatgccaccaccgtcaaccccgtggacatcaccgccgcgctgctgtcgaacaacggcctgttcgggcaagtgctgcccgtaatcggcgccgacccggcggccgacatgttcctgctcgatattccagtggcggggcgcggctacgacgtggattcgttcgcaacggacgcggccggctttgcgcgggcggcatccaggccggtggtggtggtggcgtggcaggacaacgtcgccgccacgttccgcgcgcacggcctgcccgtttacgccgacgagatccaggcgatggatgccttgtcggcgctgttgcgcctgcggcggttgcgcgaacgcggccgcatggcgtcgccgccagcatcgcaaggcattgtggcggcggagccggccccgaacgacgccgcgggcttcctgtccgaagcggacagcctggcgctgctggccggcaacggactggcggtgatcgaacacgccgtctgccacacggccgacgaggccattgccgcgtggcgccgcatcggcgcgccggtggcgctgaaggcttgctcggcaaaattgccgcacaagtccgaacatggactggtcgcgctgggcctggacgatga

SEQ ID NO: 44900 - DNA, 261 bp, Glycine max
  Peptide Sequence Number=SeqID_161678
atgcctaatcctgcaaagttcataactgagacgtccgtctcccgacttgcaggggtgacatcaactaactggggaaacgaagcacgtgtagatggaggcgttggctttgtatgcgagttgctggtacaggatgttgtggagtatcgaagtgagcctgatcatgaaatgtggagagattcttacctaattagggttcatgacattgagagaagaatgaggcaggttattctgaaaaatgaaaattctcccattattaattag

SEQ ID NO: 44901 - DNA, 159 bp, Glycine max
  Peptide Sequence Number=SeqID_161679
atgaatggtaactgcgacattataataactgtttgggaggactatgctattcagctacatgatgctattgacaaaaaccttctgcttcaggaaccattggttgttatgttgaccctaggtaaaatcaaggatgctataggtgtgtctggtgttggttag

SEQ ID NO: 44902 - DNA, 855 bp, Glycine max
  Peptide Sequence Number=SeqID_161680
atgggagataacaaggaccatgatttcttttcccacaaattccccacaacctctcaggtgatggaagagatgaaggagctgtggggcatggctctacccatcacagctatgaacatgttggtgtttgtgagagcagtggtttctgttctctttttgggtaggcttggaagcctagagctagcaggtggtgcactttccataggcttcaccaacataacagggtactctgttcttgtgggtcttgcagcaggcctagaacctgtgtgcagccaagcctttggtagcaaaaactgggaccttctctctctctctctccaacgaatggtcctcatcctcctcatggcaatagtccccataagcctcctgtggctgaacctcgaaaggatcatgcttttcatgggccaagacagtgccatcacaggaatggcatcactctactgcttctactctctcccagaccttttaacaaacaccttactacaacccttaagggtgtttttgaggtcacaaaaagtgaccaaacctatgatgaagagggaggtggtgctgaagtggcggtgtggtggtgggggagtggtgtgctctgggttggggcagttgatggggtttgctgtgcctagttgccttatgatatgtttggagtggtggtggtacgagattgtgactgtgctggctgggtacttgccacgtccaacactggctgtggctgccactggtattctcattcagacaactagcatgatgtacactgtcccaatggcacttgcaggctgtgtttctgccaggttgggttggttgagacaggggaagatagggactagagagtggtgtgcagagtgcaggtggcttggctag

SEQ ID NO: 44903 - DNA, 636 bp, Glycine max
  Peptide Sequence Number=SeqID_161681
atggactccactcttctggtgggacccatcaaactagttggtgtacttgataacttggtagggaatgagcttggagctgggaaaccatacaaggcaaaactagcagcaacggttgccttaggatgtgcttttgtgataggcttcatcaatgttacatggactgtgatattgggtcaaaggtgggctgggcttttcaccaacgacgagcccgtaaaagccttggttgcatcagtcatgccgattatgggcctgtgtgagcttgggaactgtccacaaaccacgggctgtgggatccttcgtggcacggcccgacctggtattggggcccacataaacctaggctcattctactttgtgggcaccccagtggccgtgggcctggccttttggttcaaggtggggttcagtgggctttggtttgggcttctgtcggcccaggtggcatgtgctgtgtcaatcctctatgttgtgttggtgaggacagattgggaagctgaggctttgaaggctgagaagctcactaggattgaaatgggtagttgcaatgggcttaggaataaggaaaatgagagagatgaagaaagcaaagggctcttggtgaatggaaatgggaacaacaaagatgacacatgctaa

SEQ ID NO: 44904 - DNA, 747 bp, Glycine max
  Peptide Sequence Number=SeqID_161682
atgtcctcaccttcagaggactacacgtcctctgccatcagaggactacacgtcctcgccattagagggctgcacgccctcaccttcagatggctacacgccctcgccttcgtagggctacacgccctcaccttccgaggactacatgttttcatcttcagaggactacacgtcctcaccttcagaggactacacgtcctcgccttcagagggctacacgtcctttccttcagaggactacacgtcctcgccatcagagggcttcacgtcttctccttcagaggactacacgttctcaccttccgaggactacatgtcctcaccttcagagggctacacgccctggcctttgtagggctacacgccctcaccttccgaggactacatatcctcaccttcaaaggactacacgtccttacctttagaggacaacacgtcctcgccctcaccttcggaggactacatgtcctcaccttcagaggactacacgtcctcgccttcagaggacaacaggtcctcaccctcgccttcgtagggctacgcgccctcaccttccgaggattacaagtcctcaccttcagaggactacacgtcctcgccttcagaggacaacacgtcctcgccctcaccttccgaggactacatgtcctcaccttcagaggactacacgtactcgccttcagaggacaacacgtcctcaccctcgccttcgtagggctacccgcccttaccttccgaggaccacat

SEQ ID NO: 44905 - DNA, 647 bp, Glycine max
  Peptide Sequence Number=SeqID_161683
atgaccttacccgcaatcgcacaagccgtttcaccctaccgccagctgctggtggggtttagcggtggtctggattccaccgttctgctccatctcttgaaacgctggcgcgaccgggagcctgacatccagtttcgggctatgcacatccatcatggattaagtcctcacgctgaggagtgggtggcgcactgtgaagccttgtgtgcggcctgggcgatcccgttcatcgttgagcgcgtcacgctcattgatgaggggaagggcatcgaggcacaggcgcggaaagcccgctatgccgctttttccgcggcattacttcctggagaagcgctggtaacggctcagcatctggacgatcagtgcgaaacttttttgctggcgcttaagcggggaagcggaccggcggggctgtccgccatgcctgcacgatctgagtttgccgggacgcaattgctgcgcccgctgctgggcgagacgcgggcgtcgctggaagcctgggcgcgggaatatcagctgacccggatagaagacgagagtaaccaggacgacagttacgatcgtaatttcctgcgcctgcgcatcctaccgctgttgagcgagcgctggccgcatttcgccgacgcgacagcgagaagcgccatgct

SEQ ID NO: 44906 - DNA, 141 bp, Glycine max
  Peptide Sequence Number=SeqID_161684
atggcaacaacacaggagctgaagactatctttcataaagatgatgaacaactatattgggatgagctcattactactactaatgcgaaaggcaaagcaatgttcgtagctcaagcttaccctctccatcttgttagatga

SEQ ID NO: 44907 - DNA, 1497 bp, Glycine max
  Peptide Sequence Number=SeqID_161685
atgatcgctagaatccacaaaatccccctgcccctagttgaacacttgcaatgggacctcggcctccccgaagatttcggggagaccgtggtcccggactttcctgactacttccggatcgcagacgggttcctggagctcgtctgctgggaccacgatctagccgtttcggttatccagggccgaaacgttagtgttaattatgaaccattgtttcctgtgcagttttctaatggtttagagatggataagaagtatgagaagtggttgagagagtggcagaagaagtcttatgagtctccttatgagaatttgtctcatttgccgagtactagtgatgagtctgatgtttgggttgttggtgtgttgcatgaggtacttcatctttttgttgggaagaagattgagaaggagatgttgttggagtttggggagtggttggggctgaggtcgaggtttaagagggcgttgttgcagcatccggggatgttctatttgtctagtaagattgggacctatactgttgttttgagagaggggtacaagaggggtgcactgattgaggatcatccggtgatgaatttgaggaaccagtatgttcatctgatgaatagtgttagggaagaaggaaaatcgagtaagattgtgcaaggtaagggtggtgtggatgaggtggagggaaaaggtgttgaaggaggagaaggagagggtgagggtgatggggagtgtgtggaggacggtgaagaggaggcatgtgaagttgaggatgctagtgaaactgattttgacgatgatgaagaggagtctcgaagatgtagttggaaaaatgctaccgttagaaggggcagggagtttgggaaagtgaagttagatattgataagcctttgagaggttcttcaagggaaagattgcctttgagagattcatggagggaaagatcgcctttgagaggttctcggagggaaagatcgatcgggaaaactgagttttgcgatgatgaagaggagtctcaaagaggtagtcggaaaattgatactggtagaaggagcagagagtttgggaaagtgaagttagatgctgacaagcctttgagagattctcggagggaaagatcacctttgagaggttctcggagggaaagatcgattgggaaaactgggttttgccatgatgaagaggagtctcaaagaggtagtcggaaaattgacactggtagaaggggcagagagtttgggaaagtgaagttagatgttgacaagcctttgagagattcttcaagggaaagatctcctttgagagattatcggagggaaagatcccctttgagaggttctcaaagtgaaagatcgattgggaaaattgggaagaagaattcatttgaagcttcaaaaagaagacaagtgcgaggtgcacatatagatgttgagaatacacaagatagatcaagattctctaatagaagttcattaaccagcaagaaaacccctgttttgtag

SEQ ID NO: 44908 - DNA, 390 bp, Glycine max
  Peptide Sequence Number=SeqID_161686
atggtgcgtccgagtggactcgaaccaccgacccccaccatgtcaaggtggtgctctaaccaactgagctacggacgcagaatggtgcgttcaattggactcgaaccaacgacccccaccatgtcaaggtggtgctctaaccaactgagctatgaacgcaacgtgttgtcggtgacaacggggacgaatattagcggcacagcatcaaggtggcaagagggaaaatgcatttttctctctgatttcacgcgattgcttcattaccgcgcaaagaagcgcatgcgcatcatcatcatgatcgcggctgacgtcagaccaatgataaagcccatccagaacccggcgggtcccatgcggtcaaccaccagatcggtcagggccaggatgtag

SEQ ID NO: 44909 - DNA, 231 bp, Glycine max
  Peptide Sequence Number=SeqID_161687
atggaagtgtgcagtgtgcacagtgaagggaggagcaaagaggggttttgggggttttggaattggagtacccagattgaccaagttctattcaggccgaattttcttgggcccagcttgacccgccctaacaggctaatgggtcagtttgtcgggttaagcctattttatagttctaattatgagcaaatgaaagaaaaggaagagactgagatacatataggaggttaa

SEQ ID NO: 44910 - DNA, 186 bp, Glycine max
  Peptide Sequence Number=SeqID_161688
atggtgatgatggtggaggtagaaggaggagatggagaaataatgagggtgatgctagagaggacaaaattgaaggaagaccttaataacaagctacaaagactcacacaaggtagtagaaatgttgatgattattacaaggagatggaggtttccatgattaaagctaatgttatggaggattga

SEQ ID NO: 44911 - DNA, 208 bp, Glycine max
  Peptide Sequence Number=SeqID_161689
atggctgaaaatgttgacccaattgcgaacaatgttattatcaataatgcaactcttacaaacttgctgaatccctattatgctcatccaaatgagaatcctggtgtggcgattgttgctcaggttctcaatggtggaaattaccactcatggtcgcgtgatatgctccttgctttgaagaccaagaaaaacgtccaatttgtgtatg

SEQ ID NO: 44912 - DNA, 1455 bp, Glycine max
  Peptide Sequence Number=SeqID_161690
atggtacttatggcagaagcagaggtcgtggaggccatacatctggtggaagaggtagaggcagaagcacaaaaatgtgcacttattgtaacatatcaggtatctgcaaatgcttcatctgtagctttcacaccagagcaacataaggctcttctttccttgttgcagcaaacctctcaagcctctccttctcacaccactaatcagttagttagttctcataagaatggtaattcaggtataatttgtgctactcttcatgcttatagtttcaatataaactcatgggttcttgatagtggagctactgatcatgaagctatatgtcatgaaagttggaaacgggcaatccaatatgagttatcttctcttattaagactaacacttggcagcttactcctttacctcccaataaaaagccaattggctgcaaatgggttttcaaagtcaagtttaaagctgatggatccattgacaagcacaaggctagattagtaaccaaggattttacacaaattgttggtttggactacattgaaaccttcagtcctgttgtaaaaatgaccatagtaagacttgtgttatcactagctacttctcagggcttgacagttgacaatccagctctagtttgcaagttgcaaagatctttgtatggcttaaagcaagccagcagacaatggaatgccaagcttacttctaccttacttgattcaagattccaacaatccaaggcagattattctcttttcactaaaaggtctcccattggcctcattgttatccttgtttatgttgatgatttgctgcttactggcactgatcttgctgaaatccaacaattgaagcactccgtggatgcaaaattcaacattaaagatcttggaatgctcaagtacttccttggtttcgaagtagcccgatccaactcaggtattgtcttgtatcaaagaaaatattgccttgatctcctacaagacactggtttgcttgttgccaaaacttgttccacacttatggatcccacactcaaacttcataaatcctctggtgtccttctctttgatccaactgtttacagaagacttgtggggcgattattgtatcttactcacacaaggcctggcatttgctatgttgttggaagattgagccaatatttacaatctccaacagatatccatatgcaagctgcacaacatactctcaaatatctcaaaggaaatgctggaaaagacctgtttttctcctcttcattttccacttctttaactggcttcagtgacttgaatcggggagcttgtcctaacacccaaagatccataacatgtttatgcttcttcttaggtacctccctaatatcttggaagagtaagaaacaatccattgtgtccagatcatcctcagaagttgaatatagggctctagctcaagcatcttgtgaagcacaatga

SEQ ID NO: 44913 - DNA, 177 bp, Glycine max
  Peptide Sequence Number=SeqID_161691
ggaccttgcggggcaggaggtatggtccccgcctcgtccccgaatttactgcgggggggggggggggttcatccccatccccgcggagaatttttccccgattgtagggccctgaatggggcagtccccacggggatccccgagttgcggggagaattgtcatgcctagattgttaa

SEQ ID NO: 44914 - DNA, 237 bp, Glycine max
  Peptide Sequence Number=SeqID_161692
atgcaattttgttatgacagaggagtttgcagtggtggatgtgcacagcgacacaatgatggtggagaggagttgcgcttgcggagcctcaaaggtggagatcacacgcgggtcaagatcatgcatgagcaagggctctatgcgatagtgatggtggggactggtgacaatgcacggcgcgaaggagatgggatagggtggaggtcatgcgcgagtaggggctctatgcaacattga

SEQ ID NO: 44915 - DNA, 471 bp, Glycine max
  Peptide Sequence Number=SeqID_161693
gtgcccgccgggctggaaaacgcaccggatgcgctgattggccttctggaaggcaaaaactttggcaaagtcgaattgaacatgcttgatttggatcacttagaaaaagcccaaagggtcagccttactatgcaagttgaactcagtttgaaaggggcgttaattacaggctcactcaaacctggggcacgactgataacgaaagagatcgccgataaattaggtaccagtattactccggttcgcgaggcgcttttgcggctggtctcttctggcgcgttacatgccacccccgcgcaggcatttctggtgccagaggtgacgctggagcgttataacgagattaacgccatcagaaaacagcttgagccgatggccgttgccgccgcctgtctggttgtgtgtgtcgataagcttgagacgttgcgcaaaatgtcagacgccttccatgaggccatgcgcaacgggcac

SEQ ID NO: 44916 - DNA, 201 bp, Glycine max
  Peptide Sequence Number=SeqID_161694
atggcgaaaaaggtgagcgaaatgaccataatttgtctccgtgtgccatcgggcccactgcctctagatgacaaaaggcacaaaatgaccataatttgtctctgcgttccatcagacacgattgtgtctgaatggcgaaaaggtgagcggaatgaccataatttgtctccgcatgtcatcgggcccgcagcctctggatga

SEQ ID NO: 44917 - DNA, 564 bp, Glycine max
  Peptide Sequence Number=SeqID_161695
atgtcctttccatctgaggactgcacgccctcacctttagaggactacatgtcctcaccttcagaggactacacaggactacacgtcctcgccttcatagggctgcacgccctcaccttcagaggactacacatccctaccttcagacggcagcacgccctcgccttcatagggcaacatgccctcacctttagaggactacacgccctcaccatcagagggctgcacgccctcaccttcaaagggctacacatcctcaccttcagggagctacacgccctcgccttcagaggactacacatcctcaccttcagagggctacatgccctccccatcagaggactgcatgccctcgccttcatacggctacacgccctcacctttagaggactagacttcctcgccttcagaggactacacgtccttaccttcagaggactacacgtccttgccttcaaaggactacacgtcctccacttcagaggactacacatcctcgcctacagagggctgcacgctctcgcctttagtgggctccatatccacaccttaagagaattttag

SEQ ID NO: 44918 - DNA, 261 bp, Glycine max
  Peptide Sequence Number=SeqID_161696
atgacgttgctacttaacaacattctgcccagcgaccgcaatgccgatctccttgcgaaagtatcggttggtctgtgccatcccgacataggggtcacgcccacaagacacccagtggacccggaggagcccaatagggccctggggtttccagctctagttacgggcctctatcagtcctacagggtgctcgtcccccccagcaagggattgcgcccgcaagacacccagtggacccggagaagtccaatagggtcttag

SEQ ID NO: 44919 - DNA, 849 bp, Glycine max
  Peptide Sequence Number=SeqID_161697
atggaggcttcgagtttcgccattcattctccaagtgagaatcaaaatatagagatgttttcgccgtcgttctatgctgcttgcacctttggtggaagcctcagctgtggcctcactcacactggcatcacgcctcttgacgttgtcaagtgtaacaaacagaacaccagcactggatttggagtcatgtttaaggagcagggactgaggggctttttccgcgggtgggcacctacccttgttggttacagtgcacagggtgccttcaaatatggattctatgagttcttcaagaagtactattctgacatagctggtccagagtatgcaaccaagtacaagacattgatctacctagccggttccgcatctgctgagttgattgcaggtgttgctctttgtccatttgaggcagtgaaggtcagagttcaaactcagcctggctttgctagaggcctggtcgatggcctaccaaagttgcatgccatccccaaaccaaaacacgaatgcagcaattccctgcaactaggtgtgagcattgtcggtggatacatggctggtatattgtgtgccattatctctcatcctgctgataaccttgtctctttcctgaacaattccaaaggggcaacggttggctgtgaagaagcttggattatggggtctgtttacccgtggtcttcctctttgtattcttatggttggaactctctcactggagcacaatggggaatatatgattcattcaaatttttgtggggctgtaagttttttgcacaatttgctagctggccaacgactggcggtgttgctcctgctgctgttcctactcctgcttctgctgcttag

SEQ ID NO: 44920 - DNA, 255 bp, Glycine max
  Peptide Sequence Number=SeqID_161698
atgggatttgctcaacaggcaccggcctgcattctcaaggaaaaagtctgcttttcaccaactgtgtcttgtataggactatttactcattctgtgccaataaagtgtctcctgactggccttcttggatgtagtcctctgatgtcacataagttttgcatagaagactcttcagtgactgtgttgcagcattctctgagaactggttggcagattaaaaggctgaatgatacggcacaccttaggcttctctag

SEQ ID NO: 44921 - DNA, 321 bp, Glycine max
  Peptide Sequence Number=SeqID_161699
atggccactagctccaagttatcttcctttgtctttctgtttgtcttgttagccgattcactagctctcagatcaagtaccgagccaacaatttcagcttctccaaaaccttatgtggtagcacctgctcctcctgaggaagaggcatccttgccaccactggcgccaagttccagcgagtttgttgggaagaagtcttccagttcatctaggttggattatgcagctgccattgttggtatcctgctcttcagtttcttgatatctatagcatatttgtttgagcatttaccaattaccatagatgatatttttctttag

SEQ ID NO: 44922 - DNA, 399 bp, Glycine max
  Peptide Sequence Number=SeqID_161700
agccagacagaactatcacgaaaattgtgcctcactagggacctactatccctgatggacccttctgctcatcactcttcttctggtgacctgtttttgcattccagcaaattttttggcttcttaaccggtcatcgccgcaacttaagtgattttcctagtgaccatccaccttttttggctctcttgagcctatctacagaaccccaaaacgatttcctaggcatgccaaacagcttcatgcaggatgtgttcctggtgtttgagattgatgttcaagccacgcttctggcgtggtggttgcccatctcagtgcacctatccccagagtctcgtctcaacccatgcacgtttgctggtactcgttatccagatctgatttctgttgctgatatctag

SEQ ID NO: 44923 - DNA, 984 bp, Glycine max
  Peptide Sequence Number=SeqID_161701
atggcgccaaagaagaaacccgagtctgatcctcatggaatgttcagtggcatggtcgtgtttttggtccccaaaggagttcaatcccgtcgattccaggaaaggttggtgcaaatgggggctgtgatagaggagcgcttctccaaacgggtcactcatgtttttgctatgcactcagatgcccttcttcagcaactggatagggagcgtttgtcacgttttaaaggggactgcttgaaatcaggggagatactatcagaggatatgtatttactgaagttggattctcaaggtgaacatatacctgagaagtctttggaccctggactgactaatcaaaggacttcaagcgatcttcaacaattgcttaataaaaagagcaaattatctactgaggatacaaaaattgtaaaaaatgaaagccatgatgatgatggaaaagaaaaagcggtattttcatcaacaagcacaataagcagtcatggtgaagttgacagtttaagttatggaaacacaagacaacaacaccttgatgctgaaaatgaggcctcatccttatcataccatccacctgatctaaacaagaacataacagagatatttgggaaacttgtgaacatatatagagcattgggtgatgatcggaggtcctttagctatcacaaagctattgccgtgattgaaaagttgccattcaaaattgaaagtaccgaccagataaacaatctgccatctattggcaaatcaatgaaagatcatgttcaggagataatgactactgggaagttatccaaattggaacactttgaaactgatgagaagggacatcgttcgttagatgatcttaggaatgatgactcacttacaaatgcacagaagttagggttaaaatactttgatgatatcgggcaacggattccacgccacgaggctcaggagatggaacacattttacagaaagttggggaggatgttttgcctggg

SEQ ID NO: 44924 - DNA, 189 bp, Glycine max
  Peptide Sequence Number=SeqID_161702
atggaaaaggtggaaatggaagtcaatttttcagaggaacaaattcaatcctcagatgctcttgcagagattagtcaagggaattgggaaggctgccttcgatcagaaatatatactcccgaaattcagggcttaattgacaggttccagccagattttactgcaccttctggtgaatcacttagacaa

SEQ ID NO: 44925 - DNA, 267 bp, Glycine max
  Peptide Sequence Number=SeqID_161703
atgagtaaacaacacaatggaagcagcaaaattaaatttcttataccttcttcctattttttacatggatttttgccattgccattgacggtgtggtggcgatgggaggaattttggaagaaatgctatccaacaaagatcgaagaacttgactgcgacaaagaagaagaagaacacgatcttgaggagtgtgagtctagggaaatcgacattgacgtaggtggaggagggtttcatgctttgaatcgtgaattgaaaccacgatga

SEQ ID NO: 44926 - DNA, 1053 bp, Glycine max
  Peptide Sequence Number=SeqID_161704
atgatgcaacagtttcatattcaacccatgatgaagatggataacacgatgaggaagagggagagaagcaaagccatggagaaagagaggcttcaagtgatggacttgagtggcatgtccttggagtttcttcccaaaccttcgcttgatttagccaccatttgcaagttggacctatctaataacaatctccaggaaattccggaatccttaacggctagacttctaaacgtggaagtgttggacgtgcgttccaaccagctaaactcccttcccaattccattggctgcctctctaagctcaaggttttgaatgtctcaggcaacttcatcgaatccctccccaaaaccattgagaattgcagagccttagaagagctgaatgcaaacttcaacaagctgagcaagctgccagacacaatagggtttgagctcataaacctaaagaagctctcagtgaactccaacaagcttgtgtttcttccaagctccacttcacacttaacagctttgaaggttcttgatgcacgattgaattgcctaagggcacttcctgaggaccttgagaacctcatcaacctagagacccttaatgtgagccagaacttccagtatttggagaccatcccttactccatagggcttctctggtcacttgttgaacttgatgttagctacaataacatcaagaccttgcctgagtcaattgggtgcctcaagaatctccagaagctgagtgttgaagggaaccctcttacctgtccccctatggaggtggtggaacaaggacttcatgtggtgatggagtacatgcatcataagattaactcaagtgatcaaaacaaaactaagaaaaggtggtggatggggaagattgtgaaatgtggaaccttcaataaacaatttagaaatgggaaacgacctgaacatgtgggttacaacatgcttaagcaccagaatatcaatggtcttgcttccccaggcttcatggggatgctctcccctcttcgcctgttctctccccatcgttccccccgccatttcttcagttga

SEQ ID NO: 44927 - DNA, 729 bp, Glycine max
  Peptide Sequence Number=SeqID_161705
atggccatgccagaatttgataccaggaccaagcaatccccagagggacttagtgctaagagaaggcaaggaagcgagtcaactcattcatctaagatacgcggggatcttgatgcggatgaagagcatgctcatgacgtaggcgagaaccacggaggaaactccggcggaggcgtaggacaccttgacggatttcgcgcggttgcgatcgagggcgaggtcgaggagaatgatgccgacgccgccgaggacgaacatgaagccggaggagaggccctcgataatgtactggccgttgacacggccggacatgaagacgacggggcgaacggcgccggtgtaggggtcctgcgtggagccaatgccggggggctcgacgatgatgtcggagggaagcttcaggcggaggcgagggggacggaggaagctgaaggggaggacgcggaggaggtggaagattggatcgatggatgcgccggaggaggaatcgaagccgccggaggaggtggtaacaatggcgacaatgatgatggaagcaacggaatggcaatggcgataatagcagtggaatggtggcggcgacaaattgatagcagcgacaatgtggtggtggaggtggcaaaggtaaggtgcgatgacaacgaaaatggtgatcaaatgatggaggcgataatactggtgacaatgtggtggtggtggcaagacaatggcgatggtggaatggcggcg

SEQ ID NO: 44928 - DNA, 261 bp, Glycine max
  Peptide Sequence Number=SeqID_161706
atgtccgccgcctcccgatcagccggtgcggccaatctggctgccggagctagaccgagactggcacgatctccgtttcggctcccaaagcaaacctcaatctccaatcgtgttaccgacttaccggtagaagcgagtttctgcgtggaatcgatgcttccttatcacagtgctactgcttccgcattgctgaattcgatgctctctgtgtctcgccactcttatggttggacccctgaagggcaagagaaggctagatga

SEQ ID NO: 44929 - DNA, 387 bp, Glycine max
  Peptide Sequence Number=SeqID_161707
atgggtactcactcgaagtcagactttttataccatctaattttccacctccagaatcacaataaccagcagactattaaggaggaggtgcaaataggtgtggcccaaaatagagaaacaaagttgtccaaggagaagcatggatctttgcatggcagccatgtgaaaatatggctgagaggaactcaaatgtttgtctatgacccaggagaagtgaacgctaattttggtggcaatggtcaggtaggcttggtcatcatgcttcaattagttagatgcagtgggaatttattttcagcagagccacaagttgtccgccttgaggttgaggacaaggtgaaattgataccccttaggcccttactaaaagttagttgggctacttag

SEQ ID NO: 44930 - DNA, 1059 bp, Glycine max
  Peptide Sequence Number=SeqID_161708
atggaaaatggaaaaggacttaaaccatgtaggaacccccttgcacttgaagaggcaccgcaatctgaaggtttcatcacattctccttaacaaatggccctgagtatcatatctcacagattgctgatgcagtggtggtagctagaatcttgggagccactcttgtgcttcctgacatcaggagtagcaaatcggggtatagcatgagccttggagatatttatgatgttcagaaaattattaataggctagatgggttggtaagagtaactaggacactgcctgtaaccaatggaaatccaccaatagtgaaggtacctaacagggtttcacaagactatattgtaaggacagtgaagccaatatacaaagccaagggcattgttaagattgaatcacacttttcctcagttaacccaacaatggcaggaaataagaagagccttgacacatttgcatgccaaacaatgtttggaactcttcagttgcaaccagagatgcatgaagttgtggactcaatggtccaaaagctacaaagttggagccagaactcaaatggccaattcattgcagtggacttgaggactgagatggtggcaaaggagtgtcacaaaaaagatgtctcaggaagaaaactttgttaccagccacatgagataggtgaattcctcaagaagattggattcagtcctgagactactgttgtttatgtgactcagtcaaaatggaattctgatcttgatgccctaaaagatatcttcccaaaaacctataccaaggaaactgtaatggcagaagacaagaagggaaagtctctcagctcacaaagctctgaatttgagaaggtcattgatttctacatatgttctcaaagtgaggtctttgtgccctctattcctggcctcttctatgctaatgttgctgggatgagaattgtatcagggaaaaaccagatacttgttcctgctgaaatatcaagtccatcagcttcagcctctgattacatttctccctatgtgtctcagaagaaccattttgcttatgcatgcttttgttaa

SEQ ID NO: 44931 - DNA, 1827 bp, Glycine max
  Peptide Sequence Number=SeqID_161709
atggagcaacttgcttcaatttcaagggagcatgacactgctgctctgcaacaatatggaggggtgttgcttttgaatcattatcaggttgtaggactatcaaatttgttgaaaaccaattcggagaagggtattcatggtgatgatgctgacttactaaaacgaaggaatgcatttggttccaacaattatcctcggaagaaaggaagaaattttctgatgtttatgtgggatgcttgcaaggacctgaccttggttattttaatggtagctgcagcggcttcattggcacttgggataaaatctgagggtatcaaggaaggatggtatgatgggggaagcattgcttttgcagttattcttgttattgttgttacagctataagtgattataagcagtctcttcagttccgagacctaaatgaagagaagagaaatatacacctggaggttgttagaggtggtagaagggttgagatctctatatatgatattgttgttggggatgttataccccttaatattggtaaccaggtccctgctgatggaattctgatcactggccactctcttgcaattgatgaatcaagtatgactggggagagcaaaattgtccataaggattctaaggatccttttctgatgtctggatgtaaagttgcagatggcagtggcactatgctggtcactggtgttggtatcaatactgagtgggggcttctaatggctagcatctcagaagatacgggtgaagaaacaccattgcaggttcgcttaaatggtgtagctactttcatcggtattgtaggacttactgttgctgttattgtcctaattgtgctactggctagatatttctctgggcatactaaaaacccagatgggtcggttcaatttatagcaggcaagactaaagttggtgatgctattgatggtgcaataaagataataactgttgcggtcaccattgtagttgttgcagtaccagaggggctcccattagcagttactttaacgctggcctactcgatgagaaaaatgatggcagataaagccttggtaaggaggctttctgcctgcgagaccatgggctctgccacaaccatatgcagtgataagactggtacattgactatgaatcagatgactgtggttgaggcttacgcggggggtaagaaaattgatcctcctcacaagttggagtcctatcctatgcttcgctctctgctcattgaaggtgttgcacagaacactaatggcagtgtttatgcacctgagggtgccaatgatgtcgaggtttctggatcaccaacagaaaaggcaattttacaatggggaatacagattgggatgaattttatggcagctcgatctgaatcatcaattattcatgtttttccattcaattcagagaaaaaaagaggcggagttgcaattcaaacggctgactgtaacatccatatacactggaaaggtgctgctgagatagtcctagcctgctgtacaggctatgttgatgtgaatgaccagctggtggggatggatgaggaaaagatgacatttttcaaaaaagctattgaagacatggctgcagatagtctacgttgtgttgccattgcatatagatcatatgaaaaggagaaagttccaactaatgaagaactactttctcactggtctttaccagaggatgatcttattttactagccattgttggtcttaaggatccttgtcgacctggtgtcaaacaggctgtggaactttgccaaaaagctggggttaagggtcatttgtttcaacttgaatctaacatgactaaggcctga

SEQ ID NO: 44932 - DNA, 573 bp, Glycine max
  Peptide Sequence Number=SeqID_161710
atgggtgcgagccaatcagtgcaaagtttggaagacagcgaagaagaggaacaagaggaggaagaagaagatgacgagaggaacctcaacgggcccttgatgggccgggcccaattgggcaaccacatggtgaagaaggttctggagcaggagcccgagatgctgccgtgccatgcctccgcttctccgctctcgccgcagctctcgtcgctcgggacgcctcggctcggcccctcgatcaaggtctgggacccctacaacgttctcggcccgccgccgcccgcactgtcccggagcttttcggggaacgggatagtcaccgtgccggacgacgaggcgttgacggaggttttcctaatcagccacggcgagtgcgagctgaatctggctccggacttggtcggcggccgctgccccgccgctgcgctgaccgtcaacgggaagcgccaggccagggctctggccgtgtttctcaagtcgcagggggttcggttcagcgccgtgtattcgtcgccgctgaatcgggcgcggtccatggcggtgtcggtgtgcaaggtagtttcctcagtttga

SEQ ID NO: 44933 - DNA, 327 bp, Glycine max
  Peptide Sequence Number=SeqID_161711
atgccggtagtcggtaacaaaagggatcacatgccattcccagcaataaagcaatgtgtggaattaaattcagaagtattaacatttttgcatacttctagaatgctgaatccccatgcctacaatggaagcaatttcgaaagtgcaaaaagtaattctggaaatgcagaaaaaacactcattccatctagcagtcaacttttgtggaagacaacactcaaaagtcaaaaggcttccaccttctcaagtggatctattagacaaggtggtgttaccctgcctagctccttcaagaggcgtcaccttgtgttagatatagttttctga

SEQ ID NO: 44934 - DNA, 522 bp, Glycine max
  Peptide Sequence Number=SeqID_161712
atgaggaatggtttcatgtgccactctgaggcatcaacaacagtgtgcatgagaagctgcgatactattactgggtctgtggttgtgcctaggactaggagtaggaggcatcaaagaagtgtttctcttgatgatacaaggttgatcaaatatgccaagtactccaaacttgttgactctagcactagcagcaggttgttcaattcagctcacaagaaaggtgactctgtctctgtaccaaacatcaagcatcaagagaatgaatcaagggaacttcagaaaaagccaacagattatgtcttccagagttgtttggccagtatggtggttgtgatgcgggttgctattcattgtcaaggatgcgcgagtaaagtgaaaaggcatctgtctaagatggaaggagttacatcattcagtgtagatgtagagtccaagagggtgacagtaaagggacacatttctccggtgggagtccttgagagcatttcaaaggtgaagagggctgagttctggaattgttaa

SEQ ID NO: 44935 - DNA, 1098 bp, Glycine max
  Peptide Sequence Number=SeqID_161713
tttgtgcatggcctttcaacagcaacaggctataaaggatatggaccagagcaaggtgaaaaggccttgaggaaagcaatttctgttacattctacaaagatctggggataaaaccttctgaggtttttgtttcagatggtgcacagtgtgatattactcgtcttcagctgcttatgggtcccaatctgaagatagctgtgcaggatccatcctttccgatgttagcaatcagcaacttccaaatgtgctcaaaggacaaacaagcctacatagattcgagtgtcataattggtcaggctggcaagtttgtagataaagctgggaagtacaaaaacatagaatacatgacatgtggacctcaaagtgacttctttcctgatcttcctaccatttcaaggactgaacttattttcttcaattctccaaacaatcccactggtcatgcagcaacaaggaagcaattagaacaacttgtggattttgccaaagtgaatggatcaatcattatctttgactctgcatattcagcatatatcactgatgatagtcctaaatcaatctacgaaattcctggagccagagaggttgcaattgaagtgtcatccttctcgaaatttgctggcttcacaggtgtccgccttggttggacagtggtccctgaagaactcttgtattcaaatggctttcctgttgtgcatgatttcaaccgtataatgtgcacatgttttaatggagcatccaacatagctcaagctggtggactagcatgcctttccccagagggtttaagggccatgcagacccttgttgactactatatggagaatgcaaggatactggttgatgctttgacttctcttggtctgacagtgtatggtggtaaaaatgcaccctatgtttgggtccattttcctggctcaaaatcttggaatgtttttgctgaaattcttgagaagactcacataattacagtcccgggtagtggttttggaccaggtggtgaagaatatataagaattagtgcttttggccagagagattccatcattgaagcctcaaaaagactcaaataccttatctatcaggagcaaaactaa

SEQ ID NO: 44936 - DNA, 126 bp, Glycine max
  Peptide Sequence Number=SeqID_161714
atgtatccaaatgataattcacaggctgtcatgcacattgaagactcatcaaaacgtgagaatcgacgtacgtatcatcatgactatcatgcgcaggacactgcacaaaggtgcccaggaatgtaa

SEQ ID NO: 44937 - DNA, 584 bp, Glycine max
  Peptide Sequence Number=SeqID_161715
gagacgatacaaccccggatccatcacatgtactcgcactggatgaagtacaagtgaaggataaccttacctataaagcacaacctcagaagattactgatcgaagaaggaagtcgctgagaggaaagcagatcgcgttcgtgaaagtgcagtggggacccgacgagggtgattcaacctgggagctagaggataggaaaatttcagaagcttttcctccttccacgttgcttttttctcttcttcttcttctccattgtgcctccattgaagctccaaaattcctcttcatttctaccccaaattgcaaggagaagccattttcggagtcttggatcacacctccacttcgtggggcttcaaatttcagaaaactggtagagatgatggggagagttaacctagggttaaatgttagaatggtaatgttcaaaagctgtcaagttgtgcagcagattttaccaaatatgcagaaaaatggttgtgcagcgctagtcacgggagagggtagtttcatgacaaatggaattgaattgtttggatattttgaaagcttggaggggttgatggggacccggtgctga

SEQ ID NO: 44938 - DNA, 235 bp, Glycine max
  Peptide Sequence Number=SeqID_161716
gttgcaaataaggggtgagagggatgacttgatttacacacttaaagatggtggtgagatgtcatttgagatagtttccattttggagtttgagacacaaattgatttggttgataactatgaggactcaagattttggccaaaggcacacatgacagagtatgttaggtgtgacaagattttgaacaacatatcagaggctttcaatggaagaatttgggaagctaaggactaa

SEQ ID NO: 44939 - DNA, 126 bp, Glycine max
  Peptide Sequence Number=SeqID_161717
atgccaattatggatgttgctccaactactaatagtctgcttggtttagagtctggaagtgcaaatcatgttaagtgtacattattccatcaagctggaatgctagaacctacccttatagcatga

SEQ ID NO: 44940 - DNA, 1077 bp, Glycine max
  Peptide Sequence Number=SeqID_161718
atgtcgaatttcctgagcaacactaatccgaaccctaacaagtcctttgaggtgaatcagcctcccactgattccgtgtccagtctcagcttcagtcccaaagccaacttcctcgtcgccacttcttgggacaatcaggttcgttgttgggaggtagcacagaatggagttaatgttgccactgttcccaaggcttctataacgcacgatcatccgatgtggttcttgctaaccactgcagctctaagggttttgtgctctacatggaaggatgatggcacaactgtcttctctggtggatgtgacaagcaagtgaagatgtggcctctgttatctggaggccaaccaatgactgttgccatgcatgacgcacccatcaaagaagttgcttggattcctgaaatgaaccttttagtcacagggagctgggacaagactttgaaatactgggacacaaggcagtcaaatccagtgcacacacagcaactcccagagcgctgctatgctatgacagtgagacatcctctgatggttgttggcactgctgatagaaatcttattgtttacaacttgcaaaatcctcaggttgaattcaagagaattgtttcaccattaaagtatcaaacaaggtgccttgctgcattccctgatcaacaaggtttcttggtcggatcaatagaaggaagggttggggtgcatcatttggatgatagtcagcagggtaaaaacttcacttttaaatgccatagagagggcaatgaaatatactcagtcaactctttaaacttccatcctgtacaccacacatttgcaacttctggttctgatggtgctttcaatttttgggataaggatagtaaacagcggctcaaggccatgttgagatgcagcctacctattccttgcagtaccttcaacaatgatggttcaatatttgcttactcagtctgctatgactggagtaaaggggcagaaaattctaatcctgcaacagcaaagacctacattttcctgcacttgcctcaggaatctgaggtcaggggcaaaccacgcattggtgctactgggagaaagtag

SEQ ID NO: 44941 - DNA, 228 bp, Glycine max
  Peptide Sequence Number=SeqID_161719
atgtataacatagctggtcttccaaatgagggtttaattctcacaattttgagaagcaggggaatgaggaagaatgtgcacgctctaaaagaagtgcaacttatctattttggggcatattggaatgaggaagggtgtgcacgctctaaaagaagagcaacttatctattttgggggatagggatgaggaagggtgtgtttgcacacgcacaagggtgtggcaattaa

SEQ ID NO: 44942 - DNA, 1311 bp, Glycine max
  Peptide Sequence Number=SeqID_161720
atgtcttattactctactctatcggtaacttattactgcaaactgattaattttgctctccaaaataggcgtctcaacaacaatagcttgacaggaggcatacccatgtctttgacaaatgtttcttcactgcaagttcttgatctctcaaataacaagctaaaaggggaagtcccagtgaatggttcattttctttatttacccccatcagttatcaaaacaatcctgacttgatacaaccaaaaaacactccatctcctgtttctccaacaccaccagcagcttcttcaggtaacagtaatactggagctattgctggaggagttgctgctggtgctgctctgttgtttgcagcccctgcaattgcacttgcttattggcgaagaaggaaacctcaggatcatttctttgatgttcctgctgaggaggatcctgaagttcaccttggtcagcttaaaaggttttctttgcgtgagctgcaagttgcaacagataactttagtaacaaacacattctgggtagaggtggatttggaaaggtttataaaggacgcttagctgatggatctcttgtagcagtaaaaagacttaaagaggaacgcacgcagggtggggagctgcagtttcaaaccgaagtggaaatgatcagcatggctgtacatcgtaatttgcttcggcttcgtggtttttgtatgacacctactgaacggttgcttgtgtatccttacatggctaacggaagtgtagcatcatgtttacgagaacgtcaagaatcccaaccgccacttggctggccagaacggaagcgtattgcattgggatctgcaagggggcttgcttatttgcatgatcattgtgaccctaagattattcaccgtgatgtcaaagcagctaatatattgttggacgaggaatttgaagcagttgttggagattttggtttagctaaacttatggattataaagatactcatgttactactgctgtacgtggaacaattggacatatagcaccagaatacctctcaactggaaagtcttcagagaagactgatgtttttggatatggtgtgatgcttcttgaactaataactggacaaagggcttttgatctagctcgacttgccaatgatgatgatgtcatgttgcttgattgggttaaaggacttctcaaagacaggaaattggaaacactagtagatgcagatttacatggtaactacaatgatgaggaggtagagcagttaatccaagtggccttactatgcacacaaggatctcctgtggaaagacctaagatgtctgaggtg

SEQ ID NO: 44943 - DNA, 144 bp, Glycine max
  Peptide Sequence Number=SeqID_161721
atggcgtataagaggttgtacccacagatgaggtgtttccagttgatcgcaactagtaagtatttgatagatcttggagcctttggcagggttcctagtatgtccattcctgatgcaatcctacctcgcaagggcattggatag

SEQ ID NO: 44944 - DNA, 227 bp, Glycine max
  Peptide Sequence Number=SeqID_161722
atggggctccgaaaaagggatagagaatggagaattgcactaagcaatcactacgcatggctccaaactcgtgggtggaggatggatgaacaaaaacgcaattcatggggctccgaaaaaggggtagagaatggagaattgcaccaagcaatcactacgcatggctccaaactcgtgggtggagaatgcatgaatgaaaacgcaacacatggggctccaaaaaaggg

SEQ ID NO: 44945 - DNA, 549 bp, Glycine max
  Peptide Sequence Number=SeqID_161723
atgacgctgtcgttcatcccgaaaatcatcgccgtgttcgtggcgattatcgtggccgggccgtggatgctgaacctcgaccagtgggttcagtggctcggcgtctatttctggccgatgctgcgcattatggcgctggtctccaccgccccgatcctcagtgagaaatcgatccccaagcgtgtcaaagtggggctgggcattatcatctcgattatcgtcgccccgtcccttcccccggtggagatcccgattttctcggcgaacgcggtgtgggtggctctgcagcaggtgatgattggcgttgctgtcggctttaccatgcagctcgcgtttgccgccgtgcgtaccgcgggagagctgattggcctgcagatggggttatcgttcgccacgtttgtcgatcccggcagccatctcaacatgcccgtgctggcgcgcattatcgacctgctcgccatgctgctgtttctgtcgttcaacggtcatctgtggctcatctccatgctggtggacaccttccatacgctgccgattggggaaaatccg

SEQ ID NO: 44946 - DNA, 402 bp, Glycine max
  Peptide Sequence Number=SeqID_161724
atgtcttcagacagcgatagcagcatctctagcgattccctgagttttctccaattttttcctctaactgctccaatagaattctcaaacgttagagagacaaggaaggaattgaagcctctacttgtactgtcttggtgcgttagtgaaaccaggatcgtagttttactgagaccatcttgggtttctgtgggaaaggaaaaagttacgatgcgaaaggcaaaggttggaagttacatggaagttactaaaacttccatcaacggttggaagttacatggaagttacaaaaacttccatcaacggttggaagttacatggaagttactaaaacttccatcaacggcagtttttaaaatagaaaaaacttccatcaaccgccaaaaaccacctgttctttga

SEQ ID NO: 44947 - DNA, 273 bp, Glycine max
  Peptide Sequence Number=SeqID_161725
atgtgtcttcagccaggctcagcgcatgactggcgctacgcccgaatccccttacccgcgctaagcgcgagggtggtgctaagcgcaacaattagggtaacaaggcccagggcacagaattccatagacaccatagtgcctatttcaggaaaagagctctggaggcagcaagaggatgaccttttgcagagatacctaggttttttaggtgactttagcattgggaaatgtactgttgccttagaacttgatggaagcaagatcaaaacttag

SEQ ID NO: 44948 - DNA, 210 bp, Glycine max
  Peptide Sequence Number=SeqID_161726
atggcctctttacgccctgccaatgtgggaatccttgccatggacatctacttccctcccacctgcgtcacccaggaagctttggagggtcatgatggggtgagcaaagggaaatacactattgggcttggacaggattgcatggccttctgctctgaggttgaagatgttatctcaatgaggttgattacaattttgcatgaccaataa

SEQ ID NO: 44949 - DNA, 1657 bp, Glycine max
  Peptide Sequence Number=SeqID_161727
cactcaattcacaaaccatgagtctcttccatcgcttcatgaatcattcaatgagttcaccaaagcgtacactcagtattctgagactgaacaagttgaccatgttagagccaaggactattcccacctctcactctccaaccaaacttgccttgattacattggcattggcctcttctcttactctcaacttcaacaccatgaaacatcaaaaggccaagtaccctcatcttcaattcctcaaacaccacctaattactcagatattccattctttagcttgtcttgcaagactgggagcctaaagactttgttgcttcatggagggcaagacacagaatttgaggctgcaatgaggaagagaatcatgagtttccttaacgtatctgaaaatgattacttcatggttttcacagcaaacagaacctcagctttcaaacttgtggcagattcataccaattccaaactagtaggaggcttttgacagtttatgactacgagagcgaggcggtggaagtgatgattagctcctcagagaagagaggagccagggccatgtcagctgagttctcatggccaaggctgaggatccagacaacaaagctgaggaagatgattgagagtaagagaaagaagaaaaagaagagaaagggtctatttgttttgccacttagttcaagagtgacaggagcaaaatatccttatctttggatgagcatagcacaggagattggatggcatgtgttggttgatgcatgtgcattggggccaaaagacatggactgttttggcctctctctctttcaaccagactttcttatttgctctttctacaaggtcttcggggaaaacccttctggatttggatgccttttcatcaagaaatctgctatttccagcttggaatcttacccttctgcaggaattgtcaaccttgtaccagaaaagcagcctcatcaattatcagatgattcttctggcactgacttggaacttaaaaacaaaccatcaccagcatgcctacatgaagagaaactatttcctttatcatatttctcaggtccaatgcaaactaaacaatcagaaatagttgaagaaggagaaccacctgactcaaaattaaaagctcctcaatgttctgaaattgaggaggtacaacaagaggcagttcagaaccttaagaaaagtagtaaagtcgaagaaactgacattcaatgtaggtgcttagaccaagtggattctttaggattgattctcatcactaaccggtcaaggtaccttataaactggcttgtaaactcaatgcggaagcttaagcatcccaacacacaaggggttcatttggtcaagatttatggtccaaaagtgaaatttgatagagggcctgctttggcattcaatatatatgattggaaagaagagaagggaaaagtcctacaaaccaaagtggttggaggccaagaaggagtgatgacaacaaccaacaagaaagatagtgttggaatcagtgtggttactgctgcattaggcttcctagctaattttgaagatgtctataagctttgggcttttgttgctaggttccttgatgctgactttgtggagaaggagaggtggagatatattgctatcaatcagaaaatagttgaagtttag

SEQ ID NO: 44950 - DNA, 1162 bp, Glycine max
  Peptide Sequence Number=SeqID_161728
cttgacggtagttacttcacttctcgaaaaatttaatgttgatcctaagcaaattggacgtttggaggttgggagtgaaactgttattgacaaaagcaaatcaattaagaccttcctgatgcaagtttttgaggcaagtggtaatattgacattgaaggtgttgattcaactaatgcatgctatggaggaacagctgctttgttcaattgtgtgaattgggtggagagtagctcatgggatggacgttatggacttgttgtatgtacagacactgcggtatatgctgaaggacctgctcgtcccactggaggagcagctgcaattgccatgcttgtagggccagatgctcctattgcttttgaaagcaaactcagaggcagtcacatgtctcatgcatatgatttttacaagccaaatcttgctagtgaatatccagttgttgatggaaaactctcacagacctgttatctcatggcacttgattcctgttatcagctttactgtaagaaggcgagccgtggtgcagcggtaaagttgtgccttggtgacctgttggtcatgggttcgaatccggaaacagcctcttgcatatgcaaggcactaacaactcccaggaaactgggttttgttgatgaagttgccagggacacccttgcaccatatgcatccttatctggtgatgacagttatcaaagtcgtgatcttgaaaaggcaaaccagcaagctgcaaaacatctatatgatgcaaaggtgcagcccagcacactaatcccaaagcaagttggtaacatgtacactgcatctctttatgcagcatttgcttctcttcttcacaataagaacagttcattggtaggtaaacgggtagttatgttttcatatggaagtggtttaacagctacaatgttctccttccaccttcaagagggtcaacatccttttaacttgtcaaacattgtaacagtgatgaatgtttcagacaagttgaagcagagagttgagattcctcctgaaaagtttgttgaaacattgaagatcatggaacaccgatatggggggaaggactttgtgacaagcaaggactgtagctacttacctccaggcaccttctatctcaccaatgttgattccatgtacagaagattttatgccaagaaggag

SEQ ID NO: 44951 - DNA, 1295 bp, Glycine max
  Peptide Sequence Number=SeqID_161729
atggactattgcttgagagagctagaaggaaagcaagcacatgaccctctattcctacagaaaatgaagaattcatcatcacaaagcactactactagtagtgagagatgtgtgtgggtgccagggccagtgattgtgggagcagggccttcagggcttgcaacagcagcatatctcaaagaaaaaggattgccaagcctaatcctagagagatccaactgcatagcatccttgtggcagctcaagacctatgataggcttcaccttcacttgccaaaaaacttctgtcaactccccttgatggggttcccttgtgatttccctacataccctacaaagcaacagttcatagagtacttggagagctatgctgagagctttgacattaggccaaggttcaatgagacggtccggcgcgccgaattcgacgccacgctcggcttctggagggtgaagagcttcaacaagaaggaggtagcaacagagtttgtgtgtaggtggttgattgtggccactggggagaatgcagaggctgaggtgcctgagattgagggaatgggagagtttggtggggccataaagcacacaagtttttataagagtggggaagagtttagagggaagagggtgttggtggttgggtgtgggaattcagggatggaagtgtgtttggatctttgcaaccataatgctactccttctcttgtggtcagagatacagtacatatcttaccacgagagatgctgggaaaatcaacttttgggttgtccatgtggttgctcaagtggctccctatccggtttgtggattggttccttctcatagtgtcatggctcatgcttggtgacacggctcggttcggattggaccggccaaaattgggtccccttcagcttaaaaacttgtccggaaagacaccagtgctagatgtgggtacccttgccaagatcaaaagtggacacataaaggaagatgatatgttctctaaggaagatgggttccctacgaagccattcccagatggatggaagggtgagaatgggctctatgcagttggtttcaccaaacgtggactacttggtgcatcaatggatgccgagagaataggtgaagatattgaaagtggatatcaaacggtggagagtggtgttgggagtgagggaatcatcccaaagttgttgcattgtggtgcggcaagtgaagtggctccaactaaaccatttgagaatgttgcacctctcataggtctagccagtgcaaagggtcacacgatcatgcattggctcaagggaaa

SEQ ID NO: 44952 - DNA, 132 bp, Glycine max
  Peptide Sequence Number=SeqID_161730
atggatggcactgtgggctacggtggtttgaaatggcttgtttggattaaagtgggagttgaatcggcatctatatctatccatgacaatggtagccctaccgaggagtttaaagcacaaagaggattatga

SEQ ID NO: 44953 - DNA, 336 bp, Glycine max
  Peptide Sequence Number=SeqID_161731
atgagagtagatggttcaattcttttttggagtggaaggttgggaacaatagtaagattaggttttgggagggcaattgataagctattggaagatgctataaatggcatttctcttaatctggaggcacatgattactggacgtggaagcttgaatctagtggaaccttttctactagctttgaatactctgctctaatagatatcaattttccttgcaatgaaaatcctttgcttgagaaaatttggcatcttgatgtaccaccaaaggtgtctttcctaccggggcacttacttcttaataggttacctacagtagataacctcaagagatga

SEQ ID NO: 44954 - DNA, 978 bp, Glycine max
  Peptide Sequence Number=SeqID_161732
atggctcttctgccatattcaaaatgcaaatttctttttccaatcattttcctctccttgacattatcatcaatgtcacaagcagagcttgatgctcactactatgataaaacatgtccacaagcagagaagataatttcagacactgttctcagggcttccacatttgatccaaaagttccagctaggatcttaaggatcttcttccaagactgtttcataagggtatgtgatgcatcaatattgctggactcaacacccaaaaacctggctgagaaagatggtcctcctaatctctctgtccatgctttctatgttattgatgaagccaaggccaagcttgagaaagcttgccctcgcacggtttcctgtgctgacttaatagccattgcggctagggatgtggtagcattgtctggaggaccatattggaatgtgctaaaaggaagaaaagatggaagggtctcaaaggcatctgaaacagtcaacctaccagctccaaccctaaatgtgaaccaactcattcagagctttgcaaagagaggtttaggtgtcaaagacatggtgactctctctggtggccacactcttggcttttcacactgttcttctttccaagctagaattcacaacttcagtttgttgcatgacattgaccctagtttgaacactgagtttgcactagacctcaaaaagaagtgtccaaaaccaaacacaaacttcagtgctggccagttcctggactcaacagcatcagtgtttgacaatgactactatagacaattgttggtgggaaagggtttgttctcatcagatcagtcacttgttggggatcagagaactagttggattgttaaagcatttgccaaggaccaaagtttgttcttcaaagagtttgcggattcaatgttgaaacttggaaatgtgggggtgtctgaaaatggagaagtgagacttaattgcaaggttgtgaattga

SEQ ID NO: 44955 - DNA, 978 bp, Glycine max
  Peptide Sequence Number=SeqID_161733
atgaatccaataaatgacagagttgtgggaatcacacagtggtacaaagcacctgttcccaataacagagcaggcttggtttctggtcttggtaagggcttggaagtgagtgctgtaaagatcaaaagccagttgagcaaaggcataggcttgccaattatgggcaaggagtggtattttgctggaagatcatctaagagaggtgtagtaggagtaggaggtgaagctgaggctgaaacacaagccccttctggttgcatgtgtgctgtttttcagttctttgatttccatccttttcactttcccaacataaaccaacaccaccaacaagaacagacctctttcaagccaccctcatgcacttcagaagaccacaccacagtcccaaaaggcgctgaagcacctaggaacagcttggagtcagaggatggtgatggtacagtttcatctctctcatcaaaagaagaagattttaaaattcctaagaatattgtacaaattaagacaagtggaggcacaagagcaagtggtggaaatttgaatgacttgtcctcagaactcaccggctctccagggacaaagacaccaactttggtggccaggttaatgggtttggatcttcttccaggggcaaactcaccatctttttcttcatgtctttcaactccaaacacacaaggcaatgtgtcacatcttcaccaccacctgagacacaagcaacatgtccaaaccaaacacagaaacagcatagacagtagtgacatagcctccacaagatctttgcctgagacaccaagaatctcctcagcaagaagatcagatgttgatcatcaccacagactctcactccaaatcaacaaggaaaacatgaaccttggtgaggatttggagctccctaggctctcattttccaaaaggaagagtgatgagaacaatggcaggagtccaagctactatgccagacaaattgtcaaacag

SEQ ID NO: 44956 - DNA, 1446 bp, Glycine max
  Peptide Sequence Number=SeqID_161734
atggtgggaggagtgtcactggctgaagcacccgctttcaagaaagctcctggtggtgctcctgccaatgtggctgttggtatctctagactaggaagttcatctgctttcataggcaaggttggagcagatgaatttgggtacatgttggctgacattttaaagcagaacaatgttgagacttctggcatgcggtttgactctaatgcaagaactgcattagcttttgttacacttagagcggatggcgaacgtgagttcttgtttttccgcaatccaagcgctgatatgctccttcaagagtcagaacttgataaagatctcctaaagaaggctagaatattccattatggctccatcagcttgattgatgagccatgcaagtcagctcaccttgctgctatgagcattgccaaaaactctggttgcattctatcatatgatccaaatttgagattggctctatggccttctgcagacgccgctcggaaaggcataatggatatatgggatcaagctgatgtcataaagataagtgaggatgagattacatttttgactggtggtgatgatccctatgatgataatgtagttttgaagaaactttttcacccaaatctcaagcttttaatcgttactgaaggttcacagggttgcagatattacaccaaggcatttaaaggcagggtttcaggtgttaaagttaaacctgtagacacaactggagctggcgatgcatttgttagtgggattttacactgcatagcttctgaccaaactatttttcaggatgagaaacgtcttcgaaaggctttatattttgccaatgtatgtggtgccctcactgtaactcagagaggtgcaattcctgcactacctacaaaggaagctatcttgcaattcttactagaagcagctcgtgagcttgcaaatcttgcattggagatgaagcttacatctggaccaaagaaagcagcgctggaacatatgagagagaagatagaggcatcaaccgagaaaattcgtatgacaaagataaatgaagaacaggcacggaaggtagtggcacgcggtggaggagatggtgcaagtgatggcacgacggaagaaagggaggatgggagatcaagttcttctcaggatagtgcaatccaagatggctccactgtttccagcacaagggaatcaaatggaggaacggctgggaatgttccataccaaaataatggtcagaaagttccagtgaccaatgagcataaactgcagcctcctagtgaaggagaaggaagaaacaaaaagaaagttaactttcgaagaggaaaagggattggtgcagtgcccaaaactaggtcttcaactcctgacatggttccagctttaatgcagatggaagaacctgagagtactatggtaatacgttactgcactaaatacatttttggctga

SEQ ID NO: 44957 - DNA, 240 bp, Glycine max
  Peptide Sequence Number=SeqID_161735
atgtataaatcgtatttaaaccaaaaacaagcttcagttcaagaagtccacccatacctgaaattcgaagccccacaacgtagaggtgtgcttcacgactccgaaaatggcttccttttgcaatttagagtagaagtgatgagcaattttggagctttaatggaggcttcaatggagaggaagaagaagagaaaagcaacgtgggaaggtgaggaaaagcttctgaattttgctgaatga

SEQ ID NO: 44958 - DNA, 1226 bp, Glycine max
  Peptide Sequence Number=SeqID_161736
gtatgtgtcggctcctgaagcatgttggaagatttttgcattcccaatgcatgggcatgcaccggcagttgaacgtctttatttccacctagaaaatcaacagcctgtttactggaaagatagtgaagaaattggcacagtactggctaagagtacaatcaaagaatcaatgttcacaacttggatggattctaataaaatataccatcatggacgagatcttacttatgctgaatatgtgtccaaatttgtttatgatgcacgaaaaagatgctggaaaccaaggaaacaaggaaatactattggcaggctgatttgggtgcccccttccagtggagagttggtctacatgaggatgatgctttcctctgctaaaggatcacaatgttacgaagatattagaacagtagaaaatgttgtctatcatacatttagagaagcatgctttgcaaaaggttttctaggaagtgatcaagaatttgttggtgccttacgagaagcaaacacttggggaactccacactatcttaggaagttatttgtgaagctgctatttatgaataccatggataggccagaatatgtgtggaaacaaacttggcaatggatggcaaatgatattgtatttaatcatagaagacaaggcatccaactaatagacaaagaaaaaatgcatctttgtttgacgacaattgaaaacctcttgcaagccaacaggaaaagcctacgagattttccttcaatgccatacccactaggatatgccgccaacacgcaccaaaataatctcatctacaatgaattggcttacgacggggacatattggccgccgaatttgacaaatgctaccagtggctaacagatgagcaggcttctatttttaataagattatgcatgtggttgcaactcaatcaggtggagtttattttctatatggatatggtggcacaggcaagacatttgtgtggaaaactttatcatctgctatacgctctactggcggcattgttttaacagtagcttcaagtgggattgcctcaatactattgcctggcggtagaacaacatattctaagtttgctattcctgtccctgcaacaaaaaattctacatgcaatatctatcaagggagtgatttggctaaattgttgcatatcacaaaactcatcatatgggatgaagctccaatgtgtcacagatacaatattgaggcccttgacaaaa

SEQ ID NO: 44959 - DNA, 900 bp, Glycine max
  Peptide Sequence Number=SeqID_161737
gcaaggatctaaatcatggtttgaaacaactgtttgatgacattggtgctttggagatggttgacattgctagatgtgaagggcatgggactgaaggtaatggagggaatgatgaaaatgttgaagagaatattcctgatgcaaatgttggttctacaacaggtagttctggtgcaacaaaagatgctgatgttacaataaccttaaatgattcggaagaagaaaccaatgaaagagaagggtttgtggggaaaccgaaaggttcaacatctacagaaaaagaaggtgtactacctcctgaaccccaacctgaaattaatgatgatgtacaacatgaagtccttccacaacatcaacacatggaaatggatgatgatacatacaacttaaaagagttacacactaaatcaaaagatgaggatgggtccaaaataagacaggaacatccagtgtgggttatgcataatgatctgaaagattacattgtcaaagacaactgcactaagggcaagggctcatacaaagactcttatacatggttcattttcataacaatacaagagataaatgactataaccatgagctgatgaagtctaatgaagagtcaactgttgatttaacaacacatccttttgaaggtaatttagaggaattagagaacaataacagtgatgtcagccttgcatttcatagactttacatttgtctaaaggtatgcaaggatagctttttcaaactggttgaaggtgagaataccaactcctggaaatggtttatggaacttttgatcaaagacttgggagctagagaaaagcctattgtgtctatgttagagaatatacacatctatctaatggagaggtgggacaccaactcaaaaaaggttgttgcatgggaag

SEQ ID NO: 44960 - DNA, 408 bp, Glycine max
  Peptide Sequence Number=SeqID_161738
atggacaaaaaaatatccagagaaataccagaaggataccgtgtttgtttctggaacaaggagacaagggtgatatccagagaattgccaacgctgtctttttccccgggcattggtcgtagaacaatgtttgggtttggctatgatccgtcaagtgacaaatacaaggttgtagcaattgcattgactatgctctcacttgacgtatctgaaaagactgagatgaaagtttatggcgcgggtgacagtagttggagaaaccttaaaggttttcctgttctttggactttacctaaagttggtggagtgtatctgagtggaacccttaattgggttgttattaagggaaaagaaaccattcattctgaaatcgtaattatttctgttgacctggagaaggagacttga

SEQ ID NO: 44961 - DNA, 276 bp, Glycine max
  Peptide Sequence Number=SeqID_161739
atggtgcagttttatcatgcattttccagcactttaactggattctctgcacctaatattgtttcattaaacaaggtttatgcaatctgcaatgaaaatgcaaagcgaaatggtgaaacgaatgcagttgggtggactgaagtgcatgttgaagtcgtgaaaattcaaacgacttcaaagtcattgaattgcctacgacttcactattcatggatgaatggtgtagattcaactatggaggaaatggagggtggatcttctttgccaaagatgtag

SEQ ID NO: 44962 - DNA, 1124 bp, Glycine max
  Peptide Sequence Number=SeqID_161740
cgccagcgcgcgcaggcacaggtgatgatggctggcgccctggccgggcccgaacggtggatgcgcaggcagcagcagggtgtagcgtcggccctcgcgctcggccacatccacccagcgcgccaatcgagcgatgcgtgcttcatggcccagcggcgccaatgagcgccagtcgaggatcacttcgatgccgaccggcttttcgtactcgcgcacaagcaggctgtcgcggcgtgccgagtgcttccaggaaatgctgcgcggcgcatcgcccgcccggtaggggcgcagctgatgcagctcctcgccgctggcatgggcacgggtatgcagcggatcgctgccgctctccggcagtgcaggcgccacggcctcggccagcgggtagaccagcagcggctgttccggccacacccacgaccatgcccgcaccaggcccagcggctgggtggtggacaggcggatacgcggcagttccagccagccacggcgttcgctgggaacgtccagttccacttcgccacggccgtgcgcaggcagcgaggtccagccgttgctgtcacccagctgcagatgaaggccgtgccgcgcacgcggatcacgcagtgagaggtctacgcgcaggcgcaacggttgcccggccggtaccggctcggccgagatcgcatcgatctgcacgccggacaactggagatgcgcggcaatggcactggcgatggccgctgcggcaagcagcagggccagcagcagcgccggattgttgttgtagttcagcgcgcccagcagcatggccaccagcagggtggcaacgaacaggccgaagcgggtgggcagcacatagatgcgatggcggtccagccgcttcggcaaggcttcgggcctgcgtggccgtgccagcagctgcatgcgtgcccagcgtgtggccacgctcaatccaccgcgacggtctgcaggatcgcgcgcgccagtgccggtcccgaactggattcggcttccgccaccagccggtgaccagccactgcgacgaacagcgtctgcacgtcctcgggcacgacatgcccgcgacccagcagcagggcatgtgccctggccgcacgcagcaatgccaggccggcgcgtggtga

SEQ ID NO: 44963 - DNA, 808 bp, Glycine max
  Peptide Sequence Number=SeqID_161741
gaggtgctcctgttgtcgtgcgggaaaagggttacgcgtcaaagtatcggtgagccagtgcaaaccaggctgcgcgggcggtaaaagcgttcaatatttcgccagccaaacgcggttaatccagggaaacgtaaaccgcgtgaaacgtcccgttacccgcaccatcgcccgcgcgctcagcgcgattgtgctgctgtcgctgttaaccaccggcctggcgctgatgacgctctccagcagtttgcgcgatgccgaagcggtgaatgtcgccggctcgctgcgcatgcaaatctaccggctggcgtgggacagcacgcgcgatccgcagcagctggcgcaccatatgcagcaatatcagcagacgctggagtcaccggcgctgcagcatctggagcgtccgtgggtgccgattgaggtcagcagccgctatcgctatctgcgcgacagctggccggtactgcaagagacgctgcagccggcgcgggcgcaggtgtaccagcagcgcgtggcgggctacgtcacactatgccgagctgaaaatgcatctggtggccgccagcagcctgttcggctttctggcgattgtcgcgctggcgctgtggagcattggctttattcgccgcaacgtggtgcgtccgctcgattcgctggtcaccgccagtcaatacgtcgagcaggccaacttcagttttccgccgctttccgtgcatcagcccaacgagctgggcgtgctggcgcaggcctttaccactatggcggagcggctgcattcgcactatcgcctgctggagtgcgcggtacgcaataa

SEQ ID NO: 44964 - DNA, 525 bp, Glycine max
  Peptide Sequence Number=SeqID_161742
ctgctgataggcctcggccagcgcgcgatcgaaatcggcgatgatcgcctgtgcctgtggctggctgctatcgacattacgccgcagcagcgtcagctggatacgcagaaaagagagcgactgcgccagcgaatcgtgcagctcgcgcgcaatggtggcgcgctcttcaatcagcagcatctgctgatactgcttctgcgtctgccagatccacagtgcacgcgccagcatgttggccagactgtgcatcagctcatcggccggcggcgcgcggcgggtttgccagcacagttcgccgaggcgctgctcctcctgctgcagcggcagccgctgccagctgagatcgtcggcgggcacgccggcctggaaggcgatatcctcgctggcgatttgcagcacctccagtgcttcccgtcgctgcaccagccgcagcaggccctggaacagctcgggattgagcgggctgccggtgagaatctgcgagctttcatacagcagcgacagcgtgcggttggcctgggttaa

SEQ ID NO: 44965 - DNA, 271 bp, Glycine max
  Peptide Sequence Number=SeqID_161743
agatgattttcgagactacgaggatctttgctttaaggaatttggagatagggtgaaattttgggttactttgaaccagccatggttgttcagccaaggtggctatgcaaccggaccaggaagatgtaccggtccacaatgcctcggtggtgatgctggtaatgaaccttacatagttacacacaatcaaattcttgctcatgcagcagctgttcatgtgtacaagactaagtatcaggcatatcagaaagtcaagataggcataacgttg

SEQ ID NO: 44966 - DNA, 219 bp, Glycine max
  Peptide Sequence Number=SeqID_161744
atgcccgttccccctggcaagggatcgcgcttgcaagacaccaagtggacccgaagaagtccaacaaggtcttggagttgtcaagctctaattacgggtctctgtcaattctacggagtacctgtcacctccagcaagggcatcaggccccctactaatcgagctttcatcaagaagtactgcgtccctaggcaggcacagggcgaaataccacagtag

SEQ ID NO: 44967 - DNA, 342 bp, Glycine max
  Peptide Sequence Number=SeqID_161745
atgaacttaatcattgttatgaaaaggaaagaacgcgctttacggcacccttaccaaacgcgtgctagagctagagtaatgggtgaagtagaggaggtacaagaacagatcaaggctgacatggaggccatgaaagagaaaatggccacaatgatggaggccattatgcgcatgaaggagataatggaggtcaatgcggttgcattgctgagcccccattgtgtgcaaattctaaacaagcacgccttcgcgccatttgggttgcctcccaactatacaccacccaatctgacatacactcccggtgaggatgtcaataactccctctcccatacacattga

SEQ ID NO: 44968 - DNA, 1614 bp, Glycine max
  Peptide Sequence Number=SeqID_161746
atgaaacaaacgactaagcaagatatatcacaagatatggcattcagcggttatttccttttgggcctcatagctcttgttattgttaggtcttccaaagttacatgcgaagaattagcagttaatacagtttcacctattattgacatttcactcagtcggaacagtttcccagaagggttcatctttggggcgggatcttcctcgtaccagttcgaaggtgcagcaaaggaaggtggtagagaaccaagtgtatgggataccttcacccataattatccaggtaagatcatggatagaagcaacggagacgtcgccattgactcatatcaccactacaaggaagatgttgggatgatgaaggatatgaatttggattcatatagattttccatatcatggtcaaggattctccctaaaggaaagctaagtggaggtataaatcaagaaggaatcaactattacaacaaccttatcaatgagctagtagctaatggtatacaaccacttgtgactctttttcattgggatcttccccaagcattagaagatgagtatggtggctttttaagtccgcgcatagtgaaagatttccgagactatgcggaactttgcttcagggaatttggtgatagggtaaagtattgggttacattgaatgagccatggagttacagccaaaatggctatgcaaatgggcgaatggcacctggtcgttgttctgcttggatgaatctgaattgcactggaggtgattcttcaacggagccttatttggttacacatcaccaacttcttgctcatgcaacagctgttcgtgtgtacaagaccaagtatcaggcatctcaaagtggtgtgataggcataaccttggtagctaattggtttttgccgctcagagataccaaatctgatcaaaaggctacagaaagagcaattgacttcatgtatggatggttcgtggatccattaacctctggagactatccaaaaagcatgagatcacttgtgcggacacgattaccaaagtttactgcagagcaatccaaactacttattggttcatttgattttattggcctaaactattactctacaacatatgcctctgatgcacctcatctaagtaacgcccgacctagctacttaacagattctcttgtcactcctgcatatgaacgtgatgggaaacctattggaataaagattgcctctgattggttatatgtttatccaagaggaattcgagatcttttattatataccaaggaaaagtacaacaatcctttgatttacatcactgaaaatggtataaatgagtataatgaaccaatattatcacttgaagagtctcttatggatatattcagaattgattatcattatcgtcatctcttttatcttcgatcagcaattagggatggtgcaaatgtgaaaggatattatgtatggtctttgttcgacaattttgagtggtcttcaggctatacatcacgtttcgggatgatcttcgtggattataaaaataatttgaagagataccaaaaactctctgcacaatggttcaagaattttctcaggaaagaaaccaggctttatagctcttgtaaataa

SEQ ID NO: 44969 - DNA, 249 bp, Glycine max
  Peptide Sequence Number=SeqID_161747
atgtttgggaaccctaacagagcaaccagaggacgagcttttgagagcaccaaaaatgccacaattgataatggagaatgcttgagcgactatatcgaggtgatccgatatgaaccttataatgaaaaatgtgatgtgtacagttttggggttatattgaatgagcttttaactggaaattacccatacgttgagacgaaatatggtcccaccaagattgtcgtggaagttgtggagggtaagctgtga

SEQ ID NO: 44970 - DNA, 2112 bp, Glycine max
  Peptide Sequence Number=SeqID_161748
atgttggaggttccatcttctactcacttggggtgtagcataagacataagtggcaatgggtttgtgctgttgagagaaccccttccatgagtgagttgaatgaaattctttttgggcaggcaaaagcctacaagaaattccctacagcttcaatgcctcctctggtcccccattccatccctcatattccttccactccgcatgctcccctcactcccttcgccactaatctgctgccacctgctcattctattagggtccctctccaacaggctcctccacctcaatttccatcctacccttgtcatttatgtccctctttggtgcctgaactgggggaacaccttaaacaaagggatctgtcatttgtattcaggttacagggtgctgaaaactcaacactttatgggtgttgtgtcttagttgaagaactagtgcaaaagccctctggattgctatctctgatttctgataagcagccttcttactcgtctttgagacgacatatattaatcactcagagatgttactgcattctttcaaggatcccagcttttgaattgcactttggtgtattgaatagcatcttcacacaagaaaggctagagcggttgacaaaaggtgttggagatttaaatttagaatttgatgaaggtaaccataaggaagaaaacctacagggctactcggagagtgttttggtgagtgatggaccaatagaagacagacttggtggaaatacagtaatttctcaatcaagagtgagaaagtctacacctgaaaatattgtggatgatggtcaatcagagcatctaacggttgatggggagctgcagacatataaggagagaatcaattatgacgatgctttgcttactgatcctgtaaatgataggacaacagccaaagaagattctgggcctgcaaattccgaaaatagtgatcactatggagatgcttttgcaaccaacaaacaatcagaagacaaacatttacctaatgctattttgccccttctgcgctattgccagtatgaaagttctgaatcttcctgcagttttcaaggctcgccttgtgaagacagaaattttaggagtgatgttgatgataatgagacagaggaagcatctttctctggccaagaggatttaaatgacttaaatgatattcttgagtgggccaaggaaaataaccatggaccactacaaattgtaagcgagttttaccgtttaagttgccctgccaggggctcatcacttacatttcatcctttggagcacttgcatcccttggaatatcacagatcagctgagacagttctacgtcttgctgattcaacagttgatttgaaaacgtccagtactggtctgggattagctgatgcacacattgctcttctggtggaagaggcaaatgcattatctttatgggctgtagcttgcttgtgcggtacattgagacttgaaaatgtgttaacattctttgcaggagttctactagagaagcagatagttgttgtctgttctaatttgggaatcctatctgcttcagttttatcagttattccgctaatccagccttaccggtggcaaagcctgttaatgccagttttaccaaatgacatgcttgagtttttagatgcacctgtcccttatgtagtcggtattaagaacaagaccagtgaagttcagtcaaagtttaccaatgttattctggttgatgccgatagaaacctgttgattagagaaatagacagggtaggacttacagtagaaaagatggtgaagtcaccaacaattccccaactgccaagacagaaagagctagtctcttctttacgtccttatcatgaaactcttgtaggagaaagttacttgggtaggagaagaccagtatatgaatgcacagaagtgcagattgaagctgcgaaggggttcctttcagtgttaagatcttacttggattctctttgctgtaacatccgttctcacacaatcaccaatgtacaatccaatgacgataaggtatcattgcttctgaaggagagtttcattgactcattcccatatcgtgattggccttttatgaagggactagctaggtctccctaa

SEQ ID NO: 44971 - DNA, 1044 bp, Glycine max
  Peptide Sequence Number=SeqID_161749
atgaatggaaggaacgttaacacaaacaggttccctttcactccttcccagtggcaagagcttgaacaccaagctctcatctacaaatacatggcttcaggtatctccatcccccctgaccttctcttcaccatcaaaagaacaacccacttggactcctcaagactattgcctcaccaccctcaacactttggatggaactatttgccaatggggttggggaggaaaatagacccggagccagggaggtgtagaagaacagatggaaagaaatggaggtgctcaaaggaggcgtatccagattcaaagtactgtgagaggcacatgcacagagggaaaaatcgttcaagaaagcctgtggaagttttgaaaacaacaccaacgacagcagcagtggcaacaaacacagatgcctcaaccccaacaacaatcttatcaatcaccaaaaacagtcctgcacatgcactctccccaaccactcattctctctctcatgacacttaccatcatcatcatcatcaccctcaccctcagcaacattcctcccactccttcctctatcatcattcttcgaggccctcttccggtgctgctttgtcatttcaagacaacagtgcccccttgtttctcgacactgcttcttgctctcagaataacaacaacactgactgcaggtatgtgtatggactgaaggaggaggtggacgagcatgccttcttcacagaaccttctggaactatgagaagcttctctgcttcctcaatggaagattcatggcaactcacaccactgactataagctcctcttcctcttcgaaacagaggaactgctctggtttatccaatgacaacaacgagtactcctacttgcaacttcagagcctcaatggcaacaactcaaaacagccacaacaagatcaaggttgctacatatcaggcagtgatgtcaagtgcgaaacattcatgaaacttgggaaagaagaacctcagaaaaccgttcatcgcttcttcgatgaatggccccctaaaagcagaggatcgtgg

SEQ ID NO: 44972 - DNA, 249 bp, Glycine max
  Peptide Sequence Number=SeqID_161750
atgcatcgatgtgaaatggctccgaaaaagctcccagccaagagatccaggaaggatgttgctagaaagggttctagtgcggccccacaggcagatgtggactttgatagacacaggttctggagtgaggaacaccagcaacgatttgaggccattaaaggtgtaaaagcaagcttcatgatgatgaatcaagttgattcaagtagttttgatgataacaaagatgatgacaaaaagcccaaagaatga

SEQ ID NO: 44973 - DNA, 222 bp, Glycine max
  Peptide Sequence Number=SeqID_161751
atgggtcatgctgggtcagatgtgtatgacgttgattcccaattctggctctggaatagcatgggtcttgttgttagtagcacggttgagctcggatgtgtgacgctgaaaaatcagcatggctatgctagaatagtatggcctgcaggtaggggtgagaataggctaggccggcttacaggggcctacgacctggcctacataaagtctggcctggtctga

SEQ ID NO: 44974 - DNA, 909 bp, Glycine max
  Peptide Sequence Number=SeqID_161752
atggcttcagagtctggaaaggacggtgccggcgtcccaaggaagcttaaatttaaaccaagagctccacctcgtcgagtgataaagcaagaagttaaagctgaagtggctgatgatgttgatgttgatgctgatgcagaacatgctgctaaggagaatctgctgaagcgtttccatgagagggagagtgcggtgaaggcaaagtacaaggttgagaaaaaagtgttagcttctcaaattgcttttggttatggtggcgaatcaacttctatgaaatcatatggtattcccaggggtgggagcagtatcaacatcaatcagagttcagcatctaatggggcgaaagagaaagaataccaagagccatgggactatgacagtaattatccagtaactcttcccttgaggaggccttattctggaaacccagctcttcttgatgaccaagaatttggggaggctgcagagccaagagcttatgatgaaaatgcatcaaattcagcaatggagcttgaccttttggagcacaacccagaggcaagtatgttctttattaatttgcctacaaaattgcctatgattaaacaatcagctactgctggaagcagcgatgttaatgtgaagtctagacctcatgggggttcaaaaaacgtggaggagctctgtgagttgaacgagttatcatctggcttcatgggtaaaatgcttgtatacaaaagtggtgcaatcaagcttaagcttggcgataccctttatgatgtttcctcgggtatgaaatgtgcctgtgcccaagatttggttgctatcaataccgctcaaaaacattgttgcacaattggggagatcagcaagcgtgtttctataaccccggatatagacgccataattgacaatttgcctgatttgtaa

SEQ ID NO: 44975 - DNA, 915 bp, Glycine max
  Peptide Sequence Number=SeqID_161753
atggggagaagcccttgttgttcaaaggagggtttgaatagaggtgcttggacagctcatgaagacaaaatcctcagagaatacattagagtccatggtgaaggaagatggagaaaccttcccaaaagagcaggtttgaaaagatgtggaaaaagttgcagacttagatggttgaattatctcagaccagatattaagagaggcaatatatccccagatgaagaagagctcatcatcaggctacacaagctcctgggaaacagatggtctttaatagctgggaggcttccaggacgaacagacaatgaaataaagaattattggaacaccaatttaggaaaaaaggtgaaagatggccaccaaaccactgcaaacaacacacagaatccaatgccccatttggcccccattcatatggccacttcctcaatctccctatctcctcctaaactagattctcgtgttgtccgtacaaaggctaccaagtgctccaaggtattattcctaaacccaccccctcacccatcaatgccgaacaagtccaagactgaggcagaggcagaagcaaggcttgtggatggtgtaattagtaaccaaatggaacacactacatacgacaatgggttcctgtcgtttccagacgaagaaaaagaactctcaacagattttctcatagatttcaacgtgggggatgtttgcttgtctgatctactcaactcagatttctcaaacacgtacaatttcagctgcactaatgttaaccaccacgagcagttatcgccttgttcggaccaacctgatgccatgttctcagatgaagttctcaaggactggacacacagcaattttgcagacgaagcgaatgcttccaacaaccttcattctttcatttcgtttgagtctactgaggaatga

SEQ ID NO: 44976 - DNA, 668 bp, Glycine max
  Peptide Sequence Number=SeqID_161754
atggcacagtatggtaaggtttatgaggatgctgctgagatggaaaaacgtttccaaatattcaaaaacaatgtgcagttcattgagtctttcaatgttgctggggacaaacccttcaacattagaattaaccaatttcctgaccttcatgatgaagaatttaaggctttactaattaatggtcagagaaaggtaagtggggtggagacagcaacagaagaaacatcgtttaggtatggtagttgttgggcactttcagcagtggctgcaatagagggtatccaccaaattacgacaagtaaattaatgtttctctctaagcaaaaactggtggatagtgttaaaggtgagagcgaaggatgcattggtggttatgtggaagatgcctttgaatttattgtgaagaaagggggaatcctaaggtatgagaaagttccttctaataataaaaaggcactcctaaaagttgtggcaaatcaaccagtgtcagtttatattgatgttggagcacatgctttcaaatattactcaagtgagatttttaatgcaagaaattgtggaagtgatccaaaccatgttgttgcagtagtaggttatggaaaagctcttgatggtgctaagtattggccggtaaagaattcatggggcactgaatggggtgggaaatg

SEQ ID NO: 44977 - DNA, 330 bp, Glycine max
  Peptide Sequence Number=SeqID_161755
atgtcgaagaataaggtgttgaaagtgcataacaggactttcctaaattggtttaaagatacaaactttggtgacaataatgcttctgaaatgttaaggaagctagtagatgggcctaaaagaaatgtgataatttgtggggttactctaagggctgaatctcaatacttcactagtgtacatgatgacaatcctcgtgtagcttccattcctttgtgggttgacaacaatatcggtgtgcagatagatgatttaggatttatgttggtagatcttatgaaactcgcttaccagaataaccctttcatcatggcagaacaagctaaatag

SEQ ID NO: 44978 - DNA, 657 bp, Glycine max
  Peptide Sequence Number=SeqID_161756
atgtcgatcatcgagcatgtggtgttattcaaggtcaaagaagatgttgcaccgtcggaggcagataccatggtggagcgtatcaactccctagcctcgctggaacagctgcttcaccttaccgtggggccattatttcgcatccgaacctcccccccttcgttgaaattcactcacttcttccacacgcgtttcaactccaaggacgacctccgctcctatgtggcgcacccagcccacgtggccgtcgtcaaggccaacacgcccttggtcgacgacgccatggcccttgattggctcgccgaggttcccggcggcaccgtgccgccgccgggctccgccttgcgagtcacgttcttcaagttgaaggagggtgttgaagatcgtgtaaaagatgagattgtgggggccatgagaggatttcagcgtgagttcaaacaggccattcagctcacttgcgggggaaatttctctcccgcgagagccaaagggttctccattgcttcccttgaagtttttcctggattaagcgaactagaggcagcgaaggagctaggggactatcataagaatgagaagatcaaggagcatctcgagagtgtgatggtgcttgattatgtggtaccatcatcatccaaagcgcactcagcatcttaa

SEQ ID NO: 44979 - DNA, 303 bp, Glycine max
  Peptide Sequence Number=SeqID_161757
atgttgaagttagctcaagccttcaagtatcatgatacatcttcatatctgaaggtggttggaaacaaattaaaggatatattagagatgatatcatcaatgccagcagttttagcagccagggaaagagatgaagttaacttggcaaatattgcgatgaaaaagattcaagcaggaaagcttagtgagcttgtagacccatcctttgggtttgagtcaaaccaaccaacaaaactttgtacaaactcatgtgtagctaaactatatgtaccagatttttcttctagaaaatatgagaaatag

SEQ ID NO: 44980 - DNA, 198 bp, Glycine max
  Peptide Sequence Number=SeqID_161758
atgaagaacaatgacggtttgtggtggctaatggtggttgtgggtgatggagaaactacacgaaagcaaaggctgaaacgctcaaatgagaaatgctctcgggaacggaagcttaatgcccactccagacatcttctcaaagatcccaacggtcagactgtggacaagtttcttgtgaagttgaaggccaaattttga

SEQ ID NO: 44981 - DNA, 1086 bp, Glycine max
  Peptide Sequence Number=SeqID_161759
atggattcttctccttcaccagacatatgcatcccagagcagtggttagaggccacagagtccattgcacacagttcaatgcttccgattgctcttatatgtggtgccaagaattgtgggaagacaaccttctcccgctatctcctaaacatcctcttgaacaaatacaccaaagtagcttatctggatactgatgttggccaacctgagtttactcctcctgcttttctatcactaaccattgttcataaagtaactccagatttgacagttccatgcctgaaaacaccggagaggtgccttttctttggtgatgtttcttgtaagagagatccatcaacatacttaagttatgtatttgccatatataatcattaccgaaaggagtattgcatctcagataagggagaatatcctcataagattgaggttcctcttattgtgaatactcctggttgggtgaaagttaagataagcatatccagtgaaaaaaagaatttacctgctggagaattctggtcagatggggaacatgatgaaacaattaacataattgagataaattcagctcgtcaggactcgttaaatagatcggtgcttgttcagaaggatgcacgtctactgcgtgatttacgaataatggcttatttcagacaatgcttttctagtgagtcaaatatttccacaatcaaggaacttgcacatgcgttgacctctcattgtccgtatgaagttcctattgcaagcataaagattcggcaccttcactgtgaggttccaagttctgaaatattctacagtttgaatgctaccgttgttggcttagcagttgattctgatggacctgaaaatttgccttggtgtcttgggcttggtagtggggcacaaaaatactgtgaagtaatgttgatttttggattagcttcatcagatctcatatggatcgtgaggggcattgactcagtcaaaggtgtgctctatgtcattactcccgtgccaaatagttctctggaaaaagtcaacctcttgctgcagggcaagaaatttcttgcattcttttactttcttattgacataatcttatag

SEQ ID NO: 44982 - DNA, 843 bp, Glycine max
  Peptide Sequence Number=SeqID_161760
atgcgagcacagacgctgatgacacagtggtgcacaagagcagcaacgtgtggccaattgaggatgagcactaacaccaacacccccaaacacgatggtctcgacgccattttcaaacataagcgcttacttcgaacgcaggtcagaaaaaccctaaaatccatccaaccctccctccgatctcaccaagcaatcattagtttgttaaaatgtgaccataaattctctcttccttctccttttatcgataacaccgttcaagacatagttttgggagctccgtggttcaaatccagtcgcaggctatgcgcgtacataagctgcgctgctcttcgcgaagtcgacactttaaaaatattgtcacaaattttgcaacataacaatgctactgatggaaagaaactctatgtgccgcgcgtggaggataagaatagtcacatgcgtatgctccacatatcgggaattgatgatctcattgcaaactcaatggacatcttagagcctgctccggttgatgttgatggaaatgcgcgtgaagatgttatgcaggcaaatgatccagttgatttgttccttttacctggactggcatttgacagatctggaagacgtttaggtcgtggcagaggttactatgatacattcctgaagaattaccaagaccttgcaaagacgcggaattggaagcagcccttgcttgttgcactgtcgtattccgaacaaatactggatgaaggactaataccaatgacttcatctgatcttccagttgatgctcttgtatctccggaaggaattataataaaaggtaaaagagcggtccagtgcccaaatgggatgtag

SEQ ID NO: 44983 - DNA, 1773 bp, Glycine max
  Peptide Sequence Number=SeqID_161761
atggggaagttcacacactttgtgatctatgtgttgcttgaatgggtgctgatattcatactcttccttgatgggtttctggcatttttggccaatgagtttgccagattctttgaattgcacatcccttgctggctgtgcaccaggtttgatcatgttatggttcacagaaatcctgatttctattacaacgagtccgtgtgtgaggctcacaagaaggacatgtcgtctttggcattttgtcacaaccacaagaagctttctgacataaggaagatgtgtgaggggtgcctgctttcatttgcaactgagaaagaatcggattgcgacacctacaagtcccttgtggggattttgcataaggatttggagtgctttgttcaggatgaccaaccaattcagttgagtttgaaggatgatggggtcatgcaggttgatagaagcagcaaccagaagtgttcatgctgtggagagccattgaaaatgaagtcttcttctaattctaatataaaagtgaagcactcgtcatcatttgcgcgagccccaactccttcaccgagagcttttccattttcaacatcaaaaagtgaggaacctaatggtctagaattgcatcacatcaggtacaaagaactcaaatttatgtcggatccggagcttcaagaggatgagtttggcttcaatgttaatagtccgattgttaaatcaagcggagacaccaaatctacctctttgcctctattgggagaagttgaagatttgaacgatgagtccagcaaattcaccccaacttttacaaggggcaataagttctttggaatcccactcaccgattctgcaaacaacagtcccagatggacttacaggattaacaggaaatcaccactggaaaagacagaattttcctctgactctaatgatgtaaatccccaaactgattttgatgatgccatcttaaacaatttgaagaggcaagttcgtttggatcgcaaatcactcatggctttgtacatggagctggatgaagaaagaagtgcttcagctgttgctgccaacaatgcaatggccatgatcacccggttacaggccgagaaggcagcggtgcaaatggaggctttgcagtatcagagaatgatggaggagcaggctgagtatgatgaagaagccctacaagcatctaatgatatgcttctcaaacgagaggaagatctcaaagctttagaagctgaattggagatttatagaaaaaaatatggaagcttagcagaagaaaatacttttagtagggaatctaactcatctattggtgataatagctcttcattcaagctcaatgaaggggaaggtaatgcagaaaaaggcctcaattctaatcaagttgtatcatctcaggcagaaaatggaggggtaaaacacaatgaatcagtcaaagattttaaagcagagaaaacatatcttcttggccggatgaagaaaacagaaaatagaacacccttagcagaaagtggaatttattccttactgtctagctctgacagtgttaataatttagacagcgagacaggaaaaggaggtgaagcctttctaccaaaagaactgtctttccttactgaaagggtgaaggctctgaaagccaacagtcggttcttagagcttgtttccattagagatgagaaagatagtgaaggaaccaaaattttatcagagatatcacagaatctagagaaactcagccaccttgttatgacctcatttgaggtagcgaatgcatga

SEQ ID NO: 44984 - DNA, 270 bp, Glycine max
  Peptide Sequence Number=SeqID_161762
atgaagaagatgcaaggcctacaagctccagatggagctacattatttatcatggcacgtaagctcaactccattatggacatcactgctcaaaaggagaattggaaagctgataagattgttgctcaaattaaaaatgttgatcttggtaagtggaatgatgttgttaaagtgggggcttatgcagtgttcattcaaaattcaatgtgtggttctagactgtttatcaatgaagatttgaaggacattaaagattataaaaatgggtag

SEQ ID NO: 44985 - DNA, 261 bp, Glycine max
  Peptide Sequence Number=SeqID_161763
atgtttgagaattgctttgctaaaacagggctaaaggaacatcttagatgctcacatgatgtgcattactgcaagatacataattttcaagaaaaaaaccaaatatacagcaaaatgtatcctgcggaagaagtttggcaggttcttccgcgagaaggattgaaagcctgcggaagaaggttccgcaggttcttccacgagaagaaaatggagccagcggaagaaggtgttcttccgcgggctcctgcggaagaaaggtga

SEQ ID NO: 44986 - DNA, 828 bp, Glycine max
  Peptide Sequence Number=SeqID_161764
atggaagatttccagcatatggttcatcaatgtggacttgttgatttgggatttctaggacgccaattcacttggagcagaggcactctgtctgaaaggttagatcgggcttttgctagtacttcatggcgtactcagtttccaaagaactgtaacctgactgttacgttacgccaatgggatagggatgtatttgggcatattggcaagaggaagagggagcttgttagaagattagctggtattgatcgaaaaattgctcaaagggagaataggtacctgaggaagatgcaaggtgacctctggaatgagttggagaatactctgttccatgaagaattgctttggtttcaaaaatcccattatatatttcaggatgatggtgtttttgagcctttctgctttaagggttgttttcctagactagaggcttcgtgcttggaagagatgaggaaagattgtgcaactgttgggccatatctcagtcggcttcttagacagatttctcttaatccaaaggagaaattatcgcacttaattctcttagcagtggaacataggttctcgaagcccattaagctgagcagaaggggggcaaatatctctcatttgatgttcgctgatgatctcattctattctcggaggccttcgtggaccatgttgaagttatttcagccttccttgatttcttttgtgagagttcagtagaaaagctatgccgtcttattcgatgcaatctttatttttaccctgagcggtgtgggaagaggtggatcaagtttgccggaattttctttggggggattatgaaaatgtcaaacatgtaa

SEQ ID NO: 44987 - DNA, 246 bp, Glycine max
  Peptide Sequence Number=SeqID_161765
atggagtcgccaactgtcgcaacctacccttcggcggcagggcgatgtgagactcacgggtgcgtgttccaagaaaggaatacgcgcggagtcgccaccaacgtttatttgaggaaaaacgtcagaaaaaccggaaaagacgtggtctacgaactttatgtgaaaggtcatttaaggcgttggaccattaaacaatctttcgattcttttgaaaggagagaaaacattaaggcattggaccattaa

SEQ ID NO: 44988 - DNA, 262 bp, Glycine max
  Peptide Sequence Number=SeqID_161766
gttcactgaaaatgaagaaatcaatgggagtatagttccatggaatgtagaaattaaagaagttagagtgcgagatcctttgacttatgcctctagcaataaaaattgccagaaggttgcaagagagttggatgtaaatgggtctttaaggctacaagactctcatggcaacctcgaacgttacaaggccaaactttttgctaagggttttactcagaaagatggtgttgattacaaagacagtttttcaccattctcatga

SEQ ID NO: 44989 - DNA, 312 bp, Glycine max
  Peptide Sequence Number=SeqID_161767
atgtatgaaattcagttctggactcgcacctttccttactgtcggagcttcaaattgcgccgctatagtcagaatgggttttcgtcatgtgtgatccacaacgacacaggacgcgcgattggtgacgacataagacacaacgatggagaggggaggagaacgtggtggtgtggggcagttttgggtttaatttgtccattatcatcttctggttcaatctcgtttaggaataactctgttgggttgattgagaagaaaaaggaagagggagtggaggaaggagaagaggaagagattatattttgggactga

SEQ ID NO: 44990 - DNA, 543 bp, Glycine max
  Peptide Sequence Number=SeqID_161768
atgggtgatttccaaggccccttcatagtgtcaccccctccttcactctcttcctcggataagtccagcacaaccatgctatactatgggttagtagtggtgggggttgcagccatggcattagccctatacaacttcgtcatcatcaagcgaagtagaaggcgccatatgcaatcacaggctgaaggggcaaatgggttggtggaggtggcgatggaaagtagtagaattgagaactgccaaaggaacaacttcaacttgctctcaagcttcaagtacaagaaagaagcagcaaaagaaggaagtggagatggtgattatgattatgatgatgaatgcccagtttgcttatcgggttttgaagaaggggaagaagtgaggaagctgccacggtgcaagcactggttccacgcaccatgcatagacatgtggctctactcccatttcgattgtccaatttgtcgaacacctgttgggcaattctaccaccgtttccattctggtccggagttgctggaatccggtggtggcgtctccgtatga

SEQ ID NO: 44991 - DNA, 723 bp, Glycine max
  Peptide Sequence Number=SeqID_161769
agctcaaagcttgaatcagctgaagaaagccccgtaacacctccactgaacagggaacggttacctcgtaatatgtaccgtccaacaggaatgggaatgggatactcatcctcagattcctttgatcatcagtcaatgcaatctcggcatttctatgactcaaatggtatgaactcaacaccgaaagtgtccaccattagtgcggccaaaacggagatatcatcaatggatgcttctatcagaagtagctcatcgagagaggctgatcgctccggtgatttttcaatcagcaatgctagtgatttggagactgaatgggttgaacaggatgaacctggggtttacattacgatcagagcattgccaggtggtgcaagagagctcaaacgagtcaggttcagaagtcaatggaatttatttcttggtgttctcatgtgttacacagccgagaaaaatttggggagatgcatgctagattatggtgggaagagaaccgtgccagaatacatgaacaatacttgtccagcacgcatcagttatgatgcacaaacatatgaaaaagcatgtcaccagaacgaaatattttttaggaaatataaacataagctccacgcttccagtggtactgaatttatatcgggcaaaaggtacgataatgagctcgttacttggtctctaatttccaagtcaagtccttggttatatgactggttgtggaattga

SEQ ID NO: 44992 - DNA, 1005 bp, Glycine max
  Peptide Sequence Number=SeqID_161770
atgaatcttcgccgagccgtgatgttggaagattggatggagaagcacggttcccattccctcaatgctcagttgctaaactcgagttcaagctcctcagaatgcagctctgcagggggcatattctcctcttcagaaacagacacaacaacaaccctaacgttgaagaaacaaagaccagcaaggctcacatcggagaagaagaagaagaagcaggaccgtattatgagttcagaaaagcagaacaaagaaagtggttttacaaggaccaagttgagggcgttgaaaatttacggcgaattgaaccagagagtgaagcaacccatttcaccggggagtagaatagctagcttccttagctccatcttcaactcacagaacgtgaagaaagccaaaatgtgttacgctggagccgttgaagatgtaagcttcgagcacaaatcaaattccccttgtttctcttccatcccctcttccttttctagaaggtcttgcatgagcaaaacaccctcttcggctaaaaaatccaacaacaacgaagtcaaaagatccgtgaggttttaccccgttagcgtaatcctaggtgaggattctgaaccacaatctagttatcataaatgtaacatcatttacgagagtgaacctaatcttggtgtgagaagttcttccataaaggagctgaagaagaacactgctcggggaaatgaaaatggagctgaagaagcagcagcgcgtggttttgtaaaaggttatcgaaattctggtcagggtgaatttgattttagaggtttttatgatgatgatgatgaagatgatgatgatgatgtgagttgttcaagttcagatttgtttgagctggatcatcttattggagctgcaaggtaccaagaagagcttcctgtctatgaaactaccaatttggaaacaaataaagccattgctagtgatggaagcagtgcagtagtaacctcatgttcactagcacaacttgtcaaagcaagctaa

SEQ ID NO: 44993 - DNA, 357 bp, Glycine max
  Peptide Sequence Number=SeqID_161771
atgggtgaggcaatgaaaggtgtgactaaggcaatgggacatatgaataggcagatgaacttgtcatcattgcagaaaatcttacaagaatttgagacacagaatgagaggatggaattgattacagaggtgacgagagacgcaatagatgatgctttggaaggggatgaggaagaagaagaaacagaagacctagtgaaccagcttttgaatgcaccatcaaatgctgttgctgcctcagctacaaagactaaggtgcctcaagttggaactgttgggaaggatgctgctgcgatagatagctatttacaggcaagggactccagttttactgggaaaactggagctcatttgtaa

SEQ ID NO: 44994 - DNA, 315 bp, Glycine max
  Peptide Sequence Number=SeqID_161772
atggagttccacaaggatgttgacgaagtcagggaatattgcttgaaaaagagagctggaaaacacatcagccttagaaggttcaaagcaagttttgactttcttaaaaccaagagtttggaagcttcagaaccaatggtggagactcaacagggggatagagaaaaaagaacaatagaaacgaaatttgcagactcaccaaaggaagacaagcaccatggtggtagtggctccgatggcgccggagaaagaacactcgccggaaaagctgctggaaaacataaagagtttgctggaagaagggcaacaagttga

SEQ ID NO: 44995 - DNA, 375 bp, Glycine max
  Peptide Sequence Number=SeqID_161773
atggcgagtgttggtttttctaccacaacctccgttgtgaccttcgatacttgtcgcaagctcattgtggacattccctctaaagccaccatcgctgctttcacaaacccccttcacactctcaggctattatatagaagcaaccagcgagggttcctggaactagatttggtcctcggaaaatgggttgaggacagcattcactccttggatgaaattctgattaaggctctcgttcatgttctcgacatggtgactgagaagtgtagctttggggtagttttgttggagctagttactgggaggtcacctgttcaacctttggaacaaggtggtgatttagtgacttgtgtgagaagagcaattcatgcataa

SEQ ID NO: 44996 - DNA, 180 bp, Glycine max
  Peptide Sequence Number=SeqID_161774
atggaggcacagtcccagtcccagtctcaggattattttggagagtgcagctactatgtgatgcactggatgtccaccatcattttaggaacttttaggaataattgggaagcgatcattagagccagagagattaaaagcattgcggatccagtgggcacagttttatctcccagttag

SEQ ID NO: 44997 - DNA, 558 bp, Glycine max
  Peptide Sequence Number=SeqID_161775
atgcttacgtgcatagctcgtccaaagaaacctgatgagtcggatccaaacaacgcgacaagcgccgctaaatcgcaagccgtcaaatctctcacttctcagataagggatatggcgctgaaggcttcgggagcgtacaagcattgcgcaccgtgcacggggccagcgacgcaggggcgatttcggagcaacaccaccgagtcggacgcggattcggaccggttccggtggtcgtaccggagaacggggagttcgagctcgacgacgacaaggacgtgggggaaggagatggaggcgcggctgaaggggatttcgagcggggaggggacgccgaactccgccagcgggaggcgggcggagccggtggtgctgtttgttgaagagaacgagccgaaggagtgggtggcgcaggtggagcctggcgttttgattacgttcgtttcgttgccacgtggcgggaacgatctgaagcgcatacggttcagtgatgatgacaatgactgtcttttgctacacctctctagtagggtcgctttcgcctctgcatacgcttcttag

SEQ ID NO: 44998 - DNA, 210 bp, Glycine max
  Peptide Sequence Number=SeqID_161776
atggtgctttgttctaatgcatatagttcatatgatgacatcaggacgactagagagaatcgagagatgttcaataaatggcaagctcaaaggtggtgggcagagaactacgacaaagttatggaactttacaatgttcaaaggtttaaccgccaagcatttcctcttccaacgccaccaagatctgaagatgagggcagtgatttttag

SEQ ID NO: 44999 - DNA, 912 bp, Glycine max
  Peptide Sequence Number=SeqID_161777
atggtggcaatttcgctttacagagggaaccttcaccgggtaccggacgtgccccgtcgatggcccatgccagcccccaaaatcactctcaaagacttcaaatcccttctcgctcgtcgctccaaggcactttcgcgccttcaaaactcaaaccctaaccctacccctacccctctccccaacggttcccaaaccgaaccacctcccaccgttaccgttaatcacggcgaaggcccttccaccaccgtcgcccgtgaagacggatatcgcaaagaaacgccgctcgtcgccgttagttccgccaagaaaccgctcgctggatctgattcagagaaaccgcagctcgattccaagattgacgaggcttcggtgaaaaaaccatccgacggtgtcgccgcttcggaggaaaagcagaccgagccggtcgctgagaatgtggatcagcttaatgaaaagaagaaaaggaaaaaggaaattgaggagaagttgcaagggttgaatgataataaacataacctggtgttggtgttgaagcagattctgaatgcggaggaggagttgaagagacgaaatagtatgcaagtagttgcaatgcatggtccttcggtcccacttcaaggggatggaacaaatgatactggtttgatgattaggcatatgcccccgaggttgggatcccagggaaatcttgttgctgctgatgtggatggtggtgaaggggatgattttgctaactatacgatgcattctcgccatgtgcttcggacaagtagtatgtcaccttcttcagagtccccactacggaggacccctagtcttcaacagaatgtgggtggatataggagggtgaactatggaaggctagctattatgtgtgtttggatatctaatgatgaacgaaatgaagtttag

SEQ ID NO: 45000 - DNA, 1101 bp, Glycine max
  Peptide Sequence Number=SeqID_161778
atggatagctactaccatcaacaccacaaccctcactttgacaacaacaatgaaccacatttacctcctggcttcagattccaccccacagatgaagaactcatcacatactacctcctcaagaaggttctagatagctccttcactggccgagccatagttgaagtcgacctcaacaagtgcgagccatgggaacttcctgagaaagcaaagatgggtgagaaggaatggtacttctatagccttcgtgaccgaaagtacccaactgggttacgcacaaatagagccactgaagctggttattggaaagccactggaaaagacagagagatttacagctccaaaacttgctcactcgttggcatgaagaaaaccttggttttctatagaggaagggctccaaagggtgaaaagagcaactgggtcatgcacgagtatcgcttagaaggcaaattcgcttaccactatctctctaggagctccaaggaagagtgggtgatctcacgtgtgtttcagaagaacaccaccggcggtggctccaccgtgtcatccgcctccgccgccaccaccggtggtagttctaagaaaacaagaatgaccacatcaaacaatagcagcaacatgagcctctgccccgaaccgggttcaccctcttccatataccttccgccgcttctagaatcttctccttacgccgcggctgcggcaacattcaacgaccgcgaaagatgctccttcgacagcgccgccaacaacaaccaaagggagcacgtgtcctgtttctccaccatctccggcgccgccttcgaccacctcgttccgtcgccggagcctccgctcgacccttccgctcgctttcatcgtaacaacaacaacaacgtcggtgtcggaatctccaccttcccgtgcctcagatccttgcacgacaaccttaaccttcccttctttttctctccaacgggccacatcagcagtgctgaagtggcatcatttggtgccgttggcaactggacggcggcaccggaagagcacaggatggctgacagtggctccggcatgacgattgtaccgtccgagttggattgcatgtgggactattga

SEQ ID NO: 45001 - DNA, 1050 bp, Glycine max
  misc_feature (9)..(9): n is a, c, g, or t
  misc_feature (138)..(138): n is a, c, g, or t
  Peptide Sequence Number=SeqID_161779
ataacgggnccgttgccggatcctcccggcgtgaagctgcggaaggagggcttgacggtgaagcacccggtggttttcgtgcccggaatcgtcaccggcgggttagaactctgggagggtcgccagtgtgcggatggnctgttcaggaagaggttgtggggtggcacctttggggaattgtacaaaagaccattatgctgggttgagcacatgtcactagataatgaaacaggactagaccgtccaggcattagagttaggcctgtgtctggacttgtagcagctgattattttgcacctggttattttgtctgggcagttctaattgctaatttagctcgcattgggtatgaggagaaaaacatgtatatggctgcttatgattggagaatttcatttcaaaatacagagatggactttttttccccttcatttgatcaggtcagggatcgaactttgagcaggatgaaaagtaatatagagctcatggtggctacaaatggtggtaataaggtggttgttattccacattcaatgggtgttttgtactttttgcattttatgaaatgggttgaggcaccagcaccaatgggtggagggggtgggtcagattggtgtgccaaacatattaaagcagtgatgaacattgggggaccttttcttggtgttccaaaatctgtcgcaggacttttctctatagaagccagggatattgctgttgccaggactttcgcaccaggttttttggataaggatgtttttggtcttcaaactttacagcatctaatgcgaatgacccgaacgtgggattcaacaatgtcaatgataccaaaaggtggggatactatatggggtggccttgattggtcagctgatgtatcctataactgcagtgcgaagaagcacaagaacaatgatacttacagtgcatttcaaaatggcaaagagaatcttgggtttatgaaaaatataaattatgggagactcatatcgtttgggaaagatatagctgagttacactcctccaagcttgagaggttggattttagg

SEQ ID NO: 45002 - DNA, 366 bp, Glycine max
  Peptide Sequence Number=SeqID_161780
atggacagtttcaaaacttggtttattagatatggcaatacacagtcaaatggaaaagaagctttagatgaggataagcttaaaggattttgttacctagtgtggagaactgcaagcatgagagtatatatgttaagggacaaggcagtgtggagaaacttccatgcatgcggtggggaaatctacggttgcttctcgttgaaaccatgccttttttccttctttattcttgcgatgagttattgtttggtgttggccacgaccattgacccacagagaaagaaagatgatgagaaagagaaaaagcagaatacagaagagagaacgggggagcctgtacatttggaagtagttacttacttatga

SEQ ID NO: 45003 - DNA, 284 bp, Glycine max
  Peptide Sequence Number=SeqID_161781
atgatgtttgcgttgttagcaagagcttctagactgctagccaaagctaaggcaatggcgaacgtgtactcgacccccgaggaagaacaaatgaaggccgatatgttggccttgaaggatcaaatggcttccatgacggaagccatgttaagcattgtcgcaacatgcccttttgcgggtgagcgaggcgaggctcacgggtgcacattccaaaggaggaaagatgcgcggagtcgccaccaacgtttatttgtggaaaacgtcggaaaaaccaaaggaaaccg

SEQ ID NO: 45004 - DNA, 231 bp, Glycine max
  Peptide Sequence Number=SeqID_161782
atgaagactataagcattcttcttccgttaaataacgatacacatgctgaagtgactcagcggctgactagtgcgaaagagtcatcaagtaaacctgcattgcagagtcatgaggatcttgcaaagaaacttcaagtggaactagagagaaatcgaaaggcatcaggttccaagtctgatggatctgcaagacggatgaaggaagttgcatgtcctatttgcattgtttaa

SEQ ID NO: 45005 - DNA, 720 bp, Glycine max
  Peptide Sequence Number=SeqID_161783
atggtaaggtatccttgtgaaaaaatcaatgtcaaaaggggtgtgtggactacagaagaagatacaaagaagcttgcatttggctccaagcatagatctgggctcaaaaggtgtggaaagagttgtaggcttaggtggactaactaccccaggcctgatcttaaagacgacaacttcactacccaagaagatctaattatgaagcttcatgcagccataggtagcaggtggtctatagtagcccagcaacttcttgggagaacagacaatgatgtaaagaactattggaacacaaagctgaaaaagaagctctctcaaatgggaattgaccctgttacccacaagcccttctctaaactcatttctgactatggaaacattggggattgccagaaaccaagtactccaattacgtcaactaataaggacttcaaggatgcaatgatgttaggatcagatccccgtcaaaccctgccacaaggatttacaaacatcaatgaccagccaaagctatcacccaagaccatcccagtgtctatgtttggggaagattgcttgtcaaaaacttcttcaccatctactccttctacatgtttcacttcttcagcttttagttggaatgacttcctcttggaagatgcttttataccatttactaaccaagaacaaagacttggtgagccaaatagaggatgtgaccagacaaagttgttggaataa

SEQ ID NO: 45006 - DNA, 1056 bp, Glycine max
  Peptide Sequence Number=SeqID_161784
atggaagcctcagtgaatatcaacatggaagagttcctaaacccaccaaaattagaattgctaaacaaattacttccatgtgagcctaacaagtgccatccctgccaagaagtcttgccccaattacttgttcaagtgaaccttttccaatgtggaggaatagctattggaatgtgcaacctccacatcctcttagatgcatattcttgtagtgctttcttgaaaacttggtttgccatttgcaaagggtcaaaggaagaaatatcatcatggccagatttcatttctgcctcttcttttttccctccaaggaacaccattggtgtacgtgccggcatgttaaatattaacaaagactcaaatgtggaagcaaagtgcaccacaagaagattcttgtttgattcaaaatccatcaataagctagaatccatgtcatcaagtgatgaaacaaaacctacaagataccaagcggtgtcttcattcatgtgtaagcatatgattttggcatgcacaaaggaatgttgtgacacaaaaagaccaatggttgcattgcatgttgtggacatgaggaaaaggatgggagagcctttctcaaaaggtgctattggaaacttgttatggccagcattggttctattggaggatgtcaacaagaacactaatattagagatttagttagggttttaaaagaaggattgggaaagctcactaaggaattgttcctaaaggtgcaaaatgatcctagatttttgtggagtgatgagtgtgcacaactaatgcttgaaggtatagccactaaaaacccaattacctttgtgttcacaagttgggctaatatgggattcaacgaggtggattttggaaggggaaagcctttgtggttggctcaaagaggaggtactaaagaaactatcccaaacacagtagtgttgatggaaacaaaagagggaattgaggcatgggtgacaatggcagagaaacatatagctaacttggaaaatgatatggacttcctccaattttcattggttaatcctagtgtttcaaacatatag

SEQ ID NO: 45007 - DNA, 150 bp, Glycine max
  Peptide Sequence Number=SeqID_161785
atgtcaactgagtacctatatggctggcgttttgagcctaatgataagattgcggttgaaggagagggcgacgtaagaacgaaacgacggcgtaagactacggttgaaggagagggggcgacaacggacgagagggcgacgtatgaatga

SEQ ID NO: 45008 - DNA, 189 bp, Glycine max
  Peptide Sequence Number=SeqID_161786
atggtgatggagaagaaggggagaaaaagaagaaaggattttgagtcaggcatggtgatggagaagaaggggagaaaaagaagaaaggggttgaacgacgctagggcctatgtgcggaaggctgaggaagaccaagaactccaaagtgatcagccgcaaacaaatcatataccgatttgcaaatggtaa

SEQ ID NO: 45009 - DNA, 114 bp, Glycine max
  Peptide Sequence Number=SeqID_161787
atggaagaagtggacagctcgttaagtgcgtgttcatgcttagcgcgcagcttagactttagcgcactgaaaaatccacaacgaagttcaaagggattatacgttgggaaatga

SEQ ID NO: 45010 - DNA, 261 bp, Glycine max
  Peptide Sequence Number=SeqID_161788
atgcgtacctccgacgaaataggaacaacagccactaataaaacttcaaatacggaacacgggaccaccaaatcttcaaatacttcacttcacgggaccaccaacagactgcaaaagggaccaccaccgaaacaacagcaaacggaagaaacaaacaaagcaaacggaaaaagaaacaaagcaaacggaagaagaaacaaagcaaacggaagaagaaacaaagaaagcgcagtaaaacacagcctcaacacgttaatttaa

SEQ ID NO: 45011 - DNA, 222 bp, Glycine max
  Peptide Sequence Number=SeqID_161789
atgataagcagcggaattgatgagtctgaggaactgatggtaaggaatgaagaacttgaaattactttggtggttagaatgattggaactgtgggactgtggatttatcaattcattgatataacattctgcattattttgatcaggatttttggcataccaattgatataggtacgatatggtgtcctgtgggaggcatggaacatgctaaaggagagtag

SEQ ID NO: 45012 - DNA, 151 bp, Glycine max
  Peptide Sequence Number=SeqID_161790
gggagttgtacttgcctgcagcccaatagatgcagccttggtggctactgcaggcggtgatgacagacgatttctcaggaagattggcctaggggattgggcttttgagcttcaaggtatttgcatgacactaaagttagtgatggattaa

SEQ ID NO: 45013 - DNA, 753 bp, Glycine max
  Peptide Sequence Number=SeqID_161791
atgctctcactcgaaccttcacagaagatcaggtcggtcggcggtgcacccacagggggatccaccaatcagcttccttgcgccttacgggtttactcgcccgttgactcgcacacatgtcagactccttggtccgtgtttcaagacgggccgaatggggagcccacaggccgacgccaggagcgcgcaggtgccgaggcacgccaagggcgcgcgctgccatccacaatcgcgatgatgacgtctccacgagcatatcaacagcccgggcttgggccaccatcgcaatccgcgtcggtcaatgtcccgagtcgatcggcggaccggctctcaccgttccacatccgaccgggacacatcgccggcccccatccgcttccctcccgacaatttcaagcactctttgactctcttttcaaagtccttttcatctttccctcgcggtacttgttcgctatcggtctctcgccagtatttagccttggacggaatttaccgcccgattggggctgcattcccaaacaacccgactcgccgacagcgcctcgtggtgcgacagggtccgggcacgacggggctctcaccctctctggcgcccccttccaggggacttgggcccggtccgccactgaggacgcttctccagactacaattcggacgccgagggcgaccgattttcatggtgggcttttcccggttcgctcgccgttactaagggaatccttgttagtttcttttcctccgcttattga

SEQ ID NO: 45014 - DNA, 192 bp, Glycine max
  Peptide Sequence Number=SeqID_161792
atggcatcaaaacctcaagtggggcaaggtgcattagcaggttcaatggatgggtctgtgtcagccgaactacgttgttcaacaccagttaccgcacaagatgaaagatcgttcaatgttttgatcaagaatgtgaaagataccaaaaagaaggggcaaaagggtatttttattgagtttcttggaccctag

SEQ ID NO: 45015 - DNA, 1445 bp, Glycine max
  Peptide Sequence Number=SeqID_161793
cagcaacggtacgtggacctatacccccaccgcaccgcttggcgagggacctcatactttcaccgttgttgccaccgatgcggcaggtaacaccagcctgccgtcaaccggcttcaacattatcgtcgataccacgccgccagtggccgcgaccattgccagcgtgacggatgatgtcggcggcgttcaggggccgctcagcagcggcgatactaccgatgacacccagccgctgctgcagggtaccgcaccgcctgacgcggtcgtcaccgtctatgacggcacaacgctgctcggcaccgccatccttgacggaagcggcggctggagctttacgcctgttaccccgctcaccgacggcccgcattcgctgacggtccataccacggatgccgcaggcaatacctctgtctccagcccgtttgtgctgacggtggataccgtggcgcctgccacgccggatatcccggcaattaccgtcaatcctgacggaacagaaacgccgctgaacccgggagaaaccacccgcgacaccacgccgaccctgagcggcaccggcaatccgggcgatacggtgacgatctacaacggtggcgtcaaacttgatgatgtcgtggtggacggtaccgggaactggacctggacgcccgccacaccgctgcctaacggcacctatgacattaccctgaccgtgaccaacatggacggcacgggtaacgaaagcgcgccgtcacagccggtaaccatcaccattgacaccgacgcgccggccgcgcccgcggtcccggtcattaccgacagcgtcagccagataaccggcccggttgccgatggcgaaaccatcaacgatccgcgtccggtactgagtggcaccggtacgccaaatgatgtgattaccatttacgacagcgttgatggcggcacgccagccgccgtgggtaccgtcacggtagacggcaacggcaactggagctggcgtcctgaaagcgctattgacgagggcagccacgaatttaccgctaccgccaccgacgaggcgggtaacgtctctgacccttctacggggatcaccatcaccgtcgataccctcgcaccggataccccggtgattggcgccatcgccggtgagccgaatggcggtgttactacggataccacaccaaccgtcggtggaaccggtgtgacgggtgaaacggtaatcgtctacaacaatggcgtcgagcttggacgcgtggttgtggctaacggcgaatggtcattcaccctgcccacgcagacggatggcccgctgaacatcaccgttgcggcagtcgacgctgcgggtaacgtcagcgcactcagcccggtctttaccgtcaccgtcgataccactgcacctgagatcccgctgatcaacagcgttgaagacagccagctcaccaacgggacgctctatacccgcgacg

SEQ ID NO: 45016 - DNA, 573 bp, Glycine max
  Peptide Sequence Number=SeqID_161794
atgaaaaaatatgttgacctcaatgacacaaaatacttaatagacagaattaagaaagaatctgtagagaagggcaataaaattaagctaagtgagtctacttttcaactcactaaaactcagagcttcaagttggcatcagaacgggatcgtcggaaaagtgcgaccaaaaccctgcaaatcgctccgtcatcggagcttccacgcgcctccacgcaccgttacagcttcgggtgttgtccgacgcgtgtagtccacgcaccaccgtgccgtcatcggaatcttgtccgagttgctccggcagcttcgtcagcggctcctgggtgctttccaagtgttggtttttcgtttcgacaagcttgtgtgtctgcttcggttgagttgtggtttcttggccaaggacaccatgatcacttggaaaaaggtattgatactgttccaagtgacagaaaatctgagtgggagaagctggattatcagctatgtgctgtcttatggcaatcggtcgagacagatgttttggagatccttagatcgttcaaaacatgttgttctttttggaagaaggcctga

SEQ ID NO: 45017 - DNA, 876 bp, Glycine max
  Peptide Sequence Number=SeqID_161795
atgcgtcctacaaaacgccctcgggagtcagaaatgctatacgatagttttggcagttgttcaattaatgctgccccactatttgatcagtatggcaattatacgtttgagaaaatttctgaccatcctgggttgtctcttccatgtgatcccgttcttaacaccactgatcagtttcatggtgataaccttaccggcagccatgccgcattaaatggcaatgcctctgcttctgtgcccatatttggggccatgaagttggagctcccttcactccaatatccagaaactcaacatggtagctggggcccgcctatgtccccacttccttcactggagtctgttgatacattgattcagtctcctacacttgagcctattctatcagatcccatttctccacaaagcagtggtttgctagaagcgatagtctacaactcgaaaagcttgaaaggctcaaacaatgatttattattgcaagagacaattgctacagccaatgaagtagctaatatttcaaccttgaatcattcctttcagacagaatgggatgaactaggcgatccaaattcccccttaggtcaatctgctgcttcagtcctgactgactatactcctgtacgaatgtgctctgtggatgggtatcaatcaactgaaaccagtcaggatcatgatgataagcatgaagcacctaccacccagttcccagatagttccagtaagaaaaaaatattgaaacaggtggattacacacagccagatgctttacttgacttgggttggtttgggaataatactaagtatgaaagcgatcaatttgttcagcaagatgctttgggtgcactttttggtgacaattgtcagcatcagccatag

SEQ ID NO: 45018 - DNA, 747 bp, Glycine max
  Peptide Sequence Number=SeqID_161796
atgcacaggagcaacaccgagaagatgcactctcaccatcacaaatacaaatgtcataactttggccaagttgtaccccaagtctcaccaagtcatactcatatactcataccctcaacaacacccaaaccacatactgataaaataattggtatgtacagggtacagacccgcaccccaaacatctacacctccaatttgttgtattttggggtcagggaaacacgagagaattgtgaggttcatttgagtgaagaacagagtgagaagatgaatggaaacggtggatttaacactcacttaccagtgtttgatggtaagaactggagtcgttggtcaatacagatgcgtgtgttgttcggagcacaagatgtgctcgaatttgtgaatgacggagttccggatttggcggaaaatacgacggaagcgcagaggaatttgcatcgcgaaaagaagaagaaggatcagaaagccttgttctatattcaccagtgtgttgatgcaaagatctttgagaagattgaggaatcgacgacggcgaaagctgcttgggacacgcttgtgcgttgctatggtggtaatgcaactgtgaagaaagtcaagcttcaatcactgaggaagcagtatgagaacctgaatatgaagcacaatgagaaggtagctgattatgtgtctcgcataattactgttacgaacgaaatgaagacctgtggtgagacaatttctgagcagatgattgttgaaaag

SEQ ID NO: 45019 - DNA, 477 bp, Glycine max
  Peptide Sequence Number=SeqID_161797
ccatatcttcatgagtctcggcaccgccacgcattgaaaagggttaggggaactggggggcgctttcttagtgccaaacagcttcaacagtttaatgcagaacttgtcaccgatgcccattcaggcccgggccctgtcaatgtttatcaaaagaaagatgcatctgaggcagaaagtcatccctcaagaactggaaaaaatgcatctatcacattcacagcaatctctggcttgacaagtatgtccggtaacagtgtcagtttcaggcggcctgagcacaacttcttggggaactctcctaatataggtggatcgtcgcaatgcagtgggggactcacctttggtggtggagctcggcaatgtacttcagttggccgactctgcattagcactcagacttttgctagtgctttcccatgtattttgaaagttgctcttgtttctgttgttgaactggaccagaaagtttgtgcttga

SEQ ID NO: 45020 - DNA, 736 bp, Glycine max
  Peptide Sequence Number=SeqID_161798
atggtttcgtatgtgaacatcttgctgtacggcgtgggagggttggtggtggcggggatggcattgctggtggcgtttcaggagaagctggtctacgttccggtgttgcctggcatcaccaagtcctacgccattaacccctctcgcctcagactcatctacgaggacgtctggctccaatcctccgatggcgttcgccttcacgcttggttcatcaagctcttccctaattgccgagcaagtgatggctatccttctcagcatggaataactaaggatgctcaggctgcattggatcatctttcccaaaggcctgatattgacacatctagaatagttgtgtttggacgatcacttgggggtgcagttggagctgtactaacaaaaaataaccctgacaagtggtttattggaggaagctcttcaaatggtcctaaagtactcaattttcttgtacgttctccgtggagtactattgatgttgttggccagatcaaacaacctatcctttttctctctggattgcaagatgagatggtccccccatcacatatgcaaatgctatatgctaaggcagctgctcgaaataatcagtgtctctttgtggattttcctactggcatgcatatggatacttggctggctggtggtgatcagtactggagaacaattcagcagtttcttgagcagcatgccccagagcaaaaggaagacagatcatcccaaaatgcaaatg

SEQ ID NO: 45021 - DNA, 414 bp, Glycine max
  Peptide Sequence Number=SeqID_161799
atgatagttcttgggaaagcgctttgctacatgaattttctcaaaaaggatggcttatgcacaaaagaacttctactgcaagaactagaattagctttaaatagtgtctcagagttggagacagtggcaatggaatctcctaatatcatggaagccaaatctgaatacaagttgagaaagtcacatagtttagatgatgttacagaatcagttgccagtgggtttttaagtatgcttggcttagatcatagtccaatgggtttgagctttgaaagtgagcccgagtctccaagagagtgccttttaagacaattcaagaaggaagctctttctgagggcttctctttgtttgattttggcatggacaatgataatgaagcagatgatggctatgatgcttctttttggatctga

SEQ ID NO: 45022 - DNA, 663 bp, Glycine max
  Peptide Sequence Number=SeqID_161800
atggacggtggagtgaactacaaccctcgcactgtggaagaggttttccgggacttcaagggtcgtagagccggcatgatcaaggctctcaccactgatgttgaagaatttttccagcagtgcgatcctgaaaaggataacctttgtttatacgggttccctaatgagcaatgggaagttaatttacctgcggaagaagttcctccggagcttcctgagcctgcattgggcataaactttgctagggatgggatgcaggataaggactggctgtctttggttgccgttcacagtgatgcatggttacttgcagtggctttctactttggggcacgatttggttttgataaagctgacaggttagaatatcaagattgtttgttatgcaaaaggtccaatgaacctgagccaaaccaatcttcagaagagtttgaggatttatccggctcttattcccatggcttctccagatctgcatccgcatctctgcaccacatcagtgtcttgaagcattgtgcgttgggtttttttggtttgggtgggtgggggcttcacctgtctctactgtttgatggatcttgccaagcggcggtttcagcaagtgagcttgaaatcccacaatcaccagagaagccaaggagtggtttcagcaattgtgtatga

SEQ ID NO: 45023 - DNA, 1044 bp, Glycine max
  Peptide Sequence Number=SeqID_161801
atggggtttgattataatggttttggaaattcaatgtatgttctacccgaagagcctctaccattacctcctctggcagaagggttaggtccttttcttcagaccaaagaatggggggtttccaaccctttggttatgctggctgaaatgggttctgggataatggagattttgcagtgtttggcttcattgggaattgaaaagctttccatgcaggcaaacaagttaatacctctggaagatatcacagggaagacaatgcaacaaatatcaagggaagcaaagctagtcctggaagaaacacacagacaataccatttgcagcatgatttggtgacaggacaagattctatttgcacacaaagtggcttgaaaggaacattatctggtggactagagtctgataagtttagttcaagttctattggtgaccagagaggctcggagtttgtttcgttggaagatcttgccccattagctatggataaagatgaaccatcaaacatcattgcacaatcccttgggggcatttgtgctctccaaggcaacaaggggggtttgagaatacaatctgggatgttgaatgaggatgaaccatcaaacatcattgcacaatcccttgggggcatttgtgctctccaaggcaacaagtggggtgaaaaagacagcagcagtgatggtgttgatgggataattggcctttcattaacccttgacgaatggatgaggttggattgtggtgagattgatgatgatatagacaatatcggtgagcatacttccaaacttcttgctgcacatcatatcatggcggggaacaataatgatgagtgtgaaatagtagccaaggtggagttgaaggccaacaaagaagataaaagttctgaagaggaggaggaggctattcctcagttcagaattacagaagtacatgttgcaggtctgaagactgaacctcacaaaaagaagaacaataaggatccattgctgaagtcaaagggtgtgtctaaatctagtgctaaaatcaccaccgcaaacgtgtaa

SEQ ID NO: 45024 - DNA, 562 bp, Glycine max
  Peptide Sequence Number=SeqID_161802
atgtcgaaaactgaaggtgggcaaaagagtgctgaagaggagaacgacgtcctctgtgtgcattggaagaggaggggtgcacttttggtgacccctccagctaaggtgattcaaggtgtggctgagtttcaagacattttgactcgcaattgttcaatccatggaagtaggagtggaccccataattctgctaaatatgaagctaagcattttatgctgcttctttccttggtgccccaggacttgatttggggaagcaccgggtggatctcacaaggttgctccctctcacactggaagagcttgaataggagaaaaactctgggaaatggactacaaaggaggtgggggatcttcatgaggtgttgccatcatcagcattatcatgagccagctcatgaaaaagaaaagccagaggagaattcaggtaatgaaggaaaaacatgcagtctggtgcatgtcaaacctgaattagatgtgtttcaagaaatcctggagacagttaagccagatgattatcgcttacctgattctggaatagaaagtttcaaagagcgtgaag

SEQ ID NO: 45025 - DNA, 285 bp, Glycine max
  Peptide Sequence Number=SeqID_161803
atggttttccataggaacaagctttgtcacctctgcttagcatatgcaagggtggaagagactgttgatttgcgaaccaatgtggagttggttagatcagtctctgataagcatcatgatcttttgaggccatctgctcggaacctttcgagaggacaatcaacagatgcagctggccatggaaaaggaaagtatgccttaattagagacccagaggtcttccaaacgggagtttatgataagccccttccattttttggatgtggaatcggatggttctcgtaa

SEQ ID NO: 45026 - DNA, 885 bp, Glycine max
  Peptide Sequence Number=SeqID_161804
atgacgaaaataaacacaagaaagactaaccaacaaaggctagatcacttgtcgtgcattgactgtggggaaatatttgggcgtgacaccgttcaggatcacacgcagtgtatcacagaagcggagaaatatggaccaaaaggccaaggcaaaactttgaacgttgcaactgcaaaccctaataaggatagcaaacaaaggcccgacattgatattaatgtggggttatctgaccggcctccttggttctgtagtctttgcaatacgaaagctacaagtaagcaaacacttcttctccatgctgatggaaagaaacacagggcaaaggctagagcattccatgcttcaaagcaacaaccagttgaggcagacaaatctaccactgatgcaaaggttgctgtggagactgctcctaatgatgatgtgagagatggcaaaaatggagggctgccaaaattgcaagaatcttctgaacaaaataactcaaaaccagggaatgaaatttcatcagcaaagaaaaagaggaaacttgaagcattggaggatgaccgtattaagaaaaccaagaatgacacttcagttgacatgggaaatggagaagtaattcagggtgaggaagcaacaggagagagcaatttgaagaaagaacggagtgctgtcaaaaataaaattaaatggaagaagttcatcaaatcagccttgaaatctcatcctgatagaattttgaagatgaagaaactgagaaaagttgtcctcagagcactgcaggaatgtggcattgtagtggatgacactgaattgagtgaggcgcttgagcagaagatcaattccagctctagatttgcagttgagaacaagtatgtgcgattgctggccaaagattga

SEQ ID NO: 45027 - DNA, 276 bp, Glycine max
  Peptide Sequence Number=SeqID_161805
atgaagaaacagatagcaaggaaaaaaatacccttccatatgcattgtaatcaagggaactcccaagaagagagggtgtgttcttgtgaaatcaagaatgcagagactctagtgaggattggaatgaaactgaagaagaaagagttgctttatcagcaagaaagaatgcagagagagagaaatgggagcaataaaaaggtttgtgagaatggtaaggcggggaaggtagtaatgcgagaaaaagagagagaaagaaagggtcacgaatatctatga

SEQ ID NO: 45028 - DNA, 1971 bp, Glycine max
  Peptide Sequence Number=SeqID_161806
atgatgaagcgaaagctagaaacgttggtgtggctaacacgaaaacgatcgattcagtttctaatcggtgtttttttcctctacctcgtacttgtcacactcgaactcccgtttgttttcagaaccgacttcgccaccgtgaccaccacgcgctccccgaggctcctaagtgaagaggattcgctacgaaaggactccccggcgcgtcctttgaaaacggtttccaacgctgactcgccgagtcaactcgcgcgccgccgcagcagcgtcgtttccgcgttggtcctaaacgacgccgcgttcggctcccacgtaaacaacgggtcgtcggagctctacaagcaagtgaagcacgcgcgcgaggttgggcggagtctctgggaagacctcgaatctggaaagccgctaacccgaaccgttgccgctcgggcggccgagaaccggtccggttcgtgtcccggttcggtctcgctttccggtccggacgttgttgacgtctcgggcgtcgtgccgttgccgtgtgggctcacgttggggtcccacataacggtcgttgggaagccgttggaggctaggccggatttcgagccgaagataacggtggtgacggaggatgagcccgtgatggtgtcacagttcgtggtggagttgcaggggctaaaaactgttgatggtgaagagcctcctagggtttttcacttcaaccctaggttgaagggggattggggtggaaaacctgttatcgaactaaacacgtgttaccgcatgcagtggggttctgctcttagatgtgacggttggaaatctaaggccgatgaagataccgttgatagtatggcaaagtgtgagaagtggattcgggatgatgaagatcatttggagggatctaaggcgacgtggtggttgagtagactgatagggcacacgaagaaagtaaccattgactggccattcccgttttctgaggggaagctgtttgttctttctattagtgctgggttggaggggtatcatgtttctgtggatgggaggcatgtgacctcttttccttatcgcgctggttttacccttgaggatgccaccgggctttcgttgacaggagacattgatgtccactctgtatttgcggcgtctttgccttcatcgcatcccagttttgccccgcagcggcatcttgaattttccaccaggtggcgtgctcagccacttcatgactctggcatcgaattgttcattggtgtcctctctgctggaaaccattttgctgagcggatggctgtgaggaaatcatggatgcagcataggctcatcaaatctggagtagtggttgctcgtttctttgtggcactgcatgcaagacaagaaattaatgcagagttgaagaaggaagcagaattttttggtgatattgttatagtgccgtatttggataactatgatcttgttgtgttgaaaacagtggccatatgtgaatatggggtacatacggtttctgctaagtatgtcatgaaaggtgatgatgacacttttgttagagtggatgccgttatcgatgaagcaaggaaggttccagatggtacgagcttttatattgggaatataaattactaccacaaacccttgcgctatgggaaatgggcagtgacatatgaagagtggccagaagaggattacccaccctatgctaatggacctggttatattttgtcatcagatatcgcacgctatattgtatctgaattcgaaatgcataaattaaggttgttcaagatggaagatgtgagtatgggaatgtgggtggagcaattcaacagctcaaaaccagtacactactcgcatagcttgaagttctgccaatttggttgcatagaagactattacactgcccattaccaatcgccgaggcagatgatgtgcctgtgggataaactgcaaaggtattcaaggcctcaatgctgcaacatgagatga

SEQ ID NO: 45029 - DNA, 1266 bp, Glycine max
  Peptide Sequence Number=SeqID_161807
atgtgggattggctaccctacttgaatcgtatggagaagcttttcacaagtaaaaacagaacggaggcatctgtagggaagaaggtgaagatagacatgctccctgaaatcgagaaagttcacaggagaaaggagaagttgctgaaaaaacaacacagacaagctcttcttcttgataatttcttgggtgttgatgggcttgcccctgggcgttcacttcgtgatagaaaacctgttacctacacttttgatgattacgatcgatccatcagtgaagcaattaagataaccaaacggaaaccaccatccccagaacttatacccaggagagaagcaggagcaaaacatgcagctttaaccaatggtaaatggagtggtccttcacatgaccctcaagacctgaattttggcatgccatcaccaaaatcacctgacttcgatgatatggaggaagataatcaaactgacatgttggacttggatcgaagcaatcggcgaagacagaagcctaaacggtattcggagaaagagtttgttgaagcactgtcggataatgaggctgactatgacagcgatgatgatattgttggagaagccgtgtatgatgaagagtatctccagaaacgtaagcagagaaagaaggcttctagtagctctgggtctgaaggagatgaagaatatcattgggatgaagataatgttgaagatgaagaagacgatgacgaagattccttgagtgccagtgaggatagtgacaagcctcgtaaaatcaagcaactgccaggccgtactaggaaggaaactaaactcaggtctgtgggtgagattcaatcaggtctaagacgcagtaagagggcaacaacaaaaagccgtataaattatcgaaggtacgagatatctgattcagaaacagagttcattaaatccgacaagtccaatgcatcagacgatcactcagatcctactgagaatggggagtatatgatggaaagtgaagactccgacagcaatgacgaggaagaacaagaaaccaaagcagttgagcctgttacttaccctgcagaagaaaacaaccaatctcctgctgtaggggagaatgaacaaaaccaaaaccagcctcctgaaaaagccagtagcccaggtcaggaagttgagggcactgcaaagcgacgcttccttgatttgaatgagcttgcccatagctcaggttttgatgatggtccaaatacaacaacactgaaagatgaaggcaatgatgataactga

SEQ ID NO: 45030 - DNA, 249 bp, Glycine max
  Peptide Sequence Number=SeqID_161808
atggttactaaggaagaaagagcagatgagaagaagaggaaatgttgttcctccaaataccaagtacacgggtcggaaacggaaggatcgcttttgatcttgtctggcatttgcctcagggtcgctactcatacatgcacgttcctgcagtcaaaggtgtttgatggaagccttgaaggatatgtgttgtatctatttggccaacttatgcatttaaatgtgaggcgcacaattccagaatacaagtag

SEQ ID NO: 45031 - DNA, 565 bp, Glycine max
  Peptide Sequence Number=SeqID_161809
tcccccacaagacaccaccgaaccctcgccggaacccgattcgtataaggaggaaacaaccgccacaaccaccaacagcaccgccgccgatgctgctcctcccgcccccacccggagcccccccacccggagccgcccctcccgagcctgcaccatgcgcacggctgcacgcctctacgcggcgtcgcagccggcgaggccaaaggccgcgaggagggagcctcgccgcgaggagtcgccgtcgccgccgtctccgaagctgcagcaatgcagcaagatcgtgacgccgctggtggaaccgcccccgccggtgcagttgccgcgctacaacctccggtccatgtgggaattggcttcaatactcaattttttgaatctgtttaggccacttttgaatatttcagtagaattttcggctgaagagtttgagacggctttgctcaccccgaatgacacattgggtgatatacatatgcctttgctaaagttttgtgctagttttgttgagtgtgccgttgcctgggtgggagagaaattcggagctatgaaatggagttcttgttag

SEQ ID NO: 45032 - DNA, 393 bp, Glycine max
  Peptide Sequence Number=SeqID_161810
atgtctcatgctcagaggtgcctcactgaagaagaaaaaaatgatgatgcgccttcggggaataggaatttaaaatcatacctatccacattgtctcagactttcttgtcatcgttgttcctatgctcttatttttcaccaatatttcctagaagatatgcaaagactgaaacttatggaactagtttgagtatatccctgcttatcaatgaagaaaaaaaaatactttcaaagattgtgaatgttttgtcaaaagtcaggggtgaaggtttctcaaatatcttgtctaatccaagactcacgacattctcaaagaagcaagcgatcatttttccttcgtataggtacatgtgggttaatatggtgtaccatgcagagtcctttatttcctga

SEQ ID NO: 45033 - DNA, 267 bp, Glycine max
  Peptide Sequence Number=SeqID_161811
atggtgccagaatccacgacgacgccgccgttaccgtggccgtcaattcgaggcatagggtgtggagtttggtgcggttgtgacaaagacgatttttgtaactcggggggtgggggacgagttgacacgacgagtcgtatggggggagaaggaggtggaatggcgagggaggaaggcagagatggaggaggagcagttgtgacagctggcgaaagaggaagatcaaacggtcaagagcacgaagaccgacggattgttcattcatag

SEQ ID NO: 45034 - DNA, 153 bp, Glycine max
  Peptide Sequence Number=SeqID_161812
atgagggaaagaggagtttcatcgtcaacaccagctcccatgtgcactgtggggacccttactttccgtcctactccgtcacggaaacgtaaaccattcccccccaagtcaccagtgcctcatacacttagggcagcttttccctacatctaa

SEQ ID NO: 45035 - DNA, 513 bp, Glycine max
  Peptide Sequence Number=SeqID_161813
atggcgggaacgggaatgggaagaggaagcgattcgcagaaacaactgtggagccttatccgtaatttcgctgctgagaaatctcaaggagaacgaagagtggtgaatctgagaaagcaaatcgagaagcttaaatctgagctgagcgaggccaatgcggagcttgaaaatgcgaagcgctgcaaagaactcgtcgaacaggatcttaaaggcttcgaagttcaattgatgttgactgaatcttccgctcaaacgctagaggcgagagtatctctaattcaaaaccacatctctgccgtcggatctgatttggaaactctcaagacttttgcctggaaactgaggatgcactttgatattgttttagatgcatcacaagtaacaatgaaagagaatgatgctgaagtagctataatggctcttgaaagtacacttttagaggtagtatctcaaattgctaaagaggatgaggaataccaagcagaacaaaaaaattatgagaatgtaagatga

SEQ ID NO: 45036 - DNA, 1182 bp, Glycine max
  Peptide Sequence Number=SeqID_161814
atgctgttaattggagcgtgcggaagaaaaccagaagaggcatggtgcggaagaaaaccaacagtgaaccacttcaggatatttggatgcattgcttatgccgatattccaaataagaaaagatcaaagtttgatgataaagaaagattttgggaaaataacatagatgaagcaaagcaaattcttgcaaactttgatgaagataatgaagatgaagagttacagacaagagagctagaagaacaacgaattccagcaatcatagttgaatatgaaagacctcaacgagcaagaagaaggcatgcatggatgtctgattatgaggagttgtgtgatcttccaaatggacataataccataggagtgaaatggattttcaaaacaaaacagaaagaaaatggtgaagtggataaatataaggcacgcttggtggccaagggttacaagcaacagtatggggttgattacacagaagtgttttcaccagttgcaagacatgatacaatcagaaattgtactctcatgtttgatgaattcaagaagtctatgatgaatgagttcggaatgattgatcttgccatgatgcattactttctgggtatagaaatagcgcaatcagatgttggaatttttctttctcaaaagaaatatgtgagagatattttggacatatttcaaatgcatgattgcaattctgtaaatactccagttgagtggggtttgaagttgcacaaagatcctgaagggataaaaataaatagtacactttataaacagattgtgggaagcttaatgtatctaacaacaactaggcctaatataatgtatttttcagcagcgatctcttggtcatcatggaagcagcccattgtcactttatccacaacagaagcagaatttatagcagcttcaacatgtgcttgccaagcaatttggctaaggaatattcttgaagaagttcacttcaagcaacaaggtccaactctcatctattttgataatagttccaccataaagttgtcaaagaatcctattatgcatggaagaagcaagcacatagatgtgagatttcattttttaagggacctatcaaatgaaggaattattgatcttatctactgcaagagtgaagagaagattgctgacatcatgaccaaaccattgaagttgtctacattttag

SEQ ID NO: 45037 - DNA, 549 bp, Glycine max
  Peptide Sequence Number=SeqID_161815
atggctagaggaaagatccagatcaagaggatagagaacaacaccaaccgccaggtcacttactctaaacgacggaatggccttttcaagaaggccaacgagcttaccgttctctgcgatgccaaggtttctattattatgttctccagcactggaaaactccaccagtacatcagcccctccacctcaacaaagcagttcttcgatcaataccagatgactctgggagttgatctctggaactctcattacgagaatatgcaagagaacttgaagaaactgaaagaggtgaataggaatcttcgtaaggagattaggcagagaatgggagattgtctgaacgagctgggcatggaagatctcaagctccttgaggaagaaatggacaaggctgccaaggttgttcgtgagcgtaagattgtatttactcctggacaagacaagtgcttcctctgtggtctgatgggtcatatggctgcaaactgtgaaggaaaggcaaaaaggaaggtagaacaggagagtttgatgaaaaaggagaggctattgtga

SEQ ID NO: 45038 - DNA, 282 bp, Glycine max
  Peptide Sequence Number=SeqID_161816
atgacgcgtcaaaaccgatgtaaaaaggcttctataaccgatgtagaaagcctattttgtagtagtgtttctgggttttccagactaaattttcaaaaattggagttgtgcttatactatgagcttttggtattaagagtaagtatgagtcactccagcggactcaaagttaaagattctgatgagatcgagcatacgtacaagtcctggaatcttctaggagaagaactagagccacttagcataaaagaattgcatagcttagaggaaacaactggataa

SEQ ID NO: 45039 - DNA, 285 bp, Glycine max
  Peptide Sequence Number=SeqID_161817
atgtcgtttaggacttgtgggaaggcttgggctgagcaaatgagaaaaatgagtgacaaagagttttctacctctgccctgttttcttggtttagggtagttcatgatgtttggatattgtggaagcttggaggggttgatcacccggtgatgagaggaacgaggataagggctacatgggggtacgtgagcttagttgaaagtgggcaactggtgatggtgggttcatgtttgatttgtggatgtgggagagttgatttgcaccatcgcccgatcgccacctag

SEQ ID NO: 45040 - DNA, 992 bp, Glycine max
  misc_feature (8)..(8): n is a, c, g, or t
  Peptide Sequence Number=SeqID_161818
gtggatantctcagtcccagtgtaaccaggcgctgtacgcctatgagaaaaccgtgcgaaacgcgtttgccgaagtgaacaacagccttgatgccattacgcgctatcaggaacagctgacggagctgcttgcccagcaggatgtggcccgggagaccctgcgcattgcgcagaaccgctatcgcaacggctattcatcctatctcgacgtgctggatgcgcagcgctcgctgttctcggtccagaccagcgttgtgcagcgctgggcggcggctgggtcagtgcctgaagacctgcccggtggcgctgcgcttaccgggcctggatttcgtcccgtaggccggtggtctgcagtcgataacttcatgatttcgtcgcttattcctgaagatgacatccttaatcaggtcctggaaaataacaaacgcgccggactccccgaacatgatgtagcggccaatcagggtcaactgctggcgctgttcgtgcgcatgacgcaggcgcggcgtgttctggagatcggtacactgggggcatacagctccatctggatggctcgcgcgctgccgccggacggaaggctgattacgcttgaggccgatcctacgcatgccgacgttgcgcgccagaatatcgtcctcgcggggctgaacgaacgcattgaattgattgaaggcccggccctgaactctcttgaaaagttcggtgacattccgccgttcgatctgatctttattgatgccgataagccaaacaatcccggctatctggaatgggcgctgcactactcccgtccgggtacgttgatcatcggcgataacgtggtgcgcgagggcgaagtgattaacgggcaaagcgacgacgcgcgggtgcagggcgtgcgtcggtttatcgagatgactggggataacccgcgcttaaccgccaccgcgctgcaaacggtgggagttaaggggtgggatgggtttacgctggcgattgtgaacgagtga

SEQ ID NO: 45041 - DNA, 419 bp, Glycine max
  Peptide Sequence Number=SeqID_161819
atggcacttcagcaagggaagatcagagttatgatcgctggggaggatgttgctgagaagcaacgtcatttagatctgtgtcagggtggtcatgctagtgctcatgatccgcacccgccttcccgtcacacttcgtgggacccactggccccccacctaggagcgcttatccctgactccttcctctatgggccatgcattagcatagaattccatgactatttctgggtcatatttagccatgggccctgcgagttgagtccattgcctcctggcaacttcctcctagaactcagtgtattctccctttctcagctggacccgtctctccttgaggaaagaccaactcttgatcgcttcaaagcggtgttggtgttcctcacttcagaatcggtgtccatcaaattctatatccggtt

SEQ ID NO: 45042 - DNA, 216 bp, Glycine max
  Peptide Sequence Number=SeqID_161820
atgaagtcaggtgacatgcgggggtaccgtatggtttactttagtcgtccgaagatattcaagcccaacgacgcacgagattcttctctgctgggcggtgacgatcagataagtaaagaggggcaactgccctaccctaatttcatccggggaccattgtttggtggcatgcaaccttcgcttgaccacctcgaggtacttaacacccttcgttag

SEQ ID NO: 45043 - DNA, 366 bp, Glycine max
  Peptide Sequence Number=SeqID_161821
atggtcaaggagaagtgtaaggaggtaagtgtctcctcgaagaggttaactaagaaggaaagccattttgcaataaagaaaaacattaaagaaacttcccttcttagacaacactcacatcttctcctttgtaaaagaacccttgttagcattgtcatacctcttgagcttgaggttattcctcaagaaaatgagtcgttggatgacggtttggttcgtaagagcttaaattcttgtgctttgttggtgcccaaaataggtgttgagggaagaagcccaaagtttcaagaacctttggatttgaggtcaaatccttttcaagggggaagggatgatgcaatccaagcccccaagagcattagatag

SEQ ID NO: 45044 - DNA, 831 bp, Glycine max
  Peptide Sequence Number=SeqID_161822
atggcttttactactgtggtgtttttcttgggattcctatcaggttcgtacggagcgacattaatggtcaccaacaagtgcagctacacagtttggcctgccattttatctgctgccagaagcttgccggtccacaccccgggcttggttctccaaccaggggacaccaacaccatccaagtgcctccaacctggtccggcagactctggggccggaccctctgctcctacaacatcaccggaagtttcacgtgcgtcactggtgattgcatctcctccactgtagaatgtggcggcgccaccgcaccagtcactctggcagagttcactctaaatggcactggcgggctggattacttcgacgtgagcctcgtggacggtttcaacctccccctggtggtggaaccgcggagcgcaataggagccgaaaactgtagggcgactggttgccggaggaacttgaacaaaaagtgtccggtggagctgcaggtgataaaagagggcgagggcgttgtgggttgcaaaagctcgtgcgaggttcatgagccatgcagcaataattccaacttgttttcacactttttaaaaactagatgccctgatgcttatcacaatgcctctttcacttgtgtctctgccgattttaccattactttctgccccgctttctccaagagtatgttaatccgtacaagtgaacagaaaatttccagctggggtggtggaacgctcatcccactacgtcctcttgctcctgatgaagatactcatacctattgtgttctcagtttctattttaagttgttgcgcatgcaacgtgggatcctctag

SEQ ID NO: 45045 - DNA, 561 bp, Glycine max
  Peptide Sequence Number=SeqID_161823
atggacaagctccaaaggcttagacaaggtagtatgagtgttgaagagtataggcaacaaatggaactactccttttgagagctaggcttaggggggaggaaagaacaagtattgctaggttccttagtgggcttaatatggaagtgagggacgaggttgatcttcttccatataggaacctagatgacctagcccaactttgcataatggtagagcaacaacttaaaaggaagcctacttcaaaatcttatggctctcactcttatccaaagaaagaccaaggtcaaggcatcttaggggctgcagcgtctaagcctaaagatgataaggggaagacaatagaaaagcaaccccctaaggctagtatgcaagagaagactagctctataaagtgctttaaatgtcttggaataggacacattgcttctcaatgccccaccaagaaaaccatgattatgagaggccaagaaatttatagttgccaagatgaggttactacttcaccttcctctagtgaaagtgaagaagtaaaaggggaagaacctagtgaagaaatctaa

SEQ ID NO: 45046 - DNA, 798 bp, Glycine max
  Peptide Sequence Number=SeqID_161824
atgcttaaaaatgtggatacaagtgaggttgtgaggggcccgcacgatgctcctggtcattggttggtaactgctgctaagcttgtgattgagctggttctgcaatacttgaagcgcaaggtcttctcttaccctttgccagcctctatcattcctgagcttcatgtttgcaagtctgatccttgggatttgccaggtgatttggagcaagagagatacttctttagcaccaaagtggccaaatatcccaacggaaatcgctccaacagagccacaaattcgggttattggaaggcaactggcttggacaaacaaattgttacttcagaggcaagcctcctaatggattcagaactgattggatcatgcacgagtatcggctcatccttaacggctctcagtctaaggagttgccgaaagccccgtgatgtcgacgacgatctcgacggagatgacagaaagagcgagagggagatcgtcaccgcgaacattcctctggtcgtcacaggagcgagagagagagacggagagaggaaagacagggataaggatagaaagaggagggataaggataggagagaccgtgatagggacagggagcgcgagagaagagagaaggatagggagcgagagagggaacgagcggagagggaacgagcggagagggagagatccacaaggagcaggagtcgctccgagagggacagagacagggagcaagattttgatatgtgcgatgcccgagctgtctatggcggtaaggctaatggtgtggctataattctatgcaaggactga

SEQ ID NO: 45047 - DNA, 420 bp, Glycine max
  Peptide Sequence Number=SeqID_161825
atgcttaaacaagcagatggttcttatgcttgcatagcagaaaatgcaaaccgcttcagccttggcgagcttcatactaatccattgactgatataggccaaagaggaattgttgagggtcttgggacttcaagaagaagagggaagttgtctagaatttcttcgaagaggctacaaggaattattgtggctataacctgtagtagtgcagtggtgaaattgggtgctaggcacatctgctgccccttacttgtattgtctcttgaagatgttttggtcaagctcatgttttgggcgctaggcacatctgttttggattattatgctgcattaaatattataaaacttttttttataagtcctatccaagatgctttaaaatgtgcagcatctggttcacagcttgggctaccgacataa

SEQ ID NO: 45048 - DNA, 906 bp, Glycine max
  Peptide Sequence Number=SeqID_161826
atggacccttttccacctgttaaccatgtgctttccatgattattcaacaagagcgtcataactcttcatctccaatcactatcgaatccaacacattcgtcaatgttgctcaatcgactttcgggagaagacgtggaagaggcgttcctgcaggacaatctagcgacaatactcaaactttctccaacaaaaagtgcatctattgcggtcggcgaccacgtttccacaacaaagagagctcttcttcttccgctactgtcaacaatgttgcacaggaagaagatccacactcctcaatgaacccgaactctccatctaatggtctaggttacggtttcactaaggccccatatcacagtctccttggtcttcttcagcaacagagcaacggtccaggagcctcttctcagcccaaaaatgtcaacctcatccaagtgtccagcgttggcacttctaattccactaatataggccttagccatacttgccctagtgatgcactccctacttcaatgccctcccaccaatcttcttcaaaggtatcttatcctattcatgactctcttgattattctcgtctttctccttattctcactatctcatgagtctgtcctctgagcatgagcccaccacctatcgcgaggctgctacccaaccctgttggcaagaggccatgaatgttgagatatgggccttagtttcaaaccacacctgggatattgtccaagctcctcccaatgtgtgccccattggttgcaaatgggtttacaaaatcaagcgtggccctgatggtactattgaacgcatttcttccatcaacaattggcacttgcagcagcttgatgtcagcaatgctttcctttatggtgatctcaccgaagatgtctacatgactatcccttga

SEQ ID NO: 45049 - DNA, 291 bp, Glycine max
  Peptide Sequence Number=SeqID_161827
atgtctactacacggttcaggaagatgacactttgtgcaatgggtggtgacagggaatttagcagccaagacatgaccaagaatttctttcaactagcatttttcacatggacttcgccttttggtgctggttctgtggttattaaggatgttcctccaaggactattgttgtcgggaacccagcaaagctggtaggagggaagaacagctctgttaagttggataagatttctatcttcaccatggaccatacttcacatattgctgacttttatgattattgtgtttag

SEQ ID NO: 45050 - DNA, 408 bp, Glycine max
  Peptide Sequence Number=SeqID_161828
atgcgtcttcacaaagaaccaactgcattatcttggccacattgtgttcagttacgcggattccttcacttgaccggtttttaccagaaactcattcgggcgtatgcagccattatttccccactgacaaccttccttagaaaggaccaatttagttggcaactcgcattgcaacaagcttttgatcagctgaagcatctcatgacacaagcccctgtgatagccacacctaatttttctcttcctttcacggtggaaataggcacttcaggcacaaccttgggtgttgttcttcttcaaaattcgcaccccattgcatattatagcaaggtcttttgtcctcaccttcaaaaagcttccacttacgttcatgaactccacgccatcacctctacagtccacaaatga

SEQ ID NO: 45051 - DNA, 631 bp, Glycine max
  Peptide Sequence Number=SeqID_161829
atggcacgcacaaagcagacatcgtacattgccgggtataacccccatgaaggctttttgtatgaaagggaagatccacaatcaatgctagttgttgataggatcattggacctccatttggaggaggtctagttgatttatcccttatttggtcttacagggacgattatgttggtcatgtgttaccactccctactaatctacaagctagcgattacgtggagcggtcaagtttgatagagaatggtgaagatcctattgatgattcatcttggcatttcagcagaggtagaggctggagtggtggcaaacacaggattgacatgaggccttatcgcccagagaggggcaatgttgtgccacttgaggatccttggacttgcacctctaactatttgccttggttttacaaggtttcgcacccctatgtcattctgctagatgagggaaagccatcacgtggagctatgcagagcatagaagacctcaaagttatgccaaaggggattcatcatcagctcatacaacaagctttgcaattattacataagggcttcatggctaggtgcatctcgggcatacagagacaaaagaagaggattgccaaggattgtggcaagggtgacaaag

SEQ ID NO: 45052 - DNA, 405 bp, Glycine max
  Peptide Sequence Number=SeqID_161830
atgacaacatgcatgcaagagcatagcacttacactacacacaagactcgtcaaaacccaagctccacacttactgatccttacaggtctacaaaatccaaggcccaaccttggttaatctcagcaaagcttcgtaggcttgacaaaacccagggcaaacatgtccctggtctaaggctcgacaaactcaaggttcacccttggaatataggtctatcaaaaacccaaggctcgtccttggtactcacatctccaaaacccaaggcccgcccttggtacacattctatgcaaaacccaaggttcacccttggtactcatacctccaaaacccaaggtccacctttggtacatacttctacaaaacccaaagggacctccttggtctgcttacttgcagtaactaa

SEQ ID NO: 45053 - DNA, 1509 bp, Glycine max
  Peptide Sequence Number=SeqID_161831
atggagagggttgacaaagaaattttggagcagttgtcggcctcgctagatgcacgaaccattctggctcttccttcagcaagcaatcctctcgctaccttggatggtattgtgtgtgacttagcctggaggtcactcatgaagcaggtcggacctggaggtgggactgtgccaccgtctactgctacttcgtctgtcgaagaagggggtcaacctgctgatgaggttggccatattgttgttgctgctgagccgcaagatgtgcctccagctccaccagccattaaggctcctactgttaatactgctactgttgctccttcacctccttccattgttgcaattcaggaggttgctcctactgctattgaagttgttatgccaaccactcaggcgggttcagttgtggcgctatcgtccaccgttgtggcacctttgttaagtgttggtgtggcggccactagtgctcccacgatgctgtctccttcctctgcaactccagtgacttctccctttactgttttggtggcagtgggagcaacttataagtcggagcagaagaccccaattggctttgtgtcagccttcgacaagaaccttattaggtcgagtggggagaatggactgcggcaccaagaggctatgcagaaggaggcgtccttggaggtgaaggttgccaagtggagggttactgcttgtactctttggcgagtggagcaccctaaggtggccaatgccaccgttgcttttgttgaggtcgtaaggtcgaaccgccaattgtcttccaaagttagtggtgtgttgaccaagttattgcgtacccagttagatggtgatgagctatttggatactgcaaggacttgcaggcggagaagatgaacttgagtgacaaagtggagagcttggcgattgagagggacgggctagccaaagtagttgttgatttagaggcccggcttaaagagtcagagtccaagttagaggcatccgagctgcaggctgccaagacaagggaggccaccagggagcttgaggaagagttgtttctatacaagaaggaggctattaagcaagccggtttctttgatcccttcaaggatgtgaaggacggtgtcctacttaatgaggagaagattgctgcaaaagaggagactgctaatgaaggtcatcttaggtttgatttcaacctagttaaaggtcttgtcacccatctggtggggcttccttctgttttgtggaacttctcccctgatggttcttctcttctgatggttatgaggagttggtgtgagctgaaccagattgaaggtcttatcatgcaattggtggcagttcatcttgttgaactgggaccttggacgatgattgtcttagttactgcaagtaagcagaccaaggaggtccctttgggttttgtagaagtatgtaccaaaggtggaccttgggttttggagacctatattcctgcacagataaaagttaggaacaagaaagattgtcaagggtag

SEQ ID NO: 45054 - DNA, 935 bp, Glycine max
  Peptide Sequence Number=SeqID_161832
agactaacatcgtcatctgcaccctttgtcaaccaggggcaagcgagcccgttgacacgcagagactaacgtcatcttctgcacctttgtcatccagatacggaaggtccgatgacatgcggagatacctaagtggttatccgtacaaaatgatttctgttaatcctgacccgagaagtcaagtggtagacggggatacccaagtgattatccagactaacgtcgtcatctgcaccctttgtcagccaagggcaagcgagcccgctgacacgcagagactaacgtcgtcatttgcacctttgtcatccagagacgacgagtccgatgacatgcggagatacccaagtggttatccgtacaaacgatttctattaaacctgatccaagaagtcaggcggagatacctcgtggtcatccgcaccttttgtcaaccagcggcaagcgagcccgttgacacgcaaagactaacgtcgtcttctacacctttgtcatccagagatggcgagtccgatgacatgcagagatacccaagtggttatccgtacaaaatgatttctattaatcttgacccaagaagtcaggtggcaggcaaagatacccaagtggttatccgttacaaacgatttctgttaatcctgacccgtgaagtcaggtggcaggcggaaataccccaagtggttatccgtacacacacaattctgctagcccaacctgtgagaagtcaggtagcatgcggagatgccctatacggaggaagcaactgggcggcaagctcctccacgttgccgaaaaatgtaaagtacaaaaaggggggtgaacttagtaattggggtgcgcttagaaatcttcctcaagatgcctctaggcggcaagcacctccttttttccctataaataagggagggggtgctgtttcaaatgttcatgacccctaa

SEQ ID NO: 45055 - DNA, 183 bp, Glycine max
  Peptide Sequence Number=SeqID_161833
atggacaatgcttatgtttcaacctcacctcccatgggtcctgaaaatcaactcaatgatcgaaaacttaccattctgttgaggggtctctctgatagtaacttgtcgatgtcttcgatgcgtacgtgtccaaaagaacgaggggagaggatacccataaaaggcacttcgacgctcaagtaa

SEQ ID NO: 45056 - DNA, 204 bp, Glycine max
  Peptide Sequence Number=SeqID_161834
atgggttggatatcgtgtagtttcaaaatgaattgtagggatgaagcaccaaaactgatagtaacaggcgtaaccagcaaaggcaatgcctccgatgaaagcgtcgacgagggcgtatttgaggatgttctcgcggttgggagagacggcggaagcaaaagtggcattggtgcagaggaatggagaagagggcacacacgctag

SEQ ID NO: 45057 - DNA, 1206 bp, Glycine max
  Peptide Sequence Number=SeqID_161835
atggttttaatcgaaggttcatcattggaggagtctgtcgataacgggtctgaggtttgtgggtacaatgatgaagtttttgaggtgtcatctaattctaacttcttgggcatttttgagccagttgctaaaaaaatgggtgagaatattacgactctagtggcgatggatgctactgacacaaggacttccatgagagttgcacctcaacttaagaagagccctgtccagaaggagaagtgttcacatgcccctattacgcttctcgggtacacgtgggttgatggtgaggtgaggctcccgtttgatgatttcttggcgatacgtgcttcatatcctaaacgtggcttcaacgcaacttcatccaaatggtcgtttgcaagacaaggctcaatggatattgttgatctagataccaaaacgaaaccctttgtttcctttctacctattggaaacaatgcccccgccagaatcatgactcaagctaatgctaacatgaatgcattctgcctggcctgtaggaatcagattgttgtcagcaaaggtcctctaaatcctcatctcaatcgaacatcggggccatgcgacgcaccaactgatgtggtgcctcctcccgtcactgtgaccaccaaagtggctcggggaaagcttctggtcataaggaaaggagctcccgagagaaaaaaagtcaagcaacaaatgcttgagtttcaaccttccactaccacgaccttggccaacttctcggccttgaccaaccaaggtttatttgttaaggactttcagctagatcgtctcatccctccgacgatgatctctaaccatgggtggcaagtgctgagcaagagcaatgatactgctaattgggccatcttctgggcctttcttgctaaggggctagagacacgtactactaatgttgaagccttcgttaggtcttgggatggcgagatttctaggcttcgatcaaccttggtggttgctgaaaaggagaaagaggaggccgctgtgctacacttatgtgaattctctgacctaggcgtctttggaatcaacaaagatgtatattatggggagttgatgttaattgatgatatcttgaaggatgcaacccccacactggagaggttgatgaccccgactaaggactttcaagatgatggtgccggagctgaggatgaagaccatgtatggcctagggattga

SEQ ID NO: 45058 - DNA, 482 bp, Glycine max
  Peptide Sequence Number=SeqID_161836
ccctcatctcgctcgcacaactcgtctatggtaccgggatggtttttggcatagactgtctacgaacttgtcaaggtggactcgtcgtctgcttgtcgtacattgaccaaggcgaccgaggtcatacggtgagacctgataatggcgcactgcctactaactcgttcgacaagggtgtcgaaggtgtctatggacctaggaaggcgtccaagtgctcgtgtggatctattgtcccattgtactgctcaaggttgagtggtttccatcccaagggtatgtttgtctccgtaatacaatcaacaaaaggatgtcgacggatagtccgccctactggatggtgcatgcaaggtgtgggcggattgctcgtcgtcttggggacgtctgacatgagcctctacctaatcatgctgtcgaatgaggatgggagtcttggagaggggttcggtctgaggccggaccaagtgctaacgatggatgaatga

SEQ ID NO: 45059 - DNA, 1806 bp, Glycine max
  Peptide Sequence Number=SeqID_161837
atgggaaactgcaacgcctgtgcgaaagctgatgtcgtagaagacagcaccaacaacaggaacaagaagtctaatgaaacgaaccgcggtggtaggaagaaagagcagaaccagaaaaaaccgaacccgttctcagacgaaccggcccggtcggcggctccgatccgggtcttgaaggacgtgattccaatgagccaccggacgcgcataagcgacaagtacatactgggccgggaactgggccggggcgagttcggcatcacctacctctgcacggaccgcgagaccaaggaggccctggcctgcaagtcgatttccaagcggaagctccgaaccgccgtggacatcgaagacgtgcgccgcgaggtcgccatcatgtccacgctgccggagcaccccaacatagtgaagctgaaggcaacctacgaggacaacgagaacgtccacctcgtcatggagctctgcgagggaggcgagctcttcgaccggattgtcgcccgcggtcactacagcgagcgcgccgccgcttccgtggcacgcaccatcgccgaggttgtcaggatgtgccacagcaatggggtcatgcacagggacctcaagcccgagaatttcctcttcgctaacaagaaagagaattccgctctcaaggccatcgatttcggcctctccgtcttcttcaagccaggggagaggtttgtggagattgttgggagtccttactatatggcgccagaggttttgaagcggaattacgggccggaggttgatgtgtggagtgctggggtgattctttatattttgttgtgtggtgttcctccgttttgggcagagaccgagcaaggtgtggctttggcgatcttaagaggtgtgattgacttcaagagggaaccttggccacagatatcggagagtgccaagagccttgtgcggcgaatgttggagccggatcctaaaaagcgcttgacagcggaacaggtgcttggtggaaactgggaaggtggggaatttggaatgaaaaccacttctcactttcttgatatgactaaaatacgagaagaacatccctggctgcaaaatgcaaagaaagctccaaatgttccattaggagatattgtgaggtcaaggcttaagcagttttctgtgatgaatagattcaaaaagaaagctctgcgggtaattgcagaacatttatctgttgaagaggtagaaataatcaaagacatgtttacattgatggatactgacaaagatggcagagtaacatttgaggaactgaaggctgggttgaggaaggttggttcacaattggctgagccggagattaagatgctgatggaagtggctgatgttgatgggaatggagtacttgactatggagagtttgtagctgttacaattcacttgcaaaaaatggagaatgatgagcatttccacaaagcattcaagttttttgacaaagatgggagtgggtatattgagttaggtgagctagaggaagcattagcagatgagtcaggagaaactgatgctgatgtattgaatgacatcatgcgggaagttgacactgacaaggatggttgcatcagttatgaggagtttgtggcaatgatgaaaactggaactgactggagaaaagcatccaggcaatattcaagggagagattcaagagtttgagcctaaatttgatgaaagatggctcgcttcagcttcatgatgaaattactggtcaagctgtggtgcattcaaatgatcttgagttggagttggagttggttatcttagtggcttggatgttagatgcctga

SEQ ID NO: 45060 - DNA, 300 bp, Glycine max
  Peptide Sequence Number=SeqID_161838
atggaacactttggaaaagttgcattgaatatccgaaagcttgaccctgcagtggctatgcaccatttgataacagtgttaaggtcaggagcttttgcgaacatcctatgcaaaaagccagcatttgacctcaacgaacttcgaatgaggatggctaagtacatgcagatgcaagagttggccaagtataggaatcaggagttcgtccacaagccacagtcatacaggcctaacaatccatacagaccagagtcaagccgaaggaagaaccgagaacatgtaggtcgttcagagaggtga

SEQ ID NO: 45061 - DNA, 972 bp, Glycine max
  Peptide Sequence Number=SeqID_161839
atggcggcccagttcataagagaaatcaactattccacttggctttccaatgtgatcattgtcaagaaacagaacaaaaagttaaggatgtgtacaaactacattgatcttaatcgagcatgcccgaagaacgcttacccactctcgaacatgaaccatttggtcgatggagcaaatagacacaaaatgttgagttttctggatgcgtattctagcaacaataagataaagatggacctaggggacgaggagaaaaagatatttatcaccgaattcgcaaacttttgctataaagttatgccatttggactcaaaaatgccggagtaacttatcaacgtttgatggacaaggtgttcaagagtcatcttggacaaaacctggaagtttacgtagatgacatggtggtcaaatatgacaatttggcaacccccatcacagatttaaaagaagtttttggtcaacttagaaggtataacatgaggttgaacactaaaaagtttgtcttcgaggatgatgagtgtgaaaaagctttttggcacctaaaagaaacattggcaacactgtccgtcttattgaagcatggcaccaacaaaaaactaatcgtctacctttcagtctcgagtgaggtcttgcgcggtactagtataagaagaaggaagttatttgaggctagtatattttgtgaactgagtgctacaggatctagaaatgaggtaccaaatgatggaaaaggaatggtggatggtgcatgtagacgtctccttcaatcgacatggaagtggaattggggtgatcttagaaggacccaatggcatagttgtggctcaatctttacattttggcttcaaggccacatgaaattaggccgaatacaaggctctcctaacgggactaagacttgccaaagaggtcagcgttggagtgattccaaggtcgtcgctgcacagataaacaaagtgtttcatatctga

SEQ ID NO: 45062 - DNA, 658 bp, Glycine max
  Peptide Sequence Number=SeqID_161840
cggggtggttgtcaaagcgtttgatggatcaagaaagtctgttatcggggaggttgatttgcccattacaattgggctgtttgttttccaaattacattccaggtgatggatatccaagtcgcatacagttgccttttgggtaggccgtggatccatgaagcgggggccgtgacatccaccttgcatcaaaagctgaagtttgtcagaaatgggagattgatcactgtgagtggagaggaagccttgttggttagtcatttgtcagctttttcctttattggtgctgatgaaacagaaggaacctctttccaaggactgactgtagagggtaaaaagccagagaagaatgaagtgtcttttgctacttggaagagcgcacagaaagtggtgcaggagggaacaggtgtaggatggggaaaagttgtgcagttgatagagagtaaaaaccgtgaaggactgggatttgcttcctctgcaggatccgcaacgaacagtgttggatcaagctccattactagcaccttttgtagcgccgggttcatcaacaactcgccagaagccaatgctgtcttggaagacgttcctgaagagagagtacttgcatttgtcacacctggaaaacttgtccgcaactgggacgcggttgacgtcccttca

SEQ ID NO: 45063 - DNA, 765 bp, Glycine max
  Peptide Sequence Number=SeqID_161841
atggagggattttcagtgctcatcgggagagcaaaatggaggggtgagcttcatggtgttaaccatttgctttttgcggatgactgcttcatcttttgcaaagtggatggtgtggagtgtgaactgcttgcaaatattttggaaaactatggtaatgcgtctgggaagctcattaattttcataaatcagaggctatgtttagtaaaaacacacctctaattggtagggtcgggggacaaggtatggaggagaatccagtcatggacagagaggtcacaacccaagtgtgtcatgtacaagtatttggagtgcccaagctattctacgggagggttgtagattgcgtgtggggagtggggagaatcttagggtgtggggcgatgcttggcttaggggaaaaacacatgcatctattcaatcagagcctaccccatattttggagatctcactgttagggatcttttcctcccaagggagtagatgttggaataaggacctgctaaaggctttcctggaaaggaaggatgtggaggaggtccttaaatttcctatattgcctcacaatggtaagcataagaggaaagctattctaagggaggtttgtagatggcccattttcaatatgatctacataccatggggcaaggaacatggtggatatgcagcatctgaaggtccttgggaattggaaccaactgtggtttctgttagaattaatgtctcatgtgagagacgtgtgacttatgtagggactaataaataa

SEQ ID NO: 45064 - DNA, 1137 bp, Glycine max
  Peptide Sequence Number=SeqID_161842
atggccatattcctagctgatgtggaatatcttaacacatccccctcatgcccaagattgaatatttggaatgtgaagtttgccagactagacatctatgggtggcctaacatcaaagactggacagactttgatactatattagaaacagctctcattttatcactaccacttgcctattttgcagaaataaaagaaattctatctttagtactacgagaactctgctttggctcagcagtggtacaccagatggatactggtatcattagaaagcctcattctcgaggagtgggttcagtccctcaagattggtatcaagcatgtttgttggaaggtcttgcagcagtttttggaaatggattatcaacagcatgtgttgtgaatattggtgctcaggtgacatcacttatatgcattgagaaatttggaagtagattaatgacagcgctctatgtagatcaacatatcactgatggaggtgctctaccttcaactggaaagactttgccttttggtggtgaggatatatcaagggcctttctctggacccaaagacagcgccaaacttggccaccaattcactcagatgttttcggaaagcctatagatctgttagtgttaaatcaactgaaagagacatactgtgaagtcaaggagggggaatttgatgctgttgcagtagttcattcatatgagaacaaagtgccagctggacctcacaagacaaggcttagtgctcttaatgttcctcctatgggattgttctgtccaatgcttttaactcctgatgcgtatcctcctcctcctcgtacttggtttcatgactacgaggatatgcttgaagatacatggcatattgacttttcccggagggctgacatgtcagatactttctatcccaatgttaatggaggattaccaatgtgggaaagctatccagttttttcaactaagccaaaaaaagaagagaaagtcggccttgcagaggctattactaactgcattctctcaactggtcgcatagacatccagagaaaattattttgtagcatacaattggaattgactcatttttctggaatagactggcggggtggctttgacaagtggcttaattgcagcagtagaagaaag

SEQ ID NO: 45065 - DNA, 2073 bp, Glycine max
  Peptide Sequence Number=SeqID_161843
atgagtaaagcattttcatcaaagaaatattattcctctttgcctccaccacctacaccaatcacagctgcaacgtcccgtgcgaaaaagagacaaagtcctagaagccctttgcaggatctcaaccgcatttccagcagcagcaacagtagttatgcttcttctagtgtgtccactgaagccccaaagggttgtctcaggttcttgtcttcctcttcttttagaacccctgtccacagacccaagagtctcacaaaaactcccagctcggcccctcgtgcagctgcactgaaacagtctaaatctaattcctccaaggagaaccttccaaagggtaatgctgggttgagaactaagacacttgcatcggataagatgcagatgacgcataagaagaatcccccgtgcctctaccaatggcagtctgggaagaaatctggttctaggactggccgaaagtccaacccttgttctgctttcaatgagcatggcaagcgtttacctagattaccatctgcatcagaggagttaaaggaaaaggaggatatcttgggagggagaaatgataatgctggtgagcatgatgcccatgtcaaattgggttgtggtgctgtaaacttgactccttcgagtaaaaaggttgctgggtcgtatctggaggatattagactttttggggatgtggaggagaatccaaactcgagtgctagtagaacaccgccaattcataactctctttccccggagatacaatgtgggtcttctttggttccaaaaacagcaacacctgcttgttatggtgctggctatgttgtttctggtgtcgctgacaagaggaaatgtaggcctagagggattctcactgtagagaagaactattcaggcagtgataaaatagctgctaatagttttgatgatgatgatgatgacgcgaggaagaaagtaatggatactaatgaccatgctagtccttccttgttacctttaccaactgaagctgtagtgcattggctttcttctccatgtaacaagggaaagaaaattctgagtaaggagtttgaaaatggactgaatcaaagtcagggactagcagaatccacaactcttgcttccagtacttcaccatcatccagttctaaaactttttggaatgtaagtgatagcagtgatttgtctggtggtgctaatggcatcatgagaaaaatcagttcttcaatttctccaaatggacttgctgaatttcaagtaccttctgattacatattatcaccttctcattcatccttattgttttctcccaatcccacacctatttgtagggcaggtagctcaggcaaaggaaaaaccgatcaatacaatctcattgatgagaattctcccttttccctgaattcatttggtagtggaaatgttattcaaactccacagtcagattctagttcagttttacatgttggattgtcattggcgcatgcagacaatcgaaaggaagatatttctaaccctggccttaactcatccagcaaaatacttctatcagaaaacttactcctcaatagttctatgcccctggaggattctgttaattcaagtttccaatttgattgtttaactatgccttgtgaatctattgatctcagtaaacttccaaattttttggatggtcaagatccttggttatctagttctacaatagagaatgcttcacaatcccaaatgaggatatcatggagggaagggttaatgagccaatcttatgagctggatgagtttgactgctgtagatgcttgtcagatgaagaagaagaaattgccaatgaatctggtaccaataggttttcaggtcctcaagtcaacattgaaacaaatgatggtaaaaaattgaacagtgatgttggaatcactgaaactgaggatactgaacaggaaattcacggccttgacaaagaaaaaattccagctttgatgtcatgttcaggtgctgagtccataagcactgatggtggtggtctagttgcttcaggggattcagactggactttatgccacgtgaacaagtcatttgaagtgtga

SEQ ID NO: 45066 - DNA, 327 bp, Glycine max
  Peptide Sequence Number=SeqID_161844
atgggagagacacatgaagtaccccaccacaatctagctgacttcgagcctcacctcggatatgccactgaggggcgggcatttgtccctcctgctatggtggaaaggggaaaatttgatcatatagaggaaaggttgaggaccattgaaggaggcagagattatgcttttgttgacatggtagagttatgcctagtgcctgacgtcatcatctcaccaaagttcaaggtgtcagatttcgataagtacaaagggactacttgccccaagaatcacttgaagatgtattgcaagaaaatgggggcatacgcgaaagataaaaaatga

SEQ ID NO: 45067 - DNA, 198 bp, Glycine max
  Peptide Sequence Number=SeqID_161845
atggttcagttcaagatcacatccaataacaataaaccttgtagcaataaaagtgtgacagatggagcccctcaaatgccaatgccacactacttggaaaaaaccaatatgagcacaccagccgttacagcgagggattctaccaccatcaacaagtacgtagaatgcaatcacaacatggctatctgcatgacatga

SEQ ID NO: 45068 - DNA, 183 bp, Glycine max
  Peptide Sequence Number=SeqID_161846
atgaaccacaaaggaatcccctccttcgtgttcagtgattacaaccaagaagttatacccacttcttgcaatgaactcaaaagcgtgtttaaccaagaagaccttctcttgaaaacactcaccaagagtcagtctcctgaaaagctttttgtaagaatggaggaggagaggaaaatagaatag

SEQ ID NO: 45069 - DNA, 390 bp, Glycine max
  Peptide Sequence Number=SeqID_161847
atgtggcattgttgctacatctacccattacaggaaccttccatacctttgatgctcttcatgaagaccaagtcgtggacttgcttgaagttagttcacaagaagcaagagatgagacatttcaatgtcacggggcatatgtttggctatcctgactgcgagacatttatcatagcaaattattggatctataagtatttttctactattgcttcttatattgctgatgaagattatcatgagaggacatcatgtgcttgctgttggaagtctgggaaggcattactagtgtcgatgtatcataagcggttggatagattgacatccaatgttgtgtgttggatttcttatggtgaccgttgtgcatttagagaatttgagctgatctga

SEQ ID NO: 45070 - DNA, 189 bp, Glycine max
  Peptide Sequence Number=SeqID_161848
atggccacacccatgagtactgtctgttacttagataaagatgaatttgctcaatctatagacataaaacaatatcgaggatctgtttcggattttgtcgaatccaaaaccgacagaaaaagcactagtggaacttgtcaattaagggtgggaataggccagaccagcctacaggggcctatgacctga

SEQ ID NO: 45071 - DNA, 261 bp, Glycine max
  Peptide Sequence Number=SeqID_161849
atggaagaaagtgtggagttagatggatttcctaaccattggacaagtagtcctctaaattatggaggttatgatcttgaatgtctatcgacattcgatcaacgtgatgtcaaggatataaagcaattaaccttattcaccataatgtttaaatcctcacgaatcatcgaattcgagttttcattgactgtgaagaagagcatggcatcctctaggcgtgagatggctccactagttgctgggaaagagaaagtcgattaa

SEQ ID NO: 45072 - DNA, 744 bp, Glycine max
  Peptide Sequence Number=SeqID_161850
atgaggccctctaggaacgtgataggcacattgggaaacggtggaggagagcctccgatgattgaacaaatgatggcacagatggaggacatgaggagggagatggaggacataaggagggagaatgtgaagaacctagagatgcagcagagggccaaccaagcccaagccactcttcaggctcaagcgacaaatctcagaggtttggagggggaggccgcagtggaacaaccaagggatttcagccccttcatggaagtcgtaatgaacacggaaatcttggcaaacattctcttcccaaagatgttgccctttgtcgaatcaacggaccccaatcagaatctaaagaacttttgtgccttgatgatgatcaacagtggaactaatgaagtaaagtgcaaactcttcatcgggaccctaactagggtctccttggactggtttagtgcattgccagacaactccatcacttacttcgacaaattttctctcgtttttgttgcacaatttgtagccaacaaggagtggctagcattaacaatcaaccttttttatgtaccacaacagctaggaaagtcattgaagggattccatatgagattcaatggagtggtcgtctgggtaactaatccagacaagaggatggttatggcaactttctgcaagggattgcgagtaaggtcgttcggtgagtcactagtttgccttcagtcggacaccatgacgaacgtctatctcgagtga

SEQ ID NO: 45073 - DNA, 234 bp, Glycine max
  Peptide Sequence Number=SeqID_161851
atgggtgccatcaaaggccaagtacttgctgactttgtggtattgtttgtcgacggatcagtgaatatgacaggaagtagagcaggaatcatattagcaaaggtggtaatgttagcaaagggagattccaaggtgactggcaaagcaaaagcaggagaatgcatcaaagaggccttcagggtattattagcctacactctgatccgactacatggaattcgtgaagaagtgtga

SEQ ID NO: 45074 - DNA, 333 bp, Glycine max
  Peptide Sequence Number=SeqID_161852
atgtcggatacaatgtccaggacatcctgcccgaaaatactggagttgctgcacaatgcacaaggcaagataaaagaattgaagctgcaggatccacgatgtcggatacgatgtccaggacatcttgcccgaaaatactggacacataaatctgttatatctttaacagattattgtgcaatttttcaggagaatgatagatctcctccagcacaagttgttgcagcccagatacgcacactgctatataaacatgaaggctgcacggggttgagtaccaagtccgagattgaagagttattttgtgagttttgggacttgagtgttttgtga

SEQ ID NO: 45075 - DNA, 1161 bp, Glycine max
  Peptide Sequence Number=SeqID_161853
atgggaagtgaagagatctcaacctcgctctgcgaagacattcccaatctcctctcatcattcgtcgacaccttcgtcgatttctcagtcagcggcggtctcttcctgccgccgccgccgccacctccgccgctcccaacgcgcctcccctcaccgccgcgcctggtggcaatcggcgacctccatggcgatctcgagaagtcgaaggaggcgctgcgcctcgctggcctcatcgacgtcgcggaccgctacaccggcggctccgccacggtggtccagattggtgatgtgctcgaccgcggcggcgacgagctcaagatcctctacttcctcgagaagctgaagcgcgaggcggcgcggcgcggtggccggatcatcaccatgaacggcaaccacgagatcatgaacgtcgagggcgatttccgcttcgccacactacccggggtggaggaatttagagtttggtgggaatggttcgaaatcgggaacaaaatgaaaaccctctgtcacggtttggaaaaccctaaagacccaatggaaggtattccctcttccttccgcggcgtgagggaagagttccacgacgggtttcgggcccgggtcgcggcgctgcggcccaacggcccaattgcgaaaaggttcttgtcgcaaaacgtcaccgttttggtcgttggggattcaattttcgtgcacgggggtttgctgccacagcacacttcgtacggcttggagaagatcaacgaggaggttcgggattgggttaatggctcaacaggtcggttttcaccggattattgtcggggggcggacggcctcgtttgggtgaggaaattctcgcgtggagatgaaaaggagtgtgattgttcggcacttgagcatgttttgtctacggtgcccggtgttaagagaatggtgatggggcacacgattcagactgtggggattaacggcgtttgcgacgacaaggcgattcggatcgacgtgggtttgtcgaaggggtgtggggacggtttgccggaggttttggagattagtggcagttctgggttaaggatattaacggggaatccgttgtatcagaataagggcaatgtggatgttgggaaggaacaagggcttggggaacacggtggacctaggcaagtggaagttaaggcttaa

SEQ ID NO: 45076 - DNA, 235 bp, Glycine max
  Peptide Sequence Number=SeqID_161854
atgactcctagtcatgatgcccttctatatcacaacgggaggtggaacatgccacgccaaggcgaatttatgggttacttgttcacaggaaaaaatccaaaaagatttgacattccttcgggatgtagcatcgacgaactcaaggatgtgatcaagcaagttgcacctcaagggatctccccttatggtattcatgaatcacaaatggttaggcgattgttttttcgacagccag

SEQ ID NO: 45077 - DNA, 271 bp, Glycine max
  Peptide Sequence Number=SeqID_161855
atgggctttaggccgagcaattgggaaagcccgaggagagaggctagtgacgatgacaatgatgcccctggcatggaagacctaccgtatctgcctgcacgtgttgttgaggatcctcttacagccgcagaggaattaaacaaagagcagcaacaatcacctgttgaagaagaacgaagagaacgtcctgagcttaggctatcttcccatggaaggaagatggctaagtttggtaggcctactccacaaattgaaggccttgtggctgcca

SEQ ID NO: 45078 - DNA, 615 bp, Glycine max
  Peptide Sequence Number=SeqID_161856
atgggcatggactactacaacatactcaaagtgaatcgcaacgccagcgacgacgatttgaagaaggcttacaagagactcgcgcgtatatggcaccccgacaagaatcccgtcaacaacaccgaagcggaggccaaattcaaacgaatctccgaagcctacgacgttctcagcgacccgcagaagcgccagatctacgatctctacggcgaagaggcactcaaatctgggcagtttccgccgccgcactcctcctcctcctcgtcgtcctcgcgcgccttccaccaccgtcagaacaacaacaacaacaacaacaacaacaacaacaacaaaaacaacagcaaccctcccccggccgcctcgtcgttccgattcaacccgcgcgatgccgacgacatttacgccgagtttttcggcccggaggacatcggcgccggcggccccgacgccttcttccggacctccaacggcggtggcgcgttcggcgcctccgctgcggcgggacggaaggctgccgcggtggagaacgcgctcccgtgcagcttggaggacctctacaaaggcgtcaagaagaagatgaagatttccaggaacgtctacgatgcctttgggtaa

SEQ ID NO: 45079 - DNA, 399 bp, Glycine max
  Peptide Sequence Number=SeqID_161857
atgtgccacccaacgaatgaaaacaggcagccaagcgaagccgagtcaagtgaagccgagctaatttcaccaccatcattcttcaacccaatcactcttctcaattctcatattccaatgtcaaatcctcaaacaaacaataaccgccaccagcccagccgcctgcagcgccgcgccccctcctccctgcaaataaaccgcgccgtcgagtggaacgtcgccatccccctcctctccccgctcgcatcctctccgccgccgatggagctaaaaccgccgcaagagccgccgcagcgggaggcggagaaggtcaccgtgtcgttcaagaagtggcagcaccccgccgcacctttctgttacgagcccgctcccatggtgcctcccttcgttcccgtgtag

SEQ ID NO: 45080 - DNA, 252 bp, Glycine max
  Peptide Sequence Number=SeqID_161858
atgtctacgctattcagaggaaaaaaaggagttagtttgtgggtgtggatggagcaccttcaagctggagattcacataagagttggggccagataacaaactatgccatatacaagcaagttccttctgtcacagtggatgtgactgcatcctacaatgtgcaaactttaacacatgatcttatagtgaaacatgcttataagctagaagattgcgtcaaggtagttcaaaatacagaagctacaagttaa

SEQ ID NO: 45081 - DNA, 784 bp, Glycine max
  Peptide Sequence Number=SeqID_161859
atggttgctgaagcttggattgtgaagatgggtaaccaggtaagcgccaatctcaagcacgctcttcttctcgaaccttccgcaaagagaaaacacaaccccaaaagccaagataataaagaattaattgggattctttcctttgaagtcgcaaatgtaatgtctaaaatcgttcacctccacagatccttgtcagagcccgagatcgtgaagctcaaaaacgagatctcgaactcacagggtgttcaaaaccttgtttcctcccaagagggttatctcctcgggctggctcgagcagagaagcttgaggagttaaaccgcgtcgctaacgtggtttctaggttgggaaaaaagtgttctttgcccgctttgcaaggctttgagcatgtttatggggacattgttagtggagtcatagatgtgagggaattggggttcctagttaagcacatggaaggaatggtgaggaaaatggataggtatgttagtgctaccaggagtttgcacagtgaaatgggggttctgaatgatttggagcaagcggtgaagaagtttcagcataacctgcatgaggagagtagaagggcgtttgagcagaaacttacatggcagaagcaagatgtgaggcatctaaaggagatttcactttggaatcagaattttgataaggttgttgagttgttggccaggacagtttgtaccatttatgctagaatatgtatgatctttggtgattctacatggagaaaaagtaatagtcttgggcttagtggaggttctccaa

SEQ ID NO: 45082 - DNA, 843 bp, Glycine max
  Peptide Sequence Number=SeqID_161860
atgtggggagggttatctggggttgaccacccaggaacccattcacctggcctaagcaaacgccactcagaccttggaatcaacgaaaacagtgatagccacaacaatagagaagaattcgacgaagacaatagagatgaaccaaaagagggtgcagttgaggttggaacccgaagaccaagaggaagacctcctggatccaaaaacaagccaaaaccacccattttcgtgacaagggacagcccaaatgccctgaggagccacgtgatggagataactggaggagctgatgttgcagagagtgttgcccaattcgcaaggaggcgtcagcgtggggtttgtgtgctcagtgggagtggctcagtggccaatgttacacttagacagccttctgctcctggtgctgtggtggcacttcatggaaggtttgaaattttgtccctaaccgggactttcctacctggtcctgctcctccaggatccacaggactcaccgtgtatctggctggaggacaaggccaggtagtgggagggagtgtggttggatctctagttgcagcaggaccagttatggtcattgctgcaacttttgctaatgcaacgtatgagagacttccacttgatgaagatgatgaggggcctagttcgatggtgggggcgcaaggcggaggaggatcgccaccgctgccacttggaattggaagcagtgggggtggccagttgcagggtgggattccagatccatcatctctgcctttgtataatcttccaccaaatggaggaggaggtggccaggtggggcatgaagctcttgcttgggctcatggacgagcacctttctga

SEQ ID NO: 45083 - DNA, 725 bp, Glycine max
  Peptide Sequence Number=SeqID_161861
ggataaacagtagtgattctgaagttgggagctcaatttcttcaggatttgggggtaggaaatatagcagtgatagggttgggggcagattgagcttcagcatttgcaagagggtagtccagttttcattgttcatcttctcttccttgaaatgtttggggcatagctctgggaagttggagttgatgcaggggaacatatggttagtaccttgtaatcatggttttcctcaaagcatgacacttcttcttcggtttcaattacgaccgtccattaccatagccatctctgaccctggagaaggttcagagcataccgattccaattcaatgctgagaagtctgcaagttcttttagtggacaatgatgatgtaaatagagcagttacccaaagattgcttcagaaactaggttgtgttgtaacttctgttgcttcaggattcgaatgccttactgtcattggacctgctggatcttctattcaagtcattcttttggatcttcacatgcctgatatagacggcttcgaagttgccaccaggattcgaaagtttagaagtggaaaccggcctatgattgttgccttgactgcaagtgcagaagaagatttgtgggacagatgcatgcaagttggtattaatggagttatccgtaagccagttttgttgcatggaattgctagtgaactcagaagaatcctgatgcagggaaatattgtcctgtga

SEQ ID NO: 45084 - DNA, 265 bp, Glycine max
  Peptide Sequence Number=SeqID_161862
cacccgcaaaagggtcgcacccggtttctctgtggcacagtgaagatgatttcttttttaattgatatgctgttgggatttggtggcttcttcaagtgggtttctttttttggtcttcccaatggtggtggaggagatttggttaatgtgttgttgctagcgaggtatctatcttcaacaaggctttgctctttccagggtaaggttaaagatctgatgaaggtggtatatctgattgcattaggggcttgttgtaattcttcag

SEQ ID NO: 45085 - DNA, 663 bp, Glycine max
  Peptide Sequence Number=SeqID_161863
atgggcatccgcaccgtgatgatcacgggcgacaatccgctgacggctgccgccattgccgccgaagccggcgtcgacgacttcctcgcacaggcgacgcctgagatgaagctggcgctgatgcgtcaggagcaggcacagggcaagctggtcgccatgtgcggcgacggcacgaacgatgcgccggcactcgcccaggccgatgtcggcgttgccatgaacaccggtacggtggccgctcgcgaagccggcaacatggtcgacctcgacagcgacccgacgaagctgatcgagatcgtcgagatcggcaagcagctgctgatgacgcgcggtgcgctgacgaccttctccatcgccaacgatatcgccaagtatttcgccatcatcccggccatgttcatcgccttctacccgcagctgaaaatgctgaacgtcatgggactggcaacgccgcaaagcgccattctctcggccatcatcttcaacgcgctcatcatcgtcgcactgatcccgctgtcgctgaagggtgtccgctatcgcccgatcggcgccggtgcgctgctcagccgcaacctgctgatctacggcctaggcggcgtcatcgtgccattcatcggcatcaaggccatcgatatggccattaccgccctcggcctcgcataa

SEQ ID NO: 45086 - DNA, 194 bp, Glycine max
  Peptide Sequence Number=SeqID_161864
gggtgaagacccctgaagttctatctggaaatcacgacgaacgcgctaagcgcgcctatgcgcttagcctgtttatcgcaactgttaagattttggatttccatatgaacgcgctaaacggaccatgtcgcactaagcgcgctaagcgtgccctgtgcactaagcctgagtgttttctgttgaggctgagctaa

SEQ ID NO: 45087 - DNA, 420 bp, Glycine max
  Peptide Sequence Number=SeqID_161865
atggagtgcaacatctgtggtgtaaaaataaaatctgatggtcctgcagataaaggaactggaagaatagatgtagatgcagatgaggcagttggaattggtgctggagctgaggaagggggaatctcagaagatgggaaagcctcagacctcttccccttggccttatgcagccctctgaagatctttaatggcagtccatcagcgtttaactcgaatccccttccagggatgcataatcaagctgccagttcctgtggttctggcttcgaacgacagaacctagagtatactggaaagttctctccctccttaagtatcactggggtcttcaagaatgagttcaaggtgtctacatcgaatttcaccaaacaacctctcaccttcacctgcttaggtggtttatcctcagggtcatag

SEQ ID NO: 45088 - DNA, 144 bp, Glycine max
  Peptide Sequence Number=SeqID_161866
atggggcaagaaacagttaaagaaaaacataagaaaaggattgaagagaaagaagtgtggacaaggaagaggcgatggcgtggatcgatgaggtccagacgaacctggaattggaatcaaagaccaaagaaatactaccgataa

SEQ ID NO: 45089 - DNA, 504 bp, Glycine max
  Peptide Sequence Number=SeqID_161867
atggagaccacagtcaacaccggaactctgcaaggaagctggaaacaggcaacgacgagattcccgtcatgggtaactgagaaagacctgtggcaaacttttcaaaagtggggtaaagtatgggaggtgttcatccccaagtccaaaaacaaagggggtcacagatttggtttcgtgaggtttaaggaagttgcagacgaactggggcttgaaagacatcttgacaacaacattttctttgatggaatgaaaatgtttgtcaatcgccccaaattccaaaggggcagggtcgtctctagtcaccataaccataatactaggcgtggaactgatagtataaaaggggtggataggtgcagttatggagctcatgtagtaaacgtcaatggtggtagaattcggtcctatgctgaggtggttcgtatgtcatcaccgggagcgagtattctatgtaaccagacgtcagcttttccccaaccaccaaaggatgggatgagaccaatg

SEQ ID NO: 45090 - DNA, 297 bp, Glycine max
  Peptide Sequence Number=SeqID_161868
atgaaggttctaaactttattttggcattgattcttgttcttggcgtggttaatgttcagccaaacctagctggtagggtattgaacatgaaggagcaactgagccttgtgtctctagatgataagggtcctgtgactccctcagggccttctacatgcacatatatccccggaacaggtggcacaaactgcccccctgtgaaggaaatcaatgtcgcaggaaacgctctgcacctcagtggtgaaacttatcctcgccttgttgttccgtttggtgtttcaaagaatcaacattga

SEQ ID NO: 45091 - DNA, 309 bp, Glycine max
  Peptide Sequence Number=SeqID_161869
atggaaggaagagagaaacttgatttcattggagagagattaatagttgtcaaagggtttggtggttaccctttcaccgacatgatagaattgtgtttggtagctgatgttgtcatccctccaaagttcaaggtaccagattttgataaatacaaggggaccacttgccccaaaaatcacttgaatatgtattgctggaaaatgggggagtactttagggacgagaaactgctgatgcatttcttccaagaaagcttggctggggcggcggtcatctggtgtggcaaggctgaagtaaaggctccctga

SEQ ID NO: 45092 - DNA, 909 bp, Glycine max
  Peptide Sequence Number=SeqID_161870
atgggtgaaatagaagaggtgcaagagcgaataaaggccaacatggaggccatgcaagagcaaatggccacaatgatggaggccatgatgagcatgaagaagataatggaggtcaatgcaactgcagttggtgctaccagcgccgttgctagggtggactcgactcccccattttggctcaaccaaataaaccatccatccttgaatatggtaggtcggggaggcaaagaattgggatgtatgggtggcccccattttttgcaagttcataacatgcatgccttcccgccatatggcttgcctcctaactacacaccacccaatgttgcacacgctcccaatgagaatgttgacaactctacacccattaccccgttctttggtggtgtacccttaccaaacactttggagggccctcagtttctcccacaaccacaacccttgcattttgtggtggggatagtcccttctgctatggaagaaaagggaaaattagatcatatagaggaaaggttcagggacattgaaggaggcggagatcatgcttttgctaacatgacagagttgtgcctagtgcttgatgtcattatccctctgaaattcaaggtgcccgatttaaataagtacaaggggattgcttgccctaagaaccacctgaagatgtactgtcagaagatgggggcatactcggaagatgaaaaattgttgatgcacttcttccaagaaagtcttactggggcagccgtcacttggtatactaacttggaaccttcccgagtccattcttggaaggacctaatggttgtctttgttaggcagtatcagtacaattctaatatggctccggatagaacacaactacagaaaatgtgtaaaaaagagcatgaatctttcaaagaatacgcctaa

SEQ ID NO: 45093 - DNA, 171 bp, Glycine max
  Peptide Sequence Number=SeqID_161871
atggagttgtggaagctcttcgtaactgcattaatgccagttcttaaggtgctcctcattactgctgttggcacatttcttgctctgcaccgctttaatatactgagggagagtgctaggaagcacttgaatacattgtctcttaacctttttcctcccttttgctcttga

SEQ ID NO: 45094 - DNA, 225 bp, Glycine max
  Peptide Sequence Number=SeqID_161872
atgaagaatggtggaaaaccttcgcgaaatcgcccacggaaacatctcggaagcgttacggaagcgcctcggcttggattttcttcacgaaaacaatttttctcactaatttcaagggaaaagagggtggtggttgccgcacagctcgcccaggcgagctgggttgcttccaccagaaggcgccgccttctgttggaacatcctggaaggcccaagtgggtctga

SEQ ID NO: 45095 - DNA, 1308 bp, Glycine max
  Peptide Sequence Number=SeqID_161873
gaaatctaggcaatttgcctcttatcatagttccagcagtctgtaaagaaagcagtagtccttttggagcagtggatgtttgtaacaagaaagggatggcatatgcctctttgtccatggcagtaggacacatctacatttggactttcgtgtacaacattatccgcgtatattcatgccggatttttaatgtgaacaaggttgatgattccacagtaggtccagcagcaatagaaacagatcttgaaaactattcaactagaccagtggttactgcagaggatctctcacagaccaatgatcatgtgagtcaatttggaagtgaatgtgcattgcctggtggaagagataggatgagtctgtgtcctaatatatttggaaatgtggatacattatgtgcacttgtacttcaaattcttggtctaataattggtgtagttcctccgttccaaaagatgtttgttggagatgatgctcctttacgtgtgattgaagactctgcatccatgctaggggacgcatctattccggcaatcactttgttggttggggcaaatcttctggatgggttaaaacggtcaggaatgaagctttcacttgttgtgggaatcattgtggttagatacattgctttaccaattttaggtgtgggcattgtaaaaggagaaactcactctgcttcggcaccagaaaagcaaccgctttggaaacccctctccccttttggagcaaatttccggagttcttcgtttcatggtgcggaagaatgtgcagtatgtaaagaatgcagtagtccttttggagctgtggatgtttgtaatgaaaaagggatggcatatgcatctgtccttggcagtccagtgtcagcaatagaaacagatctcgaaagccattcaactgtaccagtggttgcttcagaggttctctcagagaccaatgatcatgtgactacgctgcctggtggaagagctaagattcttggtctgataattggtgtagttcctccattccgaaagatgtttgttggcgataatgctcctttaagtgtggttgaagactctgcatccatgctgggggaggcatccattccagcaatgactttgctacttggagcaaatcttctgaatgggttaaaacggtcaggaatgaaattttcacttcttatggggatcactgtgattagatacattgccttaccaattttaggtgtggtcattgtaaaaggtgcaatccattttggcattatccatcacgatcccttataccagtttgttttattgcttcaatacgtccttccacctgcaacaa

SEQ ID NO: 45096 - DNA, 2241 bp, Glycine max
  Peptide Sequence Number=SeqID_161874
atgagagttgcagttgttggtgctggaattagtgggttagcttctgcttatgttttggccaaaggtggagtgaatgtggttctctatgagaaggaggattctttgggaggacatgctaagactgtgaatgttgatggggttgatattgaccttggtttcatggtcttcaaccggaatcttggagttgacatggaattatcagacatgtctttttctgtaagtttagacaaaggccgtggatgcgaatggggaagcagaaatggtttgacaagcttgtttgcacagaagaggaatgtactgaatccttacttctggcaaatgataagggaaattgtcaagttcaaagatgatgttattaggcaagttgctttggataaatttgtctatagctcagctttctctgccctgcatgttgaatttgagctcaacagcaaaatgttcaaagttgtgaaaaacactaattggaactatcttgatatgcttgagaataacccagatattgaccgcaacgaacctctaggggaattcatcaagagttatgagcttctctgccttctcagttctttcattctgtcacaaccaccatctacttcagctctttggcagaccacagtggctaactgtaagatggcggtcaaagaagagcttgagagggaaggtagccaaataataactaatcgtgaggttcagttggtttcgacatctgaaaaagaatgtgttgttcactgcaaagatggttctgaagaaatgtatgatggatgcataatggcagtgcatgcacctgatgccttgagattattaggagatgaagcaacatttgatgagcgaagaatactcggagcttttcaatatgcttacagtgatatttttcttcatcgtgacaaaaatttaatgccccaaaacccagcagcatggagtgcatggaattttcttggtagtaacaacaacaaagtttgtctgacatactggatcaatattcttcagaatatcaaagaaacaagtcaaccctttcttgtaactctcaatccagatcatataccagaaaataccttgcttaagtggtcaactggccatccagtcccatcggttgctgcattcaaagcttcattagagctagaccatattcaagggaaaagaaaaatctggttttcaggggcctacctaggttatggatttcatgaagatggatttaaggcatacaggttattggaagagggaggaacaatgttcacctttgagggaactggaaaaaactgcggtctgaagagtgttttgagagtccacaatccacaattttattggaaggtgatgacacaggcagatttaggccttgcggatgcatatatcaacggggacttttcatttgttgataaagatgaaggtctcttgattcttattttgattctcatagccaacagagattcaaatgcatccaatttaaaactgaagaagaatagaggttggtggacaccagttttccttacatctgctttgacatctgcaaagttcttcatggagcatgtttcaaggcgaaatactctcacacaggctcgcaggaacatctctagacattatgatctggctaggatagataagacacatgaaattcttgagattggatgtggatggggaagtttagccattgaagttgtcaaacaaaccggctgcaaatacactggtatcacgttgtctaaggaacaactgaaacttgcagaacaaagagttaaagatgccgggcttcaggaccgcatcaagtttcttctgtgtgactaccgccaattgcccaaggcatataaatacgataggataatatcttgtgaaatgatagaagctgttggccatgaatacatggaagagttctttggttgttgtgaatcagtattggcagataatggacttcttgttcttcagttcatatcaatcccggatgagcgttatgacgaatataggcgcagttctgattttataaaggaatatatatttccaggaggttgcctaccttctctaagtaggataacatctgccatggcagccacatccagactttggtacaacggggagcacgttgaaaacataggaattcattactaccaaacactcagatgctggagaaaaaacttcttggaaaggcagaatgaaattatggctctcggatttaatgaaaaattcatcaggacatgggaatactattttgattactgtggtgcaggttttaagtctctcacacttggaaattatcag

SEQ ID NO: 45097 - DNA, 660 bp, Glycine max
  Peptide Sequence Number=SeqID_161875
atgacgaagatgattgtgatggtgatgacaacggtggtcatcatgtttttcaacaacaatggacaattacacgtgagcaaccaagaacaagaagtggtaaaggttgtagaccaagaggacaacagcaacctagaacaagagggggtaaaggctgtagaccaagaggataacaaacacagacaaatccagttcattaagatgagagacctagacgcatatctaaaagaactcgttttgggacatcttctcattattagtttaacaaatattgacatgagtcacgaggacaaggataacaacaatacaacgataacgaagatgatggtgatggtgacgatgatgatgacaacagtggtcatcatgttcttcaacaacaacagacaattacacgtgagcatcctagaacaaggggaggaggagtataatgctctaacgagaaatagaacttgggacttagttccattatcagttggtagacaagctattgaatgcaagtgggtctttagaataaaagaaaatgttgatggttcaattaataggtacaaagctagattagttgctaaggaatttcatcaagttcatggctttgactttcatgaaacattttctcctgtggtaaaatcagttacaattagagtagttctaactcttgctctctaa

SEQ ID NO: 45098 - DNA, 2505 bp, Glycine max
  Peptide Sequence Number=SeqID_161876
atgaaaatgggaaggcgagcagaaactattatcctccccttggaactgatacgccacctaaagccctcagaattcagtgattcccatgagtaccacgtgtggcaaaagcgacaactaaaagtccttgaagcagggctcctcctctacccatcaatccctctagaaaagaccaacacatttgccacgcgcctcagggacatcatatatagtggggagtccaaacctattgacaccggcaaaaacgcagacacaattagaagcctttgcaattctgtggtttccttgtcatggagaagccacaatggcactcccactgatgtttgccactgggctgatggattccctttcaacgttcacctctacacatctcttcttcaatcaatttttgatgtcagggatgaaacactagtgctagatgaggttgacgagctacttgagctgataaagaaaacatggtctacactgggaatcaccttgccaattcacaatgcgtgcttcacttgggttctgtttaagcaatatgttagcaccggccagatagaacctgaccttctttgtgcctcacatgccatgttgaatgaggtggaaatcgatgctaagagagtaaaagattctttgtatgttaagatgctgtcatcagtgctgagctcaatgcagggttgggcagagaagaggttgcttaattaccatgactatttccaaagagggaatgccggtcaaatcgaaaaccttcttcctgtgttgctgacagtctcaaaaattttagatgaagatctgacactcacagacggagaaaggggagagcaaggaggcataaccgtagtggattcatcaagtgaccgagttgatagttatattcgttcttcgatgaaaaatgcatttgataaggtattggagacagtgaatgccaattctgctgaatttgaaagaaggaaagaattgagtgaagttcttctccaactggctcaggagactgaagccttgataatgaaggaaagacatcattttagtccaattctaaagaaatggcattcaacagcaggtgcagttgcggcaatggtgctgcatacatgctttggtaaaatgctgaagcagtacgtaagtgaagtgacttcactgacaactgagtcagttcaggtgttgcagaaggctggaaagctagaaaaggtaatggtccaagtgatggttgaagactctagtgagtgtgaggatggtggcaaaaacgtaattagagagatggctccctatgatgttgattcagtcatattgagtcttctgggaaaatggatagatgaatcattgcacaaaggcaaacagtgtttgcagagggcaaaagaaactgaaacatggaatccaaagtccaaatcagagtcacatgcacaatcagctgcggagctaatgaaattggccgcgataactgtggaagaattcttccaagttccaatagtcattacagaagatttagttcaagatctggctgatggattggaaaacctcttccaggactacatgaagtttgttgcttcatgtggttcaaaacaaagttacattcccatgcttcccccacttaccagatgcaacagtgattcaagattcacgaagctgtggaagagagctgctccatgcaatgctggttttgatgctcatatacaacacattaatggaaggcacgaaggtcataatcctcggccatcaactagccgtggaactcaacgcctctacgttcgtctcaacaccttgcactatcttcttacacaaattcattctcttgagaaaacactctctatgaactccggagttgttccttcaaaccgccttcgatttgcaagcaaccgcaagagttgttgttcatactttgaaacagtgaacttgtcccttctaggagcctgccaacacgtctcagaagttgctgcataccgtcttatatttcatgactcaggctctgtgttgtatgatagcctctatgctggtggtgtgggtagaggtcagataagagctgcattgagaatcctcaagcagaacctcacactaatgactacaactctcacagatagagctcaaccattggcattgaaggaagtgatgaaggcctcatatgatatattccttatggttttgcttgctggaggaagctcacgggtgtttcaccggtatgaccatgagatcatccgagaggacttcaagaatttgaagagagttttcagcaacagtgtggaagggttgatagcagagaatgtggtggatggagaggctgcagtggtggagggagtgattgcattgatgggccaaagtagtgaacaattgatagaagatttcagcattatgagctgtgagtcaagtgggataggtttgatgagtaatggacacacgttgccaatgcctcctactacaggaaagtggcacagatcagaccccaacacaatattgagggtgttgtgctatagaaatgaccacgcagcaaatctgttcttgaagagaacattccagttagcaaagagaagataa

SEQ ID NO: 45099 - DNA, 252 bp, Glycine max
  Peptide Sequence Number=SeqID_161877
tcaaccaaggatactaatggttgcgtcaacaagcctatggctctgactatgactctgactgtggcttctttagagggtagaaaggttgaagatcgcaataaagaagatgatagtgattccaattctttgttgccactgagaaaaggaggaatttcacggaaatcggataagacttataggaaaaggaaagtgcagtggaacgataggataggaaacaagcttgttgaggttttggaatatgagccaaggtaa

SEQ ID NO: 45100 - DNA, 942 bp, Glycine max
  Peptide Sequence Number=SeqID_161878
atgggttgtttcatggcatgttttggtctatccaacaaaagaaagcgtagaaagactatctacaaagtcctagctggacaccaaaaatatggaaattatgaagttcttgccataacagaaaaatccactatcccggattctgattccagaggaagagatgaagttaaggagcagaatagtgttaaaaccaagaagaagaaagttaccttcaatttgaatgtacaggtatatgagccaaaccccactgcttatcagatattgaataatgaggaagaagaaaataggaactatgctgcagaaacagaaggatctgcaaccttgcctgtgaaatacccttctaatcacagatattacaattccggagatggatatgatgaagaagatggaatggcatatgaagattctgacattgaagattatgagtatgattgggaggacgacaatgaatttgatgatgatgagtatgattgggatgatgatggtagtgatggaagtttggaaaatgatgaggctgaggtatgtaatggaaactctaaacagaaagagttgtcggagccatgctatccttctctggcacaagataagataaagaatcagatgctagatgatgctaagctgaaatccaatttacgtggacgagacagaagcacgggcatgcattctgttctgatccccgtggagaatctcacacagtggaaagcaatcaagacaaaagttgcaccatcaagcaagcacaggaggaaggagaatgttccatcaaagcaacatacaagcatgccctcagtctctgaagcaagcttgaatttctcaccttgcagcttggaatcaaatgcccttcagtccaagcctctattgccagaaatttcagttgatgctagtctttcaaactggttggtttctcctaattatcatgtctcctcgaccacaattcattgccaatga

SEQ ID NO: 45101 - DNA, 267 bp, Glycine max
  Peptide Sequence Number=SeqID_161879
atggcccgcaccaagaaaactgggcaaatgacgtctgaggcagcaaaggaaatcgctgaggagatcgattctttggaggagcaggcttcacagggatcgtttgtccctcatggacatcaggatgtcctgactaccgccattgggcgagcagagcaccctggccgtgtccgtgctgttggagtcggtgtcaccatcaagcaatattttggatcagctccacgaacatcccacagctcttcctccctgcctcctgaagacctacagtag

SEQ ID NO: 45102 - DNA, 594 bp, Glycine max
  Peptide Sequence Number=SeqID_161880
attgaaaagttgaaagctggagtgtcaaataaagaatatgaaattattactgagtgtgctgtttctaacttttctgaggtcccacatattcctccaccactgaatcaatattcctccatgacattgaatgatacaacaggagatattgtccctgaggttacaaatgttgttgattcagggaccataaatgttgaagcctctattctactgaaactctgtgtgtccataaatcttgttgagttgagcttatatacagggttaactagagatgcatctctggctactgtacaggtcagcagtgcatggctgctgtacaagtccagcacagcaggaaatggattcctctctgcaacactgcaaggtttcagtgtgtttgatgatcgtgagggagttgaacaagaatttcggttagcaattggaaagtctgagaatgttggagccagtcctctaaatacttcttcgtataatcaaaaccaggactcagtggatagtgttaagggagataattttgatctagttcagacaatgctcattgttgatgtgaaatttggtcaggattcaacatttgtttctttgtgtgtccaaaggcctcag

SEQ ID NO: 45103 - DNA, 189 bp, Glycine max
  Peptide Sequence Number=SeqID_161881
atgattctcctccgcacttggtcgagttgggaatgttgtgatgctaattcaaacccaatcactctccttctctccctacctttctccgtctatgccaatctcttccgaaaatggaaaaaatatgtttttgatgaaatggggcttcgtgaattgtcccaaactgaccttaacaatgctatgctatcataa

SEQ ID NO: 45104 - DNA, 561 bp, Glycine max
  Peptide Sequence Number=SeqID_161882
atgcccgggttccggtttaactggttggactggctggtccagtctgagttttataacactgcacacaagatccctttggtcttgaatcacagacagtacactgcccacttaccttgtactgaaattcaacattttattaaaagaacgaagacagcacgtttgaactctattcatgttacattaggtctttacgcctttatcttattctgcaatgactctttggatcatgccaatgaattatcaaactccctgaaagaaagtgccaatattaacactgttcgggcatcgcttattgttgaagaatgcacaagacttggtttgatgtatttgtgtattgctcctggatctagaccttcccctgttgctgctgctgctgcaagtcacaaattaatcacatgtatttcatgcttcgatgagcgttcacttgcatatcatgctgttggatatggaagaggatctcacattccagcagtagccattacatcatcaggcactgcagtttccaaccttcttcctgctggggaccaaaattgcggattgagcattataggggaccaatag

SEQ ID NO: 45105 - DNA, 1055 bp, Glycine max
  Peptide Sequence Number=SeqID_161883
ccgcgccagcttgacgatggtcggcgcgctttggctggagttgaccgtttgcccctgctgcgtaaccacggcgatgacgatgccgtccatcggcgcgaccacgcgggtatagcccagatcgatttttttcttgtcgacttcaatctgcgcctgcaccaggcgggcattgagcgaaagctgctcggcgcgggtggtggcgagcgtggcttcggcggtttcgaagtcctcccgcgagctggcttcgtcgttcagcatgcggcgctggcgtttgaaacgcgactcggcctgtttcagctgcgcctgtttggcctgcagttcggccttgatgacgttcagcgccgcctcggcgttgcgcagatcgttgcgctgttgcagatcgtcgatgtcggcgatcggttgccctttggtgacgcgatcgcccagtttgaccttcagcgatttcacttcaccggagacccgcgccccgacgttaacgcgttcgacggcatccagtcgcccggtggccagcacggcgttctcgatatcgcccaggcgggccgttgcggtaacgtaatcctgctgcggcgggcgttgccaatagagggccagcgcgatggcgacgcagatgaaaatgatgacggcgatcagcgtcagacgacgggtcatgcccaggttttccataacgataaaagcggcggttccagtctgccatcatggcagcgccagcttgaactggcgctaaacgtgaggcgctttcccgctggaaaggggatagtaaaggctttcccgctaaagatcacgagatcacggcgagataacgccgccgccatgatgccaaaccgcctcgagccggaactcgacatttaccaatacccggagcacctgcgcgcctgtctggcgccgttgcccaaggggccgggcgtctatctgttccacggcgagagcgaaagcctgccgctttacatcggacgaggcgaaaatgctgcgccaaacccggcgcatcagctttatcgagaccgccggcgagttgggcgcattgctgctggaggcgcagttgatcaagcagcaacaaccgt

SEQ ID NO: 45106 - DNA, 762 bp, Glycine max
  Peptide Sequence Number=SeqID_161884
caatttggggacacattcaagaaggtcaagcggatccaagatgaattgaacagatttgaagagatgacaatggatacacaactttcatcccaggagacaagggttagaaggcagctacaggcaaatttgtgggtggttgcccactcacacgagtccttactaaggcaaaaagctcgctctagatggattaaagaaggcgactgcaactcaaggtattttcatctaatgatgaatgcctctcgcagacataatttactgaaaggcatcatgagtgaaggtggatgggtggatgaaccccaaaaggtgaaggagacactaaatcaacaacagaacgacatattgacagggagttttagggaggaggaggtgagagaggctgtttgggaatgtggacgtgataaaagtcctggttcggacggtcttaatttcaagttcattaagaaattttggaaaatcatcaagcctgacgtccttcgtttccttgatgaattccacataaacgggatctttcccaagggaggtaatgcatcattcatagctttgatccctaaggtgatgtcatccattatagatggtagacagtttgcattcattgaaggtaaacacttactacatggtgtcctaattgcaaacgaggtagttgaggaagctaggaggaggaaaaagccttgcatggtgttcaaggagtttacacccactagaggactaaggcaaggtgatccccttgcaccgtttctcttcaacattgtagcagaaggctaa

SEQ ID NO: 45107 - DNA, 1227 bp, Glycine max
  Peptide Sequence Number=SeqID_161885
atgtggctgcaggatgaaatttcaagccctcttagtgctcgaattttcgaactttgtaacactgattttttcccagagactttgccaaattctgaggttacttccagctcaaactgttgttatgaggagaactcctcatatgccacaacaaatatatctgtaactgtagatgtagacaataagttgaatagcaatagcaacacagtcaccaccccaactagcactaccaccaccaacaccaacaacaacacaaccaacagtagtaacctgtctattatctttgactcccaagaagaaattgacaatgacatctctgcctccatagacttctcactatctccatctttcaatgttcccccatttctcccagccacatcccagcaagaacagtttgatttctcttctgtgcagcatcaggtccaactagcagcatgttcagttgtggagggcttctctcagtatcccaatgactctgttgcacctccttttatgggggctccattaccttctgtttttgaagaggactgcatatcttctgtcccttcttatatggctcttaacccctcatctccttgcacttatctcagtcctggcatgccaccatacatgcctcatggcccccttactactgccttatcaactggtagttctggaatatttggtgggaacattcttcttggttctgaacttcaggcacaagaattggaataccaaggagaaaatggaagaatgtattgtacagattcaattcagcgggtgtttaaccctccagaccttcaggtttctagtctgaaaggttgcagcagtaaggctcttggcactgagagtcagcaactagtaccaggggctggaagttctgccagtctaccagaaatctcaaacttagaggactcctccttcaaggttggaaaactttctgttgagcaaaggaaagaaaagatcaatagatacatgaagaaaagaaatgaaagaaacttcagcaagaaaattaagtatgcctgccgcaaaactctggcagatagccgacctcgagtcagaggaaggtttgcaaagaatgatgactttggggaaaccaatagaactacaagtagcaatcatgaagaagatgatgaagaagaagtagttgtgaaagatgaagatgatatggttgattcctcagatatctttgctcatatcagtggggtgaactccttcaaatgcaactattccttccagtcctggatttga

SEQ ID NO: 45108 - DNA, 204 bp, Glycine max
  Peptide Sequence Number=SeqID_161886
atgagtcctctgaggcgactgcgacacacagacgacacagagccctcaacaccagtagtggatccatcttcacctcagcatgcagcagacccttccactcctgtcttagagaaacctaaggaccagacaacaccagtcctgactctgggcacttctcctcccgctactccagtgcttcatctgacagatgaggaggatgtgtag

SEQ ID NO: 45109 - DNA, 327 bp, Glycine max
  Peptide Sequence Number=SeqID_161887
atgcataaaagcgtaaaagaggaaggtctctacactaattgcagatatagcaacacagatcccgaaatgagaaaagagaccaacgaagaagcaacatttggcaacaccctcaaagaagggagaagggtctccagtggttcgcgtttcctccatcgttatccttttgttcgcgattcattccttcgtcgccccaacaccgtcgtgctgttgtcgtccccatggcgacctcacgctactaagccctacaccggtagtgctagggaagcttaccaccctctgtggtggctttcgcctccttctgcgatgttttggggtgagacaccctag

SEQ ID NO: 45110 - DNA, 135 bp, Glycine max
  Peptide Sequence Number=SeqID_161888
atggtgtatggcaaaggggttctccctaaaggcgtcaagctggcgtcaaagcgagacataaggtgggccattcattcactgcaaaccctcttggctctcgggtgccatctgccaatgccactctccttgtcttga

SEQ ID NO: 45111 - DNA, 178 bp, Glycine max
  Peptide Sequence Number=SeqID_161889
ctgtaaggaccgtggagaaagcctcgctcttcacaaactccctaattcaaaggaacttcgagccgtaagaagagtcgtccacgtgcatcgtcgggttcatcgaatggaagaacagcgaagaggactatgttgcttcaatgtcaatgtgttcactcacagaacaggcaagaggggctag

SEQ ID NO: 45112 - DNA, 930 bp, Glycine max
  Peptide Sequence Number=SeqID_161890
atggggtttcccagaaagtcactattccttcttctgttactgattttcttcacaaaccttgaccttgctgaatctgcttctgattacgccaccttggtctacaagggttgctccaaggaaacattcacagatccaaatggtgtatactcacaagccctctcatcactctttgggtcattggtctcacaatccacaaaagcaaagttctttaaggccaccacagggaatggtggccaaacctccatgacagggctcttccaatgcagaggtgacctctccaactccgattgctacaactgcgtgagcaggctcccggtcctctccgacaagctctgcggcaagaccaccgccgccagaatccagctcctaggttgctacatgctgtacgaggttgtcgggttctcgcagcaaatctcggggatgcagattctgtacaagacatgtgggggaaccaatgctgctgggagagggtttgaggagaggagggacactgctttctccgtgatggaaaatggtgtggtgagtggccatggcttctatgctaccagctaccagtctttgtatgtgatggggcagtgtgagggagatgttggtgattctgattgtggtgagtgtgtcaaaagtgctgttcagagagcacaggttgaatgtggaagctccatttcaggccaggtctatttgcacaagtgcttcattagttatagttattaccctaatggtgttccaggaagacactcttcttcttcttcagcttcatcatcatcctctaattcttactcctcctcttcttctgggcaaaatacagggaagacagtggctataatattaggaggggcagctggggtggcgtttttggttatatgcttgatgtttgctaggagtttgaagaagaaacgtgatggtaggttattgacagtggaagatggttga

SEQ ID NO: 45113 - DNA, 894 bp, Glycine max
  Peptide Sequence Number=SeqID_161891
atgtattccttcaaagacaaagttacacagaaactctcccatctctttcccaactcctcctcctcctcgccccagaaaatgaaaccaggagaagaattccaacttctatgtgtctatctagctccgtactttagtagagctctcctgttaaagctgcatttgttgttggcactgtccttgtggttatgtgaacaatacacaaatagagaaacagatagtccatattcgcaagaggataaacctttgtcttcatatttatcttacattatcccttccatcagctttgatggatcgaagtcaaacaagaatcaacatgaacttaaaccaattcaatcggcttcctctggatataattatgagaattttgaatatcaggatgttccatcggataattatgttgactgtactaacatggatttgttgaaagatgataatgataatattaatgaagatcctacctctagaaggagcagtagtagttctgaggtttttgaagaagcaaatgagcagcaaacgccaaatacttcaaagaagtctcgactcaatcttactgatgactctacttttatatctcctgaattgtatgaatttttggaaatatgcctccctaatatagtgaaaggacgccaatgggtcttactttatagtacgttaaaacatggagtttcacttcgtacacttattcgcaagagtgctgagctttcttgtcctggtttgctgattgcgggagatatgcaaggtgctgtgtttggtgggctgctagactgtcccttgaaacctacagcaaagcgaaaatatcaaggaacaaaccaaacttttgtctttacaactgtatatggtcaaccaaggctgtttctacctactggtaaggattatcatggtttaaatgcataa

SEQ ID NO: 45114 - DNA, 1214 bp, Glycine max
  Peptide Sequence Number=SeqID_161892
gtcatgattcaagcctctcagttggcaatgcactgattacaatgtattcaaggtgtggtcttgttgaagctgccgatacagtgtttctcacaatgccgtatgtggattcagtatcctggaatgccatgattgcagctcttgcacagcatggacatggtgtccaagcgattcaactttatgaaaagatgttgaaggaagatatattacctgataggataacttttctcacaattctttctgcttgtagccatgcaggtttggtcaaagagggacgccattattttgatacaatgcgtgtttgttatggtataaccccagaagaggatcactattctcgtttgattgatttgttatgtcgtgctggtatgttctcagaagccaagaatgtcactgaatcaatgccttttgagcccggtgcaccaatttgggaggctcttcttgctggttgttggattcatgggaacatggaattaggtattcaagctgctgatcgactcctagagcttatgccacagcaagatggaacctacataagcctttccaatatgtatgctgctttaggtcagtgggatgaagttgccagggtgagaaaattaatgagggagcgaggggttaagaaggaacctggttgtagttggattgaggttgaaaacatggtccatgtctttttggttgatgatgctgtgcaccctgaggtgcatgcagtgtacagatatctggagcaactggtacatgaaatgaggaaattgggttatgttcctgatacaaagtttgtattacatgatatggaatctgaacaaaaggaatatgctttgtctactcatagtgaaaaacttgctgttgtttatggaattatgaaactccctttgggagctacaattcgggttttcaaaaatttgaggatatgcggggactgccataatgcattcaagtatatttctaaagtagtggaccgagagataattgtgagagataggaagcggtttcaccattttagaaatggtgaatgttcttgtagcaactactgtctaaaggatggaaatttgccttctactaatccacctctattgcacatggacgacagagttcattattgctatatcaagtcattaaccattttcaacttttgcttcaagcgtttgttagctttaacaattgcatcaggcactgtaattcaattcagtggtgctcagtttaaatgcccaggcagatga

SEQ ID NO: 45115 - DNA, 405 bp, Glycine max
  Peptide Sequence Number=SeqID_161893
atgattatgaggggcagggacatttatagtaaccaagatgaggctactacttcaccttcctctagtgaaagtgaagaagcaaaaggggaagaatctagtgaagaaatctacccccgagaagaaggacaaccattaatggttaagaatgagtgtaaggaagtaaatgtctcctcaaagatgttagctaagaaggaaagtcattttacaataaagacaaacattaaagaaacttcccctcttagacaacctccacaatttctcctttgtcaaaagacacttgttagcactgtcacacctcttgggcttgaggttattcctcaagtaaatgagttgttggatgagggtttggttcgtaagagcttaaatccttgtgctttgttggtgcccaaaatagggactcattag

SEQ ID NO: 45116 - DNA, 279 bp, Glycine max
  Peptide Sequence Number=SeqID_161894
gtggattctgaggattctgctctgattaaaacgttcctctcagtgtcgtggttcgacaacaagcaacgatggctcatggtggccaccggtggtcgtgggtggtttagaagaagcgagctcgtctcgttaagcgagagtccacttttggcgctaagtgcgacatttcgtgcttacagcaattcctctcagtatctggttggaattgcgcttagcgcgcttcttgcagtaatcgagaagtcacaaaatgttattttgaaaataccaatggtcagactgtga

SEQ ID NO: 45117 - DNA, 594 bp, Glycine max
  Peptide Sequence Number=SeqID_161895
atgtcagttttagaattatacatagaaaaggatgttgttggtggttctgcgtttcattctgcaaattctgttagatcatgtgaaaataatttatctaataatgagtcggaaccgccaagaaatgtaagcaatttacatgaggatgaagatgaagataataatgattatcttgtgtctaattcatacgttgaagactctttagatgaagatgatagtgttgatggtatatctgatacagatgatgaagtcgccgacatggttcaaccagttacaattgttcaaccaagagaagatggaattcaaaatccattttggagtgatgctttccattataacaatatcaattggagtcatcctaatgaggaggacatttgtgatttagacatgccatctacttttaatgttgggcaagaattatatgttggtatggattttgatagtaaagatgctttaaaaaatgcactcaaacaatatgttatgaaggtgcatcaaagttttaaagttcttgaaaccaaatcgcacaaatatatcgtttgttgcccaaataaaagcgcaaagtgtccttgcccattttatgagggcaattttatctaa

SEQ ID NO: 45118 - DNA, 237 bp, Glycine max
  Peptide Sequence Number=SeqID_161896
atgataatgatgaaaatgaaagaaaatcacaagtttggtgcttctgatcatatggctccggtccctctcaagaagtcgaacaggtcgtccatgtcttcatcctcttgggctggatctatggctccaggggcttccgcgggtcccgcccttgtctggcaaacaagccagtctccaggccatgcgatcatcgctcaaaactgttccagagtagggcatatgaaaggagtggagccttga

SEQ ID NO: 45119 - DNA, 264 bp, Glycine max
  Peptide Sequence Number=SeqID_161897
atggttaggtggatgtttatcaagaatctcatgctaaaggacacaggaacacaatgctctgacaggatgttgaaagctggagttgctgcacatgatgtccaacgttatgtcaaggaatcagattgggctgcacaatgcacaaggcaagataaaatgtcaaatgaagaattgaagctgcaggatccacgatgtcggatacgatgtccaggacatcctgcccgaaaatactggacacataaatctgttatatctttaacagattaa

SEQ ID NO: 45120 - DNA, 583 bp, Glycine max
  Peptide Sequence Number=SeqID_161898
atggcaagcagagaccaagcttggtcattctgcacacatgatatgtggagagaccttacggttatccgcccccctttcccattcagatacagtagtgttggatggcaagcagagaccaaagaccaagtttggtcattctgcacacatgatacgcggagataccttacggttatccgcccccctttgccattcagacacagtcgtgttcgatggcaagcagagaccaagtttggtcattctgcacacatgatacgcggagataccttacggttatccgcccccctttgccattcagacacagtcgtgttcgatggcaagcagagaccaaacagaacgcttgatagcaagcaggggctgacacagtcttctgcaccttttgttcctccggggacaacaaagtcatttacatgtggaaatttcatggtcacccgcgactcttgtcagccgagaggagcgaaattagtgtcatacgctgattttcggggacctttgcttgatgacatgcgaccattctttggtccttgtgaggtgcttggcatccatcatcaggcagtttgtgaaatcctaggaacgacgagtcacg

SEQ ID NO: 45121 - DNA, 726 bp, Glycine max
  Peptide Sequence Number=SeqID_161899
atgggagagacacatgaagtaccccgataccatactctagccgactctaagcctcaccttggatatgccactaaggggcaggcatttggtggcatacccttgccaaacactttggggggccctcagtattgcccacaaccacaacccttacattttgtggtggaaagactgcctcttgccatggtagaaagggtaaaatttgatcatatagaagaaaggttgagggtcattgaaagaggcggaaattatgtctttgctgacatggcagagtcgtgcctagtgcctgacgtggtcattcctctgaagttcaaggtttcggacttcaataagtacaaggggactacttgccccaagaatcacttatggatgtactgcaggaaaatgggggcatacgcaaaagatgaaaaattgttgatgcatttgttccaggaaagtcttactggggtagccgtcacctggtacaccaatctagagtcttcttggctacagaacatatgtaagagggagcatgaatcttttaaagaatacgcccaaaggtggagggatctggcagctcaagtagcgcccccaaatggagagaataagaaggagggaggaacccatgctatgactgtcattcctacatggccaaatttcccaccaactcaacaatatcaatactcagtcaatatcagcccttctcattacccaccaccctatcagtcaagaacacccaatcatccataa

SEQ ID NO: 45122 - DNA, 459 bp, Glycine max
  Peptide Sequence Number=SeqID_161900
atgcgtgataaggtgtggaaaaagcttaaaagatggaaggagaatgtgttatccaaggcgaggtgtgaaactctgatcaaggtagcgatcgaatccatcctgacatatgctaagagctattttaaacttcccttttcttcgtgctggtattttgatatgatgattgccatgttcttttggggaggcaagtcagactcaaggaagctacattggttaaggtgggaagcaatgtttaaatctaaatggaagactggtctcaggatgagctacacatggtacagtatcatcgcttcaagagagattgtgaaaaagggctcaatttggtgggttggtgatagaacttcaattcatgtttgggatgataaatggctgcctaatgtggtacatgggatccttcagagtgattggaaccaagtgattgatcatgaattgcttctagcaaatctcattgatcattag

SEQ ID NO: 45123 - DNA, 1122 bp, Glycine max
  Peptide Sequence Number=SeqID_161901
atggcgcagccgatctctgatcgggtagatgagctattaacgggcgtacgtgccgatgttgcggtcaagatattcggcgaagatctggacactcttaagaaaaaagcagatgaaattgccagaattgccggcagtgtacgcggtgcgacagaaatcaaggtcgaaaaagtatctgggcaacaatacctgaatatcaccattgatcgccaggccattgcccgccatggcatcaatgcctcggatgtacacgatgtgattgaaacagcagtaggtggcaagattgcaactgaaatctttgaaggtcaacgtcgtttctcggcagctgtacgctatccggaatccttccgggacaatgaggaagccattcgtaacatcatgctgacctctccaaacggatctcgtgtggctctggatgatcttgccgatattgaagtcaaggacggccctgcccaaatcagccgcgaactggccaagcgccgtattgtcattggcgtgaacgtgaaagatcgtgacctgggtgggtttgtggctgagttacagcaggtattggatcaacgcctgcaattaccagatggctattatctggagtacggtggccagttccagaacatggaacgcgccatgagtcacctgatgatcattattccggtaaccattgcagcgatctttttcctgctgttcctgctgttccagtcgttgcgctttgctaccatgattatcctggtgctgccatttgcttctatcggtggcgtgattgctttgttcgtcacaggggaatatttatctgtcccggcatctgttggctttattgccttatggggcattgccgtcctgaatgccgtggtcctggtgtcttatatccggaccctgcgcgaagaaggtcttgatcaattggaagcgatccgtaagggctgtgcccagcgcttccgcccggtgatgatgacagccacggtggccatgctaggcctggttcctttcctgtttgcgaccggcccaggttctgaagtccagcggccattggcgattgttgtgattggcggactaattacctctaccttgctcacgcttattgtggtgcccaccttgtaccgtaagtttgaagaaagcaaaatagaggcataa

SEQ ID NO: 45124 - DNA, 930 bp, Glycine max
  Peptide Sequence Number=SeqID_161902
tttgaggaatttgatgtcggtgaaaataccagctcttttgatcaagatatagtgggaaatgctttactatctaaactgttgaatatgatggacgatgaagtttctccacaaaatagtcctactgatttactaccggaaagctgggataaatttcaaagcagcatatcaggctttcaagaaaatgtttcagatgaagatgatgaaaggcttagtgttattccacctaagtcaaaaaatgttgatgcaactcctcagtcaaagtttcaaggatattcagctggaagaccacaacgagattctgctacaaaagagtcattgcatgtttccacaccagctgcgagggatcatcctccctttttaaggaaaagaagaattattcttgatagaatgattctcctgcctagcaaggtagttagaaagaacatagagagtgcaaaggacttgcttcgtttccctttcccgagggaatcacgtcgtactttacttaatgcacgctgtgtgaagaaacacagagaatctcccacttccagtcttcctgatagattctatgagcctttgcttccatgttcttcctctgagcttcaactccaattctctaaaaggaaaatgaaattacctaattccctaaagattgtggaaactccagggaatccagatgtgccagaatctcccactgctggccctctgctaagcccttcccaatcttcattttcccttgaaattgaggaaactccaagaatgttagatgtacctcaatctcaggattctagcattcaaatgaatgaagtgcctaatttgattgatgaggaaagttgcaagttgcttgcatcagagttttctacatgcaagaaaagaaagagaggacaccataaacttttcacaagtctttggaggccaagcacggaaagaatctgccctgttgttttatga

SEQ ID NO: 45125 - DNA, 132 bp, Glycine max
  Peptide Sequence Number=SeqID_161903
gaggttttcggactatggaaagctaaatcctctgttggatcttcccttggaaactggtctgattctaaagtccttgatagaacgggactaagttgttgtgctatcacgaggaatcggggtacaagaacttag

SEQ ID NO: 45126 - DNA, 210 bp, Glycine max
  Peptide Sequence Number=SeqID_161904
atgcttcaccctacagcagccattaacgaaggaggagaagcttaccttgacggcagaagtggcggagacgtctcaacagaagcagctaatgcgcggaaaagaaaccaacaagtaaaggggatgtcctccaatgctcacactcaagaagagaacaagccaacaggtcgaaggcgcagagaagaaaaggaagcagcgcaaggaggagtatag

SEQ ID NO: 45127 - DNA, 513 bp, Glycine max
  Peptide Sequence Number=SeqID_161905
atggagttatcctacgatgtgatggcctccactagtcgttgttatatatgcgagattccaggttcgcataagatcattatggagagcttccagctctgcaagaaaggggtctccgtctgcaatcccatcccagaatccacagatccattcaccttcagcttcatcgctgggtgggaagggggtgtccaagagaccattggcgaatgcataaatgaatctcctagctggaacttggaattatggttagtacctgctgaatcgtccatttgttggggtcaccaagtgtgcagatccaaacccaaaatgagtttgccggaggatattcgggtgttgctaggtgccgcttcggccaaggtgaaagtgttacaagtcggtggtgattgttgcggtggttggtcgattgcgacattgtctaagatagacgaagatcaatggatgtatgacaatataatgtctgaagaagttgatatgaatgatgaaaatgaacatgaagctggtgtgaatgaagaataa

SEQ ID NO: 45128 - DNA, 252 bp, Glycine max
  Peptide Sequence Number=SeqID_161906
atggctcttaagctcaacatgtacaaagcctacaatagagtcaaatggaagttcctagaaagaattctggtcaagatgggttttcccaatcattggtgtgatctcatcctcaagtgcatcaccattgtgtgctttgttgttttgattaatggggcaccctctaaagggttcaaggcttactggggttggcgtaaggggaccccttgtcctcttacaaattcatcctttatgctaaagcattttccactttaa

SEQ ID NO: 45129 - DNA, 1146 bp, Glycine max
  Peptide Sequence Number=SeqID_161907
atgggtccaaaatctaccctaaggctcatgagaaccctagggccttctcttgcatctctggcccaatctacttggagtcttctatccaatgcccttgcggggagggaaggtatgccactgaaagaacatcttgatgaaataaactatgttttgatggagctacgcgacattgatgtcaagatggaagatgaagatctggaaattattttgttagccttttttcctcctttctatgagaattttcttcgactaaaggtgtttgggaatggtgatgaagcctctgcatttggattatcgaggactggttatgctaaaaggcaaaagaagaagaaagacaaaggcggttctataccaatcagaatgcatgatggtgttgttagaaccttgattaaagttcatcatgttctagagcttgagaaaaatattgtatgtatgggtgccctggattcaaaaggcttttcttgctggattgaaggtggagttacgttgatcgaagggaaagggtggtctatgaagaatcaaacaggaaatatagcaaagtgtcttaggactgacaatgacctggaactttggaaaaagaagtttgtgaagaatcagacaggaaaaacagtaaagtgtcttaggtctgacaatggcttggaaaaaagcaagaagttgaagtcattactcagtagtgaatttaagatgatggacatgagagttattgaaaagattttaggcatggagatcaagagggatgaagtcctatgtactcctctgatagcgtccattcgtctacctgaactcaatagtactcggtcagaattagagaaggaatacatgttttctgttccttatgcaagtgttataggtagtcttatgtatgttatagtatgccctcgatcaaacctggcacaaatagtcagtgttgcaagtaggtaccttaagggtacaactgatattagactcatctaccatggagacacgtcctatgttggttacttagattctgaacatgctactgatttggatgcaaggagatctatgattgggtatgcattcacgattggaaactctcttgtcagttggaaggcaacacttcagcccacagtggctttatccgctatagaggcagagtacatggctctggaaaaagtagcaatgtaa

SEQ ID NO: 45130 - DNA, 378 bp, Glycine max
  Peptide Sequence Number=SeqID_161908
atgggaagacttatgttgtctgaagacctggggagtgtaaatctcaggcgtgaaatttatatgtacgaccttagctcgcccaagctagcctctggctcgcctgggcccctgatttacttcagggtaaaggaaccagctcgcctgggcgagccagttacttcaggagtaagcatcaactcgcctgggcgaactgccatggccctaagtgcccattttcctataaataggcatgctaggggggttgaggagaggttccaaggtccagagggtgaggaaattgagagaagagagaaagaagaggaaacaaagtcgaggcgccgccaaatcgcgaccgtgatcaatccctacatcgtttcttgttctatgttcttcgtgtga

SEQ ID NO: 45131 - DNA, 483 bp, Glycine max
  Peptide Sequence Number=SeqID_161909
atgaatactctcatgcatcctacaacataccttggactggacgacaaatcaacaaagatggacgggactcaatacagaataatgattggatcactgcattatctcacagcgtccatacctgatattatgtgtgagatttcaacaagaaccaagggagtttctgaagttcgagaatctggcattccatccaacagtcctagacatatcaagacaagagcaaggaaagtcaatcctaagtttggtgagaaagagtggacaatctccttctttggtaacaaggagaatccaacttcatcttcctcagatagtaatccacaatcaacaccttccttctttgaagtcatccatgcaaaaccccttccgagggaatccatcattgtccaagcactcgcatggatgaggcatgactatgtgcacacaccatctgaggccttcatggctcttccaatagatgtcatagttcatctacagcctctacaatag

SEQ ID NO: 45132 - DNA, 525 bp, Glycine max
  Peptide Sequence Number=SeqID_161910
atcgtgatggcggtgcaactaatccatgatcgagtggagatggagtgcctagagggagcttgggagaccctcgaaggcaacacgaggtgccgatttcggggcacgattcgattcacggctacttcattggtgcatccagaggaacccgcgcgcacgcttcaacgcactgtggagtggatattacccacgcctacaccatatcgtctagtggagccagtccaagtgatcgaggtgacgtcatctgaggaagaccctgaggaagacccagaggagctacctcctgagcctgctgtggatgctcttgactttctagagggtgatgaggacccactccttgaggtggattctcccgaggatgtcatgtcggcatctgaggcagattctacggaggagagcggccctggagagatggcgactagtgtcgagggaaggagcccagagtatcaagaacctcgggatttgaggtcaaatcctttccaagggggaggggatgatgcaatcctaccccccaagggtattggatag

SEQ ID NO: 45133 - DNA, 723 bp, Glycine max
  Peptide Sequence Number=SeqID_161911
atgtatgtgagagatcaagtaatggcttatccttcgggactgcacatctcaagggccaccgatatcaagatagttgctaatacggtgtgtcctcacctacctatctgggatgatgctaaaaagaaagggttcaagttatactacactaaagaaatgccctcaagtgggaagaagctcatttgtgctccagatgcttacgatgcaagaaccttccagaattatatcgtgtggatggacactttgaatgcctccacctatgtttatgatgaaagggacaatgttgtttaccacaacattatcctagtgttacgtccaattaggaagtatcactttgatgatgcttgcgtctgctttacaaaggatgccaaaaactacccattcattcattgtctcttacaatttcccactattcaatacgaaaggacttacaatctctttaagataaatgaagaacagatgatagctcatgtgactcaactccatgatgctcaacatttctccaaccttggtgttattcttcttcaaaaccttcaacaggctcaaatgtctatgttaggagttgttgttgcacttgcacccaggcctgtacctgttcccccaacacaggaaccaacaccatcatccattgaacctacaccatcctccattgctccaacacctctgcctccaccatcttcacctccacctactcaacctccaccgccaccactagctcaagattga

SEQ ID NO: 45134 - DNA, 300 bp, Glycine max
  Peptide Sequence Number=SeqID_161912
atggccaagacatggaagataaaaggggaattggagattaaagacgtcaaaaggaatcttctcactttcaggttccagaggcagaacaatatggtcatgattttggagcatggcccatggaactttgattggaaattcctggttcttcataaattgagtcctgacaaaactcctagggacatcagtctaacaaagtgccccttctggattaggatgaatggcagcgaaatggagaaggaagagagagaggagacgccatttcaaggagaagatgagtctagaagaagctcaccaccatag

SEQ ID NO: 45135 - DNA, 336 bp, Glycine max
  Peptide Sequence Number=SeqID_161913
atgtgtttggcttggagtagttatgggatggatgaccttctggaaaattttccaaaaagcattgtgagagacgtcgagaagtcgacaatcaaggacattacattacccactagtcatgccttaccattctccgcgtcttttgcccgggtcgtcgacaacaacaccataacttcgtcttcttcatcactaaagggaacaaaagtctttcccctatccatggagagagaaggacaagaaaaattcctaggggatcacaagagacaaagccttggaggggaatccttattgtcactacttggaaaacctagtagagaagaaagaggtgaatcttactaa

SEQ ID NO: 45136 - DNA, 1467 bp, Glycine max
  Peptide Sequence Number=SeqID_161914
atgaatgagttactactgaacttggaaagctacctctacctccatccaagtgaaaacccagccgtggcactcgtttctccagccttagattcgagcaactatcattcatggagtaggtccatgatgacagcattaagtgtcaagaacaaagtggaattcgtgaatggaaaagcaccagagccattgaagactgatagaacgtacggggcgtggaatcgctgcaacaacatggtggcaaaggaaatttggaatgacttgaagtctcgctatgcacaaggagaccttctaagagtttctgatcttcaacaagaagttgtatccatcaagcaaggttctctttcggtcacggaatatttcacaaagctacgagtcatatgggatgagatcgaaaacttcagacctgatcccgaaaggcaactggcaggtaacaattctctaccaagcttcaatcttgaaactaaagaaggaccttctgtcaatgctgtcaaaagtatttgtgaattttgtggacgcattggtcataatgagagcatttgctacaagaagcatggtgtaccttcgagttatgacggaaaaggcaaagggtttagcgcaagaaatgggaagacatgtacatactgtggaaagcttggccacacaatagacgtatgttacaagaagcatggatgtcccccaggattcaagtttaccaatggcaaagcaatagctaacaacgtagtggcagtagaaggaaaggccacaaatgaccaaacacagcaccaagaatcccaagaattggttcgtttttcacctgagcagtacaaggccttgttagctgtaatacaacaaccatgtgatggaaactcagcatcaactaagtcacaggttgcttccatttcatcttgttcaaatcacgatacaacaggtaccattctttcttacgaaaaagcaaattccacctcctggatattagattcaggagctactgatcatgtgtctttttccttaacaaactttcactcatatcaccagattaaccccatcacagttagattaccaaatggccaatttgtctatgcaactcactcgggcacagtccaactttctgcactcatcatattaaaagatgttctatacatactatcctttactttcaacttaatatccatatctaagcttgtgtcctctactaattacaagttaatattttcttcaaatacttgtattttacaggataccaataccaaggtgaggattggtacaactgaagtgagttgcggtctctatcaactcacacccgaacacacgaaatcacatactatatgttccattatcattcacccaaaatgtaaagttacccccataatgatgcaatcctaccccgcaagggcattggatagaagactccaagcagattggaccagagatccaagggaaggccctagggttctcatgatccttagggtagattttgagcccatgggttaa

SEQ ID NO: 45137 - DNA, 135 bp, Glycine max
  Peptide Sequence Number=SeqID_161915
atggggactcatgcctatgagatgacgtcagtgtgtccttcaaagcatgcaaaacaggagttcagcaacaaaggtttagtaggcatcaaaagcataatcgttcttgtttcctttgatgagaaaagtgataagtga

SEQ ID NO: 45138 - DNA, 165 bp, Glycine max
  Peptide Sequence Number=SeqID_161916
atggagaggatacttaaccttggtcgaggtggtatcagcagaggaagtgagtgcgtgatggaagtcttccaagaaaaatgcacgggtgagctcgaggatcaagcttttgtctgtgactctgaagggtacttacgtaacataagcacccaaaaacgcgaagattag

SEQ ID NO: 45139 - DNA, 1542 bp, Glycine max
  Peptide Sequence Number=SeqID_161917
atgtctataagcacgtccattgaacctagctcatatgctgaggcctctaaacatgattgttggattaaagccatgcacgctgagttacaggctttccaacagaaccaaacttggattctgacccaacttccacgacacaaaatgaccattggttgtcgctgggtatacaaaatcaagcacaatgcagatggcaccattgagagatacaaaacgcgtcttatagcaaaaggatacacccagatggaaggcctggattttctcgataccttctcccccgtagctaagctcaccacggtcaggttactccttgctcttgctgctctccgtaactggcatcttcgacaactagatgtcaacaacgcctttcttcatggggacctaaacgaagaggtatatatgaagcttcctccaggcctgattatggataatcccaatctagtttgtcaccttcagcgttcgttatatggccttaaacaggcgagtcgccaatggttcacacgactctcgtcattccttctttctcaaggctttcatcaatcctcagctgatcattcacttttcttatacactaacaattctcatgatataacgactattcttgtttatgttgacgacatcatcttgacaggaaacaatctcaacactataatccatattaccaagcttcttgatcagactttcaacatcaaagaccttggcattctaaaattcttcctcggcctcgaagttgctcgttccagccatggtatacacttgtgtcagcacaaatacgccctggacatcttatcagattctgacgcctcgtcggtcgccttatatatcttacaaacacttgctccgacattgcttaggtcattcaacaactcagccaatatatggccaacccaacctccacacactcacaagctgcttttcgggttctacgttacatcaaagggtctcccggttctagcattttctttgcggctcaaggaagactcactcttaaagccttcagcgacttcgactgggcaggatgctgcgacacacgccattccatcactgggttctccatctatctgggcgattctctcatttcctggcgattctctcatttcctggcgatccaagaagcagtccacggtttctcacagttcgtctgaggcggagtatagagccttggcctccactacatgtgaacttcagtggctcagctttcttcttcatgattttcgggttcctttacttcaacctgcatcactctattgtgacaaccaatccgccattcaaatagcttcaaacccagtttttcacgagcgtactaaacacatcgagatcgactgccatattgtaagggacaaggttaacaaaggcttgctgaagctgcttaccatttcatcttccatgcaacttgccgacatcttcacaaagccctttcctcctgctctttttcaaggtttccattccaagctgggaatgatgaacatccattcccagcttgcgggggctattagcagagactcatcagttagaagcttagttataagtttgttagttagttag

SEQ ID NO: 45140 - DNA, 225 bp, Glycine max
  Peptide Sequence Number=SeqID_161918
atgcaacatctaatgaagcttcttgaacgggatcagtatattcattggcacagattaaaggatgaagacatggtttgtgatatgttttggtgtcatcctgatgcagtaaaacaatacctacaaaacaaacagcgagcattcgctaagcgcaaccttcagtggctaagcgagaggaagaatccagaagaagatgagttgtcaagttcgctaagcgcaccgctctag

SEQ ID NO: 45141 - DNA, 582 bp, Glycine max
  Peptide Sequence Number=SeqID_161919
atggtgaaagttggaacctcttacgtgccgatcaacgtctcattttcgccaaaagttggcccagggcttcccggtatcaacagggacaccaggatttatttattctgcgaacaccgccggacatcagcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttggggcgaattggagctccaccgcggtggcggccgctctagaactagtggatcccccgggctgcaggaattcgatcagaattgtagagctctcagcgggcaatgccagcctgagagagctattgggtggactgaacccagtaaagccattggggtggggctgcctcaggcctcgggggcccaactactccctgaagtgtgcccacaatgtatcaagcttatcgataccgtcgacctcgagggggggcccggtaccagcttttgttccctttag

SEQ ID NO: 45142 - DNA, 264 bp, Glycine max
  Peptide Sequence Number=SeqID_161920
atggagatgtttgatgcacaggtggcctggccaagagaccagccttcttcctctagagagggtggggcctctacagcccaggagcctgtgattgaggagccaccagcaccatcaccatcacgagcagcagcaaaggagaagactactccagctcagaccccacagccatctccaccatctgcacctactcctgaggagactcagctatcaggggatgattggatgattgttttgatcaagttttccgtcattagaagaaaatga

SEQ ID NO: 45143 - DNA, 684 bp, Glycine max
  Peptide Sequence Number=SeqID_161921
atgacatccttcagccagcttcagtcacagatgcaataccagggacctcctgagcctctggttggtcctggtcccttcggtcctcgggtgagcacaaaggggagttgtgttgatccctcaggaaacgatcctgagacgggtgactctgacaggtacggcttgtacatagaagcagatcctgcccgcctggttaccgtggggagagtttatgagggatccactcttgttcataacactcctttgttgcctggccaagtaaaggtgagtgtggacaaggttaaagatgcagatgctgcagttcctgtacccactgttgaggtttccttagtggggcaggcacttcacaccttccttgcttggccgacacatcagatcaagtctttatcaaaccaggttagatgggatgccaccgtgttcggggtagttaatccagatttccccctgtacataaagaacgaagacctctctgaaatcgcacacgatggtcaatgtctcagcatatcagtgttacagttgtggattctgcatctcactgaaacatgtatgcgagcggggaattctgatatctatgaattcctcgagcctcagtccattcagaggtctgggcaatcgcagtttgaatctgaaagttacctaaagagttggatgccgagttcacaaagcgatgtgtatcttggagcctaa

SEQ ID NO: 45144 - DNA, 201 bp, Glycine max
  Peptide Sequence Number=SeqID_161922
atggagcattcccgtgagggtctgcacttaggcaatcatgaagctaagctccaaactcgaaagtggaggacacatgaacagtgctatgcaataacattcatgggcctccgaagaagggttagaatggaggaatcccttgagggtccgcacaataacgttcatggggttccgaagaagggtgagaatggaggattgccttga

SEQ ID NO: 45145 - DNA, 191 bp, Glycine max
  Peptide Sequence Number=SeqID_161923
aggatcttgaagaggacctagaggagttatctcctgaacctgctatggattcccctgacttaccagaggataatgtggacccgctccctgatgttgattctctagagaatattatgccagcatctgaggcagactctacagaggagagtggccctggagggacaacgaatagtgacgactcttcatcatag

SEQ ID NO: 45146 - DNA, 681 bp, Glycine max
  Peptide Sequence Number=SeqID_161924
gcgttacagtgtcaccgctgcccgattatagtggcaccccggcgctgttacgaacctgcggaattgctggcgggcgaatcgctgtggggcagctgtattcagctgtatacgctgcgctctgcggcaaactggggtatcggtgatttcggcgatttgcggcagatgatcgctgaaaccgcgcggcgcggcggcgcgtttgtcgggctcaatccgctgcacgcgctgtttcctgccgcaccggagagcgccagcccttacagtccctcgtcccggcgctggctcaacatcctctatatcgacgtgggcgctgtggccgatttcggtctcagcgacgcggcgcaggcctggtggcaagctgaggagacgcagcaggctattcgggcagcgcgtgacgccgcgtgggtggattacactgccgtcacccggcttaagttgcagggactgcggcttgcctggcagcagtttcgccggcgcacggcagatgatggacaggcgcaggcgtttgcggagtttgtgcgtgccgggggcgacagcctggtgcatcagggactgtttgatgcgctgcacgcggcgcgcagcgcccaggatggcacgggctatggctggcaacactggccggccgaatggcagcaggccaacagtgcggcagtgctggcattccgcatcgagcacagcgacgag

SEQ ID NO: 45147 - DNA, 468 bp, Glycine max
  Peptide Sequence Number=SeqID_161925
atgctgcaggcccgcctgccgacctcgctgctgggcattgaatgtctggagaccgagcagattattaacagtcccgccgcgctacaggggctggagatgctcaagctgcgtgggtttggcatctcgctggatgactttggcaccggctacagcaatatcggctatctgcgacggatgccgctggatgtgatcaaacttgatcgcgcgctgatcagcgaaatcgcctcagacaccgcgtcgcggattatcgcgcgcagcatcattaccatgctgaaacagctggattacaccgtactggctgaaggcgtagagaatgtcgacaccgttgccgcgctggcggagtacggctgcgatcaggcgcaggtgtacgccggggagcgtctggagcagattcagtggcaatacgatgagtctgttagcttaaagcagaatgatacttcaaaggtgaaacagaaatacccggcttag

SEQ ID NO: 45148 - DNA, 402 bp, Glycine max
  Peptide Sequence Number=SeqID_161926
atgggcagcatcaacttgcgtattgatgatgaactcaaagcacgttcttacgctgcgcttgaaaaaatgggggtgactccctctgaagcggttcgtttcatgcttgagtatatcgccgaaaatgaacgtttaccgttcaaacagacactgctgagcgacgaagatgctgagctggtcgaaatagtgaaagaacggcttcgcaatcctaaaccagttcgtgcaccccgtattgaagcgaacaagcttcgcggtatgcctgactgctacaaaataaagctcaggtcttcaggttatcgccttgtctatcaggtgatagacgagaaggtggtggttttcgtgatttcggttggtaaaagagaacgcgcggaggtttataacgaggccgtgaagcgcattctctaa

SEQ ID NO: 45149 - DNA, 234 bp, Glycine max
  Peptide Sequence Number=SeqID_161927
atgtccattggatttaatgatgaaatatgtgcaatttcagctcatcagtgggctaagcgcacatccaccgctaagtgcaactttggcatgcttaatgcgctagaagaatctggcaaagcatcaatatcaaggtcgtgcgctaagcatgagatcagtgcgctaagcgcagtagttgtcttcagccaggctcaatgcatgattggcgctaagctcaaatccacttactcgtgctaa

SEQ ID NO: 45150 - DNA, 1314 bp, Glycine max
  Peptide Sequence Number=SeqID_161928
atggcaactcacgataaatccactctggaccgcattgaagatgccatctctaaacttgcagcttctcaaatccacgttaccgaaaaacttgaagatttactccttcgagtagccaaccttgaacagaccagcactaacacccactcaccatcctcctcttcagccaacccttcacctgcaaacaccaacaatccacagaaaatgaaacttgatgttccacgttttgatggttcagacccatctggatggatttttaaaatccaacaattttttgcttaccattctaccccggactcggagcgcctcactattgcctccttctacatggaggggccggcgctggcatggttccagtggctcatgcgcaaccatcagctcacgacgtggcagagttttctcgaggcccttgacgttcgcttctcccactcgccatatgaggaccctactgggctcctcttcaagctcactcaaataggaacggtgacagaataccttacccaattcgaggccattgccaatcgcatcgttgggctctccctttctctccttctgagctgcttcatttcaggattggaccctgacatccgtcgcgaagttaaaatgcttcagcctctcaccatggtccacgccgtgggactcgcccgactccaggaagaaaagctggcagacacccgccgtccatcacgacaccgagccaccccaagccctcaaccttactttccccctaaccctccgaccatccctctgtcttcgccccctccgccaaccctacccctgttaccccctccacccaaaccaccacctatacccctgaagcaccttaccccgaccgagatggctagccaccgcgagcggggcctctgttttaactgtgtcaagaaatttatgcggggccaccattgtgcctcacgcttcttcgttctcatcgcggactcagagcccccagacaacacccctcaacccaatttatctcccacacacccagaccctaatctaaacccgcaacctgacgacccaacccagcccaaaccaccccaagcccaaattagtttttatgccctctcgggtcattccgcctcggagaccctacggttattgggccacattggctgtcagcccgtcgtgatccttgtggacggcggcagcacgcacaactttgtgcaggctcgcctcgtccgccacctgggccttaccgccacccccacaccacccctgcgagtcctagttggcaacaagaacgaactggaatgccatctactctcctctgctacctccattcgcatacaaggccataccttcaaaacagacctccat

SEQ ID NO: 45151 - DNA, 231 bp, Glycine max
  Peptide Sequence Number=SeqID_161929
atgtctgcccaagattttttgattatttttggaaatttggaaatctgggttgatgacccttctaaattggttttttgggtagatgacccagcctgggttggtgacccagaagaggttgatgatttcttgatggttggctctggaagagccagtctggctcctttgcctgtactccttcctctccttagggagattcccgatgccttaggaggcattaccacttttttgtaa

SEQ ID NO: 45152 - DNA, 2484 bp, Glycine max
  Peptide Sequence Number=SeqID_161930
atgcttcagtccggcatcattcgaccaagcacgagccccttctcgtcgccggtgctcttcgtcaaaaagagagatggctcttggcgtttttgcgtagactacaaagccttaaacgccttgacaatcaaggaccgctttcccattcccacaatcgacgagcttttggacgaattgggaggcgcaaaatggttctcaaagctcgacttaatgcaaggttaccaccaaattctcatggcggaatccgacatcgggaaaactgctttcagaacgcaccaaggtcattacgaattcctcgtcatgccctttggattgtgtaacgcaccttcgaccttccaagcaaccatgaattccacctttggtccttacttacgcaaattcgtcatcatcttcttcgatgacatccttatctacagccaaactcatcaactcttcctcaagctctcaaagtgcacttttgcggtcacagaggttgaatacctaggtcacattgtctcccaacatggtgttgcaccggtgccggcaaaaatcacggccatacaacaatggcccactccacagtctgccagagccttgcggggtttcctcagtctctctggcttttacaggagattcatcaaagggtattcctccatcgcgacacctttgaccctcctcctagccaaagactctttccaatggaatgacagcgccaccgcggcttttaatcaactcaaggatgcattatgtcgggccccggtactcagcttgtcggatttttccttaccttttttcatggaaacagacgcctccggtgtcgggatgggtgtgatgctttcccaaagaaatcaccccatcgccttcttcagcaagccattctgccccgccctccttcgcgcctccacttatgtcagggagctcgccgccatcacggcgaccacacctgaacaacaccgctacctggcccgcctcttgggttatgatttcaccatccagtacagggccggacgggaactgaagaaggagctgaatcgggacccaacctttctggattattgccaccgtattcaagcaactcctgaggcttacccagattgtgtgatccatcagaaactcattctgcagaagaggcatttatggctacccaaggattccccaatcatacacactatcatctctgaatttcacaatacgcccactgggggccacatgggcgttgcaaagaccacggcacgcgtcgacgagaactttatttggccatctatgaggaaggacatcaaactcttcgtcgctgcttgtctggtttgccaacagactaagaatgaccatcgcaagagcgccgaactgctatgcctgttacctgtgccggcgagacccaaggaggatttgtccctcgacttcatcgtaggccttccctcatatcaaggccatacaactatactagtaattgttgatagattctccaaaggcgtacacttgggattactgccaacccactacattgccttcaaagttgccagagtgttcatggaagtctccggtaagctccacggtcccccacgaagtctcgtctctgatcgggatcctctgttcatcagccgtttctgggcattcgttcacgacaaaccctcaacatggggtcgcttcctaatgtggatggagtggtcctacaacacctctgtccactccgctacaggcatgtctccttacgagattacctttgggaagaaaccacccaaccttcctcaatacgtggcgagaaattcaaatatagacgttgtcgacacttggttaactgatcgcgacttaatgttcaaaagcttgcgacacaaactgttcaaggcccaacaacacatgaaagaacttgcagacaagcaccatcgcgaactccacttcaccgaaggagacatggttctggtaaaactccatccaagacgccaatccaccgtcgtgggcgccccatacacgaaacttgcaaaaagatactacggccccttccaagtcattcaaaagctcagcccagttgcttacaagcttaacttaccccccacttcacgcatacaccccgtcttccactgttccctactccggccttataatccaccattatcagcactagacacccccatcatgctacctgagtcagcagaagataatcaaccacttgtcacgcctctcactatactggattccaaatggtccggctcaggggacgatcaccaactgctcttgctggttcaatggtccggcctctggtcggaggacacttcgtgggaaccttggcaccttctcaaggaaacctacaaccttgggggcaaggttgttttcgatgcgcatgggaatgttataaccagagacatgaaacaacaagaagcagaaacagaaccaatatcagagctaaaaccagcaacaatgcaagaaaaggaaccaaaagcaaccacagagacaagaaggccaaaaagggaaattactaagccacagtacctgaaggattttgtggcaaaatga

SEQ ID NO: 45153 - DNA, 165 bp, Glycine max
  Peptide Sequence Number=SeqID_161931
atgactgatttttcaggagtctctgctttaattgattaccaggtgattataactattttctctataaataacaagctggtgttcacatctaaacaatctaaaaatcaagagatcattaaagaatactcattacatctcaaaaattacatcttaacctcagaatga

SEQ ID NO: 45154 - DNA, 694 bp, Glycine max
  Peptide Sequence Number=SeqID_161932
atgtctcgccttctcgctcagcaaacctcaccgctaagcgaaaagaacgaaacgttcttaatgggtgtaacgtcaattacacccactttccaaaaatttgtgccctttctgctccctctctccctgaaactgctctctgtgcgtttttgtttcttttgctttgcatccttttgttctcatcaatcattcgcaacacaagtgttgatcagagaactcgctaaacgtgccttatgcgctaagcgagtttatttcttgaggatgaacactcatccgcctggtacagtacctgtggctaaatacactgataatgtcctgggaagacatatattagctgagaggaaagtggaaatatataatacagagctggatgaatttaaggctgaattggagaggcgtaacttccataagcgcctcaccaatttagctgacagtagcattgacctagcattggtgaaggagttctacgccaacctctacagtcctggggggccttcaccaaaacaagtcagaatccagggccacttgataaggatttgtgcagacaacctcaatgcctttttagaaacacctgtggtgcttgctgagggtgaatctttacccgcttactcaagatactgcaggatgcctactgacatcagggaaattgaggctgctctgtgcatacccggcagagggtttattttaaatgctgaag

SEQ ID NO: 45155 - DNA, 516 bp, Glycine max
  Peptide Sequence Number=SeqID_161933
tcggagcagaagacccaggctggctttgtgtcagcctttgataagaacattattaggttagttggggtgcagaaagctagggattctgccaaagttgccaaatggagggctattactcgtactctttggagaatggagcgccctaaggtgtccaatgtcactgttgcttttgctgaggccataaggttgaaccgccaactgtcttccaaagtggagaagaaagacttgggcggtaaggtggagagcattgcgattgagagggatgagcttgtgaaggtagttgttgagttagaggcccgacttgaggagttagagtccaagctgaataagtccaagccggaggctgccaaagagagggaagtcagcaaagagcttgagaaggagctcctcgatgtcaggcaggccagtttctttgctaaggaccttgacttaggtctctttggtcctttcaaggatggtgtctttcttgatgaagaagacattaatgcgaaggaagaggttgtcgatgaagagtag

SEQ ID NO: 45156 - DNA, 870 bp, Glycine max
  Peptide Sequence Number=SeqID_161934
atggtggcgtctctggtgctctctggttgctctgttagggttcttgtgcgtcagaaaagagaaagggacaaaagtgttttttacggctgttacactgagcatgtatggcaacacatcaccatggacttcattgaaggtctccgtctttcttttgttaaacaagtcatttttgcaatggtagataggcttagtaaggcagctcatttcatggccttatcacatccttatactgctgctgatgtggcccaatgcttccttgatcatgtctttaaattgcatggttttcctgaaaccattaccagtgatagggatcctgtttttgttagccacttttggaaggaatttatgtccttacaagggattcaagtacagctttctacagcctatcacccacaaactgatggtcaattagaagtggtgaatagatgccttgaaacatatctcagcactattaaagcaagtccctatgagattgtgtatggccaagctcctcttgttgatttaccttatctcctaagtgaattgaagattgctttggttaataggagtttgcagaaacgtgatgaaatgttaaagttacttaaattccacatgaaaaggacccaggacagaatgaagcaacttgtagataagggcagatctgataggagttttcatattggtgacttggtttatgtaaaattacatgcttatcaccaagtttcagtgcaagccatatccaatttgaagaagtttactggtactgccacttctgggaactttagtccttcacctttattggatacctctcaaaaggaacctgaagctatcactgacagaatgacagtcaagaggagaaatcgtgttgtaaccaaagttttggttcaatga

SEQ ID NO: 45157 - DNA, 636 bp, Glycine max
  Peptide Sequence Number=SeqID_161935
atggatttgcagcagagcgagttcgatcgcctcctgttcttcgagcacgctcgtaaggccgcagaagccgaatacgagaagaaccctctcgacgctgataacttaacaagatggggtggagctttattagagttgtctcagtttcagagttttcctgaatcgaagaaaatgacccaagaggctgtttcaaagctagaggaggcgcttgcggtgaatcccaagaagcatgacactctttggtgcctgggaaatgctcacacttcacaagcatttttaattccagaccaggacgaggccaaggtttattttgataaggcagctgagtactttcagcaagctgttgatgaggatccttcgaatgaactttaccgcaaatcattggaagtggctgctaagggtttgaagaactcagaccagccactccctcatatacttctttcttcctttgttttttctcttttcttcacttcttcctgggacattttgtggccaatgtcactttctgattatgatgatttaacatgtggagttggtgctggtgagccttcaacctacacttggcagcaaccaagattgaagaaagtcactgctagttctaaaagggaattgtacaagatgaagaggaagatgatgtag

SEQ ID NO: 45158 - DNA, 234 bp, Glycine max
  Peptide Sequence Number=SeqID_161936
atgtctgcctccataattcggttgataaaaggatgtcaacgggtagtctgccctactggacgtgcttatcgccctatggatgtagccgaagtggactcttggacttcacacgactttgagaggtgtctttttctagagaacatgagggggacacgcaaaataaaggatgccaggtggctgagcgtccacactcctattacaagaatgacgcggagggttaacaaatatctctga

SEQ ID NO: 45159 - DNA, 126 bp, Glycine max
  Peptide Sequence Number=SeqID_161937
atgatgaaaacgccacctgttcaagattatattggaaatggggatttaccgcctgataaggaatttgacccaggcatatttaatacgtatagcgaatacacaccaaaacaaggttttatgacataa

SEQ ID NO: 45160 - DNA, 177 bp, Glycine max
  Peptide Sequence Number=SeqID_161938
atgccccaaccacatgggatcaacatgggcttaaaggagcactcaaaccgagtatctttacccccaaggcctagactccgaagaatctgtttgggcctcaccttcctgattcagccaattctattatccaacaatccctacacctatgaatttcatgacgagaaatcacccacgtga

SEQ ID NO: 45161 - DNA, 732 bp, Glycine max
  Peptide Sequence Number=SeqID_161939
atggatgcatctgatgttcataaaactgcctttagaacttatgggggctactttgaatacttggtgatgccctttgggcttaccaatgctcctgccacatttcagggactgatgaatttagtttttcagcattacttaagaaggttattacttgttttctttgatgatatactcatgtacaacagaagtatggaggaccacctttctcatcttcatcaagttcttcttactatgagaactcacagtttgtatgctaagaaatccaaattctactttgatgttgacaaggtggaatatttgggccattttataactaaagaaggagtttccactgatccttctaaaattgcagtagtacaagattggcccctatcacaaaacttgaagcaattgaggaatttcttgggtcttccagcaaaagaagcatttcaggaattgaagcaaaggttagtaacaacaccagttttggccctatcagacacccaattgagacaggatattctcacttggattcatgcttcaacttgtggtggccattcaggtagagatgctaccttgcaaaagatgaaaaatttggtttattggagaggcatgtccaaggctgtcaaattttttgtgtatcaatgtgccacttgccaaaggactaaatatgacactgctgcatctccaggactgcttcaacccttacctattcctgagtgtggcaccctctacccttacaattataactaa

SEQ ID NO: 45162 - DNA, 393 bp, Glycine max
  Peptide Sequence Number=SeqID_161940
atggatcgaatcgacacgatgaagtttgtgttggagcgctacggcaatgatggcaaggagttggacgtggatgcggtggactccgaggggaggacagcgatccacatggcggcgacggagcgggcacgtgaaggttatcaaaattatacctttgggatgcctcacactggacggcaaactgtggacgacggcgccgcaagagaagttgcgagaggaaggaacctagaagctgtgagagaagctgtgataaagcaagaacaagaagatgatggacaccaaaagatagacgacgatgccgctgcgagagaagttgtgagaggaaggaacctagaagctacagctgcgataaaagcgacgagcctgcgagttgcgacgaagagagaaactttctaa

SEQ ID NO: 45163 - DNA, 306 bp, Glycine max
  Peptide Sequence Number=SeqID_161941
atgtcagaacttacacgcaattctcctcaaatttcaaccagcccgcatcaattagaccttgcacattatgcttcagggccctacaatgctcaatggaatgccccaaggctccttcatgataagcacacgttgtgttcgagtcgtatcctcagagaaatggaggttgaggaaccttggttggggttatggctaccattgcattatcaagtgagttttgtggttgatttagggatggcctttgtggataattgggtggtgggtaaggagaagggttgttattggctaagtaatgacattgttgggttg

SEQ ID NO: 45164 - DNA, 204 bp, Glycine max
  Peptide Sequence Number=SeqID_161942
atggacacgaaattccaacctgagattgatcggacgaagttacctcttgaagttgaagaagaagaagttacctgtcccccgtccaagcaccaagagccttatgttgcgcccaaggcttttaagaaggatccaccaaaagggatcgaaattcttcctcctccaaagtggaagtgtgatgtgccattattttctcctatttcttaa

SEQ ID NO: 45165 - DNA, 582 bp, Glycine max
  Peptide Sequence Number=SeqID_161943
atggaggtcatgaaagagcaaatgaccacaatgatggaagccatgatgagtatgagaaggatgatggaggtcaatgcagctacaattgttgccacaagtaccaccacagaagcggacccaacccacccacctggcttcaatcaagtaaatcatccagcctcggatatagtaggtcagggaggcaaagtgttaggaagtgcgggcggcccccattttttgcaggttcagaaaaaacattcattcccaccatatggcttgcctcccaactatacaccaccaaatgttgcacacgctcctgatgagaatgtcgataactcctctcccatactcattgagagccaacaaccccaatctagtcaagcacaggtccctcaacccatggggagacacatgaaactgcttcttggcatggtggaaagggagaaatttgatcaaatagaggaaatgttaagggttattgaaggaggcggagattattcctttgctgacatggcagaactatgcctagtgcccgacgtcgttatcccttcgaagttcaaggtgccggatttcgataagtacaaggagactacttgcccttag

SEQ ID NO: 45166 - DNA, 597 bp, Glycine max
  Peptide Sequence Number=SeqID_161944
atgggcccaaaaaagagcgaaattattaggattcctatcaacaacaacattgagtacgcgaagaaggtctttccaaaagactggttcatccctaagaaatgggtgaactttgagaatctgatggaagaggaattttctgtcaaagacctctttgatcatgagaaagatataacgcaggagacggtggacattatgctatatcaaaagttgcatccaaataccattgacaagaaggccttggtcggcttcttaaggaatgtgaacctcgagtatatgtgcagattcatccataattttttgttcaacatagtgatgcctagactgggatcaagagattatcattcaaggacaaatttcaagcgaaggacaagaagaaccttattccttatgaggaacggtggggtagatgtgtttgagttggaaccgtctacaggtgctacacagctaaagtgtgtgacctttgttaagatggggataactgacaacttcccaaaatatgctcaaaatcatatcaaaagtaaaaggtcaagaaaaagtcgaagaaggaaccatagtcagtggcttgacaaacggaaggggctcaagagcaaccaatga

SEQ ID NO: 45167 - DNA, 651 bp, Glycine max
  Peptide Sequence Number=SeqID_161945
atgacaaatagaaagaaaaataataaaatacataagcttactaatgatctaaaagttgaggtagaagggcaacaaggtctgaatgctactgcttatggttacttctcaaatatgtttaagtgtacccaaagcaactatgatccattggttagtatagtgcagccctatctcattgagaaggacaaaataaaacttgtggaacctttcactaaagcagggtttgagaaaacattattccagatgcatccagggaagtctccagggcttgatggtctcaatgttgtgttttatcaaagactttgggctcttcgtggatcagagatagcaatcgcctgctccaaatggaatgtgattgatactggtaaaagggatgtgttgaattcccttcaagtcaaagaaggccttgagtttgggagatatcttggagttccttctagggaaaaacttggtatgaggaagagtgtaggtgggaagagattcagaaacatctatgcctttaatatagctatgcttaggaagcaaggttggaatttcatgactatcctagaggctcttgttttgcacatctttaaggccatatactatcctaagggggacttcttggaatccaagctaggtcacaaaccatgttacagttggagcaacatctag

SEQ ID NO: 45168 - DNA, 144 bp, Glycine max
  Peptide Sequence Number=SeqID_161946
atgttaaagtgcagcaaaggcatccgaaaggtcctcttaacgaacatgatgagtgcttatatagcttgtgccgctagccctcgctttgtggtgacgagccctggctcgagggggcgtgttgagagtcccacatcgggtggttaa

SEQ ID NO: 45169 - DNA, 180 bp, Glycine max
  Peptide Sequence Number=SeqID_161947
atgagcgttgtcttcttcctccgtgccgagagtccatgttctgcgaccgcgccaccgttggtgttgagtagcccaggcaaattgagggtggtgttctccctccgtgcgtcggcattgtcgaggtgcagagatgatccatacatagtagttagcaatatagaagattacggatcaacttga

SEQ ID NO: 45170 - DNA, 195 bp, Glycine max
  Peptide Sequence Number=SeqID_161948
atgcttatgcattcctatgttttcccctggactgctagaccccgattccttatgatagccttgcctagtcctgatcaagcctcatcagcagattcctcttcacaacaacttagtcccgaactatcaaggactttagaatcagaccagtttccattgttgaatgaccctaacaaagcatacatctacatgatcaag

SEQ ID NO: 45171 - DNA, 435 bp, Glycine max
  Peptide Sequence Number=SeqID_161949
atgcgagcggggaattctgatatctatggattcctcgagcctcagtccattcagaggttccactgcagcggacattggcagatggtggtcatcctgcccaaggaacacttagttttctggttttgttcattgcataacaggccagacaactaccttaaggggattattaatagtgctaccaagggtcttgatgatgctccacagcctaaatcaaaggctcctgctaggtggattgtcgtcaagtgtaatagacaaaaaggaactactgagtgcaactactatgtcatgcactggatgtccaccatcattttaggaagttttagaaataattgggaagcgtattttaacgaccctagaccattggagcctgagagattaaaagcattgcggatccagtgggcacagttttatctccgaattagagatcaggcctag

SEQ ID NO: 45172 - DNA, 417 bp, Glycine max
  Peptide Sequence Number=SeqID_161950
atgttgggtccttctactgaacgcttgatttatctagccctactctatctagttctaaggattaatacattttctaatgctaaaaatcctaactttgcacaccaatgggtgatcagaccaaaagcatgcaataaaatttcccaacagagatacttagccttccatcgcaaggcaacacctttcagctacaagatgagggttaagaagaaaataacatattacacagtggctcgtttagcgccagttttgcgcttagtgcgagttagtgaacatcttctgagcgagctgggcgcgcttagcactggaagagacaaacgcctcgttaagcgagctgatgacgcgctgagtgtgcagatgcttctcagattctcctccagattctcccaactcgctaagcgggctgagtgccttgcttag

SEQ ID NO: 45173 - DNA, 1326 bp, Glycine max
  Peptide Sequence Number=SeqID_161951
atgtctcatcgtggccgtaacaccgccattggcgccggtgtgggtgcggtcggcggcgccgttctgaccggcggcagcaccttcggtaccctcggcggcgcggctatcggcggcctgattggtcacgaagccatcgacaacggcctgcgcgacaaagtcatggcgatagatgccaccgtcgaccaccagcgcggcgcagacaatcgcatcaaatttgccggtttcggccaggcgtttggccagcagcggcatttcaaacgcgccggactgacggcttcatgtgcaaagccgtctggcgcaaaggcgagcccgatcgctggcgtcgattcccttcacctgtatctgcgggtctcagttatcactgagaggccgatcgtgctcggtagcggcgtgtccgggctttgtgttgccacgctattggctgagcgcggcgaaaccgtcgaggtcattgatgatgaagcgcgtcagcctgcctcgtggtttgccggtggcatgctggcgccgtggtgtgaagcagaaagcgcgccagcggagggtacgttagtgctggcaccgccgcgtgataacccggagttaaaccgcttcgcgcgcatgacgacggcgcatcaatgggttgatccggcgtcgcttgaaccggcgctggaaaaccggtttgcgcgcggactgtttttcccgcgcgaggcacatctcgatccgcgccgcgcgctgtctgagctgcgtgacaaactgctgcagcgtggcgtccgctttgatgcgcgccagccctcgggccggatcattgactgtcgcggtatccatgccagagcgcaactctccggcctgcgcgcggtgcgcggggaaatgctgatcctgcagagtcatgaggtgtcattttcccggccgattcgtctgctccatccgcgttttccctgttatctggtgccgcgtcgcgacggccacttcatgctcggtgccaccatgatcgaaagcgacgatgccagcgctatcagcgcgcgcgccatgatggaactgctcagcgcggcctacaccctgcatccggcgctggcggaagcgcgcgtcatcgaaagcggcagcggtctgcgtccggcatggccggctaatctgccggaaatccactatcacaacgcgatgaatattcagcttaacggccgcaccatcagcactgaggccaccagcctcagcgaattgctgatcgaacagcaaattgacgcggcctgtgttgccactgcctgcaatggcgattttgtgccgaaaagtcagtatgccagcctgcagttacaggaaggctggcagctggaagtcctgtcaccgatgcagggaggctga

SEQ ID NO: 45174 - DNA, 1256 bp, Glycine max
  Peptide Sequence Number=SeqID_161952
atcgccaccgattcgcccagctgcaccagcttcgccagatagccctcaacggcatgatagggcacgccggccatcgggatcggttcaccggcggacgcaccgcgtttggtcagcgagatctccagcagctgcgatgcgcgtctggcatcgtcatagaacagctcatagaaatcgcccatgcgataaaacagcaggatgtcaggatgatcggccttcaggcgcaggggcagccgggatggatggttatcacactggcggataacgaaagggcagatgttagcatttttgcgcagcccgcttcatccgccagccgatgtttctggctggcgaccatatcaaattgcgacaggcgcagtaagcctgccccccagcagcaatccgccgttgtgcctgcaccgaaaggggggtttttactggaaccttctcacgccattcagccgatgtttggcgactttgccggtaatccggcggcagaacaatttatcgatcagatggtggcgaagcacggtttcaaccgcgaccagctgcatgcggtcattggccaggcgaagcgactggattacgtgctgcgcctgatggatcagcaggcgccgagctatacgccgccgaccgggccgaacggcgcgtggattcgctatcgcaataaattcatcaccccggataacgtgcagaacggcgtcgccttctggaatcaatatcaggatgcgctgcagcgcgcccagcaggtgtatggcgtaccgccggagatcattgtcgggattatcggggtggaaacacgctggggtcgggtgatgggcaaaacccgtctgctggatgcgctggcgacgctctcgtttagctatccgcgccgtgccgcttacttcagcagcgagctggaaaccttcctgctgatggcgcgcaccgagcaggacgatccgctggatctgcgcggctctttcgccggtgccatgggctacggccagtttatgccgtcctcctataagcagtatgcggtcgattttaacggcgacggccatatcaatctgtgggatccggtggatgccatcggcagcgttgccaactactttaaagcgcacggctggcgttccggtgaaaacgtcgccgtgcccgccagcggtcaggcaccggcgctggagaacggtttcaaaacctcttattcagtgaatacgctggcggccagcggtctggcaccgcaggctggggcaggcggtcgcccaggcgcgtcagggcaacatgctttaatactgtccttataa

SEQ ID NO: 45175 - DNA, 360 bp, Glycine max
  Peptide Sequence Number=SeqID_161953
atggtctctggtaatcgattacaaagggagtgtaatcgattaccaggcttgaaaggtcaggaagctaggagagctgctagtaatcgattaccaagggggtgtaatcgattaccaggcttagaaatgaaggcagcaggttgtggaggcctctgttttcatgtcctgaagctgtataattcgagtttggcctctgatgaacccgcgcgcacgcttcagcgtactgtggagtggatactacccacggctacaccataccgtctagtggagccagtccaagtgattgaggtaacgtcatccgaggaagaccctaaggaggatctcgaggagctacctcctgagcctgttgtggatgctctttga

SEQ ID NO: 45176 - DNA, 558 bp, Glycine max
  Peptide Sequence Number=SeqID_161954
atgcgtaccagcaatgtcttgcctagcgatcataactctaatctctctctgcttaagtgccagttggtgtatgccatcctaacacagatgagtgtccatgtggcccaggtatgccacccaccaggcaccctctggacccggataagtctaacagggccctgggtttccgacattgatcacgggcctctgccagtcgttcagggttcccgtcaccccagtaaagtgatccgaccgccgatcaccagggacttcatcgagaagtactgcacgcctaggcaggcgcagggtgatggatatcaggctgcaaacgcaccgccgccacctcggcaggtcgaccccactggatcactaggcatggagcgttatctacaacacttggttcgccagcaggcggccaaccaccatgggcaggtgcagatacatgagtgtctctaccggttcagcctcagtcagcaggggcagggttccgccgagaatgggttttcctttgccggcagtcacttaccttgccgagaatttatctggtctgaagattttccattccctatctttcattga

SEQ ID NO: 45177 - DNA, 357 bp, Glycine max
  Peptide Sequence Number=SeqID_161955
atgaaaatcgcctcaatcaagaaagcatatggatttgtggagtgcccaatctacagagcctatggttctggtgcttcgctgcttctggatggcagattggaggagttgattaactactttcaagggtcacttaatgtgaatcagtattgtaacaatttgaaagctgagggtggtggcctgtctggtcaggctcaggcaatctctcttggcattgctcgtgccttgctgaaggtgagcgaagatcatagagcacctttgagacaggaaggacttcttaccagagattccagagtggttgagaggaagaaagttggtctcaagaaagctcgtaaagcccctcaatattccaaacgttga

SEQ ID NO: 45178 - DNA, 513 bp, Glycine max
  Peptide Sequence Number=SeqID_161956
atggacagtgtgagagtatcaaatgagctgggggctggtgatttcaaggctgcaaagttttcagtgtgggtggtttccatcacatcagtgttcataggtgttgttgccatgatcggagtgctatcaaccaaggattactttccctacttgtttaccaccagcgttcctgttgccaatgaaacaactaggcttgctgctttgctcggtgtcacagtgcttctaaacagccttcaaccagtcctatcaggtgttgctgttggggctggctggcaatctctagtagcatgcatcaacattgtgtgctactatgttattggattaccggcagggataatattgggatttccacttggtcttggagcagagggtatttggtcagggatgattgctggcatagttttgcagactacaatccttataatcgtcacttcaatacgcaactggaaaaaagaggctgaagaagcagagagccgcgtgaaaaagtggggaggagcaattgcatatgatcaatga

SEQ ID NO: 45179 - DNA, 354 bp, Glycine max
  Peptide Sequence Number=SeqID_161957
atggcgctcttacggcggccggtgccaatgattgtctgcgcggcgaatccacctgggagcctcgacttgacgtacttcttcaggtcctcagtttccggttcggcgagtgcggtggcggtgacgacgagggaggagggggttttggggaagggggagacggagagagagagggattcggttctggcgaaggagagagtgcagggtctctgggaaatgtgggaagagaaggagagtgaagagagggaggttgtgagcgccgatagagaaaccgccattgtgttccttccactgcctttgcaaaacagaagctcgacgacacaaggatgtagccagaacaaggggataacgatttaa

SEQ ID NO: 45180 - DNA, 305 bp, Glycine max
  Peptide Sequence Number=SeqID_161958
ttttggatgcgggacttgaagaactcgtcgcggccctgcttgtagaaatagtcttgccggtccttcaagggaccgatcaccgggaacccgcagtcgccggggattttgcggatggggagcttgcttggctcaggggagtcgaaggaagggagaggagagcgtggtggaggctgaggatgccatttttgatgggaagggagagggctattgctactatatatatagagagagatgatgtgctcaccagtgatcactcaccattcaagagcgcggtctcttttattcacctgaaaaacggagactag

SEQ ID NO: 45181 - DNA, 309 bp, Glycine max
  Peptide Sequence Number=SeqID_161959
atggaggggactgtcttcactcctgcactgcaagaaattgagcatgtaaagtctgatcaaggagaaattctgagcaagcttttcttggatgcgtgcaaacacatattgcctgcggttgcttctggaggaagcaaccttgctcgcctaggcgagctgggtggcaagctcctcccctattttgctataaataggggaaggagtgaagaggaaaggggttcagccttcttggcacttcttattctctcgaaattgttgaggaaaattgtttctgtaaagaaaatccaagccaagacgcttcctcttcaactg

SEQ ID NO: 45182 - DNA, 339 bp, Glycine max
  Peptide Sequence Number=SeqID_161960
atgacatgcactccacaccatagatatgcatttcgtcatgacaagtctacactccacaatatagatccaccctctgccgtgacacatctgcaaaggacttcgccatcactccttgacgacatcgaaaagattcctaataagatgtcgtcgaagaagactttactcgtcacaaatgtcaacttccccatcagtctcgtcgagaaaacgcccctgcatgtcgtcgttgagatggtagtagtgttgctggaccaccatgtggacaccaatgtccttactctgggaggatgtgaccccgctggacatcctcagaaccctaacatcggacttcctcctagataa

SEQ ID NO: 45183 - DNA, 321 bp, Glycine max
  Peptide Sequence Number=SeqID_161961
atgaaagatgttttcggaaaagggaataagtcagcttgtggaggagtgttgcaagatcacaatgtatctttcatttgtgggtttggtgctaatcttggtgggtgcttagttctcattgctgagttgaaggcgatgatggttggtctcaaattggcttggtcaaggaggtttcagaagatttgcgtgaacttcgattctcccttggaagtggaacttctttctgaagaaagccaacaagttgcatatggtttggctaagcatgctatggaagatggcttcactagtgtttttgaatttgctcctagttttgttctcgaagtt

SEQ ID NO: 45184 - DNA, 516 bp, Glycine max
  Peptide Sequence Number=SeqID_161962
atggggagaggggtccagtgtttcagaatgtttggagaggatggttactgggtaggagatgaagatgacgccgagtgtggagttccggtaacgaaaatgagaccgccgcagcagcctttgggttttccggtgatgccatatgggaagccggaaaagccactttcaaattcaaaaaatcttgatttggaagaagatgtaaggaaggaaactttgaagcaagggggatttattaatgaggatacaaatgagaagaagcagcataagggtggtatcatcattaaaaagtctacaactacaaggaaattctttggcacgataccagttaaaggaggcataggagggtatcttgttcgtacaataaaggaagctttgggaggtagcatatgtagtggtgtttgtgttgttaaagatgacaaggctgaagcaaatcatatatgggatatagcgacaaatatgagggtgctatatgctagaaacaaggagcaaagatggaaagtatatgtagacaagccgtag

SEQ ID NO: 45185 - DNA, 999 bp, Glycine max
  Peptide Sequence Number=SeqID_161963
atggagagaaggagagataataacaatgtagcaattggtggaagagatatgaacactttcaataagttcactagagatttagaagtggaagatatttcgttgcaatcgtttgatgtccaaggaagagttgcatacatatttaaagaaaaactcaagcttcttaaaaaggaactaaaaaagtggaacttggagaaatttgaaaatcttgaaaaacaatgcaagaagttgattgccaaggtaaatttcttggatgtgatagatgaagaagtggggttgacgaaagaagaaattgaaagaaggaggatttgtgagggggaatattgggagattgccaaaagacatgaatctttcttacaccaaaaatcaagaactaagtggatcaaggatggggatgggaatacaattttgtttttccataacgtgattaattggagaaggagaaaaaatgccattaaaggtcttcaacttggtggtcggtggatagaagatccatgtagggtaaagagagttaaagaagtagtgtgggaaagtggtggagacaagagtctggtgctagatgctgaaaattcttcgttcatcactttgatccctaaagaccttactgagttttggcctatatccttgataggggggaggaacatgttggatagtatccttattgtgaatgaggtggtggatgatgctaagaggaggaagaagccatgccttatctttaaagtctattttaaaaaggcatatgattatatttgttgggatttcttgatatatatgatggtgagaatgagctttaatcataagtggatctccgggataaagacatgtttggagatgacaaccatttctattcttgtaaatggtagccctacggaggagtttaaaccaaggaaaagattaagacaaggagatataattgcttctttcttatacctaattgtagcagaaggcttaagtagtctcatgaggcaagcgttgaaaattgggaagtatgttggacataag

SEQ ID NO: 45186 - DNA, 282 bp, Glycine max
  Peptide Sequence Number=SeqID_161964
cttgggaggattgatggggacccggtattgagagaaatgaggatatgggctacgtgggagtacgtgagctcagttggaggtgggcaacaggggatgagtggtacctggagatatgttgcgggggtcaggagaccttggggacgtcaggcgagctcctggcagtcaacagataaaaggaaaacaagaccacaaagcaaggaggcttgtggtggctggccagctggggctaagatggtctctggtaatcgattaccaggggatgtaatcgattaccaggcttga

SEQ ID NO: 45187 - DNA, 1140 bp, Glycine max
  Peptide Sequence Number=SeqID_161965
atgtcttgtgtgcttgttatactaatggataagtatgtctcggaagtagttattagtgtcgtgaggttattggaatgttgcttgaagctcctaccacctgagaagcttgagcaactggatatccctgtggaagaagaatcttctagtgttcctgttggtgaagttttatacatgtcagagagtgataggtcttttgtaggagggagtgttacgttgtctcaattgcgtacagaggacacgaggtttaatttgtttactggaaatcaaacatttgaccagagagatcaaagttttgaggtgaaagaaacattggcggtacattgtgggttctacagtgtgaatggagggtttaagatatctgatgaagataaaagttacatgcaaggttgcaaagttgttgtatctacttgtgcatttggtggtggagatgatctgtatcaacccattggaatgtctgaggcttcgcttaagaaggtttgctatgtagcattctgggatgaaatcaccctaaaagcacaggaattagtggagcgcaggattggggaaaatggattcattggaaaatggcgtgttgttgttgttcaggatcttccttttgccgatcaaaggttgaatggtaaaattcccaagatgttaagccatcgcctttttcctcaagcaaaatactcaatttgggtagactccaagtcccaattccggagagacccactaggtgtgttggaagcactcctttggcgcacaaattcattacttgctatatcagaacatggagctcgcagtagtgtctatgatgaggctaaggctgttgtcaagaagaacaaagccaagccagaggaagttgaagtgcaactgaatcaatacagaaaagatggcttgcctgaagacaagagatttagtggaaaaaaagctctatgtgaagcctctgttattgtgaggaagcatacaccagtaactaatctattgatgtgcgtctggtttaatgaggtggttcgcttcacttctagggatcagctcagcttcccgtatgtcctgtggcggctgaaagcattcaaaaacatcaatatgtttcctgtttgtactcgcaaggatcttgtcaatagtatgggccatgtccgcaaggccaaacctttgcaaagctga

SEQ ID NO: 45188 - DNA, 177 bp, Glycine max
  Peptide Sequence Number=SeqID_161966
atggtaaaatcaaatgccattctcaaagatcccgtcttcaatttggctacacctggggggaaaatcatttttccaaactacagaacacagatatcatctggtaaaaccaaaggacataaaaatcattttcagactcaacgcatggaaacacaagacaaaccagcaaccctcatctaa

SEQ ID NO: 45189 - DNA, 435 bp, Glycine max
  Peptide Sequence Number=SeqID_161967
gtgttgcaagggcttgatgctgcaaccagttgtgtggaagatatggatgaatggttaagcatattcaatgtaaaactccggcacatgagggaggatattgcatcagtaaggacctgtgcccttcagtttaagaatataaacttcctagatacaatttactctctggttgtaatggccgtgtttgctggaagcatgatagaaacccgcaataacaacctggaaatgcaatcagtaaataacaaatctctcattgaagagcttgataagcttcttgagcgattgcgtgtcccttctgagtatgccacaaatttgactggaggttcatttgatgaagctcgaatgcttcaaaatgtagaagcatgtgaatggttgaccagtgccttgcgtggtcttggagtgcctaatctagatcctagttatgcaaacatgagaact

SEQ ID NO: 45190 - DNA, 174 bp, Glycine max
  Peptide Sequence Number=SeqID_161968
atggcaattggtgatggggaaaatgatgtggagatgcttgagttggcttctctaggcatcgcacttagtaatggatcagagaagaccaaatccgtggctaacgtaattggtttgagcaatgacgaagatggtgcagcagatgccatctaccgttcttctaaattaaaagcttaa

SEQ ID NO: 45191 - DNA, 228 bp, Glycine max
  Peptide Sequence Number=SeqID_161969
atggatataattgattcgggaatgcgctcgaaaattgttagagacaagtttgcccgtcttactcaaatggcaaaaattctaaatttagataaggtttctgagattctagatttctggggtgaaaactctggacctatgacctggagattaactctagcagaggttaggcatgtattgggtctgctagttgattttaaaccagaagcaatagctgctctgaagttgtag

SEQ ID NO: 45192 - DNA, 219 bp, Glycine max
  Peptide Sequence Number=SeqID_161970
atggagaattggcgaacagcgctaggcaatgacattcgcggggctccagactcgaaggtggagtggagaatggagaattggcgaacagcgcttggcaatgacattcgcggggctccagactcgaaggtggaggacacatgcacagcgctaggcaatgacattcatggggctccgaaaaaagtggagaatggagaattggcgaacagcgcttggcaatga

SEQ ID NO: 45193 - DNA, 486 bp, Glycine max
  Peptide Sequence Number=SeqID_161971
atggaagctgcaatcaagaagctggatacaagttcttccccagaccctgactctgattttgcagcacaattatcaattgtttcaagattgaagaatgagcattttgtggagttgatggggtattgtcttgaggaaaattatagaattttggtttatcaatatgcaagtttgggttctttgcatgatgtgttacacggaagaaaaggagtgcaaggtgctgaacctggtccaattttaaattggagtcaaagaataaaaattgcatttggtgcagcaaaaggacttgagtttcttcatgaaaagtgtcaaccttctatagttcatcgcgatgttagatctagcaatgtcttactcttcaatgactatgagtccaaggttgcagatttcaacttgacaaatcaatcttctgacactgcagcacgactacattcaacaagagtcttaggaacatttggctatcatgctccagagtatgcaaaaacataa

SEQ ID NO: 45194 - DNA, 1582 bp, Glycine max
  Peptide Sequence Number=SeqID_161972
aagataccagcaggaagatgcccatgaatttatgcagtgtaccttggataaactggaaagatgtttcctaggtttgaagaagagtaatttaaattttgaagatgttaatcttgtagagaaagtatttggaggtcgtctcattagcaaacttcaatgttctacttgtgaccacacttccaacacttttgagccacttattgatatgagtttagagatagataatgtagattctcttccaagtgctctggaatcttttactaaggtggaaaacattgatgataaccttcaatgtgataactgcaaggaagaagtgtccatggagaagcagcttatgttggatcagacaccatcagttgctgcatttcatttaaagagatttaagacagatgggatccttgttgaaaagattgataagcatattgatttcccattggagttagacttgcagccttacaccattaaagttatggaagacccaggggctgaaaatgatgtaccattgaaatatgatttatatgccattgttgtgcatactggactttcttctacttcagggcattacttctgctttgttcgctcagctccagacacatggcataagttggatgattcaatggttactgaggtctcagtagaaacagtactgtctcaggaagcatacatattgttttatgcgcgacagggtactccatggtttttgagtattatggaagagaaaacacaatgtttgaatccaaatattatgagtacatctcctaagtctgttttagacgttggtgacaacatgtctaaatcaaatcctattttacttccaaatattgaaagaagtgtggctgaagaatccaaagagtattctgagcctcagtttgattattattgtcaagaagatcatggttttcttgaaataaatgacactgaagatgtgactcatggctctggacaattgctctctggatcaaatcaggaaattttttattcgaatacctctaaagatgttgatgcccaaaagctgtttagtagtagggggggacataaagttgctactcatggctgcggacaattgctctctgggttaaatcaggaaagtgttggtttgaatagctcaaaaaacgttgatgcccaacagctgtttaggaactggaccaccttggatgatagtgccatgtttgacattgggaattcatatattgagaacggtagtcttgataatgacaatacctttcaggaagctgttgattttttagagaaggccggtttccattctttaactctgcctagcttgcctcctgatgatgctccagataagttccacatctcatgtgataatttgaagagagagaatcatcggagctgtaaaagatcatcaaataagttaactggggattctgaagaaagacgagaagctgtgaaatatctttgcaagaatcgttcaaggagaggggcacttttgaaatttgttactccaaacaaagttttggacaagaagagaaaaaatatggattcattgcagtgtaagaaaagcaccaaaaaaccaagccatacatctgtcaccccccctgtggccgcaggaagttcacggtga

SEQ ID NO: 45195 - DNA, 174 bp, Glycine max
  Peptide Sequence Number=SeqID_161973
atgcccacttgggctagaggaagcagcctagctcgccagggcgagttgggtggcaagcttctccctcttttccctataaatacggagaggagggaagaacaaaaacgttcaaccctcctgattttccgccgtctttcgttcgttcttcatcgttcttcggtcttgaaccggtaa

SEQ ID NO: 45196 - DNA, 480 bp, Glycine max
  Peptide Sequence Number=SeqID_161974
atggcatccgaggagccaatggatgctccccccgcgccgaatctgctttccgaaaccctaagtgccgccgaattggtcgccgatttgggcggtgattacgctctgttcccgcccggcggcggttctaccgagttccggcagctcgacgacgacgtctcgtcttcgctttggtcgtcggcgttggtttcgaattcgcgcgtctccgcagtggcgccggaatcgtggattgctccacaaggaaattggctcttacctgaaaatgaaggttcagacaatgctgaatctgcctctgaagtcgtgccttctaagatgggagcagggcttgtgaatcttggcaatacttgctttctcaatgctattctgcaatgctttacgcatacagtgcctctggtgcagggtcttcgttccagcactcatcctatcccttgttctgtattgttggggtttactgatgatccggtgttatttgactttttgtga

SEQ ID NO: 45197 - DNA, 477 bp, Glycine max
  Peptide Sequence Number=SeqID_161975
atgagtgagaaaaataataatgttgatgccagcgactgcatgattcttgatgaccatgaaggagaagagcattgttatggcaaaggaacaaatgcgaggagtgtttcttttttgccaagaagccaagagaagataggagattcggctaaagttgtgataaaacaagacataaagggaggagagcataaatatgggtttaacaacaataaacgtgagaagccagagaaagtaagggtggtggatgatgaaactggcgacaaacatgagctgtttgtagtcctaaggatgccatctagaacaaaaaaccgatgcctcaagttttttactgagggcaggagggttattataaacatcgttttctacatctaccagacaccaaatccaatgcatgttaaatacactcaatactttgactatcccagcccattcgaatatagattaaaggcaaattgggaaacttacaagatacagatatga

SEQ ID NO: 45198 - DNA, 996 bp, Glycine max
  Peptide Sequence Number=SeqID_161976
atggtgctcaaagtttttgtttctggtgcaaatgttgctcacaaaattttgggggttcaaaatgtgtcaatcgttgccgaagaagacatagaaaccatctccaaggatgaatcagcaagcttactggaagctgttgtgaatactgtgaatgaatctttggcttttgcatccaagtatggtcttcaatgtccagagacaactctagggacgcctgaagttcttgaggccattgcccgttgcaactcaactggaggccccaggggaagatattgggtacttgaccctgttgatggcacattaggatttgtacgtggcgatcagtatgctgttgctctagctctgattgaggatggaaaagttgttcttggagttctggggtgtcctaattacccagtaaagatagaatggcttaattatcattaccagcatcatcaaacaatgccagagtcgtctctaaaaactcctgataccgggggaaaaggatgtgtattgtatgcaagaaaaggcagtggtgaggcatggctgcagtcattaattgatggagataacatgctagagtggccaaattgtgctaggcttattcgtgtttcttcgattgatgatccggcattggcaactctctgtgaaccagtggaaagggcaaactcaaaccattcattcacagctggacttgctcacagtgtgggacttagaaaacagcccttgcgcgtgcacagcatggtaaaatacgcagcaatagcccgaggagacgcggagatattcatgaaatttgcaaagtgcggctacaaggagaagatatgggatcatgctgctggtgttgttattgttgaagaggctggtggtgtggtaactgatgccggggggcgcccactggacttttcaaagggaatgtacttagaaggtcttgacagaggcataattgcatgctctggtgtcgcattgcatgaaaaattaattgatgctgtttatgctagctgggactcctcaaatttatga

SEQ ID NO: 45199 - DNA, 576 bp, Glycine max
  Peptide Sequence Number=SeqID_161977
atgaagacatttgttgatctacctttctcaaggtcccctattggctacaaatgggtgtttagggtcaaggaaaatcctgatggaatagtcaacaagtataaagccaagctagttgccaaagaggaagtctacatgactcaaccccctggatttgaggattcaaacaaacaacttgtttgtaagctaaacaaagccatctatggtctaaacaacaatcctaacttcatcaaatctcttatctctaaactcaattttgagttccctctcaaggatttaggacctcttgattattttctgggaattgaggtcaactctcaacctaatggctatcttatactcactcaatccaagtacgtcagagatctaatggcaaaaactactatggataaggttattggaagacatcttcaagtggttcattttcctattgctgatcaaagagcaaacatccttactaagaaaaagcctaggtgtgaaaaggagaattgtaaggttcataaacccttccctgaccatcacaagtcagatttgcatttgacaagagctctcttccttttctcttcttcttctccataa

SEQ ID NO: 45200 - DNA, 198 bp, Glycine max
  Peptide Sequence Number=SeqID_161978
atggaaaccatatccaagcagtttgaagagcttgatgtttatggcaaatttactctgaagagtaaacttcaggaaattgcctatcctgatctaaactctatgtgtgctcctccagaaaaggctaccatggataagtggatgaatataaccgacataagatatatgattgcatcaaggacaattatttggctcaagtaa

SEQ ID NO: 45201 - DNA, 684 bp, Glycine max
  Peptide Sequence Number=SeqID_161979
atggtttatggacttgttatgaagatgaacatggattccctcagcctggccattaatttgacctacattcgcaagaactattggaaccctgccgatctatctatcacttttctgaggtctcgcaaggccaaggctaggactccagctgaggcacccccagttgctcccccaccacccaggctgtcggtgtctcccttctcctccactccactagaccagatcattcctatgttgcagagtattcatcatggccaatgtctggtgatccagagcattcaccacctctcccagcaacagccagtcatttcccttcaagacttcctagagcaggctcttgaggctcaggacccagctggtgagactgacaaagctgatgcatgtgctgctgatgccgagatggctcaggacccaattgatgaggcggatgatgctgatgtaggtgccattgatgctgagatggatgccgattatgtagctgatgtcacctctgcacagggagcctgggatccatggcccacccaggaccgaaaatataggcaagggataggaagagaagttgaagcccaaagattcacgctcaacgcgccagggttgcttagcgagctgttgtcgcgtagcagagggttttcgcttagtgcaaaaaagcagcatggagaatctgcagtcatgcgaaggggcgcttag

SEQ ID NO: 45202 - DNA, 603 bp, Glycine max
  Peptide Sequence Number=SeqID_161980
atgggaggtgggatcaaggttggagtaagaaagaacactccaggtctaagccaatgtggtcagatccttcctcaacagcttccaagtgaggttgcggtgccagtggcgatccagcttatggaggaattcgtcataatgggaatgcgcgagctcaatattcctttccgggtagcactaaacgccctatggaatcaagagaaggggtggcttagtgccactagggcgctaagcctaattcgagacaaagggcaaccagagagatttgggcttagagcagaaggtgcactatgcctggaagtgaaaggggtgttggggcttagcgcgatggtcgaactaagcccgtgcaagaaaacacagaaaccaagaaattatgaacacaagaagggactcactaagcgcaaagagcaggcttatcaagttcgtccaaaacccaaaaaaagtttgaaggaaatcatgaactcgctaaacgcacagcgagttcaccacaacccagtaaaaattgctaagaaaggcatgaactcactaagctcatgggtcaggcttagcgagttcatcaaaaacccagaaaccatgaagaaaatcatgaacttgctaggcgcacag

SEQ ID NO: 45203 - DNA, 525 bp, Glycine max
  Peptide Sequence Number=SeqID_161981
atgaagttatcagtcactttaaatagattttctctaagccaatttctatcaggcctcatcttcctgcttccaaaggttgtaacatcttcattcattaccctagcgccgaaaaaagataattcacaatctgtggcagattattgccttatttctctcattggtagtgtgcacaaaatttggtcaaagctactgattttatggttgagaagggtgattagtaaggttatatcttcgtgccagaatgcttttcttcttgggcgttatatattggatgatgttctggttgcaaatgaatttgttgattatgttgatagacataataaagggtatgtccttttcaaaatagattttgagaatgcttatgattctattagttcggatttcttggactatatgatggagcggttgggtttcagtatgaaatggagaagttgggttaaggcgattacttgtggcagcaataattttgtcttggttaaagacagcccaaccattgagtttcaatctcaaaagggcctaaagtag

SEQ ID NO: 45204 - DNA, 261 bp, Glycine max
  Peptide Sequence Number=SeqID_161982
atggagcagaatctttgggtgataaaggccatccttcatagctttaaactagtgtcaggattgaggataaacttctctaaaagtaagctctatgggattaatgcaccaatgaattttttggagggtgcaactacgtttcttcactactttgtggcaactattccttttaaatttttggagcttcccattgggattaaccatagaagagagattgcatgggagctgattgtaaaattattccggaagacactctcaagttag

SEQ ID NO: 45205 - DNA, 657 bp, Glycine max
  Peptide Sequence Number=SeqID_161983
atggataatgctgatgataagcagttcactattcctgcatgtatagaagcagagcaggttacaaggaaagggatggtttactttgatttcatgagaagtttccgggtagagtttgatgaatattttgaggatgggttaatctctatgattgaagttggaatggtttcgtgtggagaactaagatacccatcttgttctgtaaagcatggttggagatatcctggtattggtgaattccaggatgatgactttaagctaattggcagaatgtcgccagcacaaggaggatatggcacatacatgcttatatttcagcagccactagatatgcaacacttggtgctcctactttgtatgaccatcctggcccaatttatggaagtagtggtagaaagttttttggcaagaaaccagcatgagcagaagtcaagaaaacaaaaacatgaggtgaacttgttttcggtgcattgtgtgggatgctttaactatctcattgctgataggtatctagattccaaaagaacatggattggtgcagtgtacccaaatttcaaagaagaaagtctttgggacaaatatgtcactgcaatatattggtccattgtcactgttactaccactggctatggggatttacacaagagagatgttgtttaa

SEQ ID NO: 45206 - DNA, 210 bp, Glycine max
  Peptide Sequence Number=SeqID_161984
atgacggcgccatggcggtcatggcggttatggcagcatggcgcaaatagcatttttttgttttttttttccgctgtaggagttgggctgacccgacccaaccctacccggttgaatcagaattcagaacgcagccctcctccaactaaaagtgcaacccctgcacccagctgcgaccacccgcatgcaaaacgtagccagcagcaatga

SEQ ID NO: 45207 - DNA, 378 bp, Glycine max
  Peptide Sequence Number=SeqID_161985
atggtgggttacacaccttcaaactttacggatttggtcttcgccggtgaaaagatcgaagtgggtctggaaagaggcaaatttaataatcctgccttgatgaatgagaaaactagggcaaatgaagagggtgagaatgaaggagaaactcatgttgcaattgccattactacatggccaaacttcccaccagcccaacaatgtcattactcagccaataacaaaccctctccttacccaccacccagttatccacaaaggccatccctaaatcaaccacaaaacccacctaccacacgaccaatgctaaacaccacctttagcacaaaccaaaacaccaaccaagaaatgagttttgcagtgaaaaaaaacctgtag

SEQ ID NO: 45208 - DNA, 300 bp, Glycine max
  Peptide Sequence Number=SeqID_161986
atggcccacataaagaaaactggccagatgacgtctgaggcagcaaagcaaattgctgacaagattgatgtattgactactgtcattgggcaaccagaataccccagtcgtgtgcgtgctgttggagctagtgtgacgatcaagcaatactttgaactggctccaaggacctcccgcacttcttcctccatggctcccgaagacctagagcagctgactcaacaaataagggaccagctggaggagtcgatcacagaaaaagttactcgacagctgatgttatccttcagccagatgtag

SEQ ID NO: 45209 - DNA, 210 bp, Glycine max
  Peptide Sequence Number=SeqID_161987
atgagacttcatgggaggattggactcagctatgtcaggactatcaccttgaagacaagatgtttttgcaagggccacaggatgatacagaaacaaacagggatagcaggaattgtgccagaaacagcaagtgcagagccaaagtcagatgtgcaaatagcagggaaggccaaaagaagaatcactaaacctcatcacctaaaggattag

SEQ ID NO: 45210 - DNA, 180 bp, Glycine max
  Peptide Sequence Number=SeqID_161988
atgcaatacacattggcaaattgtcgttatgctcttaaggacaatgttgtcatttggttttgttccttgcacaataggctcgacaactacttgaaaggaattattaacagtgctttgaaggaattcaacaatagtcaaggaagtaaatccaaggttgcggccagatggattctagttaaa

SEQ ID NO: 45211 - DNA, 1105 bp, Glycine max
  Peptide Sequence Number=SeqID_161989
atggcgtggcttgaagagacattaatgtcttacggtcatgatgatgcgtccgtacttgacgtgtctgaactggacggcatgcttaccgcagtgctttccggtcctgttgtcgttgagccagatacctggctggtggcggtatggggtggcgagaagtacattccgcgctggaaaaacgaccgcgagatgaaccgttttatcgacctttgctttaagcatatgaacgatattgccgagcgcctgagcgaatatcccgaccagttcgaaccgatgtttggctataacgacgttgacggtgagacctataccgtggtggaagagtggtgctacggctacatgcgcggcgtggcgctgacggactggtcagccttgccggacgagttaaaggccgatctggatgtgattgcgctgcacggtagcgaagagaacggcggcgagctggatgagctgaccgaagaagaatatgcagccagcattgaacgtatccagccagctgcgctgcgcttgtataactactgggtgaacaacccgcagcagccggaagtgaagaagccgatggtaaatggcacgaaggttgggcgtaacgatccgtgtccttgcggcagcgggaagaaccaaacacaacgcacagcagcggtttccctccagctacgcggtatccctgttgaggatgctgctggcgactcttccatgccagcagggaagggaggatcagggccagaaccgacagtgccacccctgcgtaccccagcgccatcacaaacccgcgaggatagaagagggcgaaggccagcggtggcaggaagcggtattgcggcgctggaacaggtcggccaggtaatcgaacaggccgagggccacgccgaggaacgaggtcgccagcgccaggtcggcaaacaggtgtaccgccagctcaacgtgcggggaggtgacgacctcccgcagcgccagcagaaagccgttcagacccgcatgctgtgccatcagcccaataaaggcaataagcgggatcgcgctgcccctcacaaagacgcggcgcagcttgcgaatatcgccgttcatatagctgacaatgcttggcacgctgccgtggaagccaaacgag

SEQ ID NO: 45212 - DNA, 282 bp, Glycine max
  Peptide Sequence Number=SeqID_161990
atgcgatcaatctgggcacatgagattcaattgtcctgtcttcaaaagaagaatgaaaaatctgacatgaggaatttcaaagagaagaaagaaaagaaaggatacatcacttgggaagataatgtcataaattcttcaagtgattcagagaagaaaatcataagtttgggtatcatgatgaaagactatgtaaatggagaagagcaaagtcgatacattgatagcaatttctccaaacacatggcatgcatcaaagtttattcatatttctccccaagataa

SEQ ID NO: 45213 - DNA, 333 bp, Glycine max
  Peptide Sequence Number=SeqID_161991
atggaggatgagtcacctgaggccaccatcccagagccatttgatataggagaagaggcagaggagacacaggtgagacaggtagctgctaccactcctgagcaatcccttgaggctactttagagccttctacaccagtggtaaacctacccccacctcatcctgcagcacacccctccactcctcttctacatattctagaggatccaactacaccaatcctagctgtggacacttctcctcccactactccagtatttcagctaacagatgagaggatggtcagacacaggacacataggatcagtcacaggaattttgattccagatga

SEQ ID NO: 45214 - DNA, 276 bp, Glycine max
  Peptide Sequence Number=SeqID_161992
atgatgatttggaaacaacgtgcaaaattagtcatggccacagccaggacgacgttcctaaatgaaaaactctacacggttccagaacttcaacaaacactattgacaacaacgaagatgaaacatgaatatggggatcccacggtcatgtggctctgcatgccatcggactcctgggtcacggtaacaaaaattcgggtggtcgacaaaagcagggcttttgctcctacgtatcctcaatttgtgatgaggaactcagacctacgtagttcttga

SEQ ID NO: 45215 - DNA, 252 bp, Glycine max
  Peptide Sequence Number=SeqID_161993
atggaattcaaattttatgcaagctggtcttatcacaggggtgttgtcattagcggaccattttccaagactgcagtgaattacaacgcagggtgtaagactgggatggcaaacgtggttcctttatcatttgatctagccatcgaaattcttgttgaacttgtgactaaacacgagtgcacgtactactacaaagcgcgttttttacatcggtcaaaaatgacattctacatcggtggtcaaccgatgtag

SEQ ID NO: 45216 - DNA, 612 bp, Glycine max
  Peptide Sequence Number=SeqID_161994
atgagaatcattggttatgtgtgcaatgtcaacactggtataaagcctgaccttaaaaaattaaggagttgtaaattagaaatgcattcacctttctatattatctacacaatttatgcaaatttttacacttttgattttacttggcagaatatcaatatcgaagggttgtcccaatcatacatgatggagtgcttgcttggtcttttaaaatcaaaaactgtgatatacattactcatcaagtagaattcttacctaatgctgatctaatattggtaagtgattcaagaatttcatggtcaagaattcaaacaacagcatttcgtcaatttactattctcttagtaagtgattttgaacttgagaaaaatgtggaaaacacaaatgatcaaactgataagtcaaatgacacagttgttgagcccaaaggacaacttgttcaagaagaagaacgagaaaagggtagagttgggtttaaagtatactggaaatacatcataacagcttatgtaggtactcttgtacccttcatattactgcaatcgaaaggctggatttcagattggatattttatctactctcgcatttgcctgctgtttggttttcttga

SEQ ID NO: 45217 - DNA, 330 bp, Glycine max
  Peptide Sequence Number=SeqID_161995
atgaatatcaatgtgaaaggggagtggatcctaatgcacataatgtcatgtccaaattttttgtctctctcttcgtactattctatcacatcatcaaactatgggaccagtcatgttcttgttctggctgacttttcaccaagtactaggacaacaaagctagagaagctttttgagaacttcaaggattgtggatttgtgattcgttgggtcaatgatacaattgctcttgcagtattccgaacacctccagttggtaattcaacatttaacattggtgctgacaaatatggagtttttaagatggtgctgacgtcagtaccgtcttag

SEQ ID NO: 45218 - DNA, 267 bp, Glycine max
  Peptide Sequence Number=SeqID_161996
atgttcttgaaaaagcgcgattctgagaggaatctcggggttgaggcgataaagattgtaagggtagaggttgatcaagaaggaggagttggtgtcgtgaaggaattggaggagtggaggtttgtactattgaagtactaccttgaaccgttaggacatggcaacactagggaactattgaagtactatacttggtacgaaggacaccacatacaaataggggagaattgtatggtccttcataggttaatggttaggcaaagctag

SEQ ID NO: 45219 - DNA, 664 bp, Glycine max
  Peptide Sequence Number=SeqID_161997
atggccatgcccggtgagccatttgtgaggatcgtcatcattaatgtcgacccaagtaaggacatcatggagtccattcttgatgctgttcacctaggtcgtgcctacctcactatccttaacacctttggcacagtcaccatggtgatccttcataactcgctccatgtcgttgccaccctaacactccatgagcccttcaccttgctttgcctcaacggctcatacttattgaacaacaatttcaaccttaactttagagccattattccccctcctttatcttttgggatccacctctccacctctcgaggccaagccattggtggtgccattggcagccaagtcattgtcgatggcaacgttaagatcacgctctggaccttttggcatcctaagatttacaagtacattcctgaaggaaacaaagtgtcttcttcttctcccgctcgagcagttgttcaacagttgaagcgcattgtagtggttgcaatacgctatcacaaccatgggataggctccgacaagaacaaagataagagattgtccgatggtggcttagacagtacgactgaaggatttggcttctcccacaaccctttgaagatgctaaatggacttggagaggattggcctattgggcaagttcatcagatgacatctt

SEQ ID NO: 45220 - DNA, 144 bp, Glycine max
  Peptide Sequence Number=SeqID_161998
atggagaaaggtacaagtcttcctatggagaaaggtttcaagatcctgttgtttcctatcattgatagtctaggaaaccccttaagaatttttacatgtggtatcagagcatgtgttatgaaatttatgattctccaagaatga

SEQ ID NO: 45221 - DNA, 204 bp, Glycine max
  Peptide Sequence Number=SeqID_161999
atgacgactctttgcaaatccaaaggaaggaaatccgaacatttccagaaggattacctaaagtgcaagtcttggttcgaaaagaaaagtgagcttaatgctcgtagattccttacaatccaaaccataagctcaaatgagaagttcattttcatggggaatagagtgaaactccagtgtaagcagttgagacttattgcgtaa

SEQ ID NO: 45222 - DNA, 144 bp, Glycine max
  Peptide Sequence Number=SeqID_162000
atggaaatcaaacacgaactctatagacaaattggtttccacatggagtcactgctaaacttgtgccttctgatcatgttggaaaggtatacgtctcacgaggattggtcaatgatcattaatacagcgaggatgcatggttaa

SEQ ID NO: 45223 - DNA, 996 bp, Glycine max
  Peptide Sequence Number=SeqID_162001
atgggaaggcaaccctgctgtgacaaagtggggttgaagaaggggccatggactgcagaggaggataagaaactcatcaatttcatcctcactaatggtcaatgttgctggagagctctccctaaactagcagggctgttaagatgtggaaaaagttgcaggctcaggtggacaaattacctgaggccagacctgaagagaggccttctatcagaatatgaagagaaaatggtcattgatcttcatgctcaacttggcaatagatggtctaagattgcttctcatctcccaggaagaaccgataatgagatcaagaatcactggaatacccacataaagaaaaagctcaagaaaatgggaattgatcctgttactcacaagccactttccaataaaactgaggaaactcaagcccaaccagatgaacaaacccatcaaccattgcaagaacaacaacaacaacaacatcaacatcaacaacaacctatcccagttgagaaagacctcaaatttgaacctgaaaaggagcaaaacagggagccagagacttcagttgaatcatcaaccatcactgaagaagttaaggaggaagaccaaatcatgacacccctatttgactcatgggaactaatgaatgagttctgcactgatgaagctcccataatagaaccaaatgagattctagttccttctgctccttcttccgcttcaccaaccactactactatatcatcttcaacatcaacatcctcttattcaaattcatccaacttccttgaagacctgctgctcccagatttggagtggtctgatgattacaatgatactaattttgacaacaatagcagcatggccttgtgggatgatgactttattggaagttggaattcgcttattaatggtgatggtgatagaaagcaagtgtttgacgctcctatcaatcagtacccaagtgtgatcatggattcagattcttgggactatggcttgttttga

SEQ ID NO: 45224 - DNA, 972 bp, Glycine max
  Peptide Sequence Number=SeqID_162002
atgcagacgctgccgcgcaggtccggcaggccgtgcgcgtggccatcgcccggcgcgggcggcgtggattcgccggagcgcgccgagatcgcgatcaggatccccgtcagcgccagcaggccgcccagtgccgcggggaagaaccccggccccatggccgtgcgggccctcgggatggcgccaagagcgtgcgccatccggctctttacaacaagccggctggcagattacggaaggaagctgctaatccgctttctatgcgctgtcgcgatcctgaatccgggggttatccctgatggagaaagatgcgtcgcgccacgcggctcggggcgatggaatgaaagcttggcggaattattgttcgccggtgaactcgacgtcggcgggacgcggatactgcgagacggtcgtcgccaacggcagccacagcacggaggccaggccgaccccgccctgcgcgttgggctcgccgtcgcgcaattcgatgtcgccatcgttgcggcgggcataggcccgggcgatggccagtcccaggcccgagccggaggatgccaccggtttgtcggtcccgacacgctcgaagcgggcgaaggcgcgggctcgcaggagcggctgcaggccggggccgttatcggacacggccacctcggcgcggttttcgacccggctgaccgataccgtgatgcgcgccccgacgggcgcgtaatggatggcgttgtggaccaggttggacaaggcctcatgcaattcggcttcgctgccggacacgggcgcgccgatttcctggccctgcgcgttgacggcctgcacccagcccagatcctgttgcttttcgtgcgccagcggcaggtactgcaacaccacctcgcgcgagacggcgttcatgtcgagcagttggcgcggcaactggtccgcctggttggcatgcgccagcgacagcaattgctcggtcaggcggcgggtgcggcctag

SEQ ID NO: 45225 - DNA, 426 bp, Glycine max
  Peptide Sequence Number=SeqID_162003
atgcataaggcattgcgattgaatgccccattgccttatcctcatcttgttacccttttccatcaacacttcaacatccctcttgattctgaaccttatgttccaatcaagagatcattccttataggcgcttcagtcatagcatcctttggttatataaaggagcatgatggctcttgggtgaagaagggtgctagaaatgttggtgaagaaggacaagagggagaagattcatctcttctttcgaagattatggataggtttgatggtcttcaaacctttgttggtgaaaggtttgacactttggaattgcaaatggatatgcgcttcaatgaaatggagtcaagaatcacaaaggttgaagaagatgtgtcttacattcgttcaagctttgatcttccaccaccgccgccaccatcatcttag

SEQ ID NO: 45226 - DNA, 261 bp, Glycine max
  Peptide Sequence Number=SeqID_162004
gtggcctggccagaagcccaaccttctctttttggagggggtgcagcctctgcagcccaggagcctgctcttgaggagccagcagcagtagtagcagtagagggggaggatgagctcacccctcctaagcctttttattttgatgcagatgtacacatggctcaggaggaggagacttctacagaccagatcccagggccatccccaacacccacacctgatgatgccataccatttgcaccaacatctaagttagagtag

SEQ ID NO: 45227 - DNA, 438 bp, Glycine max
  Peptide Sequence Number=SeqID_162005
atggcttctaggaaaaggaaagccatagcttccaggccccagcctcactatgatacttacagactcacctatgaggacacctggaactgctgtgctgacaacattcttggccagaacatccttctggaaaggaacgcaaagctttttgtcacaaagtttgatgagttcaggatagagctagtcagaagaaactggcacaggacgctgaccaacctcatggaggggagcatagatgtggctctcgtgaaggaattttatgctaatcgttatgacccgaaggataagtttccaaagcaagttagggtcagaggacatttaatcaagtttgatgcggattccctcaacacttttttggagactccggttgttctagagccaggggagactcttcctgcttactccaggttctgcagactgagaccagaccctcaggagctg

SEQ ID NO: 45228 - DNA, 450 bp, Glycine max
  Peptide Sequence Number=SeqID_162006
atgtctctgttcttacattgccatgcccctcaccacagcatggccactctctcacccttctcaaccttcaattccaaacctctctgtgcttctctacctaacccctctttcttaactcatcaacaacagcaacaacacccttatcctctcaccacaacgaccacctctgaccataagcccctctcagtttccacactgcccagaaagttgctctgtaaaccacccaaaggaaagtacgtcagagaggactatcttgtgaaaaagttgtcagctcaggaaatccaggagctggtaaagggagaaagaaaagtgcctcttattattgatttctatgcaacttggtgtggaccatgcattttaatggcacaagaacttgaaacacacaatgtgtctgatgttttatttcaatctttacttatatcaccctccaagaaagaagatagtggatag

SEQ ID NO: 45229 - DNA, 237 bp, Glycine max
  Peptide Sequence Number=SeqID_162007
atgagtccgaaaaagacaattgggaaaaagggagttgttactggtcatatgatcagaggcaccagagtcaagtatccaagtgccaagagtgaaggacaggggaacaaaggctacaagattaccaaactgacccatgatagtaacaagtggcaaggcagatgttgcacgtgtgatggcggacaacaacacagttgcagcgttagggtcgtcggaggtagcgatgatggtcacaggtag

SEQ ID NO: 45230 - DNA, 195 bp, Glycine max
  Peptide Sequence Number=SeqID_162008
atgacaaattgcaccgattacactgatctaaatagggcatgccccaaagacgcgtaccttctccctaacatcgacagggtatgcgaaggcaagttcctcagcttcatgatcacacaccaagggatcgaagtcaaccccgacaaatacactgccatactagagatgcacaacccaaccaacatacaagaagtttag

SEQ ID NO: 45231 - DNA, 1719 bp, Glycine max
  Peptide Sequence Number=SeqID_162009
atggcaaggacctcatgccgaactggtggaggcacttctctccctcgcgaaagggcacaaccttctgttgctgcagaggagctagtcctagttactgttattctccccctttctgcttctagggtgcgaggagagctagtggcgacggagattgtgtctaagaatctgttcgagtttgacacaaacgtctttaaccatttcaaggaccatttctttaaggtcctagttattgatgttgtggctgatggaatgccactgatgttcaatagggatggggagcccctcttcccattctactggcagtttgatcccatcaggttcaagtcatatgatgaggatctgttgaccattgtggaaagggtcgacaaagaaattttagagcaactgccggcctcgctggaagcgcgggccattttgtctcttccttccgcaagcgatcatttcacttccttggatgataatgttatgggtgacttcgcttggaggccactcgtgaagcaggtcggacctacaggtggagatgtgccaccatctgttgatgcttcatccactggagaagagggccaacatgctagtgaggttggtcctattattgttgttgttgaggtcgtcgctagtgctccttcctctattttggtaaagaggaagagggacgatgctactgggccgtcgagccataagaagttgaaggcccctatgagcctctacgccttaaggcaagctgcagggctagggtccattgcgggtcgcctcatgattgcgcaagatgtgcctctagctccaccagtcattaatgaggtttttcccattgttgttaaagttgttgtgccagccactcaagctgactctgttgtggtgtcgtcgtccaccattgtggcccttttactaagtgtcggtgtggtgacaactagtgctcccagggtgttgcctctttcttcgtcagctccgatggtcctctctgctgctgttttggcggctatggggtcgccttcttcgttctcccaccctcacgtctcccttgatcatttatccatctctagtgatgctaactcactatgggccattgacaaaaatctcatcaggttggccggggtgcagaatgctactaactctgccaaggtgtttctccaaaggagtttggaaattctggaagagaacggactacgacaccaagaggcagtgcaaaaggttgtgttcttggaggcagaggccttaagggtgaactgccaactgtcttccaaggttggtgatgcactagccaagttgttgcacacccggttagatggtgacgaattgtttaactgttgcaagtgcttgcaggctgagaagatagacctgggtggcaaagtggagagcatggcagctaaaaaggatgggtttgccaagaggattgctgagttggaggcccgacttagggagtcagagtccacattggaggggtccgagctacgggcttccaaggagagggaggccagcatgaagctcgaggaagagctgattctgtacaagaagaaggtcgttgagcaacatgagaaaggctttcagaaggctgtcaagaaggtcggtttctttgcaaaggaccttgacttaggtctcttcgatcccttcaaggatgtgaaggagggtgtctggcttgatgaggagcagattgatgcggaggagaaggttgttgatgaagggcaaggtgttgtgaagcaaggcgatgatgtctgtgtctag

SEQ ID NO: 45232 - DNA, 258 bp, Glycine max
  Peptide Sequence Number=SeqID_162010
atggttgctttacatggtagtggaacatgggagctattttcgcttacttcctcagaaaactattattggttgttgggtttatacagtgaaggcattaaggttgctcaatcctcttctagcattgtcatttcccagcggaagtacactttggatatacttacagagagcgacatgcttggtagtcaccctagtgacactcttatggatcccaatgtcaagctttttatggctcaaggggagccattggaggacccgtga

SEQ ID NO: 45233 - DNA, 642 bp, Glycine max
  Peptide Sequence Number=SeqID_162011
atggtcatccgcttttgtttttttcaagactattacagtcttctttgccttctaaagacaatcaagtccgtcggcatgcagagacaatcatggtcacccactttcgttgtttgcaagactattgcagtcttttttgcctttcagagacaatcaagtccgttggcctacggagacaatcatggtcatccgtttttgttgttttcaagactattacagtctttttcgtcttccaaagacaatcaagtctgttggcaatcggagacaatcatgtcttccgctctttatcttttcaaagaccatcagagtctttcgtcaagacttcggtgtctcccttactttgcaagacttcaaggtttcactgattgggcctttgctagtggtcggtcggatggtttcatgacgtttcggaaggaaatgtgcaaaatattcaaaagaggggcaaaagggtcacttttgggacatttttcagcccctgggctcactaggaagcatagggctgaagtaaccaacacgcctgggcatgagggggctgaggagaagggtccagcatcgtatattgagaggttttcactgaaattagtgagaagaaggagaaagaagaagaaaaatcaaggttggggcgcttccgtaatgctcccgtaa

SEQ ID NO: 45234 - DNA, 1095 bp, Glycine max
  Peptide Sequence Number=SeqID_162012
atggaggataataataataataataacaaagcagagaagcagcaagatgatagtagccaccacccatctctcctccttcctaaacctaatcatagcaccatcaacaacatcaaggaggatcatcatcagtctccaagaaaattagccattggtggtggtggcggtggcagtggtgataggctgaagagagatgagtggagtgaaggagctgtgacaacccttcttgaggcctatgaggccaaatgggtgcacagaaacagagccaaactcaaaggccatgactgggaagatgttgcaaaacatgtctcagcaagagcaaactccaccaagtcaccaaagactcagacacagtgcaagaacaagattgagtccatgaagaaaaggtacagatcagagtctgccaccactgctgatgcctcatcttggcctttgtattctcgcctcgacgttctgctccgcgggacgggactgatatcttcttcgctgccaccaccaatagcagcaacagcgatagcagcaccatctcaatcaccacatgctactataaataataaccaggctttggtgttgttggagccaccttcactggctgtgttacaagcacctccttctgttgctcctccaccaattgcaattgcacaaaactcacatggacccaatggtgttgaaagactactagccaaggaagatgggataggagccaagtcatctgagcaagtatctaacaagaatccaatggactcggatagtagcacacctgctctttacagtaaaaaagacaaggtgagatgcaacaagaggaagatgaaaagtgagaacaacaacaagaggagaaggaataataataataataatgaagacgtggaaatagcaaagagcatcaggtggcttgcagaagtggtggtgagatcagaacaaacaagaatggacacaatgaaagagattgagaggatgagagttgaagctgaggcaaagagaggggagatggagcttaagagaactgaaatcattgccaatacccaactagagattgctaggatctttgcaagtgtcaataaaggtgttgattcttcactgagaattggaagaagttaa

SEQ ID NO: 45235 - DNA, 240 bp, Glycine max
  Peptide Sequence Number=SeqID_162013
atggagtcgtcaactatcgcaacctacccttcagcgggagagcgacgccaggctcacgggtgcatcttccaaggaaggaaaatgcgtggagtcaccaccaagatttatttgaggaaaacgtcagaaaaaccaaaaccgggtctacaaatttttagaataaaaagtaaaaagaccgttaaggcgttggaccttgaacggattcaagcaatttttatggataaaagcttgattatgagttga

SEQ ID NO: 45236 - DNA, 390 bp, Glycine max
  Peptide Sequence Number=SeqID_162014
atggacgaactgcacgaacgagccaagggctacatccagatggaagaaatgttcagattctggaatgaagtccgccacgccggacaaaagtgcaacgagtgcaaagcacacaccaagcccgatgcgcacaagtcagacaagaggcacaagccagacaagcgtcagcctctctccaaagggtctaggtacgagtgctacacacctctaatggtcaatcacaccatgattctcgaggaaacattcaacctggacgtacccatctggctaccctgtacgaaacctcccaagacagggtcagacgtaactaaatactgccaatatcaccacaatattggtgacaacaccgaagactgttgggccctaaaggaaaagatagaagaacttatatag

SEQ ID NO: 45237 - DNA, 246 bp, Glycine max
  Peptide Sequence Number=SeqID_162015
atgagacttgttagtggtgctctgcgcactgaatcattcgacaagaatgtcaaagttgtctatggacctgggtgggagtccaccgtaccaggtcaatgcttatcccttgagagatgtagggaagacatgacattgaatcgcgacgtcgttggtgtagagtgttgcctgtgcgttgggggtgtgattccccttggatgcgttcaggcaaggtgtgggcggattgctcgtcgccctagggacgtctga

SEQ ID NO: 45238 - DNA, 990 bp, Glycine max
  Peptide Sequence Number=SeqID_162016
atgagttctggacgtttgctagtagatcccaacggtcaaaatgtaggcttatgcactatggacttccaagttttctgcctttgctttgttttgcttggctgtgatagcttgtgctgtgtgaatgttgttttgcttggatgttgtggaagcttgggaggattgatggggacccggggatggtgggtttatgcgcgcattgtggatgtggaaaacttgttgtgcaccatcgcccgaccgccacctggtaccacatgtgatggagtggtacctggagatatgtcgcgggggtcaggagaccttggggacgtcaggcgagctcctggaagtcaacagataaaaggaaaacaagaccacaaagcaaggaggcttgtggtggctggccagctgcttgaaaacgaagtcaggaaacttagggagcctctggtaatcgattaccagcctgtgctgtgtaattcaagtttagcctctggtaatcgattaccaaggttgtgtaatcgattaccagagatgaaaagcctcaagatactccttttaacgtcatgtagtggttatgagatcgtgatggcggcacagctaatccgtgatcgagtagagatggagtgcctagagggagcttgggagaccctcgaaggcaacacgaggtgccgatttcggggcaccattcgattcacggctacttctttggtgcatccagatgaacctgcacggacgcttcagcgcactgtggagtggatactacccacgcctacaccatatcgtctagtggagcccgctcaagtgatcgagataacgtcatccgaggaagaccctgaggaggacctggaggagctacctcctgagcctgctgtggatgcccttgactttctagagggtgatgaggatccacttcttgagactctacggaggatagcggcccgagggagatggcgatcagcgggggctcttcatcctagtggacagctttttggattagttttgtatactttttga

SEQ ID NO: 45239 - DNA, 717 bp, Glycine max
  Peptide Sequence Number=SeqID_162017
atgattggtgaggtccctactgagccacgtgcactaccccagtttaggtccaagttgcagctgcacaagctcttatatgggctttgggcctctaccggaggtgtcatctcgcggatctatgtcaaattctttgctcaggctagattggtagacagtcaggtctcggatttgagacccttcgcgcactgtcatgacttaagtgccttcaaccgttgtggggctttctgcatagcactagcgtgcttgctttttgtcaaccttgacggttacaatctcccttttcagtctcctagagagctttccctaatcgaaggtggtcatcaagtccacatagcctctggtctcgactctctcgcctacaaaatcgaggaatggaccggcgtaagggtggatagtgtcggcggaactgccctggtcgatgaggaccctggacaacatgaaatttgctatggcgacaaagacaaccatggggtcgtcttagttgacggagttgatgtccttgaagtccctgtccgtaaaggtctggctggactgtcctccataggaaatgccaccagcgatggtgtggattacacctttgatgtgatgggtgggttcctgctccagtggaggtcttctgctcttcttctgcctgcttcctggttcctattctacttctttggatgtcctctgggtcttgctcttgcttggtggttgtttggtctcttaacaaactag

SEQ ID NO: 45240 - DNA, 192 bp, Glycine max
  Peptide Sequence Number=SeqID_162018
atgggatcttcgttagcaatgggatgttcatctcgatttgatgtttgcatttgtggtagttgtgaatgtggcgtaaaaggggatggaggatggaggatggttttgttggtcaaaggagtaactattgtgggggcggtatttgtagttgtggacatgagggttgtggagacgatggctgtggttgaggaataa

SEQ ID NO: 45241 - DNA, 393 bp, Glycine max
  Peptide Sequence Number=SeqID_162019
atggcgtttatggcatatgcaagttggctaggagtttcattagtggttgtcttaggtggccttgaggacgactctgttagctgcctctgcctgtccattagtttgagaatgttcagcaaaggtgaccaggaggccgtacctgcagatgaggtgcttccaggtgaatttttcctctttgctagccataatttcctaaagtggtcttgcttctatccatatgtctattccccacaaggcaaaaggcctagggttcctcagactgtgacggttgtcaggaggagtatgtggcacgtctgcaaactcttgacatcatctgcatctcctagtaaagttgagggcatctcccctaagtgttggctagtaatagctagctcgcaccgttttggtggctag

SEQ ID NO: 45242 - DNA, 285 bp, Glycine max
  Peptide Sequence Number=SeqID_162020
atggcgatgatgaagcactttttggcattggtaatgcaattctctcggaagccacaggagatgcctagggaaacaaaggaaaaacatgttcagaggtggcaaagagggagcaagttgacttggaggggaggaggagagaaaggatggagtcaggattggcggggtcgtgagaaacaaagaatcttgaaggccattgtgccggaagaagctaaactacagaggatgggtgggagctacaaggaggaaccaaagcaacaagtgggtagaaggggagtcagagagtga

SEQ ID NO: 45243 - DNA, 108 bp, Glycine max
  Peptide Sequence Number=SeqID_162021
atgtcaatttcaaccttagccgatgagggtacttgggagagaattatagataatttcactaagttcgagctcggtcgaggagagtactcaggaggaaactgcaagtaa

SEQ ID NO: 45244 - DNA, 162 bp, Glycine max
  Peptide Sequence Number=SeqID_162022
atggagcttgcgacacaatttgaagctcatagcagagggaaggagtcgacgatgaagtttgcggcagcgttcagagtagtgaagaagccacaaaatgaggctttagagtcaaccgtgaatgagtatttcataatggagattagattagtagacccatggtag

SEQ ID NO: 45245 - DNA, 228 bp, Glycine max
  Peptide Sequence Number=SeqID_162023
atggatcagagcttgaaggcaggagaagatgagtggagggagagggagagaaggggcacaaaattttgtgcctcaaatgaggaaaaacaatgttctaagatgtctattttcaatgtttgttcaccagaagagtttgatgtccatcagcaattacagagttcttacatatcctcaacaaacttcattggagcagttactaagcaatatggtgttgagagactgctatga

SEQ ID NO: 45246 - DNA, 626 bp, Glycine max
  Peptide Sequence Number=SeqID_162024
agaatctctttctcccaacccaacttcctaggaagccgtgtggtaggccaccaggctccaagaacaaacacaagatcatttccctccctgtggcccaacctagtgagtcatttttgaggattgtcatcatcaatgtagactcgggtaaggacatcatagagtccattgctgacgttgctggcctaggtcacgccaacctcgctgtccttagcccttctggcacaatcaccagggtgacccttcataactcactccatggcgctactgccctaacactcaatggaccaacccttcgccttgctttccctcaacagctcatacttattcaacggccacagcttccccctcctttatccttcgggatccacctcaccacctctcgaggcctagccattggtggtgccattggcggccaagtcaatgctagtgatgaaattaagatcacgctctgcaccttttggaatcctgaaatttataagtacattcctgaaggaagcaatggtgacaatgatgacaacaacattagcaaaaagaattataagaataaccctattgattgcaatggggtggaaaccaattggtgttcagcatttagttgtggaatccatgggtggcaaataatgtga

SEQ ID NO: 45247 - DNA, 357 bp, Glycine max
  Peptide Sequence Number=SeqID_162025
atggagaaagagctatgcatttggatggaagcagaattgtgtttggatggaagcagtgacggaggggctatggggagtcgcagagtaccacgagaggggctatgggaaatagggaaagcagtgaagtgcctcgaagccatatgccataggtgtacaacttgctcagccagtgttaccatctcgtcgaagctattccaccacagaaacaggtcttgcacaagggactcgagctcactgcgttcgttggatacgaaggaagaagtagctggaactcgccttctaatagatggaaggacttgcttgcttcaggggataggggatatgtaccgtgcattcttacacaaactgaatagttaa

SEQ ID NO: 45248 - DNA, 141 bp, Glycine max
  Peptide Sequence Number=SeqID_162026
atgactgtgaaaaagaggctaagttttgaattgcaaaatgcagcagttgggctaagcgcatatccaccgccaatggcagcttcagcgcacttaacacaaaggagaatctggcagagcatcagcatcaaagtcgcgcgctaa

SEQ ID NO: 45249 - DNA, 255 bp, Glycine max
  Peptide Sequence Number=SeqID_162027
atggacgaatacgcaagcatacgtttcatgcttgtttggctaggatttccagaagaagatgccattcgtttgatgagaaataaaaaggggatatcgaaaattcgagtggctgaagctgaagcagctactttcgaagtaacagaaagaaaagcaacgactggagtgggagagtcagagtcgaaaagaggattcctcacttctttctctcattcaaaaccgtgcatgagactttcatctcgcacggctcctaagtga

SEQ ID NO: 45250 - DNA, 162 bp, Glycine max
  Peptide Sequence Number=SeqID_162028
atggccttatggaaagaggaagcaaagaagcaactatggcaggcagggccaatgcacttgaactttcctatgcctgatccggtatctcttcttcagatgattgtaagatgtcaggtgatgcacaaaatcctcaggcaacactatcactgcatcactggctga

SEQ ID NO: 45251 - DNA, 816 bp, Glycine max
  Peptide Sequence Number=SeqID_162029
atgaaccctcttaccgatttggaggctaaagtagtacaattgaaaaactggggtagcatcctgcctgctaggcatttgttttgcggagtccagcttgcatctgggtataacaaaatttttgttgagccttacaactcacaattcatggctcatcaatttggccttactcaacatcttcctatggcctttctgacaacgacctcacctaattctcatcgtttgttgtttgccaaagagaaaagctcatcgactggaatcaccattaatccttcaccagctccgcaatcagaagatgacacttctccaaaattagctcctctgactttcaagagaaccactagatctattactgctcagaaatcatctgttcctaatcctccatcgactcgggaatcagttttcacagaagaaccttccaatgcacctttcgaatcttttgccattccttttatgccaacattgacccttggtcaattgtcaactttcacacgccccatcttgccaaatgttattgaagaagccttagttgaatacttacaatcccctgcttcttatgttcccgtggtatctgacaaatctcctattgatcaccatttttcccatgtggaacaattcatgtcaagatatgttccctccaattctgctatgctaaagtcaattcggctatcatttgccaaattggccgcaacacccacaatctttgatgctagttgccaactcctcaaccatatcaccatggcaattggtgacttaatcttcaatctaatatgcaccgatgttgatatcattctgccacgactgatttggaatagctga

SEQ ID NO: 45252 - DNA, 180 bp, Glycine max
  Peptide Sequence Number=SeqID_162030
atggctagagaaggaggatttcccctattagagatgctcagggcttggatcttaaaatccatgcaacgtcatactgagcatgtacttatgggcttagcgggaatggtggtgatctcgcacttagcgcttggtcgcgctaagtgcgcctttggactttctcgtgggccttcgtcgcgctaa

SEQ ID NO: 45253 - DNA, 312 bp, Glycine max
  Peptide Sequence Number=SeqID_162031
atggtcgaagctcttgctatgcacactatagcggatgacagaaatgttgttcagcaaagaaaagggtgggaaaaactgaaggaaagggtcatcaaacctaacattgatgccttggtgaaacaaaatcaagttagtgctaaagttattttctgcaactctagggaggaagccatatctgcagcctcactcattctcccatatgtctttgaagctcatgttgctaaagaagcttactggattgaagaatgtcctcctcaaattcagccatttcttttggatgatgtaagaccaatggtctctttatctcaatga

SEQ ID NO: 45254 - DNA, 291 bp, Glycine max
  Peptide Sequence Number=SeqID_162032
atgaaactagttgacacgatagagctatgtagagaatttgtagattattggtatccatatttaacagataaaatctcatctctagtgtgcttccaaacaagactatcccattggagatatgatgcaatcctccataggaagggaccagtcaccagagccacgagcaagaggctccaagaggattggattagagctgctgaagaaggccctatggttttcatgaacctcagggtagggtaccctagaaatgtaggatttttcagtccttgtattttagggcaccttgactag

SEQ ID NO: 45255 - DNA, 153 bp, Glycine max
  Peptide Sequence Number=SeqID_162033
atgtcttcccccaacagttctcaatcaaaaccccacgaatacactgatcactctaatgttctattccttccaacttgggcacttggctctaggggttctcacccctattataggtggctcaaaagagtaactacatcaaaagaagcttactag

SEQ ID NO: 45256 - DNA, 183 bp, Glycine max
  Peptide Sequence Number=SeqID_162034
atggacaatatcactgtcaatgctggatttgatgcagagaaggtttggaaggagctctatcagatcggtcatatggattttgggaggacttcatacaattattctttccttacctttgtgaaacgagaagctttagatgtgaaggtgtactcctgtgtttcacaagaatgtatctccttttaa

SEQ ID NO: 45257 - DNA, 678 bp, Glycine max
  Peptide Sequence Number=SeqID_162035
atggcagacaacacacgcatgaaggagcttacaggggatgtcaaaaggatcctggagacgatggaaaaccgcaataaagaatatgctgctcggtttgagaccttagaaacaacactggagatgacactcaaggataaaactagagatcccgggagtatatcactggctatgaacaatcacccttttaaggttgtgccctggtaccaaatgatgactcgtgaaaattcattcacaacatggattgcttttacgcgagccttagagacagaatttggcccatcaccgtgtgaatgtcctagatctcagttgtttaaactcactcaaattggttcagttcagtcatattacgtgcagttcacgtctttagctaatcgagtacaaggaattacacaagaagctctattggattgctttgtaggaggattaaaacctaatatcagaatggatgtcattgcacaatcacctacatcacttctcagaacagtttcgttggccaaactctatgaagagaaatatacacctaaactcaaacctttttcttcgagtttttcttccaaaacacaaacctcaaacacaaactcaaacctaaacacaaaccaaaacagccctcaatccctaaaatccacaagcttacccccactattactcacactcatacatcaaacctatcaatgttaa

SEQ ID NO: 45258 - DNA, 555 bp, Glycine max
  Peptide Sequence Number=SeqID_162036
atggatccccagccgattcctggagttgaagatagtgtcatggatgaaacagttgctggagatgatggtaaaagtactgtggaagcaccaacccaagggccatttgatgaactgggtcattctccagggctttcagggagcatatcgaaccctgttagaaagcagaaaagcattgccgaaattatgggggaggacaaagatgttcatacagcaaatagggagctggatgcaactgttgaaatggtgaatgcaattgggtcaaatgttggaaagaagagaaaaggtagtgaggatggaatggcatctaaacctgttcaaaagaaaatggagttgcttctagatgctgatggagatgtgtcatgtgctaaaaatgatggcaatggtgatgagggaaacagcgacgttggctcattgctgcagtcaaaagagaagaaagaagcttttgatgaagggaagagcgaagaacgaaatgagaagggtaatttgtcaagagaaaggaagagaagcaagtacttgtcccctcctttcactattccaaccagggggcaaagggag

SEQ ID NO: 45259 - DNA, 1023 bp, Glycine max
  Peptide Sequence Number=SeqID_162037
atgggcacggatgaaagtgacagcatggttctaggttcagagcaggagaaggaggttagggaagttcttgggggtttgaggagtgaggagggtagttgtggggttactgtgaatggggatgggttttctagcattgaaagcgaagggttgtgttgtgatggggtcgttgactttgtcgtcgagaatagtagtgtcttggagaccaaggtttcagttctgagtgaaaacgattgtcaagttttggctgattctgaggtgaatggggtgccgtcttggttaggaatgcaagaaagtgatatggatgcggtgttttccggtgatggtgctgagaagttggactttggttatggttctgagaagctggactatatgtttgcttctgagagtacagttcctgaggctgctgttttgagtgtgaaccgttcggtagaggttggtggagaagatggaagaggagggaagagtgaagagacaggaacatttgaagattgtgatgggggcattgtcgctgttggttctgagagtagagtggcagaggcttctgtttcgagtgttgaaggtttggtaggggttagcacagaagacagaagaggagggatgaaggaagaggaaggaatagatgaaaattgtgatgaggatgccgtcgctactgcttcggagagtagagcagctgaagctgctgtcttgagtgtggataatttggtacgagttgttggggaagatggatcagttgaggggataaatgaagaggatggaaaagatgtagattgtgatgggaacattgtggctgttgcttctgagagtagagaagcagaagcttctattttgagtgtggatagtttgatagggattggtggggaagtcgtaagagatgggggcgaaagtgaagaggtagaaaaagatgaagattgtaatgggaacattctgactcttgaatccgagagtagagttgcagaagctgctgatttgattgtggacagttcagtaggtcttggtggggaagataaaaacagagaggggtga

SEQ ID NO: 45260 - DNA, 258 bp, Glycine max
  Peptide Sequence Number=SeqID_162038
atggccatgagagagaaaaaaaaaagaaccaaccaggcatccgaaaggcccaacccaacaggggcgctaagcgcgcatcaggcgctaagcgagcaactaactgcaggcgctaagcgtggcgttaagcacgaaggagcagaaatcgttacgcgcgctaagcccggcgcccagcgcgcgatccaacagaagcacaggctgagcgtgcatggcgcgcccagcgcgcgatctgaacgcgctaagcgcgatgtgtggcgctga

SEQ ID NO: 45261 - DNA, 306 bp, Glycine max
  Peptide Sequence Number=SeqID_162039
atggtatgtaattacctatgtgcaaaggatagaactattgaacttggagtagaaaatgcattggatgtaaatgatatcatgagcaaaggagaaaatgaagaggaagtagttcacagtgtgagtattgacttagagggatcaagttctgccataaggaaaaacactcgcccaagtaaaaatggagagaaacaagggatgatttcctcaataaaaaaagtagttgaatcaatgaaagaatttgttgaagtgactaagaagaagacggagaacaaaaagaagatggagataaaagaagctcaagaaatg

SEQ ID NO: 45262 - DNA, 894 bp, Glycine max
  Peptide Sequence Number=SeqID_162040
atggaacaggttttgacccgcgaacaacggcttagccgcctgcgcgcgcgcagttcgctgccggtgctgatcgtcggcggcggcatcaacggcatcagtacttttcgtgagctggcattacagggcattcctgcggtgctggtggagaaaggtgactggtgccaggcggccagcggcgcgctgtcgcgcatgattcacggcggcctgcgctatctggagaccggcgagtttggcctggtgaaggagtcggtgatggagcgcgatcgcctgctgaaaaacgccgcgcactatgtgtttccgctgcgtaccaccgtaccgatcgataatctcggcggtggactggttaacgccacgcgacgtttcctgcgccagagcgataagcccacccggcgcggcgcgctgctgatcaaaaccggtctgagcctgtacgacctctacacccgacagtacggcgctatgccgcgccaccagctgcgtaacgaagccgccacgcgcgatcgctggcctggcttcgcgccctgggtgaaatacagcgccagctactacgatgcatggatcagcgcgccggagcgactcgggtttgagctgattgaagatgcggaacgcgcctgcccggaggcgctggcgctcaattatctgcgggtggtcagcgccagcgacgagacggtgctgctggaagatacgctgagcggtgagcgctttagcctgcagccgcacgtgctggtgaatgccggcggcgcgtggatcgaccagctgaatcagcagctggccgtgcattcaccaccgaccagactgataggcggcaccaaaggatcgcatctgatcctcgatcatccccagctgttacagatgctggacggtgaaatggtctatttcgaaaatcaggaaggccgg

SEQ ID NO: 45263 - DNA, 541 bp, Glycine max
  Peptide Sequence Number=SeqID_162041
atgagaattgtcgggaagcctggcaggggaaaaggaattttcatgttttcatgggcccgattaagcgcacttgcgctgctggtcagcggcagtgcgctggcaacgacatcaccagacagcatcatcaaaccgctgatgcagcagtatcagatccccggtatggcggtggcgattctgcacgacggcaaaaccgaattttataactacggcgtggcatcgaaagagagcggacagccgatcaacgagcagacgctgtttgaaatcggttcgctgagtaaaacgtttaccgccaccttagccagctatgcggcgcagcagaacaaactgaatttcagcgacgcggccagccagtggctgccggaactgaaaggcagcgcttttgatcgggtctcgctgctgaatctggcgacgcacaccagcggcacgccgctgttcgtaccggatgacgtgaccaatacccgcgagctgatgcgctggtacaaacagtggcagccagaggcccagccgggcacggtgcgcgtttattccaacctcggtatcg

SEQ ID NO: 45264 - DNA, 204 bp, Glycine max
  Peptide Sequence Number=SeqID_162042
atgcctagccatctaaaataccaagttatttttatgaatcacttagaaggagatagcccacttagaaaaggaactctgatcataggagttgtagggcagattggaggtagtctaaatgcaggtgttgttggtataaatattgggacatttacaacttgtggtgaaacttcaactacaattggttcaatgactaatgcactttga

SEQ ID NO: 45265 - DNA, 267 bp, Glycine max
  Peptide Sequence Number=SeqID_162043
atgttggagagtccaaagccttataaaccctacactagaacctcatacttccataagggacttaaggcacataccttgcaattggatcctaacattctccaacacgatgattctcctccaattcccttctcagttgagttcaaagttgccattgttataagctttcagtcagagctaagtaaattgcacaaaaaatccgaccccaaaactccgagactctggctggcaatggaaacattaccgctagagttgattcggacaaagtaa

SEQ ID NO: 45266 - DNA, 993 bp, Glycine max
  Peptide Sequence Number=SeqID_162044
atgtccgttgaactcaagctctctcgttccaatcgtatctatcgcccttcggaagctctggaaggaaaaatcgttgtcaaaactcagtcttcaatctcccactatggaattcgccttactgtcaaaggatccgtcaacttgcaggttcgtggaggatcagctggggttgttgaatcattctacggtgttattaagcccatccctattgtgaataggaccattgaggttaaatcttctggaaagattggttctggtacatcagagataccattctcagtgaatcttagacagcgggatgaaaatttagaaagattttatgagactttccatggtgcaaacattagtatccagagtttaaaattgatctgctgccagtataaattctttttgttacccagttacgcactgaacatgacagtgccacattttggtaaccaagatatatctcgtggatacttgcataaatcattatcagcaacaatggaactcattgttgaaagtgataaagctgatcttcttcaaagaccactttctccagagatggcaatcttttacattacccaagacactcaaaggcatcctctacttcctgaattaaaatctggtggatttcgggtgacaggaaaaatctgtactcaatgttctttgtctggtcctattagtggtgagttaactgtagaaacatctgcagttccaattcattcaattgatcttcagttgtttcgagttgagtccattcttctcggggagaaaattgtgaccgaaacctctctgatagcagatggagatgtgtgccgtaatttgacgctgcctatttatgtaatagtaccacgccttttgacctgtccaataaccttagctggtcccttctcagttgagttcaaagttgccattgttataagctttcagtcagagctaagtaaattgcacaaaagatttgacgccaaaactccaacactatgggtaggttcaggtccattgttagatttgtga

SEQ ID NO: 45267 - DNA, 204 bp, Glycine max
  Peptide Sequence Number=SeqID_162045
atgttgatttccgagttctttggctttttgatgttgccaaagggggagaaaaaggttgtagcaaagaaaaagcttaagaaaaagcttaacaaacttagaaatcaagtgatcatgtattgtattgtcatcatcaaaaagggggagattgtagatgcaattggctttgatgttttgatgatgatcatgataatgtgttgcaattga

SEQ ID NO: 45268 - DNA, 1557 bp, Glycine max
  Peptide Sequence Number=SeqID_162046
atgtctgggttggaggaattgagaaaaaagcttgcacctttatttgatgccgagaaggggttctcatcaagttcaacgttggacccttgtgattcttacacattctcggatggtgggactgtgaacttgttgagtagatcatatggggtgtacaatatcaacgagcttgggttgcagaagtgcacatctaggtccgtggatgaaactgatcacagtgagaaaacgtataggtgtggttcccatgagatgagaatctttggagcaatagggagtggtgccagtagtgttgtgcagagagctatacatataccaacacataggattctggcattaaagaagatcaacatcttcgagaaggagaaaaggcagcagctccttactgagataaggacattatgtgaagcaccgtgttatgagggtcttgtagaatttcatggggcattttacactccagactctggacagataagcatagctttggagtacatggatggaggatcgcttgcagatatcttacgaatgcatagaaggatacctgaacctattctatcttccatgtttcagaagctcctgcatggtctaagctatctccatggagttagacatctagttcacagagacataaagcctgccaatctactagtaaatctcaagggggagccaaagattactgattttggtattagtgccggcttagagaattcagtggcaatgtgtgctacatttgttggaactgttacatatatgtcacctgagaggattcgaaatgaaagctattcttatccagctgatatttggagccttggtcttgcactttttgagtgtgggacaggagaattcccgtatactgcaaatgaaggtcctgtcaatcttatgttgcagatcctggatgatccatcaccatcaccattgaaaaacaagttttcacctgaattctgctcttttgttgatgcttgcttacaaaaggatccagatactaggccaacagcagagcagctgctttcgcacccctttatcacaaagcatgatgatgccaaggttgatttggcaggatttgttcgaagcgtttttgatcctacacaaagattgaaggatttagcagatatgttgacaatacattattacttgctatttgatggacctgatgatttgtggcaacatacaaagaatttatatagcgaaagctcaattttcagtttctctgggaaacaacattgtggtccaagtaatatctttacatctctatcaagtattagaactacattagttggtgactggcctcctgaaaagttggtgcatgttgttgagaggctccaatgccgcgctcacggtgaagatggagttgcaattagggtatcgggatccttcataattggaaatcagttcctcatatgtggagatggcattcaagtagagggcttgccaaacttcaaggatcttggaattgacattcctagcaaaagaatgggtatatttcatgaacaattcattgtggaaccaaaaagccttattggatgctacaccattgtcaaacaagagctatacattaaccaataa

SEQ ID NO: 45269 - DNA, 201 bp, Glycine max
  Peptide Sequence Number=SeqID_162047
atggtgaatgttaacaaagcttccaagggaagaaccatcacctatagaaggggttggtatcccatagaaaggggtggtgatgggattggaaaaactctatcacaaaggaagggttgtaggtggaatgagaatggagttttgcgagggaaacatggtttgagttcgtggactccagcaagaattttcaaggaaaagacttga

SEQ ID NO: 45270 - DNA, 551 bp, Glycine max
  Peptide Sequence Number=SeqID_162048
atggaatttgattcaagctttcaagggccacaatacctttcaagccctttcccacctacgactcaaaccatgtttccttcgcaaagctcgattctaattccaccatcaccccagcccatcatgtttcaccccaacaacactacttttcatcattttcaagacttcatcacgaatgtgcctacctttgtgatggagggtccttcctccaacatcaccacccccttgtatagagggtctttccttggaggctttgttaacatccaccatcaccaccccaacaaaatggatgctttgcatggtcaccaccataaaggaaaaatcatttgggatttttcacaacaattgatggttcattcatctgaagcttcttcctccaagtcatcatcacctctttctctctctaatgagtatggattggtgatgggtgactatcattggcacactaatcagaggagtgtgcaacaaaatatgaaggtggtaaaggtgaatatggataccaacattgcaaatgataacataatcaaaggacagtggactctggaacaggacaa

SEQ ID NO: 45271 - DNA, 2541 bp, Glycine max
  Peptide Sequence Number=SeqID_162049
atggctgccacagcaactgcatcttcgatgggtccgcgctatgcaccagcagacccgacactccctaaaccatggcgaggtcttgtggatggcaagactgggtatctttacttttggaatcctgagactaatgtcacccagtatgagaggccctcctcaagctcaactgcccagccaaagtcttcttcagtgcccaattcttctgtccaggttcaacaatcgtctcaagggtcgcaatgtggtcatagtcctgatttcagtgataggtatgatagaaatggcagtggtgggtctaacgaagctggatcacggaataatcagaagagttccaaagggggaagttatgcttctcatgatgtttcaaatggaacacatgttgctggcaatgttgattcttctgtcagaggtcatggggcttcggatgctggagctggactatctcctgagtcttatcgacatcggcatgaaatatctgtgactggagacaatgtacctccaccccttgcatcatttgggtcaactggctttccatctgagcttctgagagagtggcagttaggaggatacccaagtttccacaggtgcgatatttgctcctggggaggagctaatgtccatttagtttggactttggagcgtcctttatggtggaccaagtttttggaagggctttccgaaccatccaagttcgtggctgggactgctgttggtcatgattcagtctgccacttggtctgtacggaagaagaggcctctcctcatgtacaaaatgctgggttctcagccccaactccaattcaggcacagtcatggcccattgctcttcaaggtagagatatagttgccattgctaaaacaggctcagggaaaaccttggggtatttagttccggcatttattcacctcaagcgctctggcaataactccaaaatgggccccactgcattggtactttcaccaacaagggagttggcaacacagatacaagatgaagctgtgaaatttgggaaatcatctagaatttcatgtgcttgtttgtatggaggagcaccaaagggtcctcaactgagagacattgatcgtggagcagatattgtggtagccactcctggtcgcttgaatgatattcttgagatgagaagaattagtcttaatcaggtttcttacctggtgctagatgaggcagacaggatgctggatatgggttttgaacctcaaattaggaaaattgtgaatgaggtgcctaatcgcaggcaaactctaatgtttactgcaacatggccaaaggaggttaggaaaattgcagctgatctgctagtcaagcctgtacaggtgaacattgggaatgtagatgagcttgttgctaataagtccattactcagcatgttgaagtattgccaccaatggagaaacaaagacggctggaacatattttgcggtcacaggattcaggatcaaagataattattttttgttctaccaagaaaatgtgtgatcaacttgctcgtaatctgacacgtcagtttggagctgctgctattcatggggataaatcccaggctgagagggatcatgtgttgaatcagtttcgaactgggaggtctcctgtgcttgtggccacagatgttgctgcccggggactggatatcaaggacattagggtggttgtcaattatgacttccctacaggagtggaagattatgttcataggattggaaggactggaagagctggagccactgggctagcttacactttctttggtgaccatgatgctaaatatgcttcagatctcatcaaagttttggaaggtgcaaaccagaaggtgcctccagaacttcgtgatatgtcatcacggagtggtggtgggatgggcagatccagacgatggggttctggtggacgaggtggtgattctggatatggtggaaggaataatgactctggatatggtggaaggggtaatgatgcgggatacggtggacgaggtagtgattcaaattatggagggaggggtacttctgcttctggcagaggtggaggccgtgggtttgactatgagtcccagaggaatgatagggatcggagcccagacaagggatcaagttggagggatcgcttcaaaagcgtcaaccgggatcgcagtcgtagtcctaacagggccgcattacctcaacattcccaaggtggcagctttcacaaggcaatgatggaacgtggtggatgggatagtgatcgcaacaagagctttaaccgggaccgaagccgcagtcctagccctcatagacaggtgaagggcccagcagttcgcgaacattccccagtttacagttttcatcgatcaatgatgggacgaggtcaatcatctccgtcatctcaacggcagcgtgcatgcagtcctcaccgaaactcaaccccctcccagggtgatggaagacatggtggatctcattcatcttacaatggagaagtggaggaagggatgattcccgaggaagaaggaatgataggtcaagatgatcctgtaaatgtggattag

SEQ ID NO: 45272 - DNA, 845 bp, Glycine max
  Peptide Sequence Number=SeqID_162050
gtactgttttccgtgaacccataatatgctgcaacataccgagaattgtttccggatggaaaaaacccatttgtattggtaggcatgcttttggtgaccagtatcgggccactgatgcaataattacaggaccagggaagcttaagttggtatttgtcccagaagatggtgatgctccaatggagcttgatgtttacaatttcaaaggcccaggtgtagcacttgctatgtataatgttgatgagtctattcgagcatttgctgaatcatcaatgtcacttgcatttgcaaagaaatggccactttacttgagcaccaaaaacacaattctaaagaaatatgatggcagatttaaggacatattccaggaggtgtatgaagaaaggtggaggcaaaagtttgaagaacactcaatatggtatgagcataggctaattgatgacatggtagcatatgcactcaaaagtgaaggtggatatgtttgggcttgcaagaattatgatggtgatgtccaaagtgatttacttgctcaaggttttggctcattgggtctcatgacttctgtgctgttatcttctgatggcaagacattagaagctgaggcagctcatggaactgtaactcgacattttcggtttcatcagaagggacaagaaactagtacaaacagtattgcttccatatttgcatggacaagaggactggaacataggtactttgttgctttattcaagctgcaaattatagtgcattttgatgctctttggaagttttcctttgttaatcttatttccaagtatgagcggacacttcaatgcttttgcttaagttttagattggagtaa

SEQ ID NO: 45273 - DNA, 1317 bp, Glycine max
  Peptide Sequence Number=SeqID_162051
atgccacctcagtatttttatcctccacctcaatttcagtctcagcttgtgaaccctactgcatcatcaccctctccacatgcccatgttgctagtgttcaaccagtgcaatctacaaactggtatcctgattctggtgcttctcaccatgtgactaatgtgtcacaaaatattcagcaagctaccacctttgaaggtccagatcaaatcaccattggcaatggtcagggcttgaacattaatgccttaggtgtttcatcttttcattctccctttaactcaaaaattcctcttacttttaagaatcttttatttgtgccttctatcactaaaaaccttcttagtgtcagtcaattctgtaaagataactcagttttctttgaatttcatcccaatcctgtgatatctgctccagcactccctacttcagtgcaatccactgcagaatctcctcctttactggtcagacctgataatactccctcaatttgtataagagcaaaagctggcattgttaaaccaaggctgcaaccaactttgcctctcactcatgctgaacctaagtccaccaaatcagctccatctaatcctacttggcatgcagctatgaaggcagaatatgatgctcttcttcttaacaacacttggacacttgtggatctcccttcctcaaggtctcctattggttgcaaatgggtctttagggtcaaggaaaaccctgatggtacgcttcaaaaactagatgtcaacaatgcttttctgaatgacattcttgaagaggaagtctacatgactcaacctcctggatttgaggactccaacaaacatctgctatgcagcctaatttctctgtctcattattctgttcatgcctattgtgatgctgactgggcatcagatcctgatgatagaaggtcaacctcaggcgcagcaatcttcctagggccaaatttggtctcttggtggtccaaaaagcaattagtagtggctaggtccaatactggagccaaataccgaagtttagtcctagccacagctaaactcaaagttcctcatgctcctcctgttatcttttgtgacaacctgagcacagttgccttagctcacaatcctgctatgcactacaaaaccaaacacatagaactggacttgttttttgttcaagagaaggttatcggaaaacatgttcaagtggttcatgtccctgctgctgatcaaagggcaaacatccccactaaagctctcacaccctccaacttcactgcttacaggtccaagctcagagtggttgaaaagatttctgccaacccctcatga

SEQ ID NO: 45274 - DNA, 1929 bp, Glycine max
  Peptide Sequence Number=SeqID_162052
atggcttccaaatatgataacaagtacaacaatccatcatttgttgttgttatcttcacagtggccaccctattgtgttttttctcccactcagcactatctgatccaagaatctcagaagtggggcactactgcagcacacagaagtcaccaacaagtggtgattacttccccatattcaccaaagaaatggaaaaacttcaagaagttgtgacaaaacaaaactggggaactcactctgagggcatgtcatcaaccactcctatctatggcttggcacaatgcttccaagacctttccagcattgattgccttcagtgctttgcatccagccgcaccaagctccctcgctgcctcccttcggtttcggctcgaatttaccttgatggctgcttccttcgctatgacaactacagtttctacactgaggacactgaccctttgagggacacagtgaactgcacctcacagtatggtgctgtggttggtgatggtgagaagttggtgtttgctgagagtgttgccaaagtggttgagagtgtggtgagggtggctgtgaatgagggaagaggcatttttgcagtgggagaaggtgggggagtttatgccttggcacagtgctggaaaactgttggggtaaaagggtgtagtgattgcttaaggaaagctgaaaatgaagttaaagggtgtttgcctaagagggaagggagggccttgaatactgggtgttatttgagatattcaactgttaagttctacaatcaaggaggtgaagatggccaaggagatgattcttccagaaaacgagccatcgtagcagcagggtcagtcttggctgcagctgttgtagtgctcacgctcgcggcctcttatgtggcctcaccaaaaagagaaaaagccacagattatttcagctcttcaagaaaaataggccaaggaggagctggttctgtatacaaagggactttgccaaatgggaatgatgttgctgttaagagattggtcttcaataataggcaatgggtggatgatttcttcaatgaagtgaatttgattagtggaatgcaacacaagaaccttgtcaaactattgggctgtagcattgaaggccctgagagcctcattgtgtatgagtacctacctaacaagagcttagatcaattcatttttgaaaaggacataacaaggattcttaaatggaagcagcggtttgaaataattcttggaactgcagaaggacttgcatatcttcatggaggctctgaaataagaatcattcatcgagacataaagagtagcaatgttcttctggatgagaatcttaaccccaagattgcagattttggtcttgcccggtgtttcggtactgataaaacgcatctaagcactggaattgctggaacattaggttacatggctcctgagtatctcattcaaggacaacttacagataaagcagatgtctatagttttggagtacttgttctggagattgcaagtggaaggaagaataatgtcttccgtgaggattctggttcccttttgcaaacagtttggaaactttaccaatcaaacagattgggtgaagctgttgatcctggcttgggagaagattttcctgcaagagaagcatcaagggtgtttcaaattggattgctatgcacacaagcttctgcttccctgaggccatccatgactcaagttgttagcatcttaagtaattcaaatttggatgcccctataccaaaacaacctccatttttgaactctagattgctagatcaagcatctccattaggttttagcataggcagctcctcatcaaacacatttaagaagactggtgtgtcctacagcccctctgagttctctagcacatgcagcttaattgggccaacaagaaatgaagaaacaattatggaagcttga

SEQ ID NO: 45275 - DNA, 2376 bp, Glycine max
  Peptide Sequence Number=SeqID_162053
atggaggaatttcattccactccccttgggggacacaccggcgccaccaaaactcttcaccgccttcgtcaaagctttgactggcccaacatacgttccgatgtccgccgttttgtggcccagtgtattacctgccaacagacgaagtacgaaccacagaagccaccgggcctgcttcaacccattcccctcccctccgcgggtgctcactttggtccattacccaccagtcacacggctcataaggttgcttgcctcttctttgacatggtttgtaaacaccatggttttccccggagtttaatctccgacagggacgctctgtttctcagcagcttctggagagaactctttaagcttagtggcactaagttacggatgagtacggcatatcatccccagtccgacggccaaaccgaagtggtcaaccgcgtcctggagcaatatctccgctcattcgtgcatcacaaaccccaccactggtctcgatttttatcgctcgctgaatggtcttacaataccactgttcatactagcacgggctacacccccttcgaagttacctacggcaaagcacccccttctctaattgactatgtccgcgggacctcccctattgatgctgtcgattccatgctaacggatcgcaccgaacttcacaacacattactccggcgtcttcgcaaagctcaagagttcatgacgacttctgcgaacaagcaccgccgtgatctgcaattttccgtcggagattgggcttatgtcaagcttcgaccctaccgacagaagtccgtagctcctgcctactccaaactctccaagcgctactacggtccttatcaagtgatcgaacgcatcggctccgtcgcttatagactccagcttcctccgtcatctcgcatccatccggtgttccatgtttccctgctgaaacgtcaccaaggccctcttccccttacctccgctgccctaccgccgtccagcgtggagcatcatcccctcgtcactcctttggcgttcttagattggcagtgggacacctcggttaccccggcggctcgcaaggtgttcgtccagtgggcaggtcttcctccagaggacgcctcatgggagtcttggtccgatgtgaagcacacttttaacctcgaggacgaggttccttttgaaggggagggcgatgatagcaacatccaaataacagaacacatagagactgcagcagtcccaaactacacagcagacaacaaagaggaattcacagctataaatagcagaaacaaacgtgacactcacaggcccaaataccttgcaaattacaacacatttactgaacatgttgttatgtatgtactacaatcaggtgcacggatgtctgtaggtgatggaacacttacaatagttgctaagaatcaatctgtaatggacaaaatactagaaaagttcaaccatgtttgtcagattgattttattgtgggccgtcaaattgaagttggaggtatctacacaggtattgtcaccactataaaagaatacggagcttttgtggagtttaatggtggccagcagggcctactccacatttctgagttgtcacatgaaccggtctccagagtttcagaggttgtctctgttggccagaagctttctttgatatgcataggccaagatgttcatggtaacattaaattatcccttaaagcaactttgcctcatcctggaggattggagactaatgttgtagttgaagaatctgttgcatctgtaaaagaaacagccaacatttgggcaccggttgggaatgtgtctagtatacaagaagaacaaaattctgcttctgagttgtctttaggcaatcttgagttgggggaagcaaaatccgaaacctcccaagtaccagtaattttaatacgtagtgctgcagaatgtgatgaagaggagaaatcatccagcttgaatctgtcttcaaaaaatcctcaagtagataatggggtgcaattggatctcaagtcaaaatctcgatctcaaaatgctaaatcttgtagatctcgagatgttgatgctccatcttctcattcaggtcccctgccttatacaaatgttaagaagtcaaaactttcaatgcacaaagagtcaaaatctgatcttcaaaggccaaaaggggatgagcagggacctaaagataaggtaactgcagaagatctgaaactcggaagcgaagtaactgccaaagtctcgcaaattggtgcacatgggttagtgttggatttgggtggaggacttagaggaatttaccggtttgagattaacggtatgaagcttgagaaagttgttggaaaatgggtctttgagatgctcgatgcaagtttgccatcatga

SEQ ID NO: 45276 - DNA, 345 bp, Glycine max
  Peptide Sequence Number=SeqID_162054
atggcaggtgaagacagcggcggtgacggtggaaaggacgttggtgttgtccatggccaaaacgacggcgccattggcgaagcgcgcgatcttgcaggtctcgagcgtgatcacgcgcgaaccgatttcgaattgctctgtgaaggtctcgaggtgcttggtggcggcggcggcgaaggtgcggaagcggaaggcacgccatgtgaggaagtgcggcagggtgcggaggagtggcttcgttctcttcattcgcaacgggtgaagggaaatgaaggaagaagaagctcgctgatgatcgttgaacttgtccagtctacgaaagctaatgaacttcaaacgaaataa

SEQ ID NO: 45277 - DNA, 3042 bp, Glycine max
  Peptide Sequence Number=SeqID_162055
atgcctgagcatcacacgcgtcaagtcactctcgataaacttgacgatgctgtccaacgcctttcgcagggtcagatctcccttacagaaggccaggcttccttgtctcagaaccaccattccctcaacatcaaaatagacaacatccatgcctccctcaccacccaaatcgagtccctctttgaccgcctcgccgccatcgcggtccctcattcttcccccgtctctgccacccaacctcccccttccccaatttcacgccaccatcatttgaagcttgatgtcccgcgtttcgatggccacgaccccctcggatggatatttaaggtgtcccagtttttcgactaccaggggatcccggaacccgaacgccttactatagcctccttctacatggacggcccggcactttcgtggtaccagtggatgcaccgtaacgggtattttccctcctggcccgcgatgctccaggctctcgaatcaaggttcgccccttcgttctatgatgaccctcagggcagtctcttcaaactccagcaaaccggctctgttacagactacctgacagccttcgaacgccttgccaaccgcacgattggcattgctccctcctccctactcagctgcttcgtttccggcctcatccccgagctccgccgcgaggtccaggccttacggcccatgtcccttcctcaggccatcgaactcgcccgtcttcaggaggataagttgatcgaccgccgtcgcgggtcccgtcctccgttcccagccccgccgcatccctcccctgccccaccacaatcattttccccaaaacccactacatcacctttccccaaatctcctacccctctcccttccccacgcatccccgtcaaacgcctctccgccgaagagttagccatccgccgcgatcaaggcctttgctaccactgtgacgataaatggtcacatggtcatcgctgccggtctcgattacacctactcctagctgacgaagatattgagaaccctgatatttccccggaccctaaccctgaccctcctctcgtttcccagatcagcctcaacgccatggaaggaacagttgctccccagacgtgtcgtctcctcggcatgattggccaccatcaattgattgttctcgttgacggtggaagttctcataacttcattcagactcgaatagcgcgcttcttggctctccccactgcccctaccccgccgttacgtgtcatggtaggaaacggcaataccttagattgtgacaccctctctccccaaacccttctctccctccaagggcatgagtttactcttgacctcttccaccttcccctctgcggcgccgatatagtcttaggggttcagtggctgaaactccttgggcccgttaccacggattactccgcgctgaccatgacttttccctacttgggccacactattaccctatttgctgacgcaccccccaccttaacctcagcctcggcccatcagcttaaacgttttgcccaaactcacagtatttccgccttataccacataacccccataccggcccaacccgtctcccctttaccagcttcaccccctacccctccctccatcaccatcgtcctcaaccgttatgcctccatttttaatgaaccagaccacctacctccttcccgcaacatccaacatcacatccatctccttcctcactccacccccgtcaatgtcaaaccttatcgctacccccacttccaaaaaaccgaaatcgaaacccagatttcctccatgctggcttcgggtctgattcagcccagccatagccctttttcatccccgatcctattagtaaagaaaaaggatggttcctggcggtgttgcgtggactatagagccttgaattccattacggttaaagaccgatttcccatgcccacaatcgatgagttgttggacgatttgggcaaggcctcatgtttttcgaaacttgatttacgacagggtttccaccaaattcggatggcagcttccgatatccccaagacggcttttcgcactcatcagggtcattacgaatactgcgtaatgcctttcggcctgtgcaacgcaccttcaaccttccaggcggccatgcacgatgccctccggccattcctgaggaagtttgtcgccgttttcttcgacgacatactagtttacagcccagacatttccacccatgcttctcatctggactctgtactctccacattacttgacaaacagtttttcctcaaagcttctaagtgccttttcgcccaatctcagctcaattatttgggacatatcatctcggcacaaggcattgctccagatcctgataaggtccaggccatgattgattggccgattcccaccaccaccacggtccttcgaggattcctcggcctcaccggcttttatcgtaaattcattcagggatacgcttccgtagcagctcctcttaccgcccttcttcgcaaggatcaatttctctggtccccgacagcatccacggcttttgacaccctcaagaccttaatgacccaagctccaatcctagctaccccggatttttctctgccttttatcctggaaacggacgcgtctgcggtggctatcggggctgttctcctccagcgacaccaccccatcgcctacttcagcaaagtactatgccctcgtttacaacaggcatcggcgtacgtccgtgaacttcatgccataacggctgccgtccgcaaatggcgccattacctcttgggctcttcattcaccatcctcaccgaccataggagcctcaaggaccttatgtcgcaagtcattcagaccccggagcagcaaacttacctcgtgaaactcctgggatatgattacgacatcaaatataagccgggaagctctaatattgttgccgacgcgttgtctcgtcttcctcagggcgaatgcttttccttctcagtcccacactacgactttatggataagctccgccacacgcttatgcaggaacccagtatcgggacttag

SEQ ID NO: 45278 - DNA, 1860 bp, Glycine max
  Peptide Sequence Number=SeqID_162056
atggagggtaataagaagactaagcaatatggtcttgactctgccacttcttggtttggaagttgcatttcttcatgttcatcatcagaaaaagtgtcaactcacagaaagcttcctagaactgcttccgaatcatcagttaccaaccccatgaagaagcgtggaggatggaaggccataatctttattttagggaatgaaaccttcgagaggttggcagtgtttgggttatttgccaacttcatggtgtatttgacaagagaatttcacttggaccaagtttatgcttctaacattatcagtttatggtttgggatctcaaactttacccctcttcttggtgcctttatttctgatgcctatgttggtcgcttccgaaccatagcttttgcatcctttggtaccctttcgggtttgatcgtggtgagtttaacatcgtggttaccagaattgcaccctccatcttgtactcctcagcaactagcatctcgtcaatgcgtaagagcaagcagttctcaaataggtgtgcttcttatgggactttgcttcttaaccatcggatctgctggggtaaggccatgcagcataccatttggtgttgaccaatttgatccaaccacagatgaaggaagaaaagggatcaatagctactttaattggtactacaccactttcacaatggtattgttggtcactcaaacagtggtggtctatatccaagactctgtgagctggaggatagggtttgggataccaactgtgtgcatgctatgctccataataatgttctttgtgggcacaagggtctacgtgcatgtaaagcctgaaggaagcattttttctggtattgctcaagttttagtgactgcatataaaaagagaaaactcaaccttccaatgagtgaggagaagccagatggagttttttatgatcccccactaattgggatcacagttgtgtcaaagctgcctttaaccaaagaattcagggccttgaataaagctgcattaataatggagggtgagctaaacccagatgggaccagagtaaatcaatggagacttgtcagcatccaacaagtagaagaggttaaatgcttagcaagaattatcccaatttgggcagcagggattcttagtctcatttccatgactcaacaaggaacatttactgtgtcacaagcaatgaaaatgaatagacaccttggagccaaattccaaatcccagctggttctgttagtgtcatatcactaatcaccatagctttatggcttccattctatgaccgaatcctagtgccaaaactcagaaaaatgactaagcatgaaggtggtatcactctcctcctaagaattggaattggcatggtgttctctattctatctatggttgttgctggctacgttgaaaaagtgagaagggattcagcaaattcaaatccaactccactaggaattgctccaatgtcagtgttgtggctagccccacacttgatccttatgggtctatgtgaggccttcaatattataggacaaattgagttcttcaacaggcaatttcctgagcatatgagaagcattggtaattccttcttctcgtgttcttttggtgtgtctagctatgtgagtagcataatagtcaacatagttcatcattctacaagaacacatagccatccggattggttaacagatgatataaatgctgggaggctagactacttttactacctaatagctgggttaacttccctcaacctagttttttttatatatgttgcaagaagatatcagtacaagggaaatgtggacctccttgatgaaactcatcaggtagagcttggatctcacaaagcctaa

SEQ ID NO: 45279 - DNA, 495 bp, Glycine max
  Peptide Sequence Number=SeqID_162057
atgacaatagctaccctttttagcaagctaaagtatgagttagagcttgggagactaaaggacgaagaatttgaaaagaaaaagaagggattagccttaaagacaagcacttcacataatgaagctagtgatgaagacccttcgaaaaatttagataatgaaagtatggattttcttgttaagaagttctccaagttcttgaagaagaaaagaagagacacaaggaaatttcaaaagaatagcacaaagaaaatttactccactcccataacgtacacatctttgagtgtcggaagcaaggtcacttcctcaagtgaagaggaagaagcaaatctatgtctcatggccataattgatgaggatgagacaaaaaacaatgttagtgacacttcttctgaatctaatacaaactatgagaatctacttggtgcattcaaagagttacatgaagaggcacaaagacttacctttgtgaaaaaaactctaaaaggctaa

SEQ ID NO: 45280 - DNA, 333 bp, Glycine max
  Peptide Sequence Number=SeqID_162058
atggggttctcgcattcggacttagaatcggaatccaagaagtgggtaattgccggaatcggtgttcgctcgctcaaacccatcaacacaaagcgcgttggcggcggcagcggtggcggcgatgctgagaacgaagaagaagaagcgcgttccacgacgccgactgccaaggaggcgaggataccggaaaagttgccgtgcccgccggcgccgaggaaacgccgaccaccgccgtcgaggtgtggtaacggcggcggcggcggtgtgagagagttcttcacacctcctgatttggaaagtgtcttcaagtgccatgttgagaaagccaaatga

SEQ ID NO: 45281 - DNA, 231 bp, Glycine max
  Peptide Sequence Number=SeqID_162059
atgacaccgatgatcgaggcggacttggtggatttgacggcgagttggggttctaaagggggaaaaatgagtctaactgaggatggtgtggtgagacttgatggaggggcgtgtggatttggtcttggtagtgtagagggtaaggaggatggcttcaaagcctgcaagggacggtggctccggggagtggatgtgggagaggaagaggtcgatgaggagagggatggataa

SEQ ID NO: 45282 - DNA, 804 bp, Glycine max
  Peptide Sequence Number=SeqID_162060
atgcgaaagagtagacaagatagttcaattgagagcaagctttccaaatatgtagcaattgatctgcaaacaagtggtaaaacttcaaacagcttgctagaatctttgtcaaaacacaaaggtaacaatattactaaaataaattctttgaaaaatggtacaattgatattcaatcaagcaaagaaaagtcaggtagtttgtctacacggtcaaaagtcaaggaaagtgataacattaatccctcttctatcaaagatggaaaacttgaaagtatttccagcagtttcagcaacatggttgtcaatataagatctggaaattctgaatacactaatgctaagggaacttgctcacatgtttcttataagccagaaatatggattctccctcaacaagttgaagatacattgactcagctgaatctttcaattatgatgaaggaatcacaaagcaaggacaatgccactattcgatgggatattggttttaataagaagcgtgttgcatactttgtatttccaaattggataaagttgttctacccatcgaaagttctgttggtgggagcatcctccataattatgatttacttcttggacacaagctacacattgttggggaggattactgaagggatagaagaatctgtgtgtgggaggttatattatgggacatctaaaaagattccaccatcagagcttcttgatacaattggtgttggggatgcatttgttggagttattttatattgcacgtgcaacctcttcataaaatcgttgcacatgcaagatggaactttttga

SEQ ID NO: 45283 - DNA, 218 bp, Glycine max
  Peptide Sequence Number=SeqID_162061
ggattgtgaggggaattgacacagtcaaaggtgtgctttatgtcattactcctgtaccacataattctctcgaaaaagtcaacgtcttgctacagggttatatccaaattccatcttgtttattgcaggcaagttattgctttcataacgagcaaagtgccgcctgtgagaggcaaacaaagactaccaacatgatgaagccgtcccttgagacataa

SEQ ID NO: 45284 - DNA, 609 bp, Glycine max
  Peptide Sequence Number=SeqID_162062
atggagtggttgggattggggccttttctcattgttgtaaagtgccttttctttggtgatgtttcttctaagagagatccatcaacatacttaagttatgtatttgccatatatgattattaccaaaagaagtattgcatctatgaaaagggagaaaatccttgtaaggttaagttgcctcttattgtgaatactcctggctgggtgaaaggtgttggttacgatgtattagtggacatgttgaaatatatttctccaacacatgtagttaagataagcatagccagtgaaaagaagaatctacctgctggagaattctggttagatggagaacacgatgaaacaattaacctaattgagataaattctgctcatcaggactcattaaatagatcgttgcttgttcagaaggatgcacgtctcctacgtgatctacgaataatggcttatttcaaacagtgcttttctagtgattcaaatatttctacaatcaaggaacttgctcatgccttggcctctcactgtccttatgaagttcccattgcaagcataaagattcgacatcttcattgtgaggttggcttaaattttacttttttacctttctga

SEQ ID NO: 45285 - DNA, 1530 bp, Glycine max
  Peptide Sequence Number=SeqID_162063
atggaaactccaagctcccactctctcttcgcccacatcgcctcccgagaactcttccgagttccaaaacgacatcgtatggacggattcgtctccggcttcaatgaaactggtctcctcgccgtacagcacaacgccgaggacaccattcccctctctctctccttctgcaagacttcaaaatttggacacattctcgcggtgtccgacgaggacggttacatcaccttgtttgatactcgccgcaacttccctgttactgcaaactttgaagaaaactcagagaaagtgaagatttgccattgggtttcacatcagaatgctgtttttgatacctgttggattaaggaagatacgcagattctcactgcttctggtgatcaaacaataaaattatgggatgttcaagaacagaagtgtcttggagtgttgactgggcacacaggaagtgtgaaatctatgtgttctcatccaactaattctgatattattgtctctggttctagagatggatcctttcgtatttgggacttgagatgcaaatccactgctaagagtaggcatggagaagttggcatatgttcaatgggtggtgtcaaaggagcacatatttcatctcaagcaagacgaactaggagaggaaaggctgctccaatgagcattacatctgttctttgtctcaaggaccaggtttctatagccactgctggggcggtggatagtgtgttgaagttctgggataccagaaatttgaaaagtactgtcactcagacatctcctagtcctcagtcagctgaaaagcaaacattacatggaatatcaagcttgtcccaagatgaaagtggactttttctttcagcctcttgcatggataatcgaatttatttgtataacactcttcaacttgacaaagggcccttaaaatctttttctgggtgccgaattgaatcattttttgtaaagtctgcaattagccctgatgcatcaaacatagtcagtggttctagtgatggaaatgcctatgtttggaaggttgacaaacctctggaagatcctactattttgaaaagccatgatgatggtgaagttacagcagttgactggtgtagctctgaaattgggaaattagcaacatgttctgatgatttcacagttcgaacatggaataaaaacagttatgtctctagtatacaatgtgcatctgccatccgaagaagagtaatggcaattcctagtatagagtgcaaaatgcttttaaataatggaaaaaggtactctaagacaaatgaagatgcttttttacccgatgatgctctacacccaattacgtcacccactccaatcacaccacctaaaatgaacatatctgaaggccatacgaaccaactttcctcaagattagatctaaatgcatcctctgaaaaaactccagaatctgctttgaagagcccctcatctgtattgaatcctccatcatccctaaaaagaactatccgagactactttctagcatcttcaaaaaccttgtag

SEQ ID NO: 45286 - DNA, 300 bp, Glycine max
  Peptide Sequence Number=SeqID_162064
atggctattataataagtctctcattttcattccccatcttcaattccgtgctcattcctctcctctcttgctcgcatacctcactcttacggtatgctctctccaccttcagagccaaggaggaagaggttgaaaggaagccttgtgtgaaggctcttcctttcaaggaagtgtgcgttgaaatctacaaaggcgtcaccactagccagctcaatgaattggtagcggaaaccaccgcggctatgatcgccaaccaccctgactattcttctttggctgcgaggacaattttcctctag

SEQ ID NO: 45287 - DNA, 252 bp, Glycine max
  Peptide Sequence Number=SeqID_162065
atgacaactttgtctcctctttcttcatcccacctttgcctcaaaacaaagctcccaaatcatcctttccactggataacaccaaatgcgactgttgttgttgcgacgacatgtcgtaggaagaagttctcttgcggtggttatggttggtcggagaggatggcggtgacagcggaggaggggaacacgaaagagattagtttggcggcaaaattgaaattggggcaggttccgtactttagatgctcataa

SEQ ID NO: 45288 - DNA, 369 bp, Glycine max
  Peptide Sequence Number=SeqID_162066
atggcacctcctctcacctctattcctttgtcttccgctgcatctccatggactcaaagatccagcctccatagaagctctacaagcaagcttccatcataccctaaggttcaggagaaccctagggccttccctttgatctctgacccaatctacttgtactcttctatccaatgcccttgtgggggcaacacgaggctcacaggtgcgtcttccaagggaggaaggcacacggagtcgccaccaacgtttattcgaggaaaacgtcggaaaaaccagaacatgtggtctacgaactttaatcttgaaaggttcgggagttgtttttacacacggggaaggtattatcaccccacacgtctaccataa

SEQ ID NO: 45289 - DNA, 229 bp, Glycine max
  Peptide Sequence Number=SeqID_162067
gtacatagggatggatgcaagtggggatagggtcacgatcgaccgatcgttgccccttcccggcgctaaacaagcagagaacgtcgctgcaaggcagcccaggggaacgttttcttcacccaaaactcttccccctcacttcaaaaacccccaacctcacgagaactacgagaacagcagcccccaagcttccattgttgagttttttgcttcccttttcacgctttaa

SEQ ID NO: 45290 - DNA, 872 bp, Glycine max
  Peptide Sequence Number=SeqID_162068
gattacacgtccttagcttcagaggattacacatcctcgccttcagagggctgcacgtcctcgccttcagagggctgcacgtcctcgccttcagaggactacatgtcctagcctttagaggattggacgtcctcgcctttagagggctacacaccctcatattcagaggactgcacatcctctccttcagagggccacacatcctcgcctttagagggctgtacatcctcgccttcagaaggttgcacgcccttgccttcagagggctgcaggtgctcaacttaagagggttgcacacctacgcctttagaggaccgcacgtccttgcgttcagagggctatacatcctcgcgttcacagggcgacacgtcctcgcctttagaagactacatgtcctcgtcttcagaagactaaacatcctcaccttcagaggactacatgtcctcatcttcagagggttacatgccctcaccttaagatggctacatgccctcgctttcagaggactacacgccctcgccttcctaggattacacgtccttgccctcagagggctacacgtcctcgccatcagaggattgcacatcctccttttcagaggaatgcatgtccttggctttagagggctacacaccctcacattcaaagggctaaacgtccttgcctacagagggccacacgtcctcacgtttagagggctgcatgtcctcaccttaagaggaccacacgtcctctccttcagagggctacacatccttgccttaagagggttacaagccctcgccttcagagggctgcacgtcctcgcctttcagaggactatagtgttggatcaagtggcctcagaacaattaagaaggggggggggttga

SEQ ID NO: 45291 - DNA, 930 bp, Glycine max
  Peptide Sequence Number=SeqID_162069
atgcacgccttcgccttcagaggaatgcaggtcctcgcctttagaggactgcacatcctccccttcagaggaatcgacgtccttggctttagagggctacacaccctaaccttcaaaggactgaacgtccttgcctatagagggccacacgtcctcgccttcagaggaatattggtcctcacctttagaggattggacgccctcgctttcagagggctgcatgcccgcgccttaagaaggatgcatgccctcgccttcatagggctacttgacctcacctttggagggatacacgtcctcgacttcaaagggctacacttgctcaccttcagagggcctgatgtactcgccttcagagggctacacatcctttcctttagagggctacaccccctcaccttcaaagggttgcatgtccttgcctttagaggactgcaggtcctggcctttagaggattgcacgtccttcccttaagaggggcacacgtccttacattcagagggctgcacagcctcgccttgagaaggctacactccttcgccattagagtactacacgtcctcgccttcacaggacaacaagaccttccctttagaggactatacgtcctcactttcagagggctgcatgccatggcctttatagggctacacgccctcacctttataggactaaacgttctcacctttagagaactacacgtccccaccttcaaaggactacacgtgcatgcctttagaggactacacgtcctcaccttcagagggttgcatgacctcgccttcatagggctatacgccctcgaattcaaaggactacacgtcttcaccttcacaaaatacatgtcctcgcctttagagggttgcacgccctcgccttcagagggctacacgcctttgcctttagaggcctgcacgtccttgccttaa

SEQ ID NO: 45292 - DNA, 963 bp, Glycine max
  Peptide Sequence Number=SeqID_162070
atggcacgtcgtcgccttcagagtactgcacggcgacacgtcctcgccttcagaggactacacgttctcacctttagaggactacacgtcctcaccttcagagggcttcatgccctcgccttaagaaggctacacgccttcgccttcagaggactacatgtcctcgaattgagaggactactcatctttgctttaagagggcgacacgccctcaccatcagaggattgcacgtccttgccttcagagggggactgcaggtcctggccttcagaggactgcacgtcctccccttcagagggacacacgtccttacattcagagggctgcacagcctcgccgtgagagggctacacgccctcaccttcagaggacttcaggtcctcgcctttagagggctacacgtcctcgcctttagaggagtacacgtcttcacctttagagcactacacgtcctcgccttcacaggactacaagacctcgactttagaggactatacgtcctcactttcagagggctgcacgccctggcctttatagggctacatgccctcaccctcataggactacacgttctcgcctgcagaggactacacatcctcgcctttagaggactgcacattctcgccttcagagggctgcacatcctcgccttcagaggactgcacgccctcgccttaagagggctgcatgccctcgcctttagagggtttgacatcctcgcctttagagggcttcacatcctcgccttcgtagggctacccaacctcgcctttggagggctacacaggactacacgtgctcgccttcagaggactctaggtcctcgccttcaaaggactgcacatcctcataccctcgcattcagagggctgcttgtccttgcctttagagggccacacgtccatgccttcagagggcttcacgccctcgccttcgaagagctacatgccctcgccttttga

SEQ ID NO: 45293 - DNA, 848 bp, Glycine max
  Peptide Sequence Number=SeqID_162071
ggactagatgtcctcaccgtaagagggtgcacgcccacgcctttagaggatcgcacgtcctcgcctttaaagggctacacatcctcgtctttagagggctacatgccctcgctttcagagggttgctcagcctagccttcagaggactacatatccttgccttcagagtacttaacattctcacctttagagggccacacgtcctcgccttcagagggcttcacatcctcgccttaagagggctgcatgccctcgcctttagagggcttcaaatcctcgcctttatagggctacccatcctcgcctttgaaggactacatgtccttgacttcagaggactacatgtcctcgccgtcagagggctacacattctctcctttagagagctacacgccttcaccttcaaagggttgcatgtcctgaccttcagagcacagcagaggactacacgtcctcgccttcggagggctatacatcctcaccttcagattagtacacgtcctgaccttcagaggactacacgtcctcgcctccagagggctacacgtcctcatcttcagaggagtacacgtcctcagcttcagagaactacacgttctcaacttcagaggactacacgtcctcgccttcacaggactacacgacctcaccttcagaggactatcgtcctcacttttagagggttggacgccctggcctttattgggctacacaccctcaccttcgtaggactaaatgttctcaccttcagagaactacacgtcctcaccttcaaaggactagatgagcttgcctttagaggactatacgtcctcaccttcagagggttacacgccctttccttctga

SEQ ID NO: 45294 - DNA, 1013 bp, Glycine max
  Peptide Sequence Number=SeqID_162072
ggacaccaggatttatttattctgcgaagtgatcttccgtcacagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcttcttcgctattacgccagctggcgaaagggggatgtgctgcaaggcgattaagttgggtaacgccagggttttcccagaattcgatgatacatatgtatcccctactaaaatttatcctgctgcatcttgcaacggagaggctagtcctacttgttgcactatgaatccaaccaacaaagttatggttggccctgaaacacaaatggcttataaagagaacagtcattgcaattctcctatcgaagtagatacaggcaaatcaagtaagaaggatgacgtaaggagcaaactgaactttgatgcctctaatatgcctgagagcttggacaaatcattgtctaatgaggtttatacatctgagtctgacaaggatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 45295 - DNA, 286 bp, Glycine max
  Peptide Sequence Number=SeqID_162073
atggatgaagggaagactttaagaatcggtgcttggaagattcttgtggttgatacgactgcgtgtttatgcagagtagatacaggcctaaaaactgttgctggagcaaagaggtatgtccctggaacaaagctctgtcttcggcctgacattaaaccatccattcacccaactagaaacaagccagcacgtggtgacagaagccgtagtcaatcccctctacttccaggactccctgatgatctggctattgcttgcctaatccgagtcccacgagttgaacacc

SEQ ID NO: 45296 - DNA, 249 bp, Glycine max
  Peptide Sequence Number=SeqID_162074
atggtcgacagcgagaaattgggggcaaagggggaagcactgaaagagggcccatggcctcaactcaactcaacggcacaacctaccaagcataagactaagaccatgtgtcttcgtcttcaacaacagtacacggatcctctgcaccaactgcagctgcagtttcaaatatttcaaccgttagattacatcaatgataagaagtctgccacgtgtcattacaggtcgcgggaagatagacaaccctga

SEQ ID NO: 45297 - DNA, 720 bp, Glycine max
  Peptide Sequence Number=SeqID_162075
atgagatttggtcaaactgtaaaaatcacatgtttgcctaatggttgtatttctttgttcaacaaacttactgagataaggacattatgcgaagcaccatgttatgagggtcttgtagaatttcatggggcattttacaccccagactctggacagataagcattgctttggatcgagtacatggatggaggatcgcttgtagatatcttgtgaatgtcttgctcttgagtgtggaacaggagaattccaatatacagctaatgaaggtcctgtcaaacttatcttgcaagacttcacctcatacttactctaaaaatttctccctcaaacaatttattttatatatacatgatggcttgaagttgataattctgttttgccctgccctgctgcaactgctttcgcacccctttatcacaaagtatgaggatgccaaggtagatttagcacgctttgttcgaagtgtttttgaccctacacaaagaatgaaggatttagcagatatgttgacaatacatcattacttgctatttgatagtcctgatgatttgtggcaacatacaaggaacttgtatatcgaaagctcgattttcagtttctctgggaaacaacattgtggtccaagtaatatcttcacatctctatcaagtattagaactacattggttggtgactggcctcctgaaaagttggtgcatgttgttgagaggctccaatga

SEQ ID NO: 45298 - DNA, 228 bp, Glycine max
  Peptide Sequence Number=SeqID_162076
atgttgtgtggtatctgtcataccctaatttcatccggggactattgtttggtggcatgcaaccttcgcttgaccgcctcaaggtacttaacgcccatcgctagtaaaaaggggggtgcaaatagcaagcagcccacttgggcaacagaaggcagtgccttctggtggaagcaaccctgctcgcctgggcgagctgagcggcaactacctccctcttttctcctataa

SEQ ID NO: 45299 - DNA, 935 bp, Glycine max
  Peptide Sequence Number=SeqID_162077
aagagtggatatatgtcattaagagggaccgagacgggaaaatatcatggcatgcctttgatcctgtgtaccaactatggcagccactgccacctgttcctaaggaatattctggagctcttggttttggctgtgctgttctcaatggctgtcacctgtacctgtttggagggaaggacccactaaagggatccatgagacgtgtcatattttataatgctaggacaaataaatggcaccgtgccccagatatgcttcgtaggaggcacttctttggctcttgtgtcataaacaattgtctgtatgtggctggaggggagaatgagggtgtgcaccggtccttgagatcagctgaagtgtatgatcccaacaagaatagatggtcatttatttcagatatgagcactgcaatggtgcctttcataggagttgtctatgatgggaagtggttcctgaagggacttggttctcatcggcaggttctgagtgaggtctaccagccagagaatgatagctggtaccctatttatgatggactggtttctggctggaggaaccctagcactaccctaaatggaaagctctatgccttagactgcaaggatggctgcaagattcgggtttatgatgaggttgctgattcatggagcaagcatattgacagtaaattgcatttggggagctcacgggctttggaggctgctgctcttgtccccctgaatgggaaactatgtatcatccgtaataacatgagcatttctctggttgatgtttcaaaacttgaagatttgaaaggatcatctgctgaacagttatgggaaactattgctgggaaaggacagttcaagaccttggtcacaaatctgtggtctagccttgctgggagaaaccgactcaaaacccacatagttcactgtcaggttcttcaagcttag

SEQ ID NO: 45300 - DNA, 285 bp, Glycine max
  Peptide Sequence Number=SeqID_162078
atgtttcaggctctgtgtgaggagttaactagaaaagttgccactttggtggcagagaatgaaaacctaaagagggagaaagaattggctttgaaagagtatgagtctttggagactacaaataagaacttgaagacacagatagccaagtcaataaacactgaagtggagaaaactcctgttgagcctgtgtcatctgtggctgagataacaccttcatccgaagaagataagaaagcttttgaaatgactgagtcaaaagaggcaacattgcttgaagcatag

SEQ ID NO: 45301 - DNA, 231 bp, Glycine max
  Peptide Sequence Number=SeqID_162079
atgagagatggagagactattgaggaaatgtttggaagattacaaactcttctgaatggtttgcaagctcttggatatgaatacacaaaggctcaaatcaacctgaagattctagacaattttcctaaggtgtggaagcccaaaacaactaccactcaagaagcaaggaacatgaaaaccttgaccttggatgagttgttaggagcattacatgttcatgaggtccattag

SEQ ID NO: 45302 - DNA, 120 bp, Glycine max
  Peptide Sequence Number=SeqID_162080
atggcggacacgacgatggcaatcttcaatggttgtgaggtaacgagcacagggaagacaaagtcgcgaggagaaagatttttcaacgagcgcggggagaaaatagtgattccaccttga

SEQ ID NO: 45303 - DNA, 267 bp, Glycine max
  Peptide Sequence Number=SeqID_162081
atggtacagcaaagcagttgctacaccaaaccaaatactttctatataacatgttcaaaactaaagtactcaaatcaaaattggagaagcagtgttgggcttggttggaaaaggatgaaagagaggctgagggataggaaaatgcagagggtgcagagacaaacaaagcatgaacaactgtttggctgctggaaacttgagagagcaaagtgcagggtgagaaacaagcatatgcggcttcacgatgcaaaaacaagggtgaagtag

SEQ ID NO: 45304 - DNA, 228 bp, Glycine max
  Peptide Sequence Number=SeqID_162082
atggtggagatgcataccactataatggtgaaacctatgcctccagaatgcagaccctactactgtgtaaggataggccaaagcttctcgatctcagacatagtttgtactttgacagatatgaagtatgtggtttttcatgcaaacattgatgctgaagggccagaagcatatcaggaatactacatcaagcatatagatgggtcccctgtgaaatcagatgcataa

SEQ ID NO: 45305 - DNA, 336 bp, Glycine max
  Peptide Sequence Number=SeqID_162083
atggaagacgcacccgagagcctcgcttcgctcgcccgtaaaagggtaggttgcgacagtatttcccttgggatggacaagtttttttgggcctttatgagtgatgggacattctctacaaagtctttctatgatcttttagcttgcccatatgtccagagtgaccccactttgaggaattgtctgtggagcatccctgattgtaagggggtaatggatacaattagtgaccccaaagctaatttttccgagcttatgtctattgtttctgagtgcagatccctacaattagccaagttcaatgcatacatactacacaattctttattggcataa

SEQ ID NO: 45306 - DNA, 270 bp, Glycine max
  Peptide Sequence Number=SeqID_162084
atggctatgctagtttgcagtaagaaggtgatcaaacgagttcggtgcggactcaggctactcaagaacaagaggcaggcaatagcaaggcaactgagaaaggacttggctgagctaatacaaagtagccatgaagaaattgcatttaaccgggaatgcgagttgaaacggacgacactttgtcgtcctctttggatcatgaccccattaatcttgttcatattcttgtcacatcgattcgggtggcagcaaaaaataattgctaattaa

SEQ ID NO: 45307 - DNA, 690 bp, Glycine max
  Peptide Sequence Number=SeqID_162085
atggaagctcatggtgaatatgtgataacaatgatggatgaaaatggagagtgcagagttagttatgaatcccaaattgagaatggagaattgacaatcacttgtagttgtaggaagtttgaacaattgggaatattgtgttgtcactcattgagaatattattccacaaggatgtcaagcttcttccaaacaaatatatattgaagcggtggacacgacaagcaagatgtgatacgtacaatgataatagtgggaggcaaattgatgttgatcctaggttggagagttcaaatcgatataagcaattatgtccaatgcttatgagattgtccgatgaggcatctgactatccggaagcatgttctttagtttatcaaggggtgttagagcttagtaagaaagtggctgaaattcgattgaaccaacaaccacatggtcctcgtgattccacacgtgaagccacaaggtatgctatggagcctttggcatccaaaggaattggatttaagaagagagatgtgtggtgtgttaattcgaaacctatgatatatcaggaaagtcaagtcttgttggaagcatcaaattcagactcgttgataggatgtgctcatttaaatcaactatcattacaagaatcaacttctattctttcagaagcatatactcatttagtgtcttttccaccttaa

SEQ ID NO: 45308 - DNA, 750 bp, Glycine max
  Peptide Sequence Number=SeqID_162086
atgggtgctgccaccgtccacgagaatgatgaagttgtggccttgatgctaccgacgacgctcataggggtcaggagggtcaagggtttgggtgtcgtcctcctcgaaggcaagaaggagaaaaaacttagcacgactgtgatggttggggccatagcgttcgttgtagttgtagcacaagccacactcgcgacgcgacgccattcctacttgggtaaggcgtttataggtgggggtggcaaaaggggtggaagagtcgaggaaggtgggagagtagaaattggttggggtgcaaaggaaggtggtttggggcgggatgaacgacgagcgtcgagaccaaaaatgaagcaacttaggaggaaaggggtggaaagacccataatacagttcgcaagggcctcaaattcgacgaggaaggatgaccatgagggtaggggaagaggtttcgagtgcttgaaggcaagaaataacctcgtccagccgggagtgcagggagttttgggtggtggtgagggtgttctggttttgggtaaaattcttgagttagaggccaggaaatacctccagaatgcaaagcaaaacgatggtgcaagctgcacgcacaatgaggacacacacgatgaggaaggcctcttcatggttctctttggccttgtggctgctgcgctatcatggattgtgtatgatttcctagagcaagaaatcgttagtgttttggttgagctttctctagttaaaattcagccgtga

SEQ ID NO: 45309 - DNA, 1806 bp, Glycine max
  Peptide Sequence Number=SeqID_162087
atggaccttgcccaaggttttcatcaaattcgtatggtggagcatgatgttcctaaaacgactttcaggatgcaccagggccactatgatcgtgatttcaaggctcacctcaaacaccttgactgtgtcttccagactctgcaacaagggagtggagccagatccttccaaaatcaaagctatgctacaatggccagtcccataatctcccaaacagttgcacgggttcctgggcttgattgggttttatcagcgtttcgtccaccaatatgctcaaatcgcggagccgcttacccaactactacggaaggatcaattcgcatgaccgacgcgttgggtttcggcatgggagtcgtgttgatgcagcgcagtcacccaattgcttacttcagcaagcaattttgtcccaaactgctcagatcaccgacatatatccacgaactgcacgccatcaccaccgccgtgaaacgatggctccaataccttctgggccatgctttcgtcatcctcactgaccacaaaagactacgcgaactgatgacacagctcgtgcagaccttagaacaacacgtgtacctcgctaaactccttggctataattacacaatccaatacaaagcaaggcacaacaatgtggaattagccgtgttagaagaattcaaaactctcatgaatcgtgttcacgataaccctctgcaatgcccagagttcaaaatcagggataacctcttgctataccaggggcacatatggattaatcgtggaaatcccttcattcctctcctcctagaagagtatcacaaatctccgctaggtggtcatatgggactggccaagactctctgtcgtcttcaacaaagcttcttctgggagggcatgcgtcgcgatactcagcagttcattaagcaatgcacgaattgcttacagacgaagctacccaattcgaatggagccatgatcattatgattgtcgttgaccatttccctaaaggcgcccacttaggatcactaccgccccacttcacggcccaactcttcatcgacctggtatgcaagctccatggatttcctcggagtttaatctctgaccgagatcctatttttgtgagcaagttctggcgtgaacctttcaagctatgcggcaccaagctgcgtatgagcactgcctaccatcctcaaagtgacggccaatcggaggtaatgtacgggaaaccaccacccgatatcccggactaccttcctggttcatcatcagtcgaggctgtggacttcctccttaccactcgccaagatatgtttgatgcccttcgtcaaaaactcgaacgatctcaggcacgaatgaagaactctactgatcctcaccgtcaagaagtcaacttcaaaattggggactgggtctatgtgaagctaagactttaccgccaaacttcgatcgctgataaccttgcgtcaactgctaaaatccaccccgtgttccactgctccaagcttaaaccccaccatggtcctctcgtgtcaacacaatctcttctgccatcttcatgggacaacaatccggcagttgaaccgcttgccatcctggatcataaatgggacaatcacaacccccctcaactatcagtcctagtccaatggactggtttacagcctgaagacgcaacttgggagaattggactgacctccaaggtatctaccaccttgaggacaaggtgtttcaggaagcagtagaagatgatagcgcagcagccacaaggccgaagagaaccatgaagaggcctctgagttgggaaaaatacatccactaa

SEQ ID NO: 45310 - DNA, 654 bp, Glycine max
  Peptide Sequence Number=SeqID_162088
atggaaggcctaaagggcatggataacttgattcaaatcctctctcaccatccatcttacataaacaccgaactagccaacattattgtttcaaagtttaagaagctcaatgcgcttttaaatcgaaccggtcatgcccgatttaggcgcaccccaattcactctaccgcaccggttcactcaactaatccggttcacaatgcttccacctcatcaactcaagtccctttgtcagaaaaccctaacttgttcgcgttggtgcagtctcctgtgccggtgcaagtgcaccgcatgccggcgagcgtggcactcgatttcatggagccacacaacccacttataagcttcaatgcaaaatctgttgaacttgaattctcaaaggagactttcaatgttccctcaaaatcttcattcatctcccctgccatcaccaacaacggcaatgtctccaacaaggagatcttcctagcatcggcgccaccgacaacctccgtcgaaaaagtgttggcattcaagaagcaatgctatgaacaccatgaacagtctgtagacatttctggatccagcaaatgccactacctcaagcaaaggagagaagacattaaacatcaaaatcaagaagatttaactcaattgatagagcaatgtgtatga

SEQ ID NO: 45311 - DNA, 513 bp, Glycine max
  Peptide Sequence Number=SeqID_162089
atggcctcttctagctactccaattctccatgtgcagcctgcaagtttttgagaaggaagtgcatgccggattgcatttttgccccatatttcccaccagaagagccacataaatttgcaaatgttcacaagatatttggtgcaagcaacgtgagcaaactcctcaatgaggtgcaaccccatcaaagagaggatgctgtgaactctctggcctatgaagccgaagcaaggatcaaagatccagtgtatggttgtgttggggccatttcagtgctccaaaagcaagtccttaggctccaaaaggaacttgatgccacaaacgctgatttgatccgctatagtgcttgcaatgaaattccaaacaccactactcatcatggagggagaaggatgagtgatgatggaggaggtggtggttcctcacttgctcactctcatggtttctattatccttctaattggaacaatgatccttgtggaaatagtaatggttaccccagaggcgatatataa

SEQ ID NO: 45312 - DNA, 432 bp, Glycine max
  Peptide Sequence Number=SeqID_162090
atgcatcatcatctcgaacaaagagtttcatcacaagttgttcttttttgtggttgtggtagaagggctgttaggcgtgttgctggaacaaatattaacagaggaagggcgtttttcacttgttcaattaataaggatgaagttggatattgtgggtactttatttgggttgatcaattgattgaagcacttggagttgatgattcacttggaacattttccatggaacaaagaagacaatttggaagagaggaagataagacaatgtggaaggctcaagttaactcaaagcttgattgtatagggattgaaatgaagatgtttagaacaattgtctatggaatgttcttaatccaattgttgtcaatggtggtgttttatgttcattttgttgcaaaattgcataagattcagttctgcataagggcataa

SEQ ID NO: 45313 - DNA, 231 bp, Glycine max
  Peptide Sequence Number=SeqID_162091
atgattatgaggggccaagacatttatagtagccaagatgaggttactacttcaccttcctctagtgaaagtgaagaaggaaaagtggaggaatctagtgaagagatctacccgcaagaagaagtggaccttttaatggtcagaaggcttctaggaggccaatcttgtgacttgacccaacctcatttttcacagaagatagtggttcatgttgcaattgttgcagcataa

SEQ ID NO: 45314 - DNA, 753 bp, Glycine max
  Peptide Sequence Number=SeqID_162092
gtctagatgtcactagcctcaaggaattgggacaattgatgggacccttccaaaggcaagccttccgcaaagtttacgggaagattctagggggtgaccgtagcggagaaaaccgtatcttttctccggctttcttcctttccttgagcaagattgcagctgtgattggagattcagcaaaagagttggatcgcatgaagcaaactcggaacggcgtagtgggcctgcctcggaaatacttggaaggcaaggcaaggggtatggcgagccaagagaagtggggcccgtttgcggatattttagctttgctgatttttggggttgtcctctttccgaacgttgacggcttggtagacttagccgccattgatgctttcctcgcatatcaccatagcaaggaaagtccaatggtggctatcttggcagatttgttcgacacttttgaccggagcatgatcaattggtttcctcgttggaaggaaggcaaggaaggagttcttttctcgtgtggggactatcctaatgttccactgatagggactaggggttgtattaattataatcccgcattcgccataagacagctagggtatcccatgagcggagcgccaaccgaagaaagtctctcgcctttccttgtgagggatctaggcacgcaaggtctcaaggttatacaaagaatccacaaggcgtggaggagttcgttgaggaaagacaaggagcttagggacatccgaaacggcatcattggag

SEQ ID NO: 45315 - DNA, 231 bp, Glycine max
  Peptide Sequence Number=SeqID_162093
atggacttgaagggtatcaacctcatcaaccagaattaccccgtggttgtctccatcatcatagcaaacttcatggtgtcgaagagactcaaggttttccctgacattgtccatcctcacgctggtcaactcctcagctttgcaggcaagagagtagagaccagaggctacatggacttaatgaccacctttgatcaagccaagctctctaggagcttcaccatgagatga

SEQ ID NO: 45316 - DNA, 129 bp, Glycine max
  Peptide Sequence Number=SeqID_162094
atgggtgtcaagtacctcaaagtggtcaagcgaaggtcgcatcccaataaacagatgatgttcagggctcagattggagaccctttgtccacgctcatgactctagtgcctttagccgctttggggtga

SEQ ID NO: 45317 - DNA, 222 bp, Glycine max
  Peptide Sequence Number=SeqID_162095
atgcgagggaagcggttggcacgtgtgaagaaaagggctatgagttggcgtcctgcatggaacgaagccgcagatgccgactcgtgtgaattgcgaaagccgccacgaaacgaaggatcttgtcgtatttatcttctaggctattatcagccattggatttggaggaacgtgtaaactattgtggcctagctccaacacaacctttgcacacggttgcgtaa

SEQ ID NO: 45318 - DNA, 375 bp, Glycine max
  Peptide Sequence Number=SeqID_162096
atggaagtccgttccataatgaacccggttcaaatgctggcagaacacttcattctagcagaatacttttgcatggtgatgaggatcaatattgattgtaatggctgctacagaaaagtgaagagagcccttcttgatatgccagagttggatacccatctcctagaaaagaatcagacaagggtaattgtgtgtggaaggttcattccacgggatgttgcaatcatgataaggaaaaaaactaaccgtagagtggagatattagacatacaagacctgagtgagagcaatgctgaaatggaagaccagaaaccaatgaccaataattggacacttctaactactcagaatcaaatggaaacatgtctggcttga

SEQ ID NO: 45319 - DNA, 696 bp, Glycine max
  Peptide Sequence Number=SeqID_162097
atggcgatggtggaccagcctctgtatccgattgccgttttgatcgacgagttgaagaacgaggacattcagctgcgcctgaactcgatccggaggctctccacgatcgcgcgcgcgctcggcgaggaccgcacgcggaaggagctgattccgttcctcagcgagaacaacgacgatgacgacgaagtgcttctcgcaatggccgaggaattaggcgtcttcattccctacgtcggaggcgtcgaccacgccaacgtgcttcttcctcccttggagactctctgcaccgttgaggaaacctgcgtcagagacaaatcggtggagtcgctgtgcagaattggagcacagatgagggagcaagacttggttgagcacttcattcctttagttaaggtagtgcatgttcctagttgcattgcgttttcattcgttgtgctaaggaggctggctgctggtgagtggttcacggcacgggtttcgtcgtgcggtttgttccatattgcttaccccagtgcaccagagtcggtgaagactgaactgagagccatatatggtcagctgtgtcaagatgatatgcccatggttaggagatccgctgccacaaacctgggaaagtttgccgcaactgttgaagctcctcacttgaaatctgacatcatgtctgtgtttgaggatctcacacaggatggtatgtga

SEQ ID NO: 45320 - DNA, 1698 bp, Glycine max
  Peptide Sequence Number=SeqID_162098
atgattcgtcgaccttcaatctatgttcccacactgtcacaatctatgttcttttcttcatcttcttctctaatcgctcttcacgattctcactccaaatccactttgagccccttttacaatctccttcctcctacccagaaccccaataacatcgtcaacctcatctcttccatcctcaaacacaaaagttccaacctttcccttctccatagtagtaataatgacatcaaaggaattctcccccacatgggtccccatgaaatctcaaggatccttctcagatgccagtctgatcactcttcagttcttaccttcttcaattgggtcaaaaatgatttgaacatcacaccaactctgcacaactattgtgtaattgttcacatacttgcttggtctagagtgttctctcatgccatgaacttgttgtctgagttgatacaattggttgaggttgagggtgtttgtgttcctccaaatgatggcatttatgagaatctcgtggagtgtactgaggattgtaattggaaccctgcgatctttgatatgcttatcaaggcttatgtgaaggctggtatggttgagaagggtttggctacttttaggaggaacattgaggcttgttttatccccaatgtgattgcttgcaattgtctgctgagtgggttgtctaggtttaattatattggtcagtgttgggcagtgtatgaggagatgggaagacttggaatacataggaatgcttatactttcaatattatgacccatgttttgtgcaaagatggagatactgataaggtgaccagattcctggataagatggaggaagaaggatttgaacctgacttggtcacatataacacgctcgttaatagctattgtaagaagaggaggttggaggatgcattttacctgtacaagatcatgtacattagaggcgtgatgcctaatttgattacacacacggtcttgatgaatggcctttgcgaagaagggaaggtcaaggaggctcatcaactttttcatcagatggttcacagagggattgatccagacgttgtgtcatataatactcttgtgtctggttattgcagagaaggcaagatgcaaatgtgtagatcactgttgcatgaaatgataggaaatgggatttgtcctgacagtgtcacctgtcggcttatagttgaaggatttgctagggatggaaagctgctgtcagccttgaatacggttgtggagcttaagagatttagaattaagattcctgaagatttatatgattatcttatagttgcattgtgtattgaaggtcgaccatttgctgctagaagttttctgcttaggatatctcaagatggctatatgcctaaaataaacacttacaataaactggttgagtcactatgtaaattcaataatgtggaagaggcattaattttgaaatctgagatggtaaagaggagcatgatactgaatcttgttgcctatagagctgttataagctgcttgtgtagagtaaacaggactttggaggctgaaggtttgttggaggaaatggttagttcaggtattctacctgatgtagaaataagcagggcattaataaatgggttaacatgcaagtatgtgatccatggattgcagaaagctatggaacaagatgatgagatgttgggtcacgatatgcttgaagtctaa

SEQ ID NO: 45321 - DNA, 510 bp, Glycine max
  Peptide Sequence Number=SeqID_162099
atgtttgggtttggctatgatccgtcaagtgacaaatacaaggttgtagcaattgcgttgactatgctctcacttgacgtatctgaaaagactgagatgaaagtttatggcgagggtgacagtagttggagaaaccttaaaggttttcctgttctttggactttacctaaagttggtggagtgtatctgagtggaacccttaattgggttgttattatgggaaaagaaaccattcattctgaaatcatagactcgctgtgcgtttggcaagatagcaacacccatattggcttgtggcagatgaggaagtttggagatgacaagtcttggattcaattaataaattttagttatttacatcttaatattcgtccttatgaagaaaaatccatgattttaccattgtgcatgcctaacaacggagacttcttcatgctgaaattcactagaaatgctgatgatgaataccaaacaattctgtataaccagggggatgatgtaagttcttga

SEQ ID NO: 45322 - DNA, 1484 bp, Glycine max
  Peptide Sequence Number=SeqID_162100
taaatgcttcgaccccttcggtgaacaacaaatgtttacctggaaaaatttccaagtctgtggtcaatgatgatggtttgccgttggatggtgtatatactggtcctggttgcacaagtggagctgatctttatgatcctgatcaaccgctttggaatgattgtggtctagagtcttcaaatgcactcctgactcttcagtcatccaagattgatgaatccaagcccatatctaatgatgctcccgatagtgattgtccagttggaactgccagaacttctgtcagttcacagggtgccagttcatctgtctgggccagaattggtagttcaaaaaacagatttgacatgaaagaaaaaactaactctacaacgagttcctttaattatcctgagaatcaattaaaggaagataatgatgaattagttggtgctcacaatgcttcctttcaagtaaagcaaaacatagcagatgatgctgacccaaaagccttggaagcctctttgaaagcacaaactgatagtatgcgtaacatacgcaaatcatcacaaaaggcattctgtactctatttgtaaatgggatacctcagaaatataacaagagagaggctcttcttgctcattttaagaagtttggggaagttattgacatctatattccattaaacagtgaacgggcttttgtgcaattctccaagagagaagaggctgaagctgctttgaaggcaccggatgcggtaatgggtaatcgttttatcaagctatggtgggctaatcgtgatagcattcgcaaagatagtactacaagtgggaatggtgtgattgtaactccccgtgggcaagcacctgcttttgttccatctcatcctgttgtcactgataggggtaaagacatccatcaagctgatgcttcaaagactatgtatgaagtatcatcgcctactgatcaatctaagcctgtcatcacagatggacccaaggttccacctcctttgcagaagaagcttgtaaacttagagagtctaaaggaagaactgcgcaagaagcaggaaatgctagatcaaaaacgcaatgagttcaagcgccagttgaacaaatttgagaaacaagcttctggactcaagggtgaagtatctactgagcaagctaccaagaggctcaaaatgggcgggacatctgatgttgccaaactggcttctcctcaatcatcggatgctgatgttggcatgacatctccacacacagaggcaacagctgataagaataaacagctggtctatcctgtatcccaaagtcctaaatcaagtacagcaacaagactgcaagaatctacaggcttgaagcacccaattcaaccattaatgcctgtaaatagatacaaattggacaatcgtcctgctgcatttcgtatcatcccacctttgccagctggtctagcaaatgtaagtattctatctgtctttctgtctgtggttaaggtatag

SEQ ID NO: 45323 - DNA, 126 bp, Glycine max
  Peptide Sequence Number=SeqID_162101
atgggtcagactttggagttaggaaagataactaagaacacagtcacagactacaacattgatgcacatgttgggcttcaaattcaaaaggcattaatggttgaattgggtgcttcaagcctgtag

SEQ ID NO: 45324 - DNA, 1101 bp, Glycine max
  Peptide Sequence Number=SeqID_162102
aaggatttgaagctccaactggggaagcttgttcaaaaagagaagtttttgacgcaaagagatgttggtgatggttctggggttgtggccgttgactcttcatccgtttttccagtcagtggaaatgtttatccagatgggttgtatttcactattttacgtgttggaaatcctccaaaaagttattttcttgatgtggacacagggagtgatttaacttggatgcagtgtgatgctccatgcagaagctgtgggaagggagcacatgttcaatacaagccaacaagatccaatgtagtatcatctgtggactctctctgtttggatgttcagaaaaatcagaagaatggacatcatgatgaaagtttgctacagtgcgactatgaaattcaatatgcagatcatagttcttccttgggggttcttgttagagatgagcttcatcttgtaactactaatggatccaaaaccaagctaaatgttgtttttgggtgtggatatgatcaagaaggcttaattttgaacacattggctaaaacagacggaatcatgggattgagtagggcaaaagtcagcctaccctaccagttagctagtaaagggcttattaagaatgtggttggtcattgccttagcaatgatggagctggcggtggatacatgttcttaggtgatgattttgtgccatattggggtatgaattgggtacccatggcctatacccttactacggatttataccaaactgagattcttggaatcaattatggaaatcgtcaactcaaatttgatggccaaagcaaagtaggaaaagtgttttttgatagtggcagttcttatacatatttcccaaaagaggcatacttggatcttgttgcttctcttaatgaagtttctgggttaggacttgttcaagatgattcagatactactttacccatttgctggcaagcaaatttccaaatcagatctatcaaagatgtcaaggattacttcaagaccttaactcttcggttcggaagcaagtggtggattttgtccacattgtttcagatacctccagagggttacttgatcattagtgtaatcctctctttctaa

SEQ ID NO: 45325 - DNA, 990 bp, Glycine max
  Peptide Sequence Number=SeqID_162103
atggcagaacccccgtcaccaccaccaccaccaccaccgcaatccgtttcaccggaaaacgacgtcgcaatgtccccccataacctcgacctccaaaactcctccgaagacccagactcctccttccccacccaaacgacacccgagcccgccgttccagactccccggactccaccacgacccgacccgacccgaatccacctccgcggaaacgacgccgtcgaaagaagttcttcacggaactcaccaccgggacctctacgcgccgaaacgacgtcgccaaggactgcgacgtggaagccctaatcgcgatctcggtagggttccccgtggactctttaacggaagaagagatcgaagcaaacgtggtttccaccgtcggaggctccgaacaatccaactacatcgtcgtccgaaaccacatattggcgcgttggcggtccaacgtttcggtctggttaacccatgaccaggccctccggtcgatccggtccgaacacaagggtttggtcgaaaccgcttaccggttcctgctggagcacggttacataaacttcggcctcgcgcatgagatcaaaaccctaaagcagaaacctttcgatgggtcctaccgaggaacggtgattgtgatcggtgccgggttcgcgggtttggttgcggcgagacaattggtgtttatggggtttaaagttgtgattttggaaggtaggacccgacccggtgggagggttaagactaagaagatgagtggtgatggggttgaggctgcagcggatttcggtgggagtgtcctcactggaataaatgggaaccctcttggggttcttgctaggcaattgggtttgcctttgcataaggtgagggatatttgccctctctatttgcctgatgggaggagtgttgactctgaggttgactctagggttgaggtttcgtttaacaagttgttggagagggtttgtaagctgagacaggcgatgatcgaggag

SEQ ID NO: 45326 - DNA, 421 bp, Glycine max
  Peptide Sequence Number=SeqID_162104
atgtggtgttatcgacgtcaataccctagggggtacggtatctgtcgccatagcccgcgcgtctacagaagaaagttggtgcagaccatgcgtacagccacagcatccgtgttgaagcgggcctgggttcccgcggttgtctcctgcgcggtcggtctcggcgccatcgcggtgacgaatctgcgcggtgcgttcgggtccgagccgatattctcggcaacgggcacgagcgcggaaccactcgcgtcttccacgatcaagcatgtgcgctacgaggtctacgggcccagcaatgccacgggcgcggtgagctacctggacaaagatgcgcggtctcaacgcgtcgatttcaccagtctgccctggacgcacacgatcgaaacatcggcacccgcggtgattgccagtgttgtggcacaag

SEQ ID NO: 45327 - DNA, 318 bp, Glycine max
  Peptide Sequence Number=SeqID_162105
atgccgtatgccagcggatggcgatgcagcggcaagcggaccgttcgatgtgaggatttggctggatccggtgtgtccgttctcgtggaacaccgcacgctggctggacgcggtcgcgatcgggtccggaataccggtcgattggcagctgatgaacctggccgtgttgaacgagggcagggagctgcccgacgtgcagcaggcccggatgcgggactcgcgacgggtgggtcggctcatggcgggcatccagtgcgagctgggccagcagggtctgcgcaccgcgtacttcgccttcggccgactgtatttcgatga

SEQ ID NO: 45328 - DNA, 699 bp, Glycine max
  Peptide Sequence Number=SeqID_162106
atgtttgagaatgatcttgggtggtttcaaaataatatatctagagtggttggtgatgggagggaggtgagtttttggagaactaggtggttggggagggagtctttgctaaaaaatttcaatagaattttcctaaacttggagcaaagggatgccaagattgcggaagtaagttcatggaacatgggtacaatggatgagaccttggttccaatgggaacaaattctactgcagcaaatgttggattggataccattggggagtttcggccaaaacaaaataagccggatggttgggcatggaatctaaatgtggagaagaaatatgaggtgagggaggtacgtgagacattgattatggaagaaaccatggaggatgaggagttttttaaacaaatgtggaagttaccaatatcttcaaagcacaacatatctggaagtgttgctatctgtggtttggggatttgcctgccggcaagttgcatcaatcacttttggcaacacaaagaattgatcaatagaaacaacccgtctttagcatggtgggtagtgtgggcagctatgctgtgggggatatggttgcacagtaatgctatcaagttcaatgccaagcctattgatgcggaggaagtattttatttcaatccacgaccctactactggaaatactcgatcattttaccaaaactaagaagataa

SEQ ID NO: 45329 - DNA, 2348 bp, Glycine max
  Peptide Sequence Number=SeqID_162107
atgttgtctaagattgatcgtaccaagaagaagaaacataaggaaaatatgcttcatgttctggcaggtgctagtgcacggttaacacaactagaaaccagaacccaccatcttgaaaattctgtggagaatttgaaggtatcggttggaaataatcatggtagcactgatggaaaattgaggcagctggcgaatattcttggagaggctgaagatgtctcttcacgggatctgaaaccaatgcaacttactgatgaggcatttccaggtggtcctgaagatgtctcttcacaagatctgaagccaatgcaacttactgatgaagcgtttccaggtggtcctcaagacttgtccttgcttagatcctttaggaaccatgttgccacacgcctatggataggagaggaccgtcacgagttgaaggtggttaatcatgggcgaaaagtcacggacttccgtttggagaatgagcatgtgaaggccatagtggagatgtctgggctggcgccccttctagaggcatgctaccgcatagtggacaagggtctcttgtctgcttttgctgagcgatggcacaaggacaccagttcctttcatctcccagttggggagatgaccatcactctagatgatgtgtcatctctcttacatttaccgatctctggggatttgtgttcatttccatcctttggtgcagatgaggcttgtttatacttggtggagctacttggggccaccaaggaagaggcagtcagagagacgaaattcactcgaggagcacatgtgcgattcaggtggttgcaggatttgtatgaggcaaacatcgaagatggacacttcgactatgcagcgagggcttttttgttgcatttggtgggttgcaccatctttgctgacaagagtgccacatatgctgatgtggcattgttagagctttttcgtgaccttaagacatgtggcaagtatgcgtggggtgcctctgccttggcatacatgtatgatcaactcaatgatgctagtatgcatcatacaaagcagatggcaggttatatgactcttttacaggcatggatttttgagcattttccggccattggctctcgccaattgacaattggatataaagagcgtgcaccccgtgcctgtcggtggacacctataaggggtgcaggtgacgtgttcacaattcgaactgcgctggatatgttgcaaacgaaggatatcttgtggatgccatacacggttcatagagagcataggccttttcatgacatctcactcttctcaggatacattagatgtggttcctcagcatttcctctgagagcccatactggtcattcttgttcgtctcagtgtggtaattcatcgatgaatacgacgccgtttatggacaagcaaattatggatctcactcacggtcacggatcttcttcttcttccactacgcagtcgcagagcaaggacttcatcgacctcatgaaagaaccgccacaacaccatcaccatcatcatctcgaagatgaagacaacgatgaagaagaaaaagcgcgtggcaatgggatcagcaaagacgacatcgttcccagttacgatttccaaccgattcgccctctcgccgcttccaataatttcgattccgccgcattctctcgcccttggaactccgattccaactccaacgcttcccctcccgtcatcaaaaattacagttctttggattcaatggaacctgcgaaggtcatcgtagaaaaggaccgaagtgcttttgatgctacaatgctgtctgagattgatcgtaccatgaagaaacatatggaaaatatgcttcatgttctggaaggtgttagtgcacggttaacacaactagaaaccagaacccaccatcttgaaaattctgtggatgatttgaaggtatcggttggaaataatcatggtagcactgatggaaaattgagacagctggagaatattcttcgagagactatcaaggacaagcaagatattgtgcaagctcagctgcaactagcaaagctacaagtgtccaagacagatcagcaatcagaaatgcaaactagtgcgattaccaatcctgttcagcaagctgcatctgctcctgtgcaatctcaaccacagcttcctacccctgctaatcttccacaatcaattcctgttgttcctccccctaatgcacctcctcaacctcctccacaacagggtttgccacctccagttcaacttccaaaccaattctctcagaaccaaatccctgcagctcctcagagagatccatacttcccaccacccgttcagtctcaggaaacaccaaatcagcaataccaaatgcc

SEQ ID NO: 45330 - DNA, 596 bp, Glycine max
  Peptide Sequence Number=SeqID_162108
atgacgtggtacggccactgcgcaactacttctattgggaacaacactggtttcgacctccccgcgtgctcggcgatccgatccgtgttcgacgcactcgacggcgtcgacgcgttctccgacaagatgcgcgcgctgaccacagacatcgggaacgtcgacgcggtcattccccagatggcggcacagcttccaccgatcatcgccgttgccaggtccatgcaggacaccctgctgaccatgcatagcagcttctcgaacctgatcacgcagatggcgcacatgaccgacaccgcgagcgccatgggacaggcgttcgacgcgtcccgaagcggggattacttctacctcccaccagaagcattccaaaacccagactttcagcgcggactcaagctgttcctatcgcccgacggcaccgcggcgcgattcatcatcacccatgacagggaccccgccactccggctggaatctccacggtgacgtccgaactagagtccgcccatcaagccgtcaagggaaccgccctgaccgacgccaagttttatctggcaggcaccgccgcaatctatcgagatattcagtccggctcgcg

SEQ ID NO: 45331 - DNA, 354 bp, Glycine max
  Peptide Sequence Number=SeqID_162109
agggtacatctacttggaggttgttatactgagaacaagagagggtacatctcttgtggatcagttcaagtggagggtacatccacttggttattcaaagagaacaagggagggtacattccttgtgaatctttgaagttaaaagaagaagatttcaagtgctttggagaaaaattggaagaaaaaaccttgaagaaaaattggaagaattggatagtccgcttagcgcgcaatccaggcttagcgcgcaccctcactaaacgggaaagctcagacttagtgcgaagaaggctcacaaggaagtccaaaaacacgtttagcgcgaaagtctgcgctcagcacgaggtctcatga

SEQ ID NO: 45332 - DNA, 309 bp, Glycine max
  Peptide Sequence Number=SeqID_162110
atgtcgtccgaaagcatctattgtggaaaggcaaaacctgttggacttctcgagacttggcatgacgaaagagtaggaggtaagggttcaaaaggattgcatgttatcactccaagtgtagaagatttgcaacaagctctgtatgtattgaataacaatgatgaagtttttccatacatacttctccatgaaggtttagtgaaggaaaaaagcaagttgatggaggagaagaaaaagaaacaattgcaggaagctacaaaatctggaagcactgacaccgtcattgatcctccttctcccatcagatga

SEQ ID NO: 45333 - DNA, 639 bp, Glycine max
  Peptide Sequence Number=SeqID_162111
atgaaagttatctacttccttgttgccatcttggctttggcatcctccattgtctctgcctatgaccctagtccgctgcaagatttttgtgtggcaaccaatgaaaccaacggtgtatatgtgaatggaaaattctgcaaacatcccaacctcacgattcctgaagatttcttcagacatgtggaacccgggagcactgccaaccaattgggcttaggactgagtcctgtgaatgttgcacaattacctggactaaacacgcttggcgtgtctatgtctcgcatagattatgcaccaaagggtttaaaccctccacacactcaccctcgaggcactgagatgcttatggtcatggaaggcactctttttgttggatttgtctcctccaaccaagacaataatcgtctcttttccaaagtgctcaacaagggtgatgtgtttgtgttcccaattgggctcattcatttccaatacaatgtggggaaaggcaatgctgttgccatcactgcttttagcagtcaaaatgcaggagttatcggtatttcaagtgctgtgtttctgtctactccacctattccttctgagattctcgccaaaggtttccaagtgggacagaatgtaattgatgagtttcgttga

SEQ ID NO: 45334 - DNA, 357 bp, Glycine max
  Peptide Sequence Number=SeqID_162112
atggtcatcattttgcttaaggaaaatgttgtcatctggttttgttcgttgcacttggccagacaactacctgaaaataattatttacaagtcagttatattttcaatacatttacattagcattagtcgtgaacatcaacattttaattgtacaatatgcatccatgtttgtattgaaaagttctttgaaaggatttgtcgatactccacaaagtaaatccaaggctgctgctaggtggattgttgttaaatatttcactgatactagaccattggaaccagagagattgaaggcgcttcgcatccagtgggcaagttattatttgaaagttaaaaatgaaacaattagtgtttaa

SEQ ID NO: 45335 - DNA, 228 bp, Glycine max
  Peptide Sequence Number=SeqID_162113
atggacgagtctggacaagaaactccgatccgatgtaaattgaacatgaaaaaatcaggcccaccaccaacgcttcatgaaaaactccataagcatgcaccttatacatcaatggagttagagatgaagtgtcgaggtgcgacggcaaagggaaggacaacacagaaaatgacagtagagaaaacaaattcattaatatgggaggtgtcacagtcatctgttacttag

SEQ ID NO: 45336 - DNA, 243 bp, Glycine max
  Peptide Sequence Number=SeqID_162114
cggaagggcttaccaagggtagaccttgggtttaacgagctttggaccaaaggcgcgttcatcctgggttttgacaaggctcaccaagtgcaaaccttgggtttatcgagcctttggagaagtgagactcaccaagggcagaccttgggttcaccaagggtagaccttaggtatgatgagcctttggagaagcgagactcaccaagggcggaccttgggtttgacgagcctttggagaagtga

SEQ ID NO: 45337 - DNA, 618 bp, Glycine max
  Peptide Sequence Number=SeqID_162115
atggttacgcctacagtgtacacttatgatggaaaatcagtttgcttcattggaaatgtacatcaaacaagggatgttacaattaatttccgaaacaatgaacacaccattcctgccgggtctatttctatcctttcaaattgttctttcgaagcttataacactgccaagaactatggtcctttctttgacaacatcgaggtgggtgttcttggtcccgttcagttggtagcagcagttggtgattatgattatgatgatgagatagtcaaagatctcagcaaaaaaaaaaatggagttataaagttggacagcacggggattatgacatgcattacaactatgagaacagccttaaaacatggtatacagatgaccacgttcaaaagtcccattggagatgatcctgttgtggttgatttgagtggattaggaaagggttatgcttgggtaaatggtaagagcgttggtaggtactggtcaagctacctcgcagctgatgtgaatggttgctctccaaaatgtgattatcgtggtgcatatacttccaacaagtgcttttgtcaatgtgtgcacaaccttctcaaagatggtaatcaaatcaatttctttaactaa

SEQ ID NO: 45338 - DNA, 1392 bp, Glycine max
  Peptide Sequence Number=SeqID_162116
atggccaaaacaactcatatagcagtattcacaatccccgtttttacccaccaagcctccatcatagagttatgcaaaagactccatctccatcaccacttccatatcacatgcatcttccccaccatcaattcaccaattctctccaccaccatgttactcaaatctcttccttccaccgccattagccacatttttcttcctccggtgaacgaacaagacctaccccatcaagacgtttccccacaaaccaaagtccaactcgcagtgtctcaatccatgcaatcttttcgcgacactttggcttcgcttcgtgcaagttcaaccacgccaccactcgctgctttggttgttgatgcttttgcaaatgaagcgctagaaatagcgaaggagttcgacctagcgtcgtatgtgtacatcgttacttctgccatgacgctctcgctattgttgcatttgccaacgttgcatgaagaagttgcatgcgaatacaaggattgcgtagagggtattcgaattccgggttgcgtctctattcaaggtcgtgatctccctgatgattttcaagaccgatctagctttgcttacgagttgattcttcagcgtagcaagaggtttgatcttgcttgtgggttcttagttaatagcttctgtgaaatggaggagaatgttgtgacagcctttcatgaagatggtaaagtgaatgttcctatttaccttgttgggccagtcattcaaactgggccaagtagtgagtcgaatggaaactcagaatgtttgagctggttagaaaaccaaatgcctaactcagttttgtatgtctcctttggaagtgtatgtgctctcactcaacaacagattaatgagcttgctttggggttagagttgagtggtaaaaaattcttatgggtatttagagcacctagtgatgttgatgttaaaaatgatgaccctttaaagtttttgccacatgggttcttggagaggaccaaagagcaagggttggttattacttcttgggcacctcaaacccaaatccttagtcacacttccactggtggatttgtgacccattgtggttggaattcaacagttgagagcattgttgctggtgtgccaatgataacttggccattgtgtgctgagcaaagaatgaatgctgctttggtaactgagggactcagagtggggttaaggcccaaatttagagagaatgatggcatagtggaaaaagaagaaactgctaaggtggttaaaaatttgttgggtgatgaaggaaaagggattcgccaaagaattggaaagctcaaagatgctgctgctgatgctttgaaagaacatgggcgctctacaagcgcacttttccaatttgtcactcaattggaaaactga

SEQ ID NO: 45339 - DNA, 387 bp, Glycine max
  Peptide Sequence Number=SeqID_162117
atgaaacaaataccagttatgctgatcgtgcaaatgcatactggacaggatactttaccagtagggcagctatcaaacgctattttacaaggtcgtcaatgtcctccactggctgcaagacaactagagttttttagggggagaaggaattcagggccaaatacagactcattagctgatgctttagcaattgcgcaacaccatgatgcagtcactggcacagaaaagcagcatgtggctaatgattattctaaacaattgtcaataggctacaagaaggcggaggatttggtttcatcatcgctggcttggttgattgagtcaccgttgcttactacatgtcaaaacacagttacaaagtttttaaaagagctcaaatccttttaa

SEQ ID NO: 45340 - DNA, 651 bp, Glycine max
  Peptide Sequence Number=SeqID_162118
atggctctcaagaagaggagaagacgcgtctaccttccaaccgaacccaatgaccacctcccaccacccattcccgaaccaccttctaaccacccaccctacgccgagatgatatacacggcaatcgaggcgctgaaggagaaagacggttctagcaagagggcaatagcgaagtatattgagcaagtgtatacgcagcttccaccgaatcactcaaacttgttgactcagcacttgactcacttgaagagtaggggattgctccaaatggtaaaaaaatcttacgcccttcctagatctgtgcccgtgtctgttcctggacctgcacccaccgaagggacatcaacagtgccgactgttgttgttgccatcacgacgactccgaggcccagaggtcggcctcgcaaggcccaaaatccagttcagaactcgcctctggctcaggacactgtcaacgtgcaggttcagcagaatgccgagccggtctgggctgcgcttgggcttgcagacgagattggtaagtccaaattatttgagtatttgaggcttaccactgttggagtcattggtgcctctaatagaactcctgaattgcttaaaatgaatcccattggaaaggtacactttgcttgttcccgtcttactacttaa

SEQ ID NO: 45341 - DNA, 2679 bp, Glycine max
  Peptide Sequence Number=SeqID_162119
atgcggcagagatacccacggagccgcgaagacacagccagcacaataacggcatcttcgtcttcttcctctgcgccatctcccaaccctaatccccaacatggaaccggaaaccctattcctcaacccttctcttctctttccccctcaccaatcaacctcgctttcggatctctccagatctccgataccccaggttcgtcgtcttcagccgctcaagattctggtggatcttccggaaaggtgacagaagtagggtctccaagtggagtgatggtttcacctgaacaaaactctagaacacgttctaggagtcacggggcaagatggacccgaacgcgaactggaacagtttcatatcatagaaatcaacaaactcctgggtccgtcagttctcatggaagtgcccctttgccggggagaaaagctcagacggtgaatgggaactacttgctgaattttcaatatgacccaatatcccgttctcaaccacggggtcctcctccttctcctacaacaagaaggcatcggaagaggaagccgtacagcaaagatttgtttttgcaggcgaattacaagttcacggtactaggttcgggaaattattcgcctgagtcgatggatccagataaaatgttgcagtgggaagatattatatgcgtgacatatttgacccctttttcagttcagtgtccaatttgtttggagtatcccctgtgtccgcagataacctcatgtggacatattttctgtttcccatgtattctacagtacttattgatgggtgaagaggatcacaaaggtgatagctggaaaaggtgtcctttgtgctttgtgatgatatctgccaaggatttatatacggtgcacatcacaaatgtcaaacagtatcaagtacgagataatgctgagttcacctttttaacgcggaaaaaggattcctttactctgtcacttaaaaataaacaagagacaaatatcacatcacgtgccaatgaagatatctgtgatcccttttctaagttcactcttacatcagatgtagatctctcggtgagacatgcaatatctgatctagatggttggctagccagagctgattcaggtcttgttgatgacctggagaagcttccttatgtttgtgctgcaatgcaacaattagaacagaggaagaggtattggagtgagctcaggtctcatgacagtgaaaaatcttctaagcttaatgattacgaacatcagataccgtcaacagttgcaaattctgtggatagtgacgatgaaaactgttctaatggatcaagaacttcctcttctgatttccttgatcaaaataaggttatgatgttggataagtcaactgccggaatctgtttggatcaaaagttggatgtggagaaagaattaatagagcaggaaatgaatttatcttcttcatatgaggagaaaaacgatattcaaaggcattcaagtggtgttgttggagatgtgaaggaaaatgattcatacagtttctaccagattgcttgtgcagtcgaggtgatgcgtgagatatcagtatgcccttatgcactgttatcaaatggtggcaatggcggcgctatggcggttttgcatgacggaaatttgaaaaaacgctaccgaatagcggtggcgtggcgggtttacaatggcggcaccatagccatggcgcggggaaacgcagcacagaacgcagcatgcaaccaggagcgacaccccgcaccctgcagcgaccctgcacgcagcagccaccatgcacccagcagcgacgaccccacggcccgaacgcacgacctagtagcgacaagcaccggcactcgacggcgacgagcaccggcagatgaccctgcgaaggcgatgccgcaccgaccctgcaccctcacgaaggcgaacgtcgtggcgcagttcagtgtggctgctgatggtcagcatctaattcttcatcctctgaatatgaagtgtttgcttcaccattatgggagctatgatatgcttcctcacagaataagtggaaggatcctacaattggagtcagttactcagtctgaggccatcaggaggcgctatcgattccttagtcattttccattaaccacaacctttcagctttgtgaagttgatttgagtgagatgttgcctcctgaagcattttccccatttatggatgaaatcaagaagcgtgcaaatcagaggaagcaacttgctagaaaggaaaagaaggaaaaaataatggctgaagctactgctgcttattctcttcccatatcattaagtcatcagtttacttctcgcaatgatcctccaacattctccatggatgactttgaagctcttggaaattcaaccatatcatcaagtcctcccttagctggggagagaaaatcgttctcaaatgttactaggcttgggtttgctgctgctcatgattctccatccttacaaattcaagaaactagtggtctgcataataacaacacaactgctgattcttctgtcacaacaggtttgagaaatggggagacacaatcatactccaatgctacatcaagaacagaatctaatataagctcgaatgcaccaaagacaaatgagttggggaagaagggaaagaaaccaaatcgagttcttctgtcaacagctggtggtaggcgctattga

SEQ ID NO: 45342 - DNA, 1521 bp, Glycine max
  Peptide Sequence Number=SeqID_162120
atggaggatttcccgaatgcctatgtgtattgtcaacaactcaaggaattgttcgatcaactcaagaacgtaggtgcaccggtgtcgaacaattgtcttgttcttcaaatggtggtcgacctcactaaggcttataatggggctactgtgaatcttgccatttgtccaacagctacctcactcattcaccaaagggattctcttccaccattctatcaagcctactttatgcttaccttagaagaagctggtctcccgaagaaggttgcaaccagcggggttgtcgccatgggtcaaaaccacaacaacagtggcaaaaaaaatggtggcaatcacggtggcatcaagagcagtggtggtggtggctgcaatggctgccacaatagtggctggcagcagcagtctggccagcaacaatcggggcaccaacagtggcctaccgaacaatggcagtggccatggatgccttgggctcttccaccttgcccatacccctcatccaacgccccaccccctccttacattgggctaggcccaattttcagcaagcccaatagcactaaacaagcatccttgggccaaaaccaccacaggcacacagcgacagtagctccacccactccgacaaacattgaagcaatgatgcacacttttgggcttaatcctttggatgctaattggtacatggacattggtgccacctcccgcatgacactcgagcaaggaaatctctcgtcttattttaatttgagcaatactcgtggtctaattgtcgctaatggtcattcaattgcaattcgtggttatggtcacaccaatttgtctcccacgaatccatcctccaccttgaaaaatgatttccaaacgaggatacgtctcatgagatgtgagagtcggggtgacctttatcccattaccaccaatcaagccacttcaccatctactttttccgctttagcaccatcattatggcatgctcgtggtcaattcttatctcagcaaaagtatgcaacaaagatcattgaacggaccgacatgtcatcttgtaagccatctcctactgtggttgacacgaaaccaaagcttagtgctaattccagcacaccatatgtcgatccatctcattatcgaagccttgcaggggctattcaatatgtcaccttcacgagacccgatattgcttatgttgcgcaacatatgtgtttattcatgcatgacccaagggaagaacacatgcacgctttcaagcatattgtgcattacattcagggtactcttgatcatggcttgcatctctatccatcttccacatccatttttctctcttattcgtgtgctgattggggtgggtgttcggataccagacgctctacatcgggttattgtgtgtttcttagtgataatttaatttcttggttcaccaaacagcaaactacgttgtcacgatctagtgcggaggcagaataccgaggctctgccaatgtggtttctgagtcttgttggtacgaaaccttcttctag

SEQ ID NO: 45343 - DNA, 483 bp, Glycine max
  Peptide Sequence Number=SeqID_162121
atggttaggactagaggcctaggccgtgccttaggtagggttagtggcagaggtctggggaaagaggatcgtgatgattctgacgatgctccccagaggcgaagaccgaccgcattcgcatgcaggcaacgggtacttatcactgttgctgacgctgagccagtggtacctgcggctaaggctgacgtagctgtgactgaggctgacgtagtagcggatgagccaatggtagaagttgacgtacatgacactggtgcaaacactgctgcatacaccggtgcacaggctactgtagatgagcctaagggattcctaggtggactgactgacccatcagtgctgaccaagtatgttgagcatgttgcagctagcgtatggaccggggaggagagtcctaagttgaagttatcctcccatgggaggaaagtgcataatttaggtaggcatatccctgccattgaggggctagttgctaggacatga

SEQ ID NO: 45344 - DNA, 279 bp, Glycine max
  Peptide Sequence Number=SeqID_162122
atgacgatcgatcctcatgctaaagttgaattaggatatatgtcacttgtcttcctcaactgtgaggagcgaaacatcgaaaatcaaatctatttatgtgagaacgaggaaaacaagaattttggtagaatcagacctgatggagttgtcattagaagtcagtgggatgttagggtttcttacacatttgttgaatttgaagaaaatgctgaaaaagaaaatcaaaatctaaagatgttgaaaaagctacccaaaatcaaagttcttagttggggctga

SEQ ID NO: 45345 - DNA, 468 bp, Glycine max
  Peptide Sequence Number=SeqID_162123
atgaagcgcaaggtggttcagcacaagtggaagaagaagctttttgctttgatcttggtggtgttttgtttaggaagcttgttgtttatgcagacacgttaccatcatgttgcggggttggtttcattgcaacaccgttttgtttctgagcccgaggttcaagggcccaaggttgcgtttctcttcattgcacggaacaggctccctttggaaatggtttgggatgctttctttaggggaggcgatcgcaaattctcaatttttgtacactgcaggcctgggtttcttctcaacaaggcaacgactagatcaccatattttttgaatcgtcaagttaatgatagcgtacaggttgctcttctctcgttgttttcaacagagtctgtttatgtttattatccactcccacgtgatctgtcagtggtgttcatacttcatattgataagttgctacacgcctacacatga

SEQ ID NO: 45346 - DNA, 495 bp, Glycine max
  Peptide Sequence Number=SeqID_162124
atgcttcctcttgttaatactatcaagcctggaagtaacttctggaggggtttattttctacttgggatatattttgcagaaatataatctggagggtgggaaacggaagggatgttaaattctggagacataattgggttcctgagtgtggccttcttatggataaagcttcaggttctgttcctgaggaagagctaaatgacaccatagtttccttttgtaatgatgcaggagaatggaggggtgataggattgctagctttttacctcaaccgattgccagagaagttgtcgggagggtgacaccattgcctggagtaagacatctgatggaagcaatatatgcagcatttgtgagcagcacaaggaatctctatttcacacgtttaaggattgtgctggtgcgcgacttgtttggcaatttttcatcaagacttgtggttcttgatcaaaccggaagcagcagcagaagcatgtacaaggacaaggggtaa

SEQ ID NO: 45347 - DNA, 441 bp, Glycine max
  Peptide Sequence Number=SeqID_162125
atggttgtccttccatggggtaccaatgcatcgtttattgccctaatagctaaagtggatgatcctcaaagtttaggagattttaggcctatctccttggtccgtttcatgtataaaattgtggctaagttgcttacaaaaagattgaagaaggtgttgccgggggagggagaagaagaaatgtttggtgttctaggaaaggatgttgtgacagatttgaggagaactccaaatgcagcagagatttttcaaactgatgtgttccagtgtccacagaaggtggaggaagtcaaccaaccttttcttactcttattcctaaaaaagatgagtcaaagtggggacaatattgtagttgcccaggaggtgttccactcgatgaagaacaaagaggagagaaaaggatggatggctatcaagctggattaggaaaaggcttatga

SEQ ID NO: 45348 - DNA, 348 bp, Glycine max
  Peptide Sequence Number=SeqID_162126
atgactgatgagatgtcagcattagagtctaacaatacatgggagcttgtttctcttccaccaggaaaatctgttattggctgtagatgggtcttaatagttaatactaaagtgggacctaatgtaccggtgaagattaggaggacatcaaggctctcaaacaatatctatttcagcacttccaaactgattgttagaatccttagatacatcaaagggtcacctagaaagggacttgtttacactgacaggggacatagtaacattattggatactcagatgaagactcggctggagatgcaggagatagacaatccacttcaagcaattgtatttttgtgggttga

SEQ ID NO: 45349 - DNA, 1340 bp, Glycine max
  Peptide Sequence Number=SeqID_162127
atgacaagagagaaaattataaataggatggggattgtgggtagagcgaagaggagggaagatatgggtgccagcgagaacaatagtgcaaaaccaagagtacgcccaattgtacgcttagggatctttctcatctctcacagcaacattgtcagtgtggtttgtttcatcgcaggggtggtggctcttctccttctccctatccttgccaagaacacctacatttccgagaatgccctcatgccaggttctgcaaacaacatgctctctactcaccatgtctcagatgcaaataaattcatcaaggacttaactgatttggagttcagatctggggcctcaccaattgagagtcaaaaacttattgcacattatatgtcagccttggatgctgaagttacttttcacaagttttaccctcaattcaatcagttccatccactgcacttctttaccagtcccaattcaggtataatctcagaaaatgcaacttgttcttcgtttggaatcaacactgttggaatcatcagggcaccgcgcggggatggcaaggaagctattgtcttggtaacgccttacaatccaaataaagttggtctgggtgaggctttgtccttgggcattgcttactcagtgttctcactgctttcgcgtgttacttggctggcaaaagatatcgtatggcttgtggctgattcacaatatggagaatattctggagtggctgcatggctaagagaatatcatgcccctgctttccgaagggttgacattgttaatagtgaaacatgtaatgagagcagcacttttaatcaacttggacagggtctttattgggatggaaagttatatggtggttttagacgtgcaggaactatggctgcagctcttgtaattaaagttgcagagcaaggtaaccagtatgaagacagtcttaatatttatgcggaggcatccaacggccaaatgccaaacctcgaccttatcaatattgtaaattatctggcagtacataaacaagggttgcggataaaagtgaacaagatgtggtctctgcttggatccaggtggctcaatactttgggtgttatttttgaatccttgggaaaatttgctagaagcttaaatcctcagtggaagtttggtattcctgctactgagtatgttgagggtgctgctacactggcaagttcattgtattaccagggcttaggtgttcccactggtcctcatggtgccttccgagattatcaagttgatgcaatcacactggaaatttcaccaaaagtttctcttactaaaatgatcaggcgtaatgaattcattctccatagtggaag

SEQ ID NO: 45350 - DNA, 234 bp, Glycine max
  Peptide Sequence Number=SeqID_162128
atggtgaacatggccttgttactgagttttctggtgacggcgacggtactggcgtcgtcgtctcacgctgcttctagtggtcctcacattgccgacgttaacatactcttgccgccgaaaatgaccttccctgtcgattataggctccaaggaagtgacggttgcttccaatggtcctcttccactttctatcaccacacttcacacttacttgctccaaatttttattcctaa

SEQ ID NO: 45351 - DNA, 204 bp, Glycine max
  Peptide Sequence Number=SeqID_162129
atggttaaagaatgtaatagttcgagaaagatcgagggaggtggcacaacattgggtctagagttaatgtgttgtgtgagtaacttttggtttctaagcaagaaggcatttaggtgctcaaccattagaatttcgttaaagcttatggtcattgtcgtggaagctgctgctagaatctttcaagtgtcgttcgagaagccctaa

SEQ ID NO: 45352 - DNA, 2206 bp, Glycine max
  Peptide Sequence Number=SeqID_162130
gtcatgggatcatcatgatattctgtctgttgagccagagtataattcaagcagcaagtgctcgactagtgcaaggataagatccattgccccttatagtggtcggaaggaaactgctgtttatgctgcggatttgcagactggaattgtgattcgctgcaaagtcttcattgacaacatatcaagaatacagatatttcataattctattaaacttgatttagaggggcttgccacactacgtgtccgtgcctttgacagtgaagaaaatgtattttcctcattagttggcttacagtttatgtggagccttatgcctgaagccaacggattaccttgtcaccttgttaatgttccgctaaaggattccccccttagtgattgtggaggactgtgtggtaacttagatatacaaataaaacttgaagacaatggtgtattttcagatctgtttgtagtaaagggaattgagattggtcatgagattgtgtcagtgcatctgctcgagccacagttaaagaatttggctgatgagattgttcttactgttgctgaagctatgtcacttgatcctccatcaccagtctttgtccttgttggtgcagtcattccctacacccttaaagtcatccggggaaatgttcctcaagtggtcaccttaccctcagcacatcaccaatggtctgtctcaaatgcttcggttgctcaggttgactcaaaaacagggctagcatatgcatggaacttgggaatggcagctgttattgttgaagatactaggattgctggccatgtacaagtgtcttcactaaatgtggtcctaccagcttctttatgtttgtatatatcacctttatctagttctggtgatccagtggaaggaatcaaatctattgctctaacgacccgttggtatgttgtatctggccatcagtatcttatccagataaaggtttttgcacatgatcatgatgcgcaagagatttatattacagagaatgacgatgttaaggtgtatgataatgattctggtcactggaaaacattttgggtttcaaatgatattgctgtaaaacatggctggcggaattctaaaatcttgaaggcttattcaccaggacttgaaaaattgacagcttctttgagctatcctggtggggctgatgacaaaaaggagattatcaaagctgtgcaagaagtcatggtttgtgatcgagtaaagtacaccttgggcaatgaaagtggaatcatcttactgccctggtctcctggtgtttatcaggaggtggagttaaaggctataggaggttgtgcaaaaacagtgagtgactacaaatggctatcttcggacttgtctactgtatctgtgtcagcttttggtgttgtccaggcaaaaaaacctggtaaagctactatcaaagtgttatctgtatatgattcactaaattatgatgagcccaaatctgttcctatgttatatgctgtggtatttgactgtaagaatgttgttttgtcaggagtagtaatgtggtatgtgttaagcttaagcatattggctggggatgtccttgttgaagtctccattccttcttctatggttatgcttcacaattttcccgtagaaactgttgttggatcgcatcttcaagctgccgtgacaatgaaagcagcaaatggtgcctttttctatagatgtgatgcctttaattctttgataaagtggaaagctggaagtgagtcttttgtaattgtcaatgcaactcaggagttgttatacttggaaacagtgccaaatactcaattccagtcatcagttgatggctctccttgttcgtggacatatgtatatgcttctaatcctggtcaagctgtgatccacgccatattttctaaagaagatcaccactacagtcttggtcctggtgtattaaaagcatcttcacgtattgtggcatatctaccccttattgtgcgtcaggcaggtgatggaaaccaatttggtggttactggcttgatttggttcaagccgaaagtaacaagcagtctcatagcttagaggagttatatcttgtacctggtacaagtttagacatagtacttgttggtggacctgaatggtgggacaatggtgttgatttcattgaaactgtagaagttttggatgaagggaatgctctggctgaagatggagttctagtgcatcgg

SEQ ID NO: 45353 - DNA, 1587 bp, Glycine max
  Peptide Sequence Number=SeqID_162131
atggacaatgacaaatctacgatcgagctaattggagaggccagaaagacaacatcgttctacttcacccaattccctaaggatgcgacggagcaagaactatggcaccatttcaaaaagtttggtgatgtacaggaggttttcatatccagacaacgaaacaagatgggtagaagatatggttttgctagatttaaaggggtggaggataagcacagtctagaaaagaaattagacaatatcatctttggtgggctgaagatgtatgtcaacatcccaaaatatgggagagtcagggctgaacagacaataccagaagctaaacgagtagaagggaatgagcaaaaggaaatggaggcaccctctcgaagacactcactcccgagaatgaatcaagggtcgtatgcggaggtcgtggctaggaacaatagacgctcagttccaaggggaatactaggtagccaaaaccatagccgtgaaggatcatggtcttcggtgtatcttgacataccgacaacagggaacaaatggttcaatgatgcgtgggtgggaagactaaaatctggccatgttcgacaaaacctcacggacgacagagctcagcagatgatggaagaagaaatagaaggaggggcctctccgttccactcacttgaaaagtggaacccgacccagttgattcaatgtgaaacagtgctaaggactggaattatgcaatgtgaactttatgcactacaagcttatataccctttatcatagatgagacccaatctgagttcattgagggaagacatctattacatagtgttctcattgcgaatgaggtgattgaaaaggccaaaaggaacaacaaatcctctaaatgggtcaaatggattgaggagtgtttgaaatcagcatccgtctcagttttagtgaatgggagtctctcggctgagttcctcccccaaaagagtcttaggcaaggggacccattagctcccttcctgtttaatgtggtggctgaaggtctgaatgggttgataaggagagctaaggaagaaaacctgtataagggtttccaagtaggcatcaataatgtgaatattagcatcctacagtacgccgacgacacaatcttttttcgggagacaatcatggagaatgttacagcaatcaaaactatcctaaggacgtttgaacttgcctcaggcctaaaaatcaacgttgcaaagagctgttttggagtttttggtcaatcacaacaatggaagcaacagggagccaaatatctgaactgcagattgttggctcttcctttagtttacctaggaataccaataggggcaaacccgaggcgagggcagatggtacctaaatcagtggcggataagttggtgagattgcagcgtagatttctatggggaggcggacccgaccaaaacaagattgcatgggtcaggtggaatctcatgcaacacaaaggagaactatgggctagagtagtggaatccaaatatgaaggatggcggggggcagcttattcaaaatggcctgaagtggaagcagcatcaggtcatccaacagatgggaagccacaaggataa

SEQ ID NO: 45354 - DNA, 2229 bp, Glycine max
  Peptide Sequence Number=SeqID_162132
atggaaagcaaatgcacaaaaggaagcaacattgaagaaaagataggctctgataccatcttagaaggtagtttggggcctaactcaaccccaaaagctagctcatggggtgagacaattattgctagtgtctttgcaaatggtaatactgtgatttgtgaagcacggagttttttaagggtgggagttccatctactgtcacattgcatgtacagagtgaacaacttgggattggccgcaaattgccaatttatccgttatttcctgagggaactttgtcttctttctatgagctatgtaaaaattaccagtggagtattgaagatgaaaagaccactgaaatggagtattgcaaactacacaaaacttgtgctgctagtaatggaactgctaattatcaactatctgattatctgccttgcatttatcaccaagctgtcacaattgttttccttatctccacaattatcaaccgagtctatcataatactcaactctatccgcatatctcaaccttaactaagcctgctaccaaagtattgagcttcaaggtggcagagaccttgcatgaggatagtatccagttgactgcttcagcaggaagtcaagttaatagttattttgatgacaatgaccttggttttattaatgtcttgtatggaagatctgcaggcaagaccaatgttgctgtctctttctcatgtgaactttcaacttctgggtcaaggacacagtcaaggttttacagttcatctttatcagttacagtgattcctgatcttcccctggctttgggagtccccataacctggattcttcctccctattatacaatgacaagccctttgccttcatcatcagaatcccattctcagaatgatagtcggaatcgcagaggaaccattagctattctttattgagaagtttggagaaaaatgaagctctgcaaaaagatgctatattcattgatgcggatagaattaaaacaaccaaaagtaacaatcttgcttgcattcaagctaaagatcgtacaactggaagaacagagattgcttcttgtgtcaaggttgctgaggtgactcaaattagaatagccagtaaggaggttctgctcaatataattaaccttgccgttggtgcagaacttgatcttccaacaagcttttatgatgctctaggaaatcctttccatgaagcatacaatgcagtacctttttatgctgaaactaactaccctgatgttctctgcgtaaacaaaacagctgatggaaaaggcaatgtccatatcaaggcaattcagcatggtaaagctcttgtgcgtgtagcaattagtgaagatctgcaaaaatcagattatgtgctgattagagtgggtgcccatatatatcctcaaaatccagttcttcacataggaagtcctcttaacctaagcataaaaggtttgagtgatacaatttctggacagtggtttaccacaaatggaagtgtaatatcagttgatacattatctgggatggccaaagctattggggaaggttcagcacaagtatctttccattacggaagattgagactacaaacaacaattacagtgttgaaaggaaattatatttttgtgaatgctccaaaagagacgttaactaatgtcccgtacccttcaaaaggatacaacttctccgtgaaattcagtgaatcccttggtgcacctggagaaaagaagagaattttattcaattgtagagtagatccactatttgtggggtatgtgaagccatggctggatcaggactctggcaactcatattgcttatttttcccttactcaccagagcatttggtgcactcagtacctaagttagaaggcatgaggccagatgtatcactctccatttctgcttcccttgaacacgaacatgtttctggatctgcttcagcactttttattggaggattttctataatggagatgagcaagaattcgatgcagctgaatttgacgccaggctctaacaaaacttgcattactgtcttgggaaatactgatgttgaaattcactggcatcaccgagacttgattatgatcagtctcatccataaagaagattttggcattcgagggtttgcacggtatgaggtcaaattgcttaaagccaagagattcaaagatagaatcatcatcactctcccagctaatggttacatattcctgaagcttaatatgacttga

SEQ ID NO: 45355 - DNA, 296 bp, Glycine max
  Peptide Sequence Number=SeqID_162133
tgaatgaacgaagaattattaaagcagcagctcaagctgaacgtagttcaggtagacttcgtgatacccctgttattgtggcaaatgggcgctctattcgtgtatctgcagttggtatcagtgattcgggagaggcttatgcaaattcatcttctctcagtttgaggtgggaacttggcagttgcgagggactggcatattgggattatgcttttgatatagtgaagtctaacagttgggagagatttctggtcttgcaaaatgaatcaggattggtactgaaagattcttattaa

SEQ ID NO: 45356 - DNA, 243 bp, Glycine max
  Peptide Sequence Number=SeqID_162134
atgcatgatcaacagctccgaaccttcaccctgacccatcttcatcaagttcaagatccttctaatgagcatccccatgagacgttaaaaagaaaacataggaagcaatgtccagaagttcagattcagagttataccatgctaaccagcttgagaagcccattgctcggaggttcaacatgttcagagaaattgctggttgtgatttttccacttcaaaatcttgtttcttcaagtaattaa

SEQ ID NO: 45357 - DNA, 990 bp, Glycine max
  Peptide Sequence Number=SeqID_162135
atggcattgggaagagtaatatacgttgctcacaccgtatgtatcagatcagagcttcaacccatggcacctgaccgcattggttcttcctcttcttctcgccaaagggacctcgttttcgtcgtcaaccctctagctagaaaagcagaattactcgttatttctttggggataaagtttaatttttggaaatattggaccataattggcactcaaatcaactgcaagaaacttgagttccaggtgctaatgggaggacagatatgtgaatccataacgtcgggtccttgtcatgctattgacataacaagagaggctataagggagggggctgatgctgtcattgctgttggaggagatggaactcttcatgaggttgttaatgggtttttctgggctggaaaacctgttgttagtcaagtgaaagagtctacacactcaactgctcttggtctcatccccttgggaactggttctgattttgcaagaacatttgggtggtcttctttagggttgagatcaatgatagatgtcggtgttatcactggagagagttgcgaccatcattacttcataaatgtcgccgacattcatttgagtgcaaaggcgggtttttatgcttctagatacaagagatttggcaacctgtgctatgtcattggtgcattgcaagccttcattgggcatcaaaaccaggacatgagaatcaggttcaatgatggtccatgggagacatgtcctcaagtgacagccctttgcattggaaatgcaaaatactttggtggtggcatgaaaattacaccaaatgctgatcctttcagtagaaatttagaggttgtaactcttcagaacttcaagtggtatgattttgtcttgaaattacataagctatacagtgggacacatctctcagtaaaaaatgtatctgatagaaggtataatcttttccaaagaagtcaatctaccattcttaattttaccttccattaa

SEQ ID NO: 45358 - DNA, 857 bp, Glycine max
  Peptide Sequence Number=SeqID_162136
tgaagcaagtccttataactggaggaatcctccagattggaggtggatgtactgcagattcagtgtacaaagcaggctttgagcaagctatagttcaaaatgagaagtactacaagaggttccctcaagatattaaaattgttcaagaacttgttaattatttggctgaacaagaaggaggaggggtggctcttccatctggtggcttcctaaccccaagagggctgcagactcttggtctatctggcttaggatccagagctggtttcgagagcatgcactatttgtttgagagcgtgtgggatcctacttttgttccgggagcaccaaagagaataagttacaacttcctaagttcttttgagaagtggttaaattttgataccaatccactctatgctcttctacatgaatccatctattgtcagggttctgctaataaatggtctgctaatagtgtaagaactgcagttggagacaagtttgatgcaattagagctgccagagaaggactacctgtactttttacaggagagatgattttcccatggatgtttgatgagattcatgcattgaaaccattcaaagatgcagctcatatattggcagagaagaaggattggcccccattatatgacgttcaggttctgaataacaataaggtacctgttgctgcagctgtttactatgaagacttgtacgtgaattttaagctggccatggaaacagcttctcaaatagcagggattaggccatggataactaatgagttcatgcattctggcttgcgtgatgatgggagcaaagttattgatcatttgttggggatgctaaatggaaggaaacctctattttga

SEQ ID NO: 45359 - DNA, 392 bp, Glycine max
  Peptide Sequence Number=SeqID_162137
atggcaaaggaacccattgaggcccggagactaacatcgtcttctgcaccttttgtcgtcctgacttgtgaagtcagctttcgtcaaccaggggcaaacgagtctgttgacgcgcgaagacttacatcttcttctgcaccttttgtcgtcctgacccgtgaagtcagtaaggtgacatgcggggttaccttatggttatccgcacctttcgtcatccaagggaaaacgagcccgttgacgcgggcaaacgagcccgttgatgcgaggagactaacatcgtcttctgcaccttttgtcgtgctgacccttgaagtatgggcaaacgagcccgttgatgcgcggagattaacatcgtcttctgcaccttttgtcgtcctgacccgtgaagtcag

SEQ ID NO: 45360 - DNA, 489 bp, Glycine max
  Peptide Sequence Number=SeqID_162138
atgagggcacatgtcattggaaatgagatcgtgttcctttcaaggaagagagataagacctattactatgtaaatgggatgatgtgcttgggaagagaacaggagaggaagttgacatggatttatttggataatcaagaaagctttacatggaattgctgttgggaaagaagagcaaaacttgccatacttattatatttgcaaggtggacctggcgaggaacaggcttatcaactcccttgactgtgtcatcaatgtcacaattcaagtctgctgatgaattagctgactttttaaaatatttccgagctgataatatagtaaacgatgcagagtttattcgagttcgccttgttcctgatgctggtccttggacaatattgggtcagagctatggtggattttgtgcagtcacgtatttgagtttcgcaccaaaaggattgaagcaagtccttataactggaggattcctccgattggaggtggat

SEQ ID NO: 45361 - DNA, 747 bp, Glycine max
  Peptide Sequence Number=SeqID_162139
atggaatcacccggtaacgagcatgtggtgggtggcgcagaacataacgacgtcgttacgcccttttcccacagagaagaaccccacaattcccaacccctcaccggcgacggtgccagtcccggattagatgataacaatgttcttagatttggttctaattgcactcgacccataatttgcagaaagatatttataggtggtttagcgagagaaacgaccattgcccaatttatcaagcactttggtaagtatggtgagatcacggattcggtcatcatgaaggacaggaaaactgggcagcctcgtggatttgggtttataacgtatgcggatccctctgtggtcgataaagtcattgaggatcctcatatcatcaatggcaaacaagttgagattaagcggacgataccgaggggagctgttggctctaaggattttaggacaaagaaaatttttgtaggtggaattccttcaaatgtgactgaagagagatgcacttgtgcagatgaatttagagacttctttacacgctatggcgaagttaaagatcaccaaataatgcgggaccactctaccaaccgatctcgtggctttgggtttatcacatttgactctgaagaagcagttgatgatctgctgtccatgggaaacaaaattgactttgctggatctcaggtgaggaatcttttattcaaaatgagtacatgcattgcattattctacctggaagatatagggtattga

SEQ ID NO: 45362 - DNA, 153 bp, Glycine max
  Peptide Sequence Number=SeqID_162140
atgaaacgagctaacccatcaccgaataaaaccagggatcgacttggcttatctgccattgctccttctgcttctgggtttttcacaattttggaattagatgcagagagtccggatattgatttagcgaatatgatgttttctcgttattaa

SEQ ID NO: 45363 - DNA, 555 bp, Glycine max
  Peptide Sequence Number=SeqID_162141
atgcttgctcattgtcgtgccgttgctcgtggcgccaagaggcctcttctcgttggagacttgccatttggaacctatgaatccaattccagtaaggcagttgatacagtagttaggatgttaaaggaaggaaacatggatgccataaaattagaaggagggtcaatttcaagggttgttgcagcaaaagccattgttgaagctggaatagcagtcatgggacgtgtgggacttactcctcaggccattagtgttttgggggcatttagacctcaaggaagaactgttgctagtgctatcaagaataagtctatgaaggttgtggagatggcattggctttgcaggaagctgggtgcttttctgttgttgtagagtgtgtgcctgcacctgtggctgctgctgctacagcagcacttcagattccaacaattggaattggggctgatccattttgcagtgggcaggcagcatctgcagcatttgaagcagtccaaactatggatacttccaaatcaaacggtgaaggacaacaaaggactaaaacaacattttag

SEQ ID NO: 45364 - DNA, 1026 bp, Glycine max
  Peptide Sequence Number=SeqID_162142
atggaaaaagaggttgtggaaaacctttggaacggtgatagagattctcaaattcaagcagctttggaactgggtagattaagcaggaagcagaggcacaagttggaagagagtggtgttatggttcctcttgtttccatgcttcattctcaagactatgaagccatagaagctgctttgtgtgccttgctcagcctttcctttggcagtgaaagtgggactaaggaatatgttcttggtaacaaaaaaagaaataagattcggatcatcaaatctggagctttgccagttctggtgagtctcctctattgtcatagccagacagtgatcatacaattgacattagcagccatgctaaccctctcttcttgcaaggcaaataaggtagcaattgcttcatctggggctatccaactcttggctgaatttgtcaacagcaattgtagcactcagtctcagcttgatgctatagctactctacacaacctcacaacctgcaaagagattatgccattgattgtctcttctggtgttatgttctccttgcttgaactgatccacagcacagtaaaatcatctccattggttgagaaagcaattgagttgctagagaacattgtgtcttcatcagagagtgcactttgtaaggctgctggtgctggtggagcgatcgggatactagtcgagactattgaagatggatctttactaagcaaagagcatgcagtgagtatacttttacttatatgccagagctgcagagagaaatatagagggttgattttgacagagggagtgatgccaggattgcttcagttaagtgtggatggaacatggagagccaaatccatcgctcaagaactgttgttgcttctgagggactgctccaattatggctcaagatgtaaacaaatcaatcatgagcttatagaacggataatggaagaaattgaagcagaaggagagaaattggcagatactactttaaggttggtagaggaaatgattgcaaagctcaatgcttaa

SEQ ID NO: 45365 - DNA, 813 bp, Glycine max
  Peptide Sequence Number=SeqID_162143
atggcatcctttagccagatgcagtcccagatgcagtcccagggacttgcacgacctgccgagcctctggttggtccctctggtcctcgagtagttgtgtcttcgacaaaaccacctccaaagcccgatccagaggtcgatgatccggttacatgggatgccaccgtgttcggggtctttaatccagatttcctggtctacataaagcacgaagacctctccgaaatcgcacacggtggtcaatgtctcagcatatcagtgttacagttgtggattttgcatctcactgaaacatgtatgcgagcgaggaattctgatatctatggattcctcgagccacagtccattcaaaggtctgggcaatcgcagtttgagtctgaaagttacataaagacttggatgcagagttcaaaatgcgatgtctatcttggagcctacctaaatggcggacactggcagatggtggtcatcttgcccaaggaacaactagttgtctggttttgttcattgcataacaggccagacaactaccttcagggaattattaacagtgctttaaaaggtcttgatgatgctccacaacctaaatcaaaggctcctactaggtggattgtcgtcaagtgtaatagacaaaaaggaagtactgagtgcggctactatgtcatgcactggatgtccaccatcattttaggaacttttaggaataattggaaagcgtattttaacgatcctagaccattggagccagagagattaaaggcattgcggatccagtgggcacagtattatctccgagttagagacaagacctag

SEQ ID NO: 45366 - DNA, 240 bp, Glycine max
  Peptide Sequence Number=SeqID_162144
atgggatggcaacttcctaacaaaatggtatatggtgtccgtccaagtgttgatgagtatgagaagttaatacagtttctctgcttgaaggctttggattgggaaatggtagaaaatctacaggaggaaatgaaagggagtggtttgcatctcaaaggcatgatgacgggtttgattagagttgtcaaggagatggagaaggaggttgtggaggttgagagcattactgcagtggcgtaa

SEQ ID NO: 45367 - DNA, 2190 bp, Glycine max
  Peptide Sequence Number=SeqID_162145
atgccttctcgggccatgcagccccagagatactctgcttattgggctagatttcacgcaagcttctacactcagaccacaaccccattaagagtcactgtcggcaacggtgatgaacttcaatgtcaccagctttgcaaggatgttccatcgttgggtccaattctcacggactacaacactcttaccatgcaattccgctatgaagatagggtagtggagctcactccagtaacccctcgattgctacggcgcatgacccagtccggcactgcgagcacgttcttccacttgcgcatagagcctccttcaacccaaaaaacttcttccccaaactctcctcaccatcaatcacctgccatctccagcctcattgcccaatttcacaatctatttcagccacctatgaccctaccaccagcacgcaccactaatcattccattacgctcattcccaatgcctcctctatgaatgggctcctacaaccaagtaccagcgctttttcatctccggtcctgctcgtgaagaagcgagatggttcttggcaattttgtgtggactaccgggctttgaatgctatcacggtcaaagaccactttcttattccaatagtggatgaattgttggatgagctcgacgatgccaaattcattaaaggctatgcaaccatagcggcgccattaatgcacctcctaacccaggagcagttcaggtggccactagaggcagaccttgcttttcaaattctcaaggatgttgtcagtacgacaccagtcttagctttacccaacttcgccattccattcgtagtcgagacaaacgcctcgagggttggacatcgttttatcgtcctcactgatcaccgcagtcttaaagaactcatggcacaggtgatacagacaccagaacaacaattgtatttatctcgccttcttggatatgactatacaatccaatatcgtgccagcaaatccaacgtggtggaagatgccttatcaagagtctatgaaccacctacagggactctgttgttattgtccacaccccacttcgcttttcttgaggaattgaagaaggagttaattgcaaattctgattttctcgtgcttcgacaagtcatccagttcatccctgactctcatctcaattattccattactcaagacttcatcatgaaaaatggacgaagttggttaccaaatggacttccttttattcaaactctattgtctgaatttcaccagtcaccgacgagaggccatatgggggtctgcaaaactctggctcgcctaaacgataattttacttgggctaacattcatcaggatgttcgcaaattcattcctagctggtaccacttgggtatgctacccatacaccataatgctcatttagtagccttgctattcttggacattgtcggtaagcttcatggtatgccccgtaacatcgtctctgacaaagacccactgttcattagcagattctggcgggagttgttctccgtaagtggcacgaagctccgcatgagctctacctaccaccctcaatcagatggttatactgaagttgcaaatcgaatcgttgagcaatatctcagggcctttgttcataacagaccgacatcatgggggcggcttttgatgtgggccgaatggtcctacaatacatcatcccactctggttcggtatttgcttccctacgcaagaaactgttgaaagctcataattgcatgaagaaggtagcagatggccataggagagataaagagtttcagattggtgattgggtgatggaggaagatcgcattggaaaagtggcctataaactacaactgccagaacactcccgcattcacccggtgttccactgctcaattctgaaaccatttcatcaatcttctttgatgataccagaagccgtagctctaccaatgtcagcagtggacaacaaacctgaggttcgtcctttagttttcttggcaactcgatgggactctacttcttatgagtcgaaacaacaagtcctcgttcaatggactgggttagctccgaaagacacatcttgggaggactggtttgacttaaaggctacttatcaccttgaggacaaggtgttgtctgatgcgcacgggaatgttaagaaaaaaactaaggaggtgcaagtgggaaagaatgggccagaataa

SEQ ID NO: 45368 - DNA, 1662 bp, Glycine max
  Peptide Sequence Number=SeqID_162146
atgtccgaccttgtctctactacggatgacctaaatccctacgcggatcaactacatccctacaaactgcactacacaagcaaaaatggaagcagaacgacacaagaaaagggacaattggcttacctcgatggtggagcaccgcaatgtacgtcttgccagaagagaaaaactaccacgataacaccgccaataatgctcacggagaatggaagaagaagaggcacacacatgacgaagaagcaactcgcaaaagaagaagaggcagctcgcggaagaaggagactcagctcgcggaagaaggagaatggcagaagaagaaaagcttggtgcacaaaactttttaaaaaatacgcaaggaacaattctttgtgtacggttccctcagccactgcacccaacggcatcatggaagacagtttcagagtgcgagcagagagagcatttggttctcttccaatccccgcttcttcttccctcaactcactctggtctctcaccgaagacgaaatccaaaacaccccttccaatcgcacccccaaacccaaacccaagcccaaaactaaaccccaatcccaatcctattcattttccagttcccgggttcagctcgagaaggacctcaatgatttcgacgacgacgaagaagaagagccacgtggaccctctaaaccccctgattacgatgatgaacagtggcagattaaggctggtattggccgagattgcaccctcgattacgaggaagaggaggatcaatatgacaagcaggctataggcaaagagaacttgggtgatcgcttgtatatgaaggatataaatgacgatggagttgagattagttcttgcaatgttttccccacttcgttcagagatttagtgagagacccgcgtgcaaatcatttggctgcgaggattaggctgaagcaggatgatgaagcagcagctaaaaaaattgatgctctgcatgtgtctgagaaatctgcgccagacattggtagtggtggtgatgctgttaacccaaagtcaatcttgagaagtaaggataacccttcggagcccaggccgcagaaacgtgttcggtttgattctgaatgtgacgatagaggtaatgatgatgttgatgggcatgaaggaaccagggatgttcgcatgaagacctcttcaatggaagaggatacagcttcggatcagttgtcaaagtcgcaagaatttgattcagcagttccagattacattcgtaatccttcaagatacacgcgttacacttttgatgattctccaagtgacatggatgacaaatcaaataaggaatcatgcatgagcttcctttcgcagttgaaggggtcaaatgctgccaagggaactggatctcaagcagatgaagctttggaagatcttccatcggtaacctttatatcaaagaagaaatctggagatgccaatatgtgcgacagtgagacggtgccaaagccaaagcttgatgctggcatggaggccatgaatagaagagccttccctgttggcatagctgctggtgattctgagaacagtgatgcttgtgcaatggaagaagatgaaccagaagttgaagtcgttaaaaagagcttgcagaagttaaaccgccagtacaggaagaaagctcaggaggagcctgtgtaa

SEQ ID NO: 45369 - DNA, 447 bp, Glycine max
  Peptide Sequence Number=SeqID_162147
atgggtggtggtttgctgggaaggagcgatggtggcgtcgaaactaatgatgaggaacttgtggtgaagcgaggtgacagaggtcccatggtcgaagaaaatcgagatcgtggcggtcctgaaaacgacaacggagcccagtcaggtcctcgtaggaagacggtgcaaaacaggcttcgagggcgtggagaaaaggagaccacgaggatagttgggcattctgagacatccattggagccatgccaacactagaccatccatggagtggaagcggaagaagcagggaaaggttggatggtctccaatcgttccaggcgaaggataaggttgtcgatcttggtggacatgttgatttgagagtaggtatgaaagtcgataatgcttcctcttgggcctatcttttgaagcttcttctggcccattctttcccacttgcagctccttag

SEQ ID NO: 45370 - DNA, 984 bp, Glycine max
  Peptide Sequence Number=SeqID_162148
atgggggatatggtggatatggatgatgacgcggaagatagaaggaggctcgatagggctagggtgcttgtcaagactccgtggactccgacgatcaggcataccgtggaggttcacatcggagacgaacactttaaagtgtttatcgtggaggaatgcggtggcgacactcatgcatgtcggagaggtcgccgcagtttttgcgaatcgtcggaggagattgactccgacgaaagctatagcgggagctctaccccgaggtcgtctctcgggatggtggacgccggactcgtcgcagaggtgccggcgacatcgaaacccctatcaatagtagacccacccaacaacgccgacgaggaccgacaaacgaagtttttacccactggtttcagtgatcaccattacacaccgggtaaagcaagtatctcgcgagtgcaaggtagcagatgccaggccacctcatgtgaccagacgccgtctgcagtaccacaaccaacggtcacctgccaccgtgatacgcaatccaaatgtggaaaacagaaggatatcgggagcgccacccctgcagaaatgacggagctgaatcatgcaaaaggaaaaagtgtgttggaggagagttgtgaggagtcaacgtctctaggggcaatgggaagggatatttgtaataaagcagaattgggggacgtggcagaaactcaccccaccaagaggcaccagtacaaggtgaagatacagacgtattcagtgaaacacaatgctttcaacaggcaaccaacatttggagcatggctaaacaccttggggctacaggaattgcccatgaatatcatatcatataatgtgagggggttagggaggggggtaaaatgggcagccatccggagattggtcaagatggagaatgttgacatgatatgtttacaggagacaaagaaggaggtgattgaaaaagccatgtgccaaacactgtggggagatgctgag

SEQ ID NO: 45371 - DNA, 474 bp, Glycine max
  Peptide Sequence Number=SeqID_162149
atgtattatcgcgcgttcttggatccaatcactcctatcaagtttgggataaaattcacaagtactttagccttcataggaaatcccgtgtgcgacagtttcgcactgcaatgcgtcgttggcattcctattcgtcacgaggaatatgttgatgccctcttcgaaggattaccgtcagattacgcgccattgatctctataatcgagagtaagatgtgcactccatccatcacagagatagaagctttattctatggtcatgaaactcggctaacacgctacaatagagatgcacaggagataagttctacatctttaaactacactcaaggttattcgcatccaaacgctcataaaactggtgattctggtgttcctaaaggttcgtatggccgcgacggtggtcatggtgctttttctgaccgaggtgccagacgcagtggtggcggctttggcaaaggatgcagcatttga

SEQ ID NO: 45372 - DNA, 753 bp, Glycine max
  Peptide Sequence Number=SeqID_162150
atggttctgcagtctctggacgacgttgttcaccagcacttgatggtttctaccagggcagataagagtccgggatccaaaatcgtcgtagcgaatggcgggaacggagctaaggctgagaagaagcgaagagaatcggaggattccataatgccgctgccgcggaggtcgagtgcgaggattcaagcgttgcagaaggcggaggagctttttgctcgtaaaagagtagagggagttgaggagaaagataactgtgacgacaacttgacaccggagaaggtgaaggtaaagaagaggaatagaaaaagtagtggcagtgaggagagtgtagtggtggaagtagagtttgtttcgccggcaaagaaaaagcgggttgcctaccgcaagtgtaaggtggtgggagaaatgaatggaaatggtaaaggtgaagaattgagtggaaatggtaaggtgagaaaagtgaatgcgaaggaggaattggaaaatgcgggagggggtttgggggagaagagtgacttgcttaaggtcaaagagacgataagactgtttactaagcattaccttcaattagttcaggaagaagaaaagaggtgtgggaaggcagaggctgagcgaaaagttgctaaaaaggcctctaaaaaggcttcaaaattgaaggttagaagaattttcttgcaattttcaagctgcattttagttcagagtattgataaatgtactgttgagaattctccaccgggcattcaaatataa

SEQ ID NO: 45373 - DNA, 156 bp, Glycine max
  Peptide Sequence Number=SeqID_162151
atggaaaacaacaatcaatcgaacatgaaagatttccgagaaatcgaacggtttggagatggtaaagataacgaggagagagactgcggaagggaagaagagaagggtttttgttttggtggtatgggtaataatagcttcactctcggggagtga

SEQ ID NO: 45374 - DNA, 126 bp, Glycine max
  Peptide Sequence Number=SeqID_162152
atgggtgcaaatggttacataatagaagtgaacgatggaacaagaatgcggctcgccttagatttggctttgaaacctcataacttgaatcgtaaaaggttaattgaaagatcactcgagcactag

SEQ ID NO: 45375 - DNA, 249 bp, Glycine max
  Peptide Sequence Number=SeqID_162153
atggggtgttattacgccattggtattcctgtaggtattgtacttggcaacgttctcgatttgcaagtcaagggaatatggattggaatgttgtttggaacgttgattcaaactatagtgctaattgtaatcacctataaaactaattgggatgagcaggttaccattgctcagaagcgtattagcaggtggtcgaaggtggacaatgctgatcaagaaaatgaagcacaaagaaaatatgttagctaa

SEQ ID NO: 45376 - DNA, 297 bp, Glycine max
  Peptide Sequence Number=SeqID_162154
atgagcacttgggaggacctgaatgactcattgtttgacgagggcagtgaggaagaagccaacctatatctgatggttgatacgtccacccgtaaagcaaaaccagcactatacgcaagttcagatgatgaggattctcagcctaatgacctgtcaactttgatggtgaagaaaggacgtgaggtcttgaaggtactacctcctgagattgaaaaactctataaggagataaaaaccttgagagataaccaaggcaaatttattggtggtcatgaagtccttaacaacattatttag

SEQ ID NO: 45377 - DNA, 279 bp, Glycine max
  Peptide Sequence Number=SeqID_162155
atgatgagtgcgaaaagcggtcttggaaacatccataggggccatgtggatttgatgaaacccctgtgcaagatccaacttagaaaaccaagtggcatggcccaagtcatccaaaagctcatcaatggtggtagggggaaatggtccttgacggggaaagcttggttggttgttggaaaagaggtgagaaaatttccaatggaagttgaagccttggtggtaggggttcagacgaagcaacataggtggtacaaagttgaagatggaagaaggcagtga

SEQ ID NO: 45378 - DNA, 138 bp, Glycine max
  Peptide Sequence Number=SeqID_162156
atggcaagcctccatttcaacaagagaaagtttcttgaaagtggtcttcgggggctagaaggactgaaggcctggacgagggcaaaggctgtagtgcttgaacctcgtggtagatctaaggcgataaacctgaaatga

SEQ ID NO: 45379 - DNA, 219 bp, Glycine max
  Peptide Sequence Number=SeqID_162157
atgaaagcaccaaaattgttaggaaccaaaaacagaacacctagagttcgaggactaggcaacctcccaagcataaaggtgacaatttttttaggcccttttcaagtaaaggctcagggtgatcacccctcttgcctaagggtcgggcctagagccactcttgacttccgctccacgtcggcaatgactctagggattgacaacgattacgacgactga

SEQ ID NO: 45380 - DNA, 207 bp, Glycine max
  Peptide Sequence Number=SeqID_162158
atgatgttgtttgctaagacaacaattgtcgtgcttggagatttagctaatactttgggcagtaatactggtcccttgattcagcagaaggcggaaacaattttgacacaaacagattttgttcataaggagttcatgccattgcaagaagagggtggtcaggatgatgatattgttcaatccaagtatgattcagatgaagattag

SEQ ID NO: 45381 - DNA, 548 bp, Glycine max
  Peptide Sequence Number=SeqID_162159
gaggaaaagagagaagcagaataatcctggtatcggtcgggccagagatgacgaaagttcaaatagacatgcaggagctaactttaggaggaatatggccataaaagattccgaatcagaaggcatgctcagtgatgttgaaaatgcaatgtgggagtctgaggatgaggagcaagagaataatgactcaggacatttgagaaagttcagtggtaactacaggagtagtagcagtgatgatgagtatgcacatcaaacaatgagtaacaagaagagtggtgtgagggatcatgagagtaaggttggtggttctgctcaatatcacgatagttttgatgcaccaaacagtgtgagagggatgcatgcagttaacaaaattgattctgaatccgtagatgaattcagcagttcagaaaactggctgtggccttcagatgctgaggagactggggactaccctacaaatcaaaatagtaataatgtgatcaaaagtgatatccctaagactaagaggagaacaccaaaagagacagatgaggcatgggaca

SEQ ID NO: 45382 - DNA, 1018 bp, Glycine max
  Peptide Sequence Number=SeqID_162160
atgttctaccttcaggtctcacacccgagtgcggcaacactgttaaagttgaagaggcataccatagagttggtaggagcatgcgcagcaaggtggaaaggcgaatgcagaaagagtctggccaagaagaaagtggcattgcttctacagaaactcaagaagtatgagctaccggagctgcctcctcctcgacatgatccagaactcttaacacctgaacagcttcaggcgtataaaaaaattggattcaggaataagaactatgtcccagttggtgttcgtggtgtctttggaggagttgttcaaaatatgcatctccattggaagtttcacgagaccgtgcaagtttgttgtgacaacttccccaaggaaaaaataaaagaaatggcttcaatgcttgcaagattgagtggtgggattgtgataaatgttcataatgtgaaaacaatcattatgtttcgtggcagaaattatcgccaacccaaaaatttgatacctattaacacccttacaaagaggaagctattgttaggcttgactgctcaaatctgttgcctcttttttttccctttgaaaattcatcatttctgtccctggttatgtacctactatacaaagaacttggtgttggaggaggctcttttcaaggccagatttgagcaagctcttgagtctcagaagctaaacataaagaaaatagaacagcagcttcggcggatgggagtaaatcctgaggatccagctgccatggccagcatccagagagttgcttccacattcttcaatgccatcgaccagaaagaaggaagcccttatgtcttccgtgaaggcaagcagtcaataatagaacctgctgaaggttttgaagagtcagagcctacagctgatagtgatcaggaagagctagatcggttcattgctgagatagaggatgcggcagataaagaatatgaagctgaagaggcaaaagaaaaagaagagtttggcagaattagatactggaacaaagaagaatttg

SEQ ID NO: 45383 - DNA, 1452 bp, Glycine max
  Peptide Sequence Number=SeqID_162161
atgacattttgccgtttctggacatgggtcctacacgaattcaccaatgacaacgttagaggcaccgaatttagagttcttttattacgtcatagcattgcttcattaagaagaagcaatcttaacgagattagttctataatctatgtaatggcttgggaagcaagtagccacggaggtggtaataaggtaatttaccatagtggctctgtttcgctcgattttcggggacacaagacagcaacttacgaagcaaaggttcggaattttcagtcaacagtgggtgggagctggcttattgacattggaggatttgcaaggaaagtgaaaaatactaatctgtcaacagatgatcaaataaaggactgtggaacatatcttgaatgccagaaatgtcattatcatattgataacaatgatgtttctcatgagtggcctggctttcctgtgggtgtgaagtttgatccttctgatgttgagcttttagagcatttagcagcaaagtgttgtattggagacagagagccacacatgtttattcacgagttcatcccaactctagaaggagagctaggtatttgctacactcatccacaaaatcttccaggtgctaagacggatgggagtagtgtccatttctttcacaaaacagttaatgcatatgctactggaccaaggaagcgtcgaaagattcatcatcaagatggtatgactgaggagcatgtacgctggcacaagactggtaggaccaaagctgtgatagaagatggagtgcataagggttttaagaagatcatggttctctatataagatctaagaaaggctccaaaccatataaaaccaattgggtgatgcatcagtaccatctagggagtgaagaagatgagaaggatgatgaatatgtggtttcaaaaatattttatcaacggcagaagcagagtgagaagaatgaggagaatacagtggttgaagattctaacatagcagcacaagcaggtccaagaaccccaaaaccaaatccccctactcgaccttgtacgggaaaatgtgatgacaattttgatgaaaatgaacttctgtcattcatccaggatgccaagcctatacctggagaatcacatgcaccaccatacgatgttcaagatgaggacaataaggacgaccctgcatggttggctggtgaatcacaagctgactttgatggcttggaagacatattattatgtaaggatatgttagattcatcttctctcttaaaccattctggattgagctccacttataatgccaatgcaaacaagttggttgcacctggaaccgataatgattatgcatcttatggagtttctgtcctggacacccttgaatttgatactcctcctgattttgatctttctaatttgcaatttggttctcaagacagcacccttcagtggattgacacaccataa

SEQ ID NO: 45384 - DNA, 1176 bp, Glycine max
  Peptide Sequence Number=SeqID_162162
atgggcattgatagtgaatacgtgatatctcacaaggcctatgcgagggtgggattgcttgggaacccgagcgatgtctactacggcaaaacgatagcgttaagcgtcgccaacttcttcgccaccgtcacgctgcgtccctccgaccagttaatcctccaaccccaccccctccacgatctccttcatttctcatcgctccctcaattggtcaacaggttgagctcccaaggttactatggaggcgtgcgattgcttatggctatttgcaatgtcttctacgcgtattgcagagagaacgccatcgatcttggcgacgacaatttcactctctcctacgacaccaatatccctcgccaggctggtctttcgggttctagcgggatcgtgtgtgctgcgttgaactgtttgttggatttctacaacgtcaggcatctggtcaaggtggaggtcaggcctaacctcatcctcgctgccgagaaagaactcgggattgtggccggtcttcaggatcgggtcgcacaagtttacggtggccttgtttacatggactttagcaaggaaaacatgaatgagctgggccatggagtttatgtaccagtggatttgagtctcctccctcctctgtatctcatctatgcggaaaatcctagtgattctggcaaggttcatagtaaagtacggcagaggtggcttgatggtgatgagttcattgtgtcttccatgcttgaaattgctaatatcgcccaagaaggaaagactgcattagaagaaaaggactactccaaatttgcagctctcatgaatcgaaattttgacctgcgaaggtgggtgtctcactaccctcagcaaatctcaagactaggggtctgctcacccaatagccgatggaaaggaattatgggtccatcaactaacatccgagcaaagttaatgtttggagatgatgccctcggtgatttgaacctaaaaatggtagaggttgccagaaaggttggagctgcgtcaaaatttaccggtagcggaggagctgttgttgcattttgtcctgaggggacttctcaagtgaagcttctcgaggacgaatgtcaaaaagaaggatttgtgatactacctattgaacctcttccttctcgtctaaatgaaattgacttgaaaaccttgcaaataaagtaa

SEQ ID NO: 45385 - DNA, 162 bp, Glycine max
  Peptide Sequence Number=SeqID_162163
atgggatctggcaatgaggttcactcagttggggacttcaatttagattccaagtggcttgtagatcccaaacaactatttattggtccaaaaattggggagggtgctcatgccaaagtatatgaaggaaacactattgtgcttctcctttccatgagttag

SEQ ID NO: 45386 - DNA, 1197 bp, Glycine max
  Peptide Sequence Number=SeqID_162164
atgtacggctccgacgaagatgaatcccgacgccccgacgagaccttcgtggagttgaagcccgaggtggtggactttcccactctgcacaagagggaggaagagctttacttctatgacgcctttacttatccctgggagaaggacaagcattacaagatggtttaccagctggagaagaagtactttcctgatcaatgcctcgacaaggcgtttctccaaccgggacagtcaaatgctaatgctaatgggaagggaaagggtaggaagaaagttgttggtggtggcggtggtgaggaaaagttggtgttttttgaggaggggaatgtggaggagaagggcgaggagagtggaagtggaagcagacaacttaaggagaagaaggttgaggacttcttcaagggtttgaagaaggatcctagtcctagtcttaacaaggatgttcaagttggagagccttttctttcctcaaggaggactggtcttcctcccgtctgggatactcctcatggcactgtgctcttggtcaacaaaccaaaaggttggacttcattcacggtttgtggaaagctgcgtcgccttgtcaaagtgaaaaaggtaggtcatgctgggactcttgacccaatggctacgggtttattgattgtttgtgttggtaaagcaacgaaactggtagacagatctgagcaacttttctgtttcagatatcaagggatgattaagggttatagtggggttttccgcttgggggaggctacttcaacatgggatgctgattcaccagtcattcaacgtgagccatgggagcacatcaaagatgaagatataaagagaaatgctttgtccttttctggggagatttggcaagttcctcctatgttctcagctattaaagttggaggcgaaaagatgtatgagaaagcaaggagaggagaaagcattgaactttcacccagacgaatatcaattttccagtttgacatagagcgtagcttggatgacagacaaaatttgatttttagagtgacatgttccaaagggacatatattcggtcactctgcgctgattttgggaaggctcttggcagctgtgcccatttaactgctctccgaagagattcaattgggcaatattcagcagatgatgcatgggagtttcaagagctggaagaggctatcaccaaaaattatctctaa

SEQ ID NO: 45387 - DNA, 369 bp, Glycine max
  Peptide Sequence Number=SeqID_162165
atggaggccaaaaatcactgtggcgcggcatatggaggctggaaatcacgacagtgtcacgtttggatgtcggtaatcgcggcggcagcgcttcacggaggttcccgacaactgatgtgtgttaatgttgcaagagtgattttgagttctgacagagaaggttggagcatgaagaaacctgggtggaaaaggttcctttcacatgtaggtcccgactttctggtctccttggcttaccttgatcctgggaacattgttgtgggtaatactaatcggactcgtgtttgtgcttataattcaatcattggctacaaatgtcggcgtaaccactggaaaaaagggtgttcaaaaacacacatagaggaataa

SEQ ID NO: 45388 - DNA, 342 bp, Glycine max
  Peptide Sequence Number=SeqID_162166
atgcactccatttttttgtttggtacacctcctaaatttgtaaagtccccatcctatatttctcgcctcactcactctcttcttggggccgccagcttggcaaccatagctaaagagcatgaggtggttgatcatcgacttgagtctcatgagcttcgagaacaagcaggaaatgatgtgtactatggattgaataatgggcacgatggtgggtttggtgcggtgtggaggcattggttgcgacgatgttggtgtttgagtgtgacagtagtgttaggtggaggtggagtgcaatggtcatggaggtttgggagagaagcaactaggattgtgcttaggtga

SEQ ID NO: 45389 - DNA, 3591 bp, Glycine max
  Peptide Sequence Number=SeqID_162167
atggaggtggagcgttcgtcgctgtgtaactgcgtggtgaactttttgttggaagagaactaccttctcaccgccttcgagcttctccacgagcttctggacgatggccgccacgaccaggccattcgcctccaacagtacttctccgaccccgcccgcttccctcccaaccaaatctcccgcctcaactctctccccactgccgatccacaaactctcctccaactcaagaacgaatccgaccacaagttgtccatcaccgattacgaactgcgcctcgccaacgaagacattgccaaactcaaatctcaactctatgctgctgaagctcctcagtctaatagtggacatgtttccgagggacaaattcaggaacaaaaacccaatcataacaataatcattcttcctccttcactgcttcctctttgggaccgctaaaggatacagaacgtcgagatcttaattgtgctgtcaaagaatatttgcttattgctggctaccgtcttactgcaatgactttttatgaagaggttacagaccagaacttggacaattggcagaatacaagtgcattaatgccgcaagccttgcgtcattattattatcagtatcttttatcaacttcagaggttgctgaggcctttgaaatgaaggaaaaaattgcccaagttccagaaaatataacactgctgaaagaaaatgagaggctgaatcaagaaaaggagagcttgttgaaggacaaagatttggccgatggtcaaatagcagcattaactaaatccttggaggcactgcagagagatcttaaagaaaaagagaacatggtgcaagttttaaagcagtccttggagaatcaaagaaaagggctccacgctagcagagttgagatcagtaagctgaaaatgagtattgaagggtctggttctggaaatagtctagttgttagtgatgttgacaattttcaacctgtgtctttagatgagtacaaggaagaaattaagaaattgcaaatggaagttgaacggttgaaggaaaagaatataggaattcctgaaccaggaaattttgttggttctgaaaatgaaactctgcagatagaagacaaagtgcgagagattcatgaggatcaaggtgcaatttcttaccatgttgatgcaccacaagatgtcatacgcgatgaagatgctcaatcaacaacttctcaaactcttaacaaatatactgataaacacgaagatgcactgcatgcattatttaatccagcaaatggaaatagtgcttttgaaaatattgataatgtctctgaacaaaatgttggcaagcaagaaggggataacaggttaaatgcaaaatcagacagtgcaaatgatgaagcaatatccgagaagatggcaacactcttatcagagtttggttatgataacaagtcaaattcttctaatgatttggggttaggaaccattcagatacttgcagacgctttgcctaaaattgttccgtatgtcctcatcaatcatcgtgaggaactgcttcctctaatgatgtgtgcaattgagcaccacccggatagcagcactcgggattctttgacccatacattatttaatttaatcaagcgtcctgatgaacaacagagacgcataataatggatgcatgtgtcagccttgcaaagaatgttggagaaatgagaacagaaacagaattgcttcctcaatgttgggaacaaataaatcacatgtacgaggagcgtagactacttgttgctcaatcatgtggagaacttgcagaatttgtacggccagagattcgggattctcttattttatctattgtgcagcaactaatagaagattctgccactattgttcgagaggccgcagctcataatttggctatgctgcttccactttttcaaaacatggataaatatttcaaggtggaggagttgatgttccaattgatatgtgatccctcaggagtggtggttgaaactactctcaaggaattggttcttgcaattataaagtggggaaacaaattagaccacattttgggagttttattctcacatattttgagctctgctcagcattgtccacctctttctgtaattgaagggtgtatagagtcacatctacatgaattgggtgaaagagagcgctggaatatagatgttctattgagaatgctgatggaattgcttcctttggtgcaccagaaagcaattgagacatgtcctttcttgtccagagtagaatctacacaagttgtgttttctgccacattgtttgaattgtatgcaaggggacatgttgaatgggatgcatttgaatggatgcatgttgagtgctttcctaaattgatacagctggcttgcttgttaccatggaaagaagataatctacggagccgaatttcaaagtttctgttatctgtttctgaaaggtttggagattcctatacgacatgcatcatgctacctgtatttttaacagcagttggagatgatgctgatttgacattttttcctagtgccatacattcaaaaattaaaggtttgagaccaaaatctgttctttcggagaagctctctatattgtgtgtcctaccgcttctgttggctggtgttttgggtgcttctggaaaacgtaatcaattagaagattactcaagaaagctgttagtagaagacagtttgaaggagaatctggcaacaaagcacactgtagagatcattaatgctgtccgcttcatttgcatatatgaagaaaatcatggtatgatatttaatatactgtgggaaatggttgttagctctaacgtgaacatgaaaataagtgctgccaagcttctaaaagctattgtgccatatattgatgcaaagcttacttcaactcatgctttgcctgctctaattactcttggatctgaccaaaacctcaatgtgaagtgtgccagcattgatgcatttggtgtagtggctcaacgctttaaaaatgagatgatagttgacaagatacgtgttcaaatgggtgcttttcttgaagatggatcccatgaagctactattgctgtcattcgtgcattggtggttgcaatttctcaacttacagccgtgcctactgctgcttctagtgatttgatgcttcggcaagaaagagccaatgcattttgtgaggcaatccgggctttggatgctacagatcttcctgcaaatagtgttcgggattacctcctgccagctatacagaacctattaaaagatttggatgcactggatccagcacacaaagaagccattgaaatcatcatgaaggaaagatctggggcaagtgttggtggtggtgcaagcaagtcgatggcttctcatcttgggattgcatcatcagtgagcaacttctttggtgatggtggcttgcttggaaagaaagacagcacagaagcacagccacagccagagagagttgtataccccaacaaggctgctgctacatcacaaccacaaccagaggacactagattaaagcgcatcatgctgggacatttcagcgacatacttaggaccaagggaaaatcccaagacgaataa

SEQ ID NO: 45390 - DNA, 197 bp, Glycine max
  Peptide Sequence Number=SeqID_162168
atgattgtccctcatcggttgtgtgcagattccattatcaataagtgggaactgatttctaaacatagagtgttgccgcaacctaaccttcggcgggaggacgacgcgagggctcatgagtgcatcttccaagaaaggaaaatgcgcggagtcgccaccaacatttattcgacgaaaacatcggaaaaaccggaaag

SEQ ID NO: 45391 - DNA, 486 bp, Glycine max
  Peptide Sequence Number=SeqID_162169
atggggaactacatttcttgcactctatcaacagcaggaagcagcaagcactggagaggcataaaggtgatattcccaagtggggagattgagcagttggaagaaggagttaaagcagcagaactgatgcttgagatgccgagcttctttgtggtggacactcggtctctacaaattggacgaaggtttagtgcactgaacgcagatgaagagcttgagtgtggtaacgtgtatgtgatgcttcccatgaagaggcttaactctttggtcaaagcatctgacatgggtgccttgttactcactgccaaaagggtatctgcaaaaaaagtgattcctgcagagaaagaacctgagttgaagttggattgtgacgacattcaagagttttctagccccgagttcatgcacaggttgtctatgagcaggtcaaagaagcctttgcttgagaccatagcagaagaacctgtgagctcaagatcatcatga

SEQ ID NO: 45392 - DNA, 747 bp, Glycine max
  Peptide Sequence Number=SeqID_162170
atgattcgtcggttatggtgtttacagagcggctctccctccgtgcccccctcgagcaccaagaagaagaagccccttgtcttgttgggcgcacctcatgtctccgccatcgtccttgaagcccttctgaacgcttctacttgtccagattcttcatttgaggttgcggctattgtgactcaacctgctgccagaagggacagggggaagaagctctctctctctcccttggcctctcatgctcttcagaggggcttctctcctgatctcattttctctcccctccgtgctggtgacgatactttcttgtctaatttaaaagctctccaacctcacttgtgcattaccgcagcctatggcaatatattacccaccgactttcttcatattccatctttcggaacagtcaatattcaccctagccttttgccattgtatcgtggtgctgctcctgttcaaagggcattgcaggatggtgttaaagaaactggagtatcattagcattcactgtccgtgccctcgatgctggacctgtcattgctactgaaaccattcaagttgatgatcaaataaaggcccctgatttgcttgagctcctgtttcataaaggatctaaacttctgattggagaacttccttctatacttgatggatcagcaagagtaaaggcacaacctcaagacgactctaaggctacattggctccaaagctttctactgttggagctcctgttgatcagaaatag

SEQ ID NO: 45393 - DNA, 528 bp, Glycine max
  Peptide Sequence Number=SeqID_162171
atggggagagacttcgaagtaaacagagttgggtctaaggggggttcacgtctgagttctcaccagaagctagagaaccagagccatgggtcaaagagtggaccaactgagaaggaagagggtgtagagtatatggtggaggaatgtcacgaaagggtcgtaggagagaaacatgaaacattgggggaggttaaccatacaaagcttgaaacagagtcatttggatggcagagcgaaagtaataccatcttggagtatgtcattgatgattgtggttgtggcctctttttgagaataagggtaacgataaggtttgacattgacaagggtagtattagggagtgtattagggaatttgggctatttaaaggtggttcaggattgggttttgtgggggaaagtatgaatggagtattgtcaagagtaaaagatatactaggtatagaaaaatctgttgtgataagacctaaggtttgcaaccattcaatccctaacgccacatcaacaccctcaatgggtagaaagtag

SEQ ID NO: 45394 - DNA, 2013 bp, Glycine max
  Peptide Sequence Number=SeqID_162172
atggagactaatccacttccactgccacttatcttgttcgtcttttcgcttttgttttctgctctagattcttcagactccaaatcttctcccctcctctatgactgtgaccaatgccatcgcaccaaggaacgcgatgtttctacaactagaagccgcgatgaaaaggacgttggtataattgcaacatacagtgattctgcttctggccatgttcgactcgctaggttgaaaatgagggatttatctgattcctggatttgggaaaaccctactcatcaatatcaaaagacctcccgggaattcatggaatcatttcaaactgaatccaatcccaaccactccacagatgaacattatcctgaacaaagcagagttcaaattccccgttcctcatcaatgactatgacgcccatgaagatcaagcgccgggtaatgcggcaagacagaaggaaagctcgtgcagctgaacttactcgggaagacaaagaaaatgacgatcacattgtatcagcagcaattgaacacactgaaggatttgataccactatcaagggaaagtatggtatatggaggagagaatatgagaacccaaattccgattcaacgctgaaactcatgcaagatcaaataataatggccaaagcttatgccaacattgcaaagtctaagaataaaattgttctatacgaagctcttatcaagcactccagagatagtcaacaagctataggagaagccagttctgataccgagcttcaccttgggttaccatttattgcatttgctagagcacttgatcgagcaaaagctatgggtcatgttctttccatagcaaaggaccaactttatgactgccttttggtgtcaaggaagttaagggcaatgcttcaatcaactgaagataaagtgaatatacagaagaaaagaagtgcattcttgattcagctggctgcaaaaactgtgcctagaccattgcattgccttcccctgcaacttgcagcgaattattacctgcagggttatcataagaaaggaaatcttgacaaagaaaagattgaagatccatctctttatcattatgccatcttctctgataatgtactggctgcatctgtggttgttaattctactgtacagaatgcaaaggaacctgagaagcatgttttccatatagtgacggataaattgaattttgcagctatgagaatgtggtttctcatcaaccctccttctaaagcaaccattgaagttcagaatgttgatgatttcaagtggctgaattcctcatattgttctgttctacgtcagcttgaatcggcaagaatcaaggaatattactttaaggctaatcatccttcttccctctctgttggttctgacaatctaaaatatagaaatcctaaatatttgtcaatgctaaatcacttaaggttctaccttcctgaagtttatccaaaattaaacagaattctattcttggatgatgacattgtagtgcagagagatttgacacctctttggtcaattgatttgaaaggtatggtgaatggtgccgtggagacatgcaaggagagtttccataggtttgataaatacctaaactttagtaatccactgatttccaacaacttcagtcctgaggcgtgtggctgggcatttggcatgaatatgtttgacttgaaggagtggaagaaacgaaacatcactggtatctatcatcggtggcaagatatgaatgaggatagaaccctctggaagcttggaaccttacccccaggactaatcaccttttataatctgacctatccgttagatcgaggctggcatgttttgggacttggctatgacccggctctgaacctaacagagatagagaatggcgctgtcattcactacaatggaaactacaagccatggttgaatcttgctgtttccaaatataaatcgtactggtccagatatgttatgttcgataatccatatcttcgagtttgcaaccttagcgaatag

SEQ ID NO: 45395 - DNA, 3090 bp, Glycine max
  Peptide Sequence Number=SeqID_162173
atggatcacgtcactcctgagtccctcttgcctttggatttcaactcccctactgggattaagcttctgtgttctgagtggaaaacaacacctacactggaactcaatgctgtcatggccgactcttgtgctgttcagtctcgtcacgatagttggtctttgctttggcttcctattgatcttatccttgaggatgcaatggatggcaatcatgttgcagaagctagtgctgttgaagcacttactgggttggttaaggctttgcaagctgttaatggtactgcatggcacagtgcctttttaggtttatggattgcagcactacggctagttcaaagggagagggatccaggagaggggcctgtacctcgccttgatacctgcttgtctatgttattgagcattacaacccttgtagttgctaaccttattgaagaagaggaaggcgaacttattgaagaagctgaacatagccctgcaaatcaaaggatggacaaacaggctttgggagaacgtcatggggaattggttaccagcttacagctattgggtgattatgagaatttactcactcctcctcaatctgttatttggggagccaatcaggctgctgccaaggctaccttgtttgtatcaggacatagtggatacttggaacatacgaatgtgaatgacttgcccacaaactgttctggtaacttaaggcatctaattgttgaggcttgtattgcaagacatcttcttgatacctcagcttatttctggcctggttatgtgagcgcacctttcaatcagctgcctcatagtattcctaaccatttacctagctggtcatcattgatgaagggatcaccactaactcctccattggttaatgtcttagttgcaactcctgcttctagcttagcagagattgagaaagtatttgaatttgcaatcaaaggctcggatgaagaaaagatatctgctgctaccattctttgtggggcatctttagtacgtggttggaatgtgcaggaacacatagtatttttcatcataaagatgctttcacctccagttcctcctaaatattctgggacagaaagctatttgattagccatgctccttttttgaatgtctttctggtgggaatttcatctgttgacagtgttcagatattctccctacatggcgtggttccactacttgcagctgtcttaatgccaatatgtgaagcttttggatcatctgttcctaatgtctcatggactgctgtaaccggtgaaaaactcacttgtcatgcagtgttctctaatgcatttattctcctgctgagattatggcggtttgatcgtccacctgttgaacatgtgatggggggtgcagcaaccccagcattaggatcacaattaggtcctgagtaccttttattgcccttatttatggattcctttccaaaattgaacatttggtatcggcaacatcaagaatgtattgcttccacctgcaatactcttgcacctggagggccagtttctcagatcgttgaagcactacttagcatgatgtgcaagaaaataaatagaagtgctcagtcattgacgcctacaacttcaggaagcagcaattcatctctttcttcattggatgatgctttgatgaaactcaaagtgcctgcatgggacatccttgaagcaactccatttgttcttgatgctgctctcactgcttgtgctcacggaagactctctcctcgtgaattggctacaggtctcaaagatcttgctgattttcttccggcaactttgggtaccattgtaagctacttatcatctgaagtaacacgtggcatatggaagcctgcttttatgaatggaactgattggccaagccctgctgcaaatttatctattgttgagcaacaaatcaagaaaattctagcggccacaggtgttgatgtccctagccttgctatagatgggaatgctccagctacacttcctttgccattggcggcttttctgagtctcacaataacatataaactggataaatcttgtgagcgcttcgttgttttggctggcccatctttgattgccctttcttctggttgcccctggccatgcatgcccattgtaggtgctttgtgggctcagaaggtgaagcgctggagtgacttttttgtattctctgcttctgcaactgtattccaccatagcagggatgccgtagttcagctcttaagaagttgcttcgcctccacccttgggcttggttccgcctgcatttataacaatggtggtgttggcaccctccttggtcatggctttggttctcactactccggagggttcactccggttgctcctgggtttctctacttaagagtttacaggtctattagagatgtgatgttcttgacagatgaaattgtatctcttttaatgctttcagttagagatatagcaaatggtgggttgcccaagggtgaagtggagaagctaaagaagactaagtatggaatgagatatggacaggtttctctttctggatcgatgacacgtgttaagcatgccgctcttcttggggcttcgtttctttggatatctggtggttcaggtttggttcaatctttgattacagaaactctgccttcatggtttttatcagcccaagggttagagcaggaagggggagaatctggagttgtggttgctatgctgagaggttatgcacttgcatgttttgcggtacttggtgggacatttgcctggggtatcgactcttcgtcaccagcatcaaaacgacggccaaaggtccttgagattcatttagaatttcttgcaaatgcactagatggaaaaatatctcttcgctgtgattgtgctacttggcgtgcgtatgtgtctggggttatgagcttgatggtgagttgcacaccactgtggatccaggaacttgatgtgggtatattgaagagaatgagcaacggattaagacagttgaacgaagaagacttggctctgcacctattagaaattagagggacaagcgtcatgggtgagcatggtgcatatgtgatgataccaagaccttatggaaaatga

SEQ ID NO: 45396 - DNA, 576 bp, Glycine max
  Peptide Sequence Number=SeqID_162174
atgaaaggtgtgggtttgaatacatgtttcgctgaaccaatgcaaggatccgggaatgtttttccggcgcaaggcatcggtgttgtcgatgacgatatcggcgggatcgacggggaggaagcggggggagtgctggagcaatccttcgtcggacaaggaggcttcgagaagctgagagacgagagtgaagagaaagagaacgagaacgacgccgggatgagggtcgagggaggaatagagttgggagaagtgaagaagatgatggatggaggacatgacggaggggtaattggggaagtggatgaggagggagaaggcgtggcggctgaggaggtccatgtagagagtgtaggcggaggggtggaggcggcgaagagggaggacgcgggaggagaggagggagagggcaaggaagggagggaggaggcggagggacatggctttctcgaggaacttccaggtgatgggaaggtgattgtcgaagcagatgtgggagaccaggcggtgggccagctcgatggaagggagggagacgccgccggagttgagggcggagctgacctggatggaccatag

SEQ ID NO: 45397 - DNA, 642 bp, Glycine max
  Peptide Sequence Number=SeqID_162175
atggccattggccaggcagaagcctctggtaagcctcagatggccatagagaaaatggttgaaggacgtctccgcaagtattttgagaatgcagtatttatggaccaaaagtttattatgaatgatactatgaatgtgaaggcggtgctggataatctatccaaggaggtgggttcatctgtgagggttgttgactttctcggaatggaagtcagggaaggaattgcaaggaagagaatccaatcaagatatcctctgtctaagaaccatatatccacccaacctggtagcaagccaccaattatgagcaagactaatttttcaaaaagaatttacaaaaccttttgtgttgttgcaaaagtggaagtggaagcggaagcggcacagtgggcgaaagcaaaagctgtggaaaccctaactgacaggaggatgccagcaacaaattcaaacaccccaacgacacaagcaaagatagtatctgaaacgatgacgacgcctgtgatggaaccatcccttgctgtgtctgctattatggttgttgttcttactgaggttgaggttaaggttgaacatgaggcggtgacgatggcggtggtagtggcgttggcagtggaaagtgagaaggaaagagttagagagtga

SEQ ID NO: 45398 - DNA, 729 bp, Glycine max
  Peptide Sequence Number=SeqID_162176
aactcttttatggaaaagcttcagaagcctaataaatggcttctgatccctacccctccatatttctattgtttaatctgtgtggaagctggaattgatgtgcgcctttgtgacattggtgccgcaattcaagaggtcatggaatcttatgaagttgagattaacgggaaggtgtatcaagttaagagtatacgaaatttgaatggacatagcattggtcgctaccaaatccatgctggaaaatcggttcccattgtgaagggtggggagcagacaaagatggaagagggtgaattttttgctattgaaacctttgcatcaacggggaaaggatatgtacgagaagacctggaatgcagccactacatgaaaaattttgatgttggtcatatcccactgagattgcctagagcgaagcaactgttagcaactattaacaagaacttctctactttggccttttgtaggcggctcacagcatctacacgtaggcaacgacaagttgcacctattgctaaggatgttgagcatgtgaatcatgctgctgaagagggttttttcggcgggcctcatgacacatcagttttgatggactatgttcatcatgtgattgtgatagtttggaatggagaggaatgtcctaagttgaagttgtcctcccatgaaaggaaggtagagaaatttggcagccttgctcttgagattgaaggtttagtgattgccacatga

SEQ ID NO: 45399 - DNA, 684 bp, Glycine max
  Peptide Sequence Number=SeqID_162177
atgtggaaggatggagaaaaggggaacggggtaagcaagcctggaggttggtatcggaacagggcactttgccatcacgtattttcatatccaaatattaccccaagaggtttgttgtcctcgcaagtggtgttgaaagagggacttcggtggaggttgggtagtggtaaggaagtcaacatgtggtctgatccttggttaaggttcgaaggaaacccttacattgagactcctattgtgcaaggggcagagaagttggtcgttgcaaatattgtagacattgctactgggacatggaatttaatgacgttgtggaacatttggcaacgaagaaatgatgcagtttgggaaggaagtttgtgtgattatgaattagtcataaggcggggagactccttttttcaagactgggatcgagcaaaggaagcctacaaatcaagagatatttcagtggaagatgttatacaaaatagattgattcctctagtgcatggaagattaaaatgcaatgttgatgctgcatttttaaaggagaccaattctactggttttggtcttcgtcttagggatcctcaggttagaatggtggtgctcagatcgtgctgtgttaagccatgcatgcaatttgtggaggttgaagcctacggtttaatgttggcgttgcaatttgtttcaaatctgtga

SEQ ID NO: 45400 - DNA, 144 bp, Glycine max
  Peptide Sequence Number=SeqID_162178
atgagttcatcatttcttgcaactcatcacaaaaagaatgaggaagctgataaatacccatccaatatcttggaatccaacaaattgttttcggtggtcgccgcatgggtgattgggaagggaagaggggatgacaagccctga

SEQ ID NO: 45401 - DNA, 792 bp, Glycine max
  Peptide Sequence Number=SeqID_162179
atggagtttaataaccttagtcttaaagatgctttggtctcaactgcatgctgctttgcctggcttgaagaaagtagcatatcgcctggacatcatgatgtaatttccttattcctcaaagttaaacagagagcacattctatatcaactgaaaaggctacaatttctgctaccgatgaagattccattgccgatgtgatggaacagcatgatgaatttctcagttcaatgctggctcgttcagctaagttacagatggtcttcagatgttgggaaagaaatgatgttaaggaggtcattggcataatggccaagatggatgatcatgctgtgattgctgatgttgttagcattataatggaaaaaattgatatcattacacttgagatatgtgctggtcttctgccacttctaaccgatcttctacaaagtgaaatggaaagacatcttggaatatccttggaaatgctattgaaactggtcagaatatttggttcagtaatctattcaactgtatcagctacacaacctgttggtgtcgatatcgaggcagagaacaggctagagcgttgcaacctctgcttcacagagcttgaaaaagtcaaacgttttttaccttctctctcaagaagaggaggatcaattgcaaaatctgcacaagagttgaatctggctttgcaggatgcactgatagctgctaattctgccgacatatactcgaagccaaagcttgagacatgtccctctgctgatggttgcacagctgactataacctgtcgtcatctgcttaa

SEQ ID NO: 45402 - DNA, 1288 bp, Glycine max
  Peptide Sequence Number=SeqID_162180
atggcttccgcttcttacaatcctcctcctcctcctcctctgctgccggggaacaatgaagtttcggtaaatgatgcaattctggtgaacgcgattccagtgcatgtagagacgcctacaccggacactgactccattatcttctcgcaaatccccaaattccaccgtggtttgcgtcgctcgctgatcacaatgctggcaacatttcgtctgagttcttgctgtgggaacaacaagacttcgtggcttcagtccatgacctccagcgaagttcttcctagactcattagttgtaagtcctcctggcatctctgggataagcttcattcacatttccagtctattttttgtgcgaagaagaagcaacttcgcaatgatcttcgaaacatttcacttgataattgttccatttctgaatatcttcgaattcaaaccttaattgattctctctcatctattggggagttttttccgggcagtgaacatgttgacataattcttgatggtttaccggatgagtttgagtctctcgttgctctcatcagttgtaggtttgaactgctttctgttgatgaagttgagactctccttgctcatgaaactcggattgaccaacaagggagtgccaacaatactgtcactgcagagccgcaagtcaaggttgctcaggctcaaaacagttctgctcgtgatactaattcgaactacaacaattactatgacagtaatcggtatctcaacaatggctgtggaggtggttggaatttctctcgtggcggcggtcgtggtatttctcaaaaggttgatgattattatgttcctacccagccaatggctcaacaatacacaaaccagaattccaatcaacagtggaactctaatcccagtttccagtactctaatacatacccaaaccaatatcccaacaatcctcagccttcattccctcctccacaagcccatctaaccagtgttcaacctgcaccttcacagaactgtttcatcctgctttttgtttggtcaaagggttctaaagaggtgctgctcaaagggatggttggctgtgatggtctttaccagttccctgatttacttcagtcagctagccagcaactcaagcctcctttcactgtcaataccatttcagaacctgtctctgatgtcttgtcttcaaattctacttcggtttttgtaaatagggttactaatccctctcatgtaaatactgtttctagtagtgatgtttcttttgccatttggcattccagattggggcaccccaatgctg

SEQ ID NO: 45403 - DNA, 705 bp, Glycine max
  Peptide Sequence Number=SeqID_162181
atgactgtactgaatgagatcactgctaaggctaggctatctgtttcacaaaatccagatcaattactaaaagaaataaggtctcttggaaggttgtccgtttctcaagattcagactccttaaaggaggggaaatgtttggcatccacaggaagtgcaccaagtactcctcaaaggatcaatttgaactctggtcccaaagcagtacccggtggttcaacaacagtgcttaatacaacagctcagaaaaggagttctttgaaatctcatacagcatccagtgttccacttatcaataaatcagatattatacccataattgtccccagaactagcatgagatctgagcctgtagctgattctagaaaagaagttggtgtttctggaagaacaatgccattccccttgcagtcaaaggcagaagatatacataaatttccaaacaacagagatgatgtggataagcccctctctcctgtaaacgaatctgcagcttctaagggtattgaattaagtggttttgcagataaaaataatttccctgtttctgtcagctcaatgcaagaatttgggcttgcagtgagggttaccctcacttgtatacaccattttggccatattactagtcaatctgagattccagcacaacctttcatgccgaggactttaccttttgagcttgaaaaacaaatgagaacattttag

SEQ ID NO: 45404 - DNA, 303 bp, Glycine max
  Peptide Sequence Number=SeqID_162182
atggtgaaccctggctcagcagatagaacagttaaattctgggacctcgaaacctttgagcttattggttcagctggtcctgagacaacgggagtgcgttctcttacttttagtcctgatgggaggaccctgctttgtggtttacatgagagtttgaaggttttctcttgggaacctataagatgccatgatatggtggatgtgggttggtctagattgtcagatcttaatgttcatgaaggaaaacttcttggttgctcatacgattcaagctgtgttggagtctgggttgtggacatctcg

SEQ ID NO: 45405 - DNA, 642 bp, Glycine max
  Peptide Sequence Number=SeqID_162183
atgcacttgccctccattttctatctgcagatctctctctctctctctctctctctctctctacttgaggaatttgtagcacatgcttctaccgtcaattgcctcaagattggacggaaatcatccagggttcttgtcactggaggtgaagatcacaaggtcaatctttgggctattggcaaacctaatgccatactgagcctgtcaggacattcaagtggaatagattctgtaagctttgattcctctgaagtgttggtagctgctggagctgcgagtggtaccatcaaactttgggacttagaagaggcaaagattgttcgtactcttaccagtcataggtccaattgtacatcagtggacttccatccttttggagagttctttgcatctggttctttagatactaatcttaagatatgggacatcagaaagaagggttgtatccatacttacaaaggccacactcgaggggtaaatgcaattaggtttaccccagatgggcgctgggttgtttctggtggagaggacaatactgtaaaggttagaattgacttccttaatcatgatattaacagagtcagattccctaacatggttattaacagagtcagattccctaacatggttatttatcattga

SEQ ID NO: 45406 - DNA, 237 bp, Glycine max
  Peptide Sequence Number=SeqID_162184
atgaaagtcaaagacaagcgttatgcaacaaatacactagactcaaccctacatgcaatgtggtaccatttttcagtgaaaaacctcgtcgggtgcctaggagtacatgacgggacatgcctcacaatggggagaccagtctgggtcgctctgttttgcgagaatgctccaaccatatgggatcagtacaggcttaaaggagcactcaaactgggcgtatttacccccaaggcctag

SEQ ID NO: 45407 - DNA, 2545 bp, Glycine max
  Peptide Sequence Number=SeqID_162185
actgacaattaaaaaccctaatcccggtatacagaaggtgcgtcatgcgcttgcgcatgctaggttctcttccttgcgtgtttgtcagattgatggtactatgagagatatgcaccggaattctactggtagtactaataacaacactaataagataccatcggcactgaggctgtcctcacctcaacaatctctaagacgcttgggattgtgttcccagatagcaacgggggagcactcttctcctattgtcttccctgaaaaacgtggcaaagtcaaggcttccaggaagaccagtgtccccactaccattcgtccagatgatcaggacataaccaagaattttgagcataggattgacattgcaggagctggaggaggagatgagaagtctgatttgttaggatatgtcgttttctctggaaaactcattttggataagagaaaacttgctacaaatgataatgctgatgcccaacaaacttcggagattaccaaccaagatgctgtagatgccaaactaacaagcaaggccatggcttggggatcccaagtgctgcatcttgatgatgttatctcggtttcttataatgctggtctcagacatttcacagtgcactcctacccattgaaaaaagcttcatgtgggctttcttgctttataaaatctcgacgaagtcgcaaggactttcgctttgtagcttctagcatagaagaagcacttcaatgggttggtggatttgcagatcaacactgtttcgtgaattgtcttcctcaccctttactgtcttcaaagaagcaagcatcctcagaattacttcatacagatacccctcctgaattgctctttagatgtaaaactccacctaagatgcttgtaattttaaacccacgatcaggtcggggtcgttcaagtaaagttttccatggcattgtggaacccatattcaagcttgctgggtttagattggaggtagtcaaaacaacatctgctggtcatgcgagaaatcttgcatcaagtgtagacatcagctcttgccctgatggaattatctgtgttggtggtgatgggataatcaatgagaatttcagccctccttcccactaccctgccaagctggtagttggctcagctgtggtcaatgtgtcccatgcccacgttcttaatggtctccttagtagagacaatcaaaaggaaggaatatctataccaattggaattataccggctggttctgataactcgttggtatggactgttcttggagttagagatccagtttctgcagcaatggctattgtaaagggtggtcttactgctacagatgtctttgctgttgaatggattcagactaataaaattcactatggattaacagtctcatattatggttttgttggtgatgtgttggaactttctgaaaaatatcagaagcgctttggcccgctgcggtattttgttgctggattcttcaagttcctatgcttaccacgctacaactatgaagttgaatatcttccagcttcaaagactgagagagaaggaaagctttctggtgaaaaggaagtagttgacatgtcagatctgtatactgacatcatgagcagatcaaataaggatggaatgcccagagcatctagtctttctagtattgactcaataatgactccaagtcatatatctggtgtagacctggatacctgtagtagtacccatgctagcactgaaccttctgaattggtgcgtggcttagatccaaagtccaaacgcctatcgtctggaaggggcaatgtaatagcagagccagaagttatccatccgcagctgcctctgtcaacaactccaaactggccaagaaccagatctaagtcaaggaatgataaaggatggactggattgaccacaacacatgatacctctagacggggaaatactgtgacaaatgatagagaggatatatcatcaacactgtctgatccaggtcctatctgggatgctgaaccaaaatgggatgctgaacctagtaattgggatgtggaaaatccaattgagttgccaggaccatcagatgacacagaaataggatctgcaaaggaggttgtgccccgttttggagataaatgggttgcgtcaaagggacaatttcttggcattctggtttgcaaccatgcatgtagaactgttcagagctctcaggtggttgctcccaaagctgagcacgatgataacacactagatttgctcttggttcatgggagtggaaggctgaggctgttgagatttttcttactcctacaaatgggtcgacatctttcactgccatatgttgaatatgtcaaggtaaagtctgtgaggataaagcctgggaagcacactcacaatggatgtggtattgatggggagcttttcccactcaatggacaaatacccaatttgtcttgcaaattccttatcgctgtaacagctgagctttgtaaatcttttgttccgcaacaagaagctgaatgtattgctgatcaccatttcctcgaactggtcaattga

SEQ ID NO: 45408 - DNA, 996 bp, Glycine max
  Peptide Sequence Number=SeqID_162186
atggcttccaacgatgatgagtccgttctcgatccctgggccttcattttggagttgtctcacatatctccatcccaagaacaaatcttggccactgctccatttgtcggagcagtacaggacaccgccacctccgcctcccatgacatcgacatgctgccgttgccggactccgtccccgaagacgtattccacacgccggaggaggcctcgcttcccacctccccctccgaaaaccattgcgtcgttaattacgccttcatcgacgtggatgatgtggatgcttggttcgaattggggaaggattccgagttagggtcttcggatgttcacgtggaagaagttaacggagaggaaatgggaaatttagaaacccttagtggggatgtgagcattagcgtgtctgaatctgctgaggggcccaagtcaagtgatggggttgtggaatcgccggggaagaagaagagtgagcagggtaagaacaaaagtgccgtttctggagagcagaagactgataaggaagcagggccagggctgcgtcgggtgttgccaccctccactgcagcgtcgacgccgatgactgaaacgggaagtggaagaagtgggaacggtgggggtggggcgaaaaggaagtttttggatgctttttttgctgcggttaaagctttctcagagttacagagcactgttgaagaacttaacgaagaccataaggaagcagggccagagctgcgtcgggtgttgccaccctcaattacagggtcgacggctaaaacgggaagtggaagaagtgggaacggtgggggtggggagaaaaggaaagcttttgatgtttttgctttgcttaaagctttctcaaagttagagagcactgttgaagaaaataacgatgaccatcgcaccctgttggatgtggcaagagctaagggtgttacctttcctcggccaaggtggtggccggagggggataactttgacccgccgccaccacaatag

SEQ ID NO: 45409 - DNA, 398 bp, Glycine max
  Peptide Sequence Number=SeqID_162187
atgaaggacttaggtccaacaaagaagatccttggtatgcaaataacgggagataatcaaagagggattttgcagttatctcaggtagagtacatcaactatgttttgcaaagattcaacacgagcaatgccatgacggtttcgtatccttcaaccattggaagattgatgtatgcaatggtttgtacgaggccagatattggccatgcagtgagagttgttagtaggtttatgtcaaatccagaattagaactacaaggctatgtagatacagactttgcaggtgaagttgatcaccaaagaggtactgccagttacattttcactgttggtactacaactgttagttggatctcatggatacagaagatagttgttttatcgactatagaggctga

SEQ ID NO: 45410 - DNA, 1410 bp, Glycine max
  Peptide Sequence Number=SeqID_162188
atggctgcaaaagatgtaaaggtgaaaattgaaaagtttgatggcacgaactttagcttttggaagatgcaaatagaagattatttgtatcagaaaaaaatgtatcaacctctctttggaaataaacccaagggtatgaaggatgaagattggactcttctcgacagacaagccctcagagttatctgtttgacattatctcgtaatgttgctttcaacattggaaaagaaactacgacaacgagtcttatggtggctctttttagcatgtatgaaaagccttcaacttcaaacaaagttcatttgatgaggcgagcattgatacttttgtcttctctaccaggaagttggaatactactgtcacaactgtgagtagctcgttaggaagcaataagttgaaattcaatgatgttcgtcatctggttctcagtgaagagattcgacggagagagtcagaggcgagggcagaggcaaatgttgcctccacctcaggagaagtacatgatgctttaatatgctctttagagagtaaggaagagtctagggtatcctttcacaccacttctaagaaagaattctttgcgaattatgtccctataaaccttggtaatatttatcttggcaaggaacaatcttgtgagattatgggtaaagaacttaatagtgatggctacacaacagtcttccatggcgatcaatggaaaattttgaaaggtgcaatgacagttgcttgtggtaataaaagcgaaactctttacatgacagatgaaagacttggccatatgagtgagaaagggatgaagatcatgcactcaaagaataaattaacaggtcttcagttggtagaaattgacacgtgtgaagattgtataattggaaagcagaaacgagttagctttgagacaagtggaagaactccaaagaaagagagactcaaatttgttcactttgatgtttggggtccaacgactgtcccatccattggtgggagacaatacttcataactttcattgactatcactctaggaaggctttcaagatatggaaagccatggtagaaaacaagacagggttgaagatcaaaaagcttagatttgacaatggtaatggaaaggactgtggcaggcttgccaaagcaattttgggcataagcaatcaacacaacaacttaatcattggatcacaaaatacaagaagaggtgggaataagcttgatcccaaatcaaagaagtgcactttcatcgattatggtgaagatgagtttggctaccgcctatgggataatgaaaatgaaaggatgatctgtagtagagatgtgatcttcaatgaaagaataagcattattgccaatgaagagctctaccttgagcaattggatgtgaagactacattcttcatggaaacttag

SEQ ID NO: 45411 - DNA, 522 bp, Glycine max
  Peptide Sequence Number=SeqID_162189
atgagaaagcagaggagaagattagctggagacgaagggatggatatggatattgtagagcgagagtggaatagaacaaagaagatgagcggcgccagcagcactataaggctatcgccgatggtgagcgtgtccccgaattgcaattgctcatcgatgatggtgatgaagaagacgacgacggcggtggctcctttgtggatgaaaagcaagagcgctaggggtggtattaggtgcgaggtggctattaatgcggtggatgagtcgacgacgtcaccggagtcgaagattggagcgcgtgtgaaggtgaaggcgggtgtaaaggtgtaccacgtccccaaagtagccgagcttgacctcacgggtctggaaggcgagatcaagcagtatgttggcctctggaacggtaagcgaatctccgccaatcttccttacaaggttcagtttctcaccgacatcccagctcgtggtcctgtcaagttttttgcccacctcaaggaagatgaattcgactatctttag

SEQ ID NO: 45412 - DNA, 406 bp, Glycine max
  Peptide Sequence Number=SeqID_162190
atggttatgacattgtgtaattctcatggctgctgcagtgatagcaagaggattagtcgttctctgaaagggtttggggttgagggtttgggtgtgcttgtgttggattttggtcagaccgtgggtgatgttcacccaagtttgcatgggactcaggtggaacagtcgactaatattagcaatagcacattggaaggtctagagcaggccattctcaagttaaaaatagaaaggaaaactagaatttcagaagcagaagtggacaggcttgccaaactaaaagcaagcagaatgaaagaacttgtttttaagaagaggtcagagttagaggaaatatgcagattgactcatattgaaccagatccaagtattgtggccgagaaagctagtgcattaatagattctg

SEQ ID NO: 45413 - DNA, 315 bp, Glycine max
  Peptide Sequence Number=SeqID_162191
atggttgagtctcctcaggagcaagtgcagatggtggagatcgctatggggtctgagctagagtggtctcctcctctgctagtgctgagagaagagctggtagtggaaatctatgtgggtgtgggacgaatcactgggatctctacggaggaagaaagaggaagtgtagaagaagaaggacctcctgtctctgatggtgctgtggaagaggcctcagatctctttcctctggccttcttgggtcctttgaaagttattgttggatcattgagatttcaacagttcttcttaataagtatgagaggtgggggctag

SEQ ID NO: 45414 - DNA, 309 bp, Glycine max
  Peptide Sequence Number=SeqID_162192
atggagaatggagaattggcgaacagcgctacgcataacttcgcggggctccagactcgaaggtggaggacacatgaacagcgccaggaaatgacattcatggggctccgaaaaaaaacgctaggcaataacattcatggggctccgaaaaaagtggagaatggagaattggcgaacaacgctacgcataacttcgcggggctccagactcgaaggtggaggacacatgaacagcgccaggaaatgacattcatggggctccgaaaaaaaagtggagaatggagaattggcgaacagcgctacgcataa

SEQ ID NO: 45415 - DNA, 321 bp, Glycine max
  Peptide Sequence Number=SeqID_162193
atgttcaaaacattggtaatcgattacatgctcatggtaattgattactgctttgtaaatcagtttgaaaagaatgttggctactgtctttggcatcatcaaaattgtggaagaaatgccttccaagattattttgatgatgccaaagaatcaagagttaagcaagttccaaagaataaggagtcaaaaagcttcaacaatcaagtttcaagattcaagattcaagaacaatcaagtttcaagaatcaagattcaagaacaatcaagatcaagattcaagactcaagaatcaagagaagactcaatcaagataagtactaa

SEQ ID NO: 45416 - DNA, 1347 bp, Glycine max
  Peptide Sequence Number=SeqID_162194
atgcatgcaagtggttcatttatagagtatttgggcttagggctaacggcttgtaaggtgaggagtgaggactgcccaagccttataaggactacattagccatatctctagtcgatgtgggatctcaacccaccaagggccgacatcctgacaaatcactcagcttttctggtcagccccactataggcattacgcagcccttgcgggaatcattgcaaattctgttggagagcatttaattttcttcagcagccctgtgaccaattatgaagagatcaatggtcccagtaatgctataagaaatccacttcaatactctgggggccaaggtggttggagaactacacataatgagaggaatgctaatcagccctctaatgatgtaaatgggcatcattcaaggagaagtgatgatattggaagatttaattatagacagaatacaaacagaatggacagaagaaacactgggagtggtcaaagcagcaagcatgtacatgtttctcaatcagatcatacagctcaaccaacttctgtgttcattccatatgtggaccagtcatctagagcccatcctactgctgacattctgaccaaaaggcaaaggaaacgtgaatcaccttcagggattatgttcctcggttcaactggggaatcatcaagctcatcccagaaccctgaagtgattgagttgttatctacaccaaggggttcatcaaactcatcccggagctctgtcttggatcatgaagtggttgatttgttatccacaccaaggtatgccaacagatcatctgaagatttagatgataatgacaatagctcggaagctcgggcacggcaaatggaagcagatgagagattggcacgtgaactccaagaacaactgtatcatgatgatccttttgaaggcagaggggttggtttttcttttctgtattgtttgctcaccttttgtgagattgatgaagatttagcatgggacctgcagcgtgcagaggctcttctgcgtacaactattgatagccacagcatgaatcaacctacacagcttccaagggcaaatagacagtctcgcacacggtttcaacaaaacccttctagaaggagagctatggctcaagcttctttctctaatagaatgtcacagtggaggagtcgttctacaagtcggacccgggcacctaacacatcatctaggggaagaggcccccagtttcctttggatatggacttagatatgagacttgatatattggaagctttagaggattcaataggggatttcagcgatatgggaatggctgatgacatctttaatgcacgtcgtgatttcactgagtaa

SEQ ID NO: 45417 - DNA, 126 bp, Glycine max
  Peptide Sequence Number=SeqID_162195
atggttgggaatttatcagttcgtgaaacgggtcgggtcgggtcgggtcgatcggaatacgtagatgaatcggaacagcgcaaactgaatcccagggcaaaaagaagtattactacaagattttag

SEQ ID NO: 45418 - DNA, 396 bp, Glycine max
  Peptide Sequence Number=SeqID_162196
atgaggctaacagtgcttggactttcaacaaaatgtttgctaacagtgcttggttgggactttcaaaccttgaagattgataatttaaatggtgcccaaaaagtcaaaaaacccagtcctgcacgtcctgcaaagtcctgcaaccctaggctcgtaccctgtctgaaatcgccagtcaaagctgcgatttcagcacaggctcgaaatcgccagcttcaccggcgggacgctcctcaacctgaaatcgccagcagcagcagcgggttgccatccacgtgtcctgtgctcacgaactcgccattgaagcttgcgttttccatgcaaaatccatgcagaccacgtacaaaacagcaccatggcggaaattctttcaaaacggccccatttggggaataa

SEQ ID NO: 45419 - DNA, 1192 bp, Glycine max
  Peptide Sequence Number=SeqID_162197
tgcttatcggactgctcattgcaaaggtaaacgtggtggtttcaaagatactcttcctgatgatctactggctcctgttttgaaggctgtaattgagagaaccaatgtgaaccccagcgaagttggggatattgtcgtagggagtgtattggctcctggagctcaaagagctagtgaatgccgaatggctgcattttatgctggttttcctgaaactgtgcctgttaggactgttaataggcaatgttcatctgggctccaggctgttgctgatgtagctgctgctataagggctgggttctatgacattggtattggtgccggtttggaatctatgacaactaatccaatgggatgggatggatcagtgaatcctaaggtaaaaatgtttgaacaagcacaaaactgccttcttcctatgggaattacctccgaaaatgttgcacagcgctttggggtttcaaggaaggaacaagaccaggccgcagttgagtctcacaggcgagctgccgcagctactgcttctggtaaatttaaagatgaaattgtcccagttaccactaagattgtggacccaaaaactggtgaggagaaatctgtcaccatttctgttgatgatggaattcgacctggcacaacagtgtctgatctaggaaggctcaaacctgtgttcaagaaagacggaagcactactgctggtaattctagtcaggtgagtgatggtgctgcagctgttctgctgatgaaaagaagtgttgcgttgcaaaaggggctacccattcttggtgtattcaggactttcgcagcagttggtgttgatcctgccataatgggtgttggtcctgctgctgcaattcctgttgctgttaaggctgcaggtctagagcttgatgatattgatctttttgaaataaatgaggcatttgcttcccagttcgtatattgtcgtaacaatctagggcttgatccagaaaagatcaatgttaatggaggtgcaatggcaattggacatcctctgggttcaacaggtttctgcatctggtcagcagcacctaaagtcttgtctttgtccctttgtccaaacagcaatctcaatatccaaaagttccttccactgacctgccccctatccaaggttgccttagtcaccctcaccaaaaattgccagcctctccacttccttcctaggtga

SEQ ID NO: 45420 - DNA, 219 bp, Glycine max
  Peptide Sequence Number=SeqID_162198
atggggactactcagagtaagcagaagagcgatcaagacaaaaggaggaaagatttggaattcgaggcctggtcttcaggttttgaccatcaggattatcacaatagcatctggagcctgagctatgacttttgcacagaagcaatgaaatatgttggagtaggaattcatccagaactcgcccaggcaagttttagttgggccaactcgcctaggtga

SEQ ID NO: 45421 - DNA, 293 bp, Glycine max
  Peptide Sequence Number=SeqID_162199
atggtccgtggcggcgatgggcaacagcagcggcggtggaggatgatccctttctcttcttcgatggctctgccatttgatgaagttttagtggattttaatcggtggaagacgcgtgagggaaagccttggctgcgcagtgtcgcaacctacccttcggcgggagggcgacgcgagactcgcgggatgcgtgttccacgaaaggaatacgcgcggagtcgccaccaacgtttatttgaggaaaacgtcggaaaaaccggaaaagacgcgatctacgaacttttaagtgaaag

SEQ ID NO: 45422 - DNA, 512 bp, Glycine max
  Peptide Sequence Number=SeqID_162200
gaacggcccgagttgaagttatcctcccatgggaggaagacaccgacgatcgaggacttatatccccatttgtcgagaggtggcaccgggagacgagtactttccatcttctagtggggaaggtattcatcacgttggacgacatcacgtctcttcttcatctgccgatcgttggcgacttccacgccttccagcctctgcacatcaacgaggcggtgttgatgttggttaagttactgatggtctcaccagagacccaacactggacagctgcagctcgtgcttatcttctgcatcttctgggttacactctttttgctaataagagtgtaacccatgttcatgttgtacacttagacgccctgcgtgacctcactcaggctaggaggtatgcatggggaacaactggccttgtccatatgtacgatcaccttaatgatgccagtatcagcaccagccgacagcactttccgtctgttgcggagtgcaatgctgatccagactatgacgag

SEQ ID NO: 45423 - DNA, 393 bp, Glycine max
  Peptide Sequence Number=SeqID_162201
catcctcttcaagcttcttatccaaggcacattcttggtggtgaagctccttcttccatggcttattccctagtggatgctcaaagatccggcctccatagaagctccacaagcaagcttccatcacttgccaatcgtctaacaaatcctcaagtgtctttgagctcccccttccgtggtgcggctggtttggtcaaggtgcattgttatgatggttcatttgtagttcgtggttatcgccatggtgggtgttgcggtgcaacggcgaagaagattgtcaatctgtatgtgatgcgatcctcccaaggtggggatccaacaccagagccatggctaggaaactccagaatgattaggccagggatgcaggagaatgtcctagggttctcatga

SEQ ID NO: 45424 - DNA, 966 bp, Glycine max
  Peptide Sequence Number=SeqID_162202
atgagggagtggtttgcttacaggctacaatgcagatcaaatgaatcaaaaaatttgttgaattctgggagactattccaacaatttgttgttgagcaatatactatggttaaatcagaaagactttcttacatcagaaacaaccaaaaaaaacttcgagttgataagttttggagcttacaacactcattggatgatggaagcacgaaaggcctaaataaaggtaaaagagtcattttgccttcaacctttgttggtagtccacgctatatggatcaactttattttgatggtatggccatatgcagccatgtgggcttcccaaatctgtttattactttaacctgcaatccaaactggcctgaaatccatagattgctaaatcccttgaatctaaaagcaacagatagaccaggcataatctccagagtcttcaaactaaagtatgaactaatattgatggacttgacaaagaatcagatgctagggaaagttattgcatcagaaataccttcacagcaagatgatacaaaactgcattcattagtaaaaaaccatatggttcttggcccatgtggaattttgagacctggatctccatgcatgaaagaaggcaagtgtagtcgtttctatcctaaaatgttccagccgcatactattttagatgcagatggttatccggtctatcgtagaagaaataatggtcacacaattgagaaaaatggtgttataattgataataggtatattgtaccttacaatccaagattgcttagaaaataccaagcccatatcaatgttgaatggtttaaccaaagcacttctatcaaatatttatttaagtacatcaacaaaggatatgatagagtaactgttgttttgattcatgatgatcatgatccaattcacaatggtagcactcataatgatgagatcaaagaatatctagattgccggtattattaa

SEQ ID NO: 45425 - DNA, 510 bp, Glycine max
  Peptide Sequence Number=SeqID_162203
atggtctttggtggagatttccgacagatcctgccagtcattccaagaggcagccgctctgatattgttaatgcaacaattaattcctcttatctatgggattattatcagatcttgaggctgacaaaaaacatgctcttacaaaacaacatgcaagcaacagatcaagaagaaattatgacttttgcacaatggattatagatattggtgatggtattattggacatgacaatgatggctacgctactattgaaatttcacatgaactattaatcacagaatataatgatcctattcatagtatagttagctctacattcctagatttatgtcatcatcacaatgatcgtgaatacttccaattcagagcaatattagcttctacaaatgaaacagtacaacaagttaatgattatatacttgcattgataccaggtgaacaaatggaatatctgagctctgattcagttgacaaatccgaaaccattgaaagtagtcatttctgctaa

SEQ ID NO: 45426 - DNA, 477 bp, Glycine max
  Peptide Sequence Number=SeqID_162204
atggccaataacgcaaaaaccgccaagagcaaggcgctgcgcggcggctggcgcgagcagtggcgttacgcctggatgaacgccattaaagacatgctgcgccagccgttggcgacgctgttgacggtgatggtgatcgccatctccctgacgctgccgagcgtgtgctacatcgtgtggaaaaacgtcagcaccgcggccagccagtggtacccgacgccgcagctgacggtctacctggataaatcgctcgacgacgacgcggcgctgaaagtgctcgacgccatcaaggcggaagccggcgtggagaaggtgaattacctgtcgcgtgaagaagcgcgcggcgagttccgcaactggtcgggctttggcggcgcgttggacatgctggaagagaacccgttgccggcggtggcgatcgttacgccgaagatgagcttccagagttcggataccctcaacaccctgcgcgatcgc

SEQ ID NO: 45427 - DNA, 405 bp, Glycine max
  Peptide Sequence Number=SeqID_162205
atgaccacctccaactcccttgctgcttggattatcccaaccctggagatcaccaccatccacagagacaatgaaccctctattcatgtagaacactttttcaacattcaagaacttgaaaaagtggctctaaagctcaatgagaccttgttattttgtggtgctagacatttctttaacaagccgaaaactatataccctaaactcatcgaaacctattggaggaatactgagtttgtcaacaagaagacaatagcatctaaggttctgggagtcaaagttgtgttgtccagtgacactatagccaaggcaacagggtgcctacgtcaaggcagtacctatcaggggagatgggagaagaactataattcccatgttacaagggcattctaccaaaaatgctga

SEQ ID NO: 45428 - DNA, 1425 bp, Glycine max
  Peptide Sequence Number=SeqID_162206
atgtcgtcgcaacgatcatcatcatctgtgttcgacaacgatcagtctccgacgttgttgacgtcgtctcagcaacccttggccatgccccggttcttgtcgcaaacccaaaaccctggtcaaaccctagaagacgttttttctcgtctctctgtctccgcgtctcccttcaactacccaccttctgatttctccgccggtagctcttacggcgtcaaaaccccctcaaagattcttccttgtaacggttggggtcatggggttaccactcttcaaagttccaatctttggcaccccgcattcacctccaacaattattcttattatgatgatggttttgtcgattccaaacctttggtgaggcaaagagaaaaaacccccacatttggtggaggtgcttttcccgtttttccactctccaatgggatgcaacagaaaacccctgatgatgctggtttcttgtacgggtttttgggtggtaataacgggtccaataatctggggtttagtggcaacgaaaggcgcctccgatggttcaatgatttgcgggggagggttctgttgttggctacggatcaacatgagtgtaggactttgcaggagacaatgagaaaattgactagagaagagttttatatcatcttcttggagctgatcaatcacgtgaccgatttgatggttgatccctttgggaactatgttgttcaaagaatggtggaaatctgcactgaagagcagctgagtcagatcgttttgagcttggctcagtgtaattttcagttggtcagaatttgtctaagtgcgcatggaatccggggtgttgagaaactattggagcgtgttacaacccaagagcaacgagatcttgttttgtcagctctttgccccggtgctgctatattggccaaggatgtgaatggtcatcgggtgcttctgcattgtctaaaacaattctctggagaagacaatgagcaatgcattaaccatgcacagggagaaacaaaacagaagctgcttgatgctatcatattacatgtttcactcttagcagaagactgttacggcaactatgttgtgcaacatttgttgtcgctgaaagtaccaggagttgcagaatctctactcatacagcttaaaggaagatttttctatcttgcctgcaacaaatatgggagtaatgtagtggagaggttcctccaagactcgggtgaaaagcattcgacatctattgttttggagttgctccacaatccaaatgttgcaatgcttcttgtggatccctatggaaattatgtcatcaaatcagcactatcagcatctaaggtcagtgggtcatgttcggaatcgcttggagcgactgatcaaactaaattccctgattatgcggagcaacctctatgggaagaagttacttgcttggtttga

SEQ ID NO: 45429 - DNA, 153 bp, Glycine max
  Peptide Sequence Number=SeqID_162207
atgaatgggcaggctaaacggatgtccagaaggtacgaactgaaggaatgcatcggccatcatctgcccaagatgcacctgggccggggtcgaaagatgcagcccatcgggctgaaggggcaacccatgagcgtccacagttctcaggtttag

SEQ ID NO: 45430 - DNA, 624 bp, Glycine max
  Peptide Sequence Number=SeqID_162208
atgagcaaggttggacaaagaggtgttctatctgagaatatgccttgcttgttgttgttgttgctatttctgattcaagcatggccagtgaagccacaacaagcctacgataggaacatattcatattagcgggtcagagcaacatggcgggtcggggcggcgtagtgaacaacaccgccacgtgggacggcgtcgtttcaccccagtcccgtcccaacccttcagtcttgaagctcgacgcgcaccttacgtgggtggcggcgcgtgaacctctcgacgcggacatcgattctgcgaagacaaatggtgtcggaccaggaatggcatttgcaaactgggtgttggagaagcacccagagtttggtctgattggtttggtcccttgcgcgattggaggcagcaacataagcgagtgggaacgaggaaaagagctttacaatcagatgataaagagggccaaggcatcgctgcgtgacggtggcaccattcgggctttgctatggtaccaaggagaaaccgatacagtgaatttacacgatgcgcagttgtaccaaacaagagttcacaagttcttcttggacgttcgtgatgatctacggtctccgttgcttcctataatccag

SEQ ID NO: 45431 - DNA, 303 bp, Glycine max
  Peptide Sequence Number=SeqID_162209
atggttgttttggaaatggtcactggaaaaagcgtaacaaaggatgttgatgccactgataatggagtggaaaacctgcatctcagcatggtcgcatggcttaaagagaaagacaaaaatggatctgggtgcgttagtgaaatcttggacccaacagtagaaggaggttatgacgagggtaagatgaaagctttggctagagtggccctgcagtgcgtaaaggaagagaaggacaagagacccaccatgagtcaagtagtagagatacttcagaaatctagccgcgaaaatgatcatcagtga

SEQ ID NO: 45432 - DNA, 1956 bp, Glycine max
  Peptide Sequence Number=SeqID_162210
atggctgcagtatataccttgttgttgatccttctgatctctcttgttatttcatcttcagcagtggacaccatgcatcaaggttcatcactctcggtggaggaaccaaaagatttcatgctctctccaaacggcatgttctcttctggtttctttgccgttggcgaaaacgcatattccttcgccgtttggtattccgaaccctatggccaaacacgaaacgcaaccgtcgtatggatggcgaaccgtgaccagcccgtgaacggcaagggctcaaagttttcgcttcttcacaacggcaacctcgccttaaacgacgctgacgagtcccacgtttggtccacaaacaccgtttcactgtcctcctccgtgcttctgttcctcgacaacaccggcaacctcgttctccgccaaacggagagtaccggtgtcgttttgtggcaaagctttgatttccctacagatacgcttttacctcaacaagtgttcacgagacacgcgaaactggtctcttctagaagcaagacaaacaagtcctcgggtttctacactttgttcttcgacaacgacaacattcttcgtcttctttacgatggtcctgaagtttctggcctttactggccagatccatggctggcatcttggaacgctggaagatccacttacaacaacagcagagttgcggtgatggacacgctcggcaattttagttcttcagatgatttacattttttgacatctgattacggcaaagtcgtccaaagaagattgaccatggataacgatggaaacattcgtgtttatagccggagacacggtggagagaaatggtctattacgtggcaagccaaagcaagaccgtgtaacattcatggtatttgtggcccaaatagtttgtgctcttatcatcaaaattctggtatagaatgctcttgtcttcccgggtataagtggaagaacgtagccgattggtcttctgggtgtgaaccgaaattctctatgctttgcaacaaaaccgtgtctcgatttttatatataagcaacgtggagttgtatggctatgactatgcgatcatgaccaatttcacgctcaatcagtgtcaggagttatgccttcaattgtgcaattgtaaaggcatccaatacacctatgtctttgaaagtggcacttatacatgttacccgaagttgcagttgcggaatgcgtaccgtacaccgtattttaatgctgatttgtacttgaaactcccggcaaacagttcatattcttatgaggggtccacagaacagcacggtcttgattgctcttcttcgagaacgatacagcttgagagagcctatgacatgggtcatgaaagcagatatattaagttcttattttggtttgtagggggagttgggggaattgaagttttttgcatatttgtgatttgtctttttctggtgaaaacaagtggccaaaaatattccggtgtagatggacgagtctataatctatccatgaatggtttcaggaaattcagttattctgagctgaaacaagccaccaaaggttttaggcaagagataggaaggggtgcaggaggggttgtttacaaaggagtgttgctggatcaacgcgttgtagcagtgaagagactcaaggatgctaatcaaggagaagaagagttcctcgcggaagtaagcagcattggaagacttaaccacatgaacttgattgagatgtggggatattgtgctgagagaaaacacaggctattggtgtatgagtacatggagaatggatctctagcacaaaatatcaagtccaatgctttggattggaccaaaaggtttgacatagccttaggtactgcaagaggtctagcttatattcatgaggagtgtttggagtgtattctgcactgcgatgtaaagccacaaaacatacttctagattctaactatcatccgaag

SEQ ID NO: 45433 - DNA, 840 bp, Glycine max
  Peptide Sequence Number=SeqID_162211
atgcagtttcaagaggcaggaaacgaaggaatgaatctgtcatcaaggtactctctcattttaagtttcaatttatataaggcacttgccacatatatccactcttctttaaagttcatggaactcttctgcatcagtataaactttgatcttgaaaagcttgtcaacattcaaattcctccaacactaaagaaacaattagttgatgattgtgagtttattacccatctcggcaagcttgttaaactcccccgtactcctaatgtgaaaggcatattgaaaaattattttgattacagattgaagaaatgtggcttgatgggtgattcagttgaagaaattatgaaaggattgtcttgttactttgacaaagcactgccagtgatgcttttgtacaagaacgagcaccaacagtaccaagaggcttgtccagcgaatgtctttccttctgctatatatggtgctgagcatttgttacgtctctttgatggtagtgtggttattatgccctttgtggacagcaaaatgctggccctttgggttcaggcttgcatgagtttattgctatatgctcatggttcttgcaaaaaaaccagagcacattcttcctttctacttatcatgttgcagaaggtattgagaacagcaccaacaaacaaggagactaggcttgtggacaacaattgtttttgctatgtacatagtttcacagagctgctgctgtatacaatgcttgtcacaattgcagtttactttcttcatcaaaatgatgtgaaatcagatttgggttcagggagtgtaacttctacggaaggaatatgcaccgaccctcaattttaa

SEQ ID NO: 45434 - DNA, 864 bp, Glycine max
  Peptide Sequence Number=SeqID_162212
atggtgaaagttggaacctcttacgtgccgatcaacgtctcattttcgccaaaagttggcccagggcttcccggtgctccagtggcttctgtttctatcagctgtccctcctgttcagctactgacggggtggtgcgtaacggcaaaagcaccgccggacatcagcgctggcaagctgcgcaactgttgggaagggcgatcggtgcgggcctcttcgctattacgccagctggcgaaagggggatgtgctgcaaggcgattaagttgggtaacgccagggttttcccagtcacgacgttaaagccaaaagttacgctactactccctactctctgtcagacacgccctgcctctccaatcccacccacccctctcaaaatgtctgacccggaaaatacacccgcgccccaatcggagcaagactcctcttcgccgccgcccgcccaagaccaacccctcgcagctgccgccaagctcggccccgccgccgtctccttcagcatatggccccccactcagcgcacgcgcgacgccgtcatcactcgcctcatcgaaaccctatcctccccctccgtcctctccaagcgctacggcacaatgtcccccgacgaggcctccgcctccgcccgccagatcgaggacgaggccttctccgtcgccgccagctccgccgcctccgacaatgacgggatcgagatcctccaggtctactccaaggagatcagcaaacggatgctcgacaccgtcaaggccaaatccaccgccgcttccgccgctgtcgataacgggactcctgcctcggatgctgctcctccccccgccgcagatggagactccgccgctgtcgccgagtccgaaacctga

SEQ ID NO: 45435 - DNA, 228 bp, Glycine max
  Peptide Sequence Number=SeqID_162213
atgttgaagctcgttagggcaagacaacaagatctgaagtggaatgtcttctctattaccagttttagctggtcaatcaatgtagtggctggcctctctaaacgcatgctggaacttcaaagcccacgagcgattaatgaagctacaaattttgtcaaccaaagggaacaacaggtgagtatcctcaactccgttaaaaatcatgtgaatgataaatttagaatctga

SEQ ID NO: 45436 - DNA, 192 bp, Glycine max
  Peptide Sequence Number=SeqID_162214
atggagagtgagtttaggaacatgtctatggaagtaacaactttggtcaaattgatgttcttgaaggaggattggttgaaggctattgtcgaagatgaaggtgaaaaccatcgcgaggagggcaatgaaacctccgactacatctccaatctcccgaacaagtggactggctttggtgtttcaatttcttag

SEQ ID NO: 45437 - DNA, 270 bp, Glycine max
  Peptide Sequence Number=SeqID_162215
atgccgatgaagagcctttggattgcgtttaccataatgctcgtgttgtcatcgcagctatgtttggtgcgtagccgagttcttcgatcgaaggtggcgttaacaaaggtagcttctgattgtgtaaagttgaaaggatcaggttcttctctatggacgacaaagtcctttgttgtttctaattctgacaattcaagcactcctgtttcaaaacgcagcttggcatttagactagcttctggacctagcaaaaaaggacctggacattag

SEQ ID NO: 45438 - DNA, 1014 bp, Glycine max
  Peptide Sequence Number=SeqID_162216
atggatgaggatttttcatttctacaacctctggatcttatcacaaagggcccaagtgaactacacaatatagtgaaagccagaaaggaaaatctacgtcagcataaatttgaatcaaataaaataataaatgacttgagtcaggatgacccaaggagggaggaaactgagaaagagaggaaagaaaaggaaaatgaacacacattggaaaaaattaggttagagaaagataaggagccgccaaagcctgagtataaagaaatacagcacaccgatcaaaaccatacagagaaacctgaagataagattactgtcgaaaatctagaaaatagagcacaaggaggggctgagccaatggagatctcccagagccccatgtcgtcgcctgatgatactccatgtggttatgtaaaacttttgaaaggtcatacatcagaggtttttgcttgtgcatggaatccatcagctccacttcttgcatctgggtctggagattcaacagctcgaatttggaaaattgctgatggagcttgtgactctagtgtgcaaaatgaaccagtaaatgttgtggtgctgcagcacttcaaagaaagcaccaatgaaaaaagcaaggatgtgacaacacttgactggaatctgatatcttttgctatgatttttattacaaagggggatggaacactattggcaactggttcctatgatggccaagcaagaatatggagtagagatggggagttgaattgtacactaaacaagcacagaggtccaatcttttctctaaagtggaacaagaagggggattatcttcttagtggaagtgtggataagactgctattgtatggaatataaagactgtggaatggaaacaactatttgaatttcacaccggcccaactcttgatgttgattggcgaaacaatgtttcatttgctacatgctccactgataaaatgatacatgtttgcaaaattggagagaatagaccaatcaaaactttctcagggcatcag

SEQ ID NO: 45439 - DNA, 279 bp, Glycine max
  Peptide Sequence Number=SeqID_162217
atgaatctaagagggagacaagtagagataagtgacccaatgtgcccgttatgcaacaattcggaggaggttgcagcacaccttttcttcaattgcagtaaggtcttccccttgtggtgggagtcactctcatgggttaattcagtgggtgctttctcgaaagaacagaaagatcatttcatgcagcatagcagaaggaatgctacacaaacaaaagatataagatggagctattggtggatagccctcacaaggaccatatggaaacatagaaataag

SEQ ID NO: 45440 - DNA, 195 bp, Glycine max
  Peptide Sequence Number=SeqID_162218
gttgactgcgaaggatgtcaggggatggctgaggatttaggagcgattgctgaggatttggagcgggtcatcaacctcaggatggtcactgaaggcactgacttatatgacatcatgactcattgtctgaggagagctagaggtgacgccacagatgaaagtcttaggccacaccaaagacgctgcatggattag

SEQ ID NO: 45441 - DNA, 771 bp, Glycine max
  Peptide Sequence Number=SeqID_162219
tgatcttccgtcacagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggaattcgattgcttgattttccttttccattaaaagatcgcgatgtggtgattaaagggaaaatgagtaaaaatgcggatggcagtattagtattaaaaacaatgccattaaaaataactatcctgaacagcctgatgtgattcgtttaacccgctatgagggttatgcagatccagctggtgcaattccgcttagttttgtgaatatgtttgtacagcaacaaccctatcaaatgctgatgaaaatgaaaaaggaagtgaataatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 45442 - DNA, 210 bp, Glycine max
  Peptide Sequence Number=SeqID_162220
atgggtgacctagaggaagtacaggaacaaatgaaagccgacatgtcggctttgaaagaacaaatggcttccatgatggatgccatgctgggaatgaaacaacttatggagagtaacgcggccaccgccaccgctgttagttcaactaccgaggcagacccgactcttctgactgctgcgcaccaccctattccaaatatggtggtatga

SEQ ID NO: 45443 - DNA, 261 bp, Glycine max
  Peptide Sequence Number=SeqID_162221
atggagccctacaggccctggtaccaacagtcccaatcagcagctagtactagcaagtgcctcattcgactcaacaataaagctctgggatgtggaactagggaatatcagtttatccccaagaaaaatgctgaatcttgtggtcgatttcttgatcacagggcaacttctcagtccacatctgctagtgcagataactttagggaagaactggcttggagaaggaaacctggtggagtgaagcaggaagacgaagaatga

SEQ ID NO: 45444 - DNA, 1113 bp, Glycine max
  Peptide Sequence Number=SeqID_162222
atggatgactcatcatatgacaacatattttctcactcacccaaccaagacttcaactccatctccttctctttttatcttttccaaatcaacaacacacaaaaggaagaagatggagactatgtcgccgcaaagagaaagacaaatgctgccaccgtagtcatagttgaaaaacaacaccccaaacggaagcacgttgtgttgggtgaacttcccaatttactaaatgttattgtccccacagctcaaaatccgcacaaagagaaactccaatgtcagaagaatcccaatagaataagccatctcccgcaaacaacaccctttctccaccccagatcgatgaatcttatgtttccgacatcttcgagcatcttcatgcaatggagtgaaaatgaaaacaggaaacaaccagaaaatgaaaacaataaattttcatgttccgtgttttcagttgagaacagaaaccacatttcggatatgcagagaaagagaaggccaatgattgattacatggacaaagttcagaaacaagttacgacaactatgaggacaatattggtggattggttggtagaggtagctgaggagtacaagcttctctccgatacccttcatctatctgtttcgtacatcgataggtttttgtctgttaatcctgttagcaaatcaagacttcagttactgggtgtttcatccatgctcattgctgccaagtatgaggaagttgacccaccccgtgttgacccgttctgcaacatcactgataacacataccacaaggcagaggttgtaaagatggaagctgacatgctcacgaccctaaagtttgagatgggaaatccaactgtaaacacctttctaaggaggtttgcaaatgttgcttctgagaaccaaaaaacaccaaatttgcagattgaatttttggttggctaccttgctgagctaagcttgctggactatgattgtttaagattctcgccttctatcatggctgcatcagttatatttcttgccaggtttattatctggcctgaagtgcatccttggctgattgaaaagaatgtgtcctcatcttgcatgacttgtatttgtcaagaaaggcagcctccttaa

SEQ ID NO: 45445 - DNA, 972 bp, Glycine max
  Peptide Sequence Number=SeqID_162223
atggagactcgcgccgccgcaaagagaaaggcaaatgccgccaccatagtctttgtcgaaaaacaataccccaacaagaggcagcgggttgtgttgggtgaacttcccaatttacaaaaccttattgtctccgaaactcaaaattcgcgcaaagagaagctcctatgtcggaagaatcccaatgagaagaaaccatcacccacaaacaacaacacctttccttcccctcagatcaacgaatcttatgattcggatatccacgggtatcttcgtgaaatggagatgcagaataagagaagaccaatggttgactacattgaaaaggttcagaaaatcgttaccccaaccatgagagcaatattggtggattggttagtggaggtagctgtggagtacaagcttctatcggatactcttcatctctctgtatcatacatcgatagaaaatatgaggagatggatccacctggtgtggacgagttttgcagcatcactgatcacacttatgacaagacagaggttgtgaagatggaagctgacatacttaagtccctaaagtttgaaatgggaaatcctactgtaagcacctttctaaggaggtatgctgatgttgcttctaatgaccaaaaaactccaaatttgcagattgactttttgggcagctatattggcgagctaagtttgttggactatgattgtttaagattcttgccttctattgtggctgcctcggttatatttcttgccaagttcattatctgtcctgaagtgcatccatggacactcaaagttgagaatccattgcagacttcttccttgtgtgaatgctcgggttacaagccagctgagttgaaagaatgtgtccttatcttgcatgacttgtatttgtcaagaaaggcagcatccttcaaagctgttcgggcaaaatacaagcagcaaaaggtggttgtttttgcatttcttttgttataa

SEQ ID NO: 45446 - DNA, 369 bp, Glycine max
  Peptide Sequence Number=SeqID_162224
atgtctagcaagatcataagtaccgcttttcacaagatgactttgttcaaaacttcaaatcctccaaattcaaactacttcacctctagaatgaactatgcaactttaacctcatcctatggagtgattctccagatgcatgctattgctagactgacaaatttgttcagctgtatccaagattgtgtcctgtgtttccttcatggcctcaatgataactatgaaaggcaattgaacattggtatgtgtcctgatcctgctgcccttgcaattcagacacaaaccttgcccatcaattttctaagccaggcccttccaaacaatggtcgaacaaaccacactgttcaacacatgcttgatcaagcatga

SEQ ID NO: 45447 - DNA, 1263 bp, Glycine max
  Peptide Sequence Number=SeqID_162225
atgttgcccacaaaaagtgcaacctgcactaaaagaaaccaactcaactcaacctgcaggaacaacattgagaggaaaatcataagtgaaattgttgcatataatatagtttcaatcacactccgttatggttattacggcgattcttgcatcctgcttggccctgcctcatcccgtttgatgaagaccagttctgtttttgtgaagcagcttcaagtgtcaaacaaggacaataatcaagttattcttcatgccttcaatgagaagcccgagttaagctcccaaactaattggacagtgtcaaatttgtgtcttgttgaagcgtataaaagcaagggctccaccatccgtatggggtgggaagcacacactactagtagtttggatcagctacatgggatggtgatcaaaggtttgtctcaagaaccttcttatttcgcaggagaaaagaagtttaaactgccacaggctaaacaaacgagcttccccaatgcaatggctcttcacaagattgttaatggtaaagaagctgaatacaaggttgaggaagataatatgtaccacatgggggttctaaacatgaatgccaggaacattatcttgaatatgaaagttaatgtttcggcaaaggtatatgataccaccaaaggcaagaagatgtgctctactgcaaatggatcgtgtaggctcagttttgtcttccctaatactcagtatgttatttttacggcacctggcaaaggagatgggggttcgtatgttgaaatttcttttctggctcgtgtgttgacctacatattacttttaggagctcttatgattgttgtttatctgattctgaagttccttggagtctatgatggtggtgatcggaatagtcgtgtgactgtcgacgccacatacagaacaagtgatgtagtggcaaggcaaaccgaaactgagcccttgatgcaagtggagacaaatcgatggacatatggaacaaatgcaaaagatgacgaagaagaagattcaggagcatccagtagctcttcagaggagttatatgatgaaaaattatgttgcatttgttacgatgaacaacgcaacagcttctttgttccttgtgggcattgtgccacttgctatgactgtgcagagaggagattcacattagaagcattttgcaggattgtagatggggagagcaaagtgtgccctatatgccgaaggcttattcacaaagggaatcagttactatggcttgggcagagttcatcatag

SEQ ID NO: 45448 - DNA, 1530 bp, Glycine max
  Peptide Sequence Number=SeqID_162226
atgagtgctccatcgcgagaagaggagtcgaaggaggaggagagggacgaggaagcgaaccggcttctagaagaagaagaagaagcagaatcatcatcagaagagggggagaagatcctggtggcggatttggagttcgacagggtggacgatgggagcgttcctcctcctttctcgtggaagaagctctggctgttcacggggcctgggttcttgatgagcatagcgtttttggatccagggaatctagagggggatctccaggctggggccatcgcgggctactcgcttctatggctcctcatgtgggccaccttcatgggcctcttgatccagcttctctccgccagggtcggcgtcgccacgggccgccacctcgccgagctctgcagggacgagtatcccaattgggcccgcctcgtgctctggttcatggccgagctcgccctgattggcgccgacattcaagaggttattggaagtgccattgccatccaaattctcagccgcggcttcttccctctctgggctggagttctaatcactgcttcagattgctttttctttctatttcttgagaactatggagtgaggaagttggaagctgcttttgcggttctcatcgctgttatgggtctttcttttgcctggatgttcggtgatgctcaacctaatagaaaagagcttttaatgggtattttggttccaagactaagctcgaaaacaattcgtcaggctgtgggtgttgtgggttgtgtcattatgcctcacaatgtattcctgcattctgctttggtgcaatcaaggaaggttgatcctaaaaagataggtcgggtgcaggaggctctcaactactattcaattgaatcggcggcggcacttgcagtctccttcatgatcaatctatttgtcacaacagtttttgctaagggtttttatggaacaaaacaggcagatagcataggattggtcaatgcagggcagtatcttgaagagaagtatgggggaggagtcttccctattctttatatatgggggattgggttattggcagctgggcagagtagcaccatcactggcacatatgctggccaattcataatggggggtttcctcaaccttcgtttaaagaaatggttgagagcattgatcactcgaagttttgcaattgtgccaactataattgtagcgattgtttttaataaatcagaaggctcattggatgttttgaatgaatggctcaatgtgcttcagtccatgcaaattccctttgctctaattcccctcctcacattggtctccaaagagaagatcatggggacctttagggttgggcctgttcttgagctagaaatctctatttcacttgttaagaatggttctgtcactctgtctagtttagcagccagagtcaatctgcttatcaaatctagagttattgaaagaattaagatgtatgttggctattcaacaacaatctatgcctattttctgggtaaaaatagaaacagatctgctgtaatatattaa

SEQ ID NO: 45449 - DNA, 1326 bp, Glycine max
  Peptide Sequence Number=SeqID_162227
tcacggtggtgcagtaccagccaaacgacaggccgccaacattcagggaaatacacgcggtattaacgagtatgaattatcttttcgccagcgcatgaatgaaaacgtcgaggccaagatggcgatagccaaacgagcactcgattttatcagccccgaatcgtccagacccttgcagcgcgcggcagtatccgcaccatctgcctgggtggagaatattctgaccgttatgaagatttccacggcgtcgtcgcagagcagccgctacgggaatttcagatcaataagatctttttttcctgcagcagtttgggcaatgacggttatttacgcgaaggccgctgacaaaatccgcatgggcatcgtggtaaaaattggcggtattccgtggttcaacgccatggaagcgggcatcaaaagtgaagcggcaaaacgcggcatcgacgcgtggatggtcgggccaaccgccgctgacccggcgctgcaggtgcgcgcgattgaagatttgattgcgcagaaggtcgatatcatcggcgtggtgccaaacgacccgaaagtgcttgagccagtgctgaagcgcgcgcgggaagccgggatcatggtgattactcacgaatcgcccggccagaaagacgccaactgggatttcgagctggtcgatgcgccgacccacggcatcaaccatatgaaagcgctggcaaaatgcatgcatgaagaaggcaaatacgccatgtatgtcggcagcctgacggtgccactgcatcaggagtggaccgacgccgcgctcaactaccagaaacagcactatccgaagatgcagctggtgaccgacaagttcggcgtcggcgaatcgctggatgactccatccgcaccaccaacgagctgatgtctaaatacccggatctgaaaggcattatggcctttggttctcagggaccgattggcgcaggccgcgcggtcatgaaccgcaacaagatcgatcaggtgtgcgtcatcggcgccttcagcccgggccagggcgcgtcgctggtacagcgcggtgctatcaagggcggctatatctggaatccgcagaccgccggtgaagtatttgtgcgtatcgccgacatgatggagaaaaaagagccgatcaccgacggcatgaccattgaagggctgggcaaagtgaaggtggatgaggcgacgcacaccattctcggtcactccacagacgctgattgcgctcgacaacctgtcgaaaacatttggtggcaaccgcgcactgagcgatatctcgctgaccctgctggccggcgaagtgcactgtctcgctggcaccaacggct

SEQ ID NO: 45450 - DNA, 228 bp, Glycine max
  Peptide Sequence Number=SeqID_162228
ggatcacgcccacaagacacctagtggacccgaagaagtccaacaaggtcctagggtttccagctctgattatgagcctttgttagttctacggagtgctcgtcgcccccaacaaggcaacagacgcaccgccaccacctctagagtccacctcagctcatctacaaaggctgaagcgttgcctacgacacgtggccaaccagcaggcgaccaagtccaaaaccaaag

SEQ ID NO: 45451 - DNA, 384 bp, Glycine max
  Peptide Sequence Number=SeqID_162229
atgggttatgaaccgacatgccaatacgttaacgctggctgcactggtactggccgggctgaacatgcgcccgctgctgacctcggtcagtccgctgctgggccagctgcgccacagcctgcatctgtcagggctggccgcctcgctgctgccggcggtgccgattgtgatgatgggcgcggtggcgctgttcagcgccaggctgatgcagcgcgtggccttaaagcccttactgctggccgggttgacgctattgctgctggcactggcggcgcgcggcgtgatcgacagcggcagcgggctggtgctcagcgcgctgtttgctggcatcggcgtcggcgtggtgcagatggcgatgccgggactgattcgacagcgttttag

SEQ ID NO: 45452 - DNA, 641 bp, Glycine max
  Peptide Sequence Number=SeqID_162230
gggttgtctctaacagccttacttttgagcgcctgagcccggtcattaactgggcctacatcaggaagaactattggaatcctgaggatctaacagtttctatccgaggggctaggagggcgagggcgaggccagttgagcttccttccacttctgtaattcctactctagcatccacttcagcagcttcttctgtcccaactcagacagattctcagcgctttgaagccatgcttcagagcattcatcagggacaaatcactttattacaaagatctattccttcagttgagcagttcagggagatggtagcctggcccaggacccaaccttctcttcacaaggaagatgaaggtcccacagcccaggtaccacagcatgtggaggatgagtcatctgaggccaccatcccagagccatttgttataggggaggaggcagagcctcctgcaccagtggtggacctaccctcacctcagtgtacaacagacccctccactcctattgtacagacaccagaggacccgaccacaccagacctggctatggacacttctcctccagctactcctgtacttcatctgacaaatgagaaggatgttcagacacacgatacccaggaccagtcacaggaattctaa

SEQ ID NO: 45453 - DNA, 246 bp, Glycine max
  Peptide Sequence Number=SeqID_162231
atggtcgaacaagaaaacagggaggtgaagccacaccaagaagaaacggaggttgtgagcttgggtgatggcgaggaaagaaaggaggtgaaggttgttataggcatgtccacaaacatccgagatgaattggtagctctgctacgagactaccaagacattttcgcttggtcataccaagatatgccaggcttaagtcccgacatcgtacaaaactgcgaaggatcaagctcgagatgtccttga

SEQ ID NO: 45454 - DNA, 714 bp, Glycine max
  Peptide Sequence Number=SeqID_162232
atggaattaagggacattgtagcaatagatgaaccattgcaaaatgaaaatccagtgatagatatgataaatgatgcatttgggaacaatagacactataatgtgtgtcctaatatgtatgaagaagcatctgagtttgtagacactatgcctaatgaagtaaatgaagaaatttcttatttgcttagagatggtaccaaagaattgtatgaaaggtgtcgaaagtactcaaagttgttttttctattgaggttgtataatataaaatgtttgtgcggtatgactaataaagcaatgacgatgattttggagtcattgaaagatgcatttgaatatggaaagattcctacttcattttataaggcaaagaaggtgatctacaagcttggtcttaattatacaaagatagatgtttgcccaaagaattgcatgttgtattggggagaagatgaaaatttagagatttgcaagcattacagaaaatctagatggaaaacaaaaagtactaatggtaaaaagaatttaccagccaaggttttacgttacttttccttgcaaccaaggttgcaaagtgcttctaattccatacaactgacctccttgggagtgcatgaagcaatcttcttggtcagtgcttctaattccatacaaccgacctccttgggagtgcatgaagcaatcttctttgattctttctatggccattctagctaa

SEQ ID NO: 45455 - DNA, 306 bp, Glycine max
  Peptide Sequence Number=SeqID_162233
atggtgtatcatgttgatgatgaggtaaataagggttggagtgttgttgtccacatgatgccaagagaattgtatgatatgggagaagttggagaagacattacatttgaaatcacgcctcctaaacccaaatgtccaacaaaagtagcacttactcagcaattacattttcctcctcatatggctcatactcagcaaccatatattccttctcctatggctcccattcaacaaccatatattctttctcttatggctctcactcatcagccatatattccttctcctatgcctcctactcaatag

SEQ ID NO: 45456 - DNA, 651 bp, Glycine max
  Peptide Sequence Number=SeqID_162234
atgtggctaaagtgggtttctgaacttcacacgagaggtagtggcggtggagatgtcaggacatctccctgcgtgcgacgtagctatagcgatgggtcgtcattgcccacccctaccatcgctggccaagaatgggtgagagatgacgttctgaaatacaagtcctctctgacctcgacgacaagtgtcgctactcttcaacgccaagtcttgggtctcattctttccttgaccgctttccaatgtgctcttcttgagcacttgaacgtgactccttctcaactccacccaaacagttgggcaatggtttccttgaacgacatgtccaagaagttgtttaagtttgattcaaacatctttccctattttaaggactatttctttaaggtcctggctactggtgttgtggttgatggtttgccactgatgttcaacagggacggggagccctgcttccattctactggcagtctgaccctaccagacgtgcgtgcaattctgtctcttccttcagcgagtgatcccttaattgccttgaatggtaaagtgcctaaccttgccctcttcaatccactcgtgaagcaggttggacttgcaggtgggattgtgctaccttctactattgttggagaaaggggtcactcatcgtga

SEQ ID NO: 45457 - DNA, 213 bp, Glycine max
  Peptide Sequence Number=SeqID_162235
atggagacggatccaatgtctgctaatggcattggggtaccatcaccattcatgaccgatataagcaagacaggatttaaagacataaaagacttaggatcatatgacatgtgttgtgacgctccagaatcaagaatccaaatggaaatcatacctgacaaactagaggaagacaaaccttttaaggaggaggtagacatggcatgcgactga

SEQ ID NO: 45458 - DNA, 278 bp, Glycine max
  Peptide Sequence Number=SeqID_162236
gtatgacagaggtggatggaatatatgacaaccaagaaggattaggttgtgagtacaccagccaacccactacttccgaaaccagtagacctgacctcttgagtggacctcatgtgccagcaaagattataagtggacttaaggctgtggattttaggcaacctgaggtgctattggtaaacaaggttgatgaatttgaggtgagaaaaaggccacttgaggcattagcaaatatgggactaaatggagagtacaatttgaaggagttaatgacattg

SEQ ID NO: 45459 - DNA, 555 bp, Glycine max
  Peptide Sequence Number=SeqID_162237
atgactatgggctacacatatgaagcaatggacaaagaagataaaactattatgaagtattttgaaaatgcaagcagatatatggatgtgtttcaaatcattgataaaagatgtgatgttcaacttcatcacccattacatgcagccaaccactttttgaatctggagttcttctatgacaaccctcggatggcatttgatggtgaggactctaattgttgtttcaatgcggaaagaaattgccccaaactcactgaaattgatgaatgtaatgagtggctacttggtgagatagatgaggatggtgatgatgaagatagggtttcggaggaggaagatgatgaccttaattggagacacatttctatagtgcttcggatcttggcaagcctagatatagtagggcaagagggaacatctcaaagagcttctaaaaaagacaaaggaggagcttctttaactaggaagggaaaaatggttaaagttaaggaagtattggaagataatactagtgaggaagggaaattagaggcaaatttgtcaaaagaagattga

SEQ ID NO: 45460 - DNA, 204 bp, Glycine max
  Peptide Sequence Number=SeqID_162238
atgaaacccgatcatggtaaaatattctacatcggttgtcctaataaccgatgtagaatgtccgaaattctacatcggtcgttgatgcaattctatcccgcaagggtattgggtagaagactccaagtagattgggctagagatccaagggaaggccctagggttctcatgagccttagggtagatttcgagcccatgggctaa

SEQ ID NO: 45461 - DNA, 612 bp, Glycine max
  Peptide Sequence Number=SeqID_162239
atgcaagaggtgtctctatctctgcttggtgaagaagtggtctcgcacatcactgatgctattaaagattggattgagggtgttgtgattcccgtggatggaaaggagggccctgcagatgtttgtgtgattgaactgggaggcactgaggaggctgtttccggattcgaacccatgaccaacaagtcaccaaggcacaactttaccgctgcaccagggctcaccctccttgtgcgttacaaaacagtctgcatggaagtgtatgggagaatagtaggtgatcagaatgtggtatcttcaactcagggaaccagatcaaagaggaaaatgaaaaactctgggagacaatgtatcccagtgagcctagtttggcttatagttgaatgtggagttgggattgcagtacttgtcggatgcttcgttcataagaaaggtacagagaatcagatagctgaaaaacttggagctggtttctctcgagtcccatttgctattattgtgggtatcacaacttacgactatgtttgggagaattatctttccttggaaggttgtttctgctctggtattgaaaattttcccttgtcaggcaagttgaccttgttaaactaa

SEQ ID NO: 45462 - DNA, 669 bp, Glycine max
  Peptide Sequence Number=SeqID_162240
atgagattggtgcgacaagaagcacttatcagtgctctcaaattagagatgccacacgaaatagtactatggaggagaggccaagtggaagtgcatgtgctgactgcgttctcaggaaaagacaagttgttcgaccacattgcaccatttgagggccataatattgcttggatgaagagttgctacaagggttctttgttgattttgggtttatctatgagagcttttagcgaggtgtcaccggcaacgatgcagggttcatcggggacaacaaggagttcacttacaacaaaaggggacaatcaagtagagtggagacatgctccaactgtccactcatcgagaggcttcttgtgtctttgggaggaaggtaaattccagcttcttgattgtgtgaggatcttgtacatcttgaatttaaaaagaaaggtgggagatagagtgtggtgcatcatagaagattttaatcccattctgaatagtgatgagagagtgggaagtagtgatagtagtcaacgaagatatagagaaatggtggagtttaatgcttttattgatcacatggaggtggtggagttaccttcggtgggaagaaagttcacttgggtaacggcagcaggtggtgctatgagtagattgaatagggctttggtttcttttgaatggtag

SEQ ID NO: 45463 - DNA, 675 bp, Glycine max
  Peptide Sequence Number=SeqID_162241
atgaccaatgatgtttcttgtgtacaatcgtacgagcttgaacatgattcccacactctaatgaatgtttccgaccacccaaacaataatccgtttcaaaaccctactcatatcgatgacgtgattcaattatttgcatgcgacacggaagcgcctttggcagcgcgtgaggtgtacgcgcctcggaaatggaagcgcttcaggggcgtgagaaggcggccgtgggggaagttcgcggcggagatatgggatccaaagaagaagaatggaagggtttggctcgggacgtatgagactgaagaggaagctggtttagcttatgatagagcttgtttcaagatgagaggtagtaaagcaaagttgaattttccacacctaattggatctcacgcgccgcctgagagagtgagtgtggtggccgcacggaagccgaactcgccagagccttgtttcctgccttccccgccgccggtgaccgaagatagctcacagccacaagggttgaagaaaaggaggaacctagctgatttacttaataggttagccaagaacagaagccaaatagtgctctattctgttatgagcaatagtgctctatgcatttgtaattctgttagtcctatagtgctctctattagtgctttagagattctgttattagcttttgtcttgtag

SEQ ID NO: 45464 - DNA, 501 bp, Glycine max
  Peptide Sequence Number=SeqID_162242
atggcggaaagagggaaattggatcatatagaggagagactcagggccattgaaggaggcgaagatcatgcttttgctgacttggcagagttgtacctagtgcctatcgtcgtcatccctccgaagttcaaggtatcaaacttcaataagtacaaggggactactttccccaagaatcacctaaaggacctaatggtggccttcgttaggcagtatcagtacaattctgatatggctctagataggatgcaactacagaacatgtgcaaaaagggacatgaatctttcaaagaatacgcccaagggtggaggaatatggcagctcaagtggcgcccccaatgacggaaagggagatgataacaatgatagtagacacgttaccggtattctactatgagaaaatggtgggttacacaccttcaagctttgcggatttagttttcaccggcgaaaggatcaacgtgggtctgaaaagaggcaaattgagtgggatcctctag

SEQ ID NO: 45465 - DNA, 1153 bp, Glycine max
  Peptide Sequence Number=SeqID_162243
tcaacttgaaggaaacattccaacttctttgggtaatgtctgcaacttaagggtgatacgtttatcatatctcaaactcaaccaacaggttaatgaacttttagaaattcttgctccttgtatttcccatggactcacaagacttgcagttcagagttcacaactttcaggcaatctgacagatcatattggggcatttgaaaatattgtgctgctagatttttccaacaactcaattggtggtgctcttcctagatcatttggaaaactttcatcattaagatttctcaatctgtctattaataaattcagtggaaatccatttgaaagtcttggatcactctctaaattgtcatctctttatattgatggcaatctttttcatggagttgtcaaggaagatgatcttgcaaatcttacaagcttgacggagtttggagcatcagggaacaatttcactttaaaagtgggtcccaattggcgtcctaattttcggctttcctatttggatgtgacatcatggcagttaagtcccaactttccatcgtggattcagtcacaaaacaaacttcaatatgttggactgtctaacacggggattttagattctattcccacctggttctgggaaacaccttctcagattttgtatttaaacctctcttataatcatatccatggtgagattgagactacattaaagaatccaatatctatccaaactattgatctaagctcaaatcacttgtgtggtaaattaccctatctttcaagtgatgtgtttcagttagatctttcaagcaattcattctctgaatccatgaatgactttttatgtaagcatcaggacgggccagtgcaattagaatttctgaatcttgcatcaaataatttgtcaggagagatacctgattgctggatgaattggacatctcttgtgtatgtaaatttacaaagcaaccattttgttgggaacttaccccaatccatgggttccttggcagacctgcagtcgttacaaattcgtaacaacacactctcaggaatatttccaaccagtttgaagaagaataaccaattgatatccttggaccttggggaaaataatctttcaggaagtattccaacatgggttggagaaaagctcttaaat

SEQ ID NO: 45466 - DNA, 723 bp, Glycine max
  Peptide Sequence Number=SeqID_162244
atggtttcccgggaaaataccaattggctcttcgattacggcttgatcgacgatattcccgttccggatgccacctttggcgtcaattcctccgccttcacatggccccctaacgccctcgacgctccttccaatgtcggcgaaagtgctgataaggacaagaaatgtggaagaaatgagagtgatgaggtggacgaagttaggtctgaatcatgtgctgcttctagctccaaggcatgtcgagagaagttgcgaagagataggcttaatgacaagtacactgtttacttccaaattccaactacctcccctgtctttctgttatccttgcctgccaaaacggacaagactgctatcctgattgatgctgtccgaatggtgacccaattaaggggtgaagcccagaagttgaaagacactaatcagggtcttcaagaaaagattaaagatttgaaggctgagaagaatgaacttcgcgatcagaaacagaggctcaaggcagagaaggagaagctggagcagcagctgaaatcattgaatggacagcctagtttcatgcctccccctgctgcaatccctgctgcatttgcggtgcaaggccaagcccacggcaacaagttggtaccttttattagctatccaggagttgcaatgtggcaattcatgccacctgctgcagtggatacctcacaggatcatgttctccgaccaccagttgcctaa

SEQ ID NO: 45467 - DNA, 291 bp, Glycine max
  Peptide Sequence Number=SeqID_162245
atggtactatcaacaacaccaaaggaaccacggtttgctagccagtcgcgcacacattgccttcgtgcaagttctactgcaagagaagtgctgaggccacaccacccatatctgatgagaggtgctacactcacgaagcaaatgataggtagtttcattgctaagtcgacatcgtacacacttgcggtcacttgtaaggtgacacttgaaaaagagacatgcacccacgctaagcgagcagcgcaggcttggcgcgagtacgcaagcccaagtccactccagcaactataa

SEQ ID NO: 45468 - DNA, 327 bp, Glycine max
  Peptide Sequence Number=SeqID_162246
atgaaaggccaacaacagctcaaaaaatctaaagtggtgaaaattgactcaagaaaatcatgggaacaccacataactaatgcaaccaataaaggctatcctgttatggttcatttctctgcttattggtgcatgccttctataactatgaatcctttttttgaagaactggcctccacctatcaaagtgttctctttctgaatgttgatgttgatgaggtcaaggtaatttatttgtataacctatggtgggaaggacatccttcatcgtttggtgtttatataaaactactgcttctaattggcagaacatgcaatgctatctaa

SEQ ID NO: 45469 - DNA, 348 bp, Glycine max
  Peptide Sequence Number=SeqID_162247
atgaataacacaagttttcaaggtttggaaaaccagaaaacttcagaaagcttttggtacaaagaagaagaagaagttcaaagagattcaagactacagaaattcacaaataactccattaaattcccactcccctatagtgatagtaagttgctacaatcaagaatgggagggcacagaggtctcaacgttctccccaaaaagagatggagtgataaaaggttcgtcgcgacaatggagcagctcaagcgcgaagagacccgaaagcgtgaggccgagctctgcctcgatcgacttcgcgtcgctcaaggcttggcgttgtcgatctctatattttttccatcttag

SEQ ID NO: 45470 - DNA, 237 bp, Glycine max
  Peptide Sequence Number=SeqID_162248
atggcgcgcgatctcggcccgcgcggcatcaccgtcaataacgtgcagcccggcccggtagacaccgagatgaacccggacgccggtgagttcgccgagcagctcaagcagctgatggcgatcggccgctacggcaaagatgaagagatcgccggcttcgtcgcctacctcgccggcccgcaggcgggttatatcaccggtgccagcctgagcatcgacggcggcttctcggcataa

SEQ ID NO: 45471 - DNA, 180 bp, Glycine max
  Peptide Sequence Number=SeqID_162249
atggtgactttcaagtatgagcgtttaggtacattttctttcgtttgtggcattcttggtcacaatgataaatcctgtgagacattgttgaaaaaaaagcaaaggaggaaagagggaatcgatggtggctggtggctatggaacaacatatcaagtgtggaaagtggaagtgcggcttaa

SEQ ID NO: 45472 - DNA, 126 bp, Glycine max
  Peptide Sequence Number=SeqID_162250
atgcttaagttagctaattgttacctctgtcctgccaggcataattggtcttccatgtcagtgcatgattcccatctcatgacagtgctacatatagcacttgatcaggtgttgaatgtccagtga

SEQ ID NO: 45473 - DNA, 138 bp, Glycine max
  Peptide Sequence Number=SeqID_162251
atggtggctttagagggaatgtccatgacgagcttgcggcaagtatcgaaggtcacaacgaaggttgtggcagactacggaggtcatggaagggtgaagggcgagagtgagatgtgcggagattgctacaaagcataa

SEQ ID NO: 45474 - DNA, 266 bp, Glycine max
  Peptide Sequence Number=SeqID_162252
gagactcgaccattcccactgccactgactccgacgacaaccaagacaacctcgagtgtctcaagagagtgcggagcctctaccagcctttgtccgttattttgccgctggctgccgtgtccgacaatgacgatgacagcgtggacaacctcgagacagtgcgagcgattatgaaaaggtttagtacctatggcgaagttaatggatttgaatgggtaatattaaataggtatggagaggaaggattatttcctatgaaagcttga

SEQ ID NO: 45475 - DNA, 414 bp, Glycine max
  Peptide Sequence Number=SeqID_162253
atgaaccctcatgctttaaacatcaacatgaatacccttgatgacattgagctccctataacgacgtcgtttaacgatgcttccgcgttggtgccgccgacaacggcaatgtttggatggaactccaactttcggaatgttttcttggtggagaactgggcagagctgccgttgaaggaggataatgtggaagacatggttatctacggtgttttgcatgaggctgccaccaccggatggctccccgctaatgccaatggggtgagcaacgtagggataactgtgaaaatggaaactaagagtcaaaatagtgacaattcagttgcgcgtggcactcacgcgcctcctaggagggggttgagctaccggggcctaaggaggaggccatgggaaaagtatgcagtagagagataa

SEQ ID NO: 45476 - DNA, 211 bp, Glycine max
  Peptide Sequence Number=SeqID_162254
ggtgacttatctgtcaacttttccactattacacccattaaaccaaactctgctttacgtaaagttgccagagtacgcttaacctctggatttgaaattactgcttatatacccggggggagggttaaagatttacccggtgtgagatatcacattgttcgaggaaccctagatgctgtcggagtaaaggatcgtcaacaagggcgttcta

SEQ ID NO: 45477 - DNA, 1129 bp, Glycine max
  Peptide Sequence Number=SeqID_162255
tgcttactcatggttgaaagaagacattgagaatgttgtggttgtccactgtaaggctggaatggcaaggacagggttgatgatttctagtcttctagtattcttaaagttcttcccaactgctgaggaatcaatggattactataatcagaaaagatgtgttgatggaaagggacttgttctgcctagtcagattaggtatgtcaaatattttgaacgagtcttgacttactttaatggtgaaaacccaccggcccgcaggggattccggcttctcagatgcccttactggattaggccctctataaccgtctcagatcacagtggtatgcttgccattctttatgaaggatttctctgtgacttgagctttcacaatttgcagccagaagatttttggtttagtgcgccaaaaaagggagtgatggtctttgctttgccgggagagcctggccttaccgagttggctggggacttcaaaatccattttcatgatcgccaaggagatttttactgttggttgaacacaactatgacagaaaataggaaagtattgaacaccagtgatctggatggctttgacaagagaaaattgccttctccgggatttatggttgaggttgtgctggtggattataatggcaatgatgtaacttctaaaactgaaactactacaaagaaatcagatgagagttcaagtaacaatcctgccagttccgccccagtggaaaggagcaccacccctgcacagaatgcagacaaagaatcagatagtcatgataaagatgacgtgttttcagatggcgaggcagagcaatctgcttcttcaagaagcaagcaaacaaaagcaccttctgaagcagttgaaacagttacaaatgacaccagaatctccgaatcaaacagagtttcaaatgaaattgcaaatttatcacatgcaacagagcaagtttccttgggaaacaagagctctacgccaattcgtcatgctagtgagccaggaagtaatgttgatggaaaaacagtgtccagtctcgaggtgcccagtgcagaaagtgagtttaaggccatggctgctgatgcttctgtttttacctttggagatgatgaagactacgaaagtgattga

SEQ ID NO: 45478 - DNA, 1504 bp, Glycine max
  Peptide Sequence Number=SeqID_162256
ggatctggctccagcaacagtgtacgcttttggaacaaccaaacacacagcaacagttcctggtccaacgatcgaggccatctatggcgttgacacccacgtgagatggcaaaatcacctccctccaaagcacatacttccctgggaccctacgatccccaccgcgatgaccaactccacacgtggcattcccacagtggtccacctccacggtgggatccacgcgccagagagcgacggaaacgccaacgcatggttcacatcgaaatacaacgaaaggggacccacatggacaaagaagacatatcactacccaaataatcaacaaccagggaacctatggtaccatgaccatgccatggggttgacccgagtcaaccttctagctggcctactcggagcctacatcattcgccaccctcagatcgaggacccgctaggcttacccagcggtgacgaattcgatcgaacgctgatcgtgttcgatcgcagcttccgcacggacggttcgatcttcatgagttccaccgggaacaaccctaaaatacaccctcagtggcagccagagtacttcggcgacgccatcattgtcaacggcaaggcgtggccgcgcctcacggtgcgacgtcgtaagtatcgattccgcataatcaacgccagcaacgccaggttctttagattcttcttcaccaacggcttgagattcacccacgtggcatccgattcggcttacatcgagaagcccgtaacgaccaatgagacgctggtggggccatctgagatcacagacatcgttgttgacttttctcaatccaagagtaacttggctattctagccaacgatgcaaaatatccttaccctgccggtgaccccgtcaatgaggctaacggcaaggttatcaagtttatcatcgtacctgatcaagaagttgacacgtcacgggtccctaaacggttgttagaataccctgttgttgatttatccagtgtggcgcacacacgctatgttgctatgtacgagtacgcgagcgacattgatgagccgacacacttgtacctaaatgcgaaaccgtatgaagcagcggctacggaaaccccgaaggtggggtccacagaggtgtggtatgtgatcaacttgacggaggataatcacccgcttcacattcatttgggtttgttcaaggtgttggatcagacggcgctggtgaaaccggatgatgagtttagagaatgtatgaagaaaatcaacgatgcggtcaagtgccacgtggacaagtacgctcgtggcaagaaagaagaggtgccggctcatgagagagggtggaagaatgtgttcaagatgatacctgggcatgtgacgaagattgccgtgaggttttcttacattcacaccaatgcttcatatgtgtttgatgcaaccacagagcctggctacgtctatcattgccatgtattggaccatgaagacaatgctatgatgagacccttgaaaatcatcaagtga

SEQ ID NO: 45479 - DNA, 606 bp, Glycine max
  Peptide Sequence Number=SeqID_162257
atggattcagtgcctgctgatgtgtctaattcacatcctatcaatgaaccgtcgaattctcctccggctgaagagaccgacagacaagcttctgcttctgtagcctccaggcaagataattctccacatgaggcatcacctaggctatctcccacgggcatatcgtcctgggccaaaaacttgaaaatttctcagccattttctggcaaccaagacgactcatcaagtggaaatgttgggaaatcaactttttcacgcatcacaagtaatttcggattgaggttgtctccaaagtctcctgtagcagatgacagttccaatgaaacagctggacaatctaatttgtttggaactattacgaaaggcctggtcgactcttctaagaatgcagtgaaagctgtgcaggaaggaggttttgatttagatatgacatatatcactgaaaacattattgcaatgggattccctgctggcgacatgagctctgggtttttcggctatgttgagggattttacagaaatcacatggaagaagtgattaagttttttgaaactcaccataagctgtacatagaaggccagccactagaagcacctgtaaggtga

SEQ ID NO: 45480 - DNA, 1224 bp, Glycine max
  Peptide Sequence Number=SeqID_162258
atgactaaagaagaagactttaagctccttaaaatccagacttgtgttctcaaagtgaacattcactgtgacgggtgtaagcagaaagtgaagaaactccttcagagaattgaaggtgtttaccaagttcaaatagatgcagaacagcagaaagtaacggtttcaggtagtgtggattccgctactttgatcaagaaactggtcagagctggtaaacatgctgaactttggtctcagaaaataaatcagaaccagaagcagaagaacaacaatgccaaggatgacaagaacaaagggcaaaagcaagcactggtcaagggacttgaggccttcaaaaaccagcagaaatttcctgcttttagttctgaagaagatgaatactactacgatgatgaggacgacgaggaggacgaagatgaagagatgcggtttctcagggagaaagccaatcaacttcaaatgctcaagcagcaaacagctaatgcaaataatgtcagaaaaggcatgggagccattgcagcgggtgctaacaatggtaagacgaacaatggtgacaatgccaatagtggcaaaaagggaggcccaaatcatcagaatatggggatgaaggatagtcctaatggggggcttgatcagaaaaccatggcagctcttaaatttaacaatggccacctgggtggtgatggtctcaacctcaaccttggtgaggccaaaagggccaatgacattggtgctatgatgaatttggctggttttaatggcaataattgtgccaataatgttggtagtgccactgttctagggggtaataataattccaatggtttgggaggttttcctgttcagtccaataacaatatgattcccgggtctgctgcagctttttcaaatggtggtctttctggtggccaatatccatcttctctgctaatgaacatgaatggctttaataaccatccatcgccatctccattaatgatgaacatgaacatgcagcaggcaaggcaagccatgcagcagcaaccccagatgatgtatcacaggtctccttttgttccccctaacactggctattactacaaccacagtagctacagccctgcacattactcctactcctatggcttgcctagttaccctgcagcagcagggggtggtgatgatcactctgcagctcacatgttcagtgatgacaatactagcagcagttgttcaataatgtaa

SEQ ID NO: 45481 - DNA, 258 bp, Glycine max
  Peptide Sequence Number=SeqID_162259
atggacacaagaacattgctcctgaaactactcatcactcttgtggctctttcaggatgctcttcttcggcttcagatcatttggttaatgtatccaagttggagaagttcgtggatgagcttcctcacatgcccaaaatccttggctatcatctttcagatggcgtcccaaaatctaagtccttgaagattggcatgttcaagaagaaatggcgtgccatgcctagttctttctatgctggtttcgatgattgctag

SEQ ID NO: 45482 - DNA, 1833 bp, Glycine max
  Peptide Sequence Number=SeqID_162260
atggcgacactctcggagacctacgcgtgcgcaccctccacggagcgcggtcgcggcatcctcatctccggcgatgccaaaacgaacaacattctctactgcacgggccgatcggtcataatccgcaacctcgacaacccgctgcaggtgtgggtgtactgcgagcatgcctaccccgtcacggtggcgcgctactcccccaacggcgagtgggtcgcctccgccgacatctccggcaccgtccgaatctgggggacccacaacgagttcgttctcaagaacgagtttcgggtcctctcgggtcggatcgacgacctccaatggtccttcgatgggatgaggatcgtcgcttgtggggacggcaagggcaagtccttcgttcgcgcctttatgtgggattcaggttccactgttggtgattttgatggccattcgcgccgggttttaagttgtgcatttaaaccaacaaggccattccgcattgccacatgtggagaagattttttggcgaatttttatgatggtccaccgttcaagttcaatatgtccatcagggaccattcgaattttgtcaactgtgttagattttccccagatgggagcaagtttattactgttagctcagatagaaagggcattatatatgatggaaagacggggaacaaacttggtgagttgtccacggaggatggtcacaagggaagcatatatgctgttagttggagtcctgacagcaaacaggttcttactgtttccgctgacaaatctgccaaagtatggaatgttgttgaggatggtagtagtggaacggtaaataagactttggcatgtactgaatctggcggggtggaggatatgcttgttggttgtctttggcagaatgattatctgcttactatctctcttggtggcacgatctatttatattctgctaaggatttagataaaagcccattgtcattatctggccacatgaaaaatatcactgttttgactctgctcaacagaagtgaaaagatgcttttgtccagcagctatgatggagtgatcattagatggattcctggcatgggatacagtggtaagtttgagggtaaacaatttgggttaatcaaattgttagtcgctggccaagatgaagttattgctgctggatttgacaacaaggtatacagagttcctcttcatggggataattttggtcctgctgaaactgttgatgttggaagtcagcctaaggatgtaacccttgcactcaataaccctgaatttgctatcgttgcaattgaatccggagttgtcttgctaaacggttctaaaattgtttccactataaacctgggcttcattgtgaccgcggctgctatgtcacctgatggtagtgaagcaattgtgggagggcaagatggtaagttgcacatgtattcagtctcaggagatacagttactgagcaggctgtccttgagaagcaccgaggtgccatcactgtaatcagatactctccagacttttccatgtttgcatcagctgatttgaatcgtgaagctgttgtatgggaccgtgcttccaaagaggtgaagcttaataacatgttgtttaacaccgcacgtattaactgcctagcttggtcacctgatagcacactcgtagccactggttcccttgatacatgtgtcattatatatgaagttggaaagccagcatcaagccgcagaaccataaagggtgctcatataggtggagtatacgggttggtttttattgatcaggaaagagtggtcagttcaggagaggatggttgtgttcgtgtttggaatttgatttctgaataa

SEQ ID NO: 45483 - DNA, 237 bp, Glycine max
  Peptide Sequence Number=SeqID_162261
atgtcagtcctgacacagaagcacgaatatctagctcttagcagtcgggctctaaaccaacaagtattcaattatctacaaagctacacattatctataagggtgtgtcccaaggatgcataccctctgcttagcattgacaggctagtcaatggagcgttcgggttccaagtactaagcttcctggacgcttactctggatacaaccagattcagatgcacgctcaagacgagtag

SEQ ID NO: 45484 - DNA, 185 bp, Glycine max
  Peptide Sequence Number=SeqID_162262
atggcaaacttcttggcagaattcgctaggaacaaccaaaccacctcaaactggtggagcctctacgttgataatgcccccaacatgaaggggagccaggcaagaatcatcctcgaaggccctaatgatgtcactctagagcatgccatcaagctcaactttaaagcctcaaacaaccaacctaa

SEQ ID NO: 45485 - DNA, 288 bp, Glycine max
  Peptide Sequence Number=SeqID_162263
atgagcccggaatgggtttgggcaaggacagcctcaggaatgccgatgtggttgacattaggggtaacccgcacaaatatgagttggggtatgagcacgggagacctggaagaaggaatgcaccgtcaagactctaggcagatagggcatggcccggtcatatgtgaggatcgatcctttgaggattctaacaacgagggcttgataatcgattttgaccgagaagtgagtcaaacgataaacaaagaagaggaagaggatgtcctttcaccggattggagaggttga

SEQ ID NO: 45486 - DNA, 411 bp, Glycine max
  Peptide Sequence Number=SeqID_162264
atgaagatgaacatgaatgtcggagtcctcatctctggacagatcactcttatggctcagtccaactccttgaggctcggatttccatcccttatcactaccttatgcatggcccaaggaacatctactgtaccagctcctattccttcagcaccagttcctgctacttccggtccctccactcagagcacagacctcatgatggtggcctggctaggagtccagccttcttctaatggaggaggtgaggtcttcgcagctcaggagtctcagccagatccagagactacaactgctgctcaggaggatgattcaaaggccactcccccagagtcatttgtacaccacgctggagctgagaaccccgcaaggatcactagcaggcacgcctgtgctgcatttgaccgatga

SEQ ID NO: 45487 - DNA, 231 bp, Glycine max
  Peptide Sequence Number=SeqID_162265
atgcaaatagcagggcaaaaaacattgttcagcacaacttgtgtcaatgggagcccaagcagtggatcatggtctactgtcacagacacggattgctggataaaacaaatagcaatgaataagttgaatactaagttcaaagtcatgaagtgtcaaaatggaagagttgcaagaaagatcatattaaaaaatgagggtcatgatcaaaactcacagattgatgttgggtag

SEQ ID NO: 45488 - DNA, 183 bp, Glycine max
  Peptide Sequence Number=SeqID_162266
atggcacgcagcgtgttcgctccgtgcccctatttaagggacctacaagggagagaacaaactaggcatttagcaataaccccccaaggtattatcctctttgaagaacatattgcagcagtagggactactagcaacaataagttttcaaagagaaaagctctagatgagggttcactgtaa

SEQ ID NO: 45489 - DNA, 252 bp, Glycine max
  Peptide Sequence Number=SeqID_162267
atgcttcctatggtagcgagcttgtttttgactcatcttctccttaaagtggcttcttggaccctatgggctcagcacgtatccaccgctaagtgtagcttcagcgggcttagcgtgacaagggaatctggcagagcacaagaatcaaggccgcgcgctaagcgcgagatcagctcgctaagcaaggtgttggtctatggccaggctgagcgcacggctggcggcaagctcaaacccacttactcgcgttaa

SEQ ID NO: 45490 - DNA, 1971 bp, Glycine max
  Peptide Sequence Number=SeqID_162268
atgaaatcctcaaaacggcggcgtttgaacgaaacgcatgatcgcattcgcaggtcacttcgcttccgccttctcctcatctcgtcgttgcctgagaacactgcggcattggtacaatctaggaatctagaaaatgctttcaggggtgaaattcatttcccgggaccaggtgagtatagctatcgtagttgtatcttagtgcatgatgaggacttggattctgtctcgaaagaaaggaaaaaatcagataggaggagggaaaagaataagaggaaaaggaggagctctagggacagctctgatgatgatgatgatgggcttgagaagataaagaaaggatctagaaagaagaagtggtattcgtcggatgaagactctttgatttacacaactgaaagtgagagtgagaaagatgaaaagaagaggaggaggagagcgaaaaagaaaagggatgatggttcgtcacgtgattctggcgaaaggtcaaaaggaagatcacgatccaggagtggtaaaaaagaatatacatctgaggatgaggaagactcttattcttctgatggtagtgatagtttttcgggtcttaaaggtaagcaccaaaagtcagatagaaaagatgggagtaagaggaacaagatcgaaggtggcacggtaaattctacaagtgagatggaaattgcaagaaaagaaatgggattggattggatgcttaggtctgaaagtaagaagcctgtagttacggaatcagaggaaaaactgtcagaggaggttcctgttgaggagtcaaagaaggcaaatcctaaggaactgaatccatatttgaaggataatggaagtggatacccggaagaaagtggagctaaagttggtgccgaccaacttctatcttcttcccttgttggggatggaggagcaagttggagacttaaagccttaaagcgtgcacaagagcaagcagctcgagatggacgaagattcaatgaggttgtggaagaaaggtggagttctcttggtgagttgactgcagctgttgcatctcatgcagctgccccagctcgtgctcatctgcgtgctataaaaaatagacaaagagggataactgaagaaaattcacaagattctgataagcatggtcgaagggattctaaaagggactacttaaaggatgtttctgttcggcaccatgaaatgaaagcacctaaagttcgagattctttgtcttggggaaagcgaaagagccaacaagtggtagctgagggtgccggggtcatctctgctgcagtatctagcctaaataagtttgccaatgatggaagctttatgcatgattttggtagcaagatgagtaataattctgacggctctgttttggatagtagtgaattagaaaaggtttcgttggaagctaatagacctgaagaaagtagtgcagtagtcaagaatgagatgagtgaaaaccagttggcagctaaggttatgcaacttcgtttgaagggaaagcatgaagaagctgacaaactgatgcaagaagcaaaagttatgaacacaaagcaaggaaatcaagaccattcaattagatcaagaaccgagggaagttctagcaggtatgctatgcagaaaatatctgctgagcagaagaaaggagaggatgatgctgatatgcatcttgctcgcaagatcatgcataacaagcagtttagggcttctactcaggctgatgatgaatatgactttgaggatggtccaagcagaaagagtagaaagaagcaaggaggtgatgatcacaagagtatccaaaagaagacaaatcgattcttgactcagcaagagcgctgcctattttgtttagaaaatccaaatcggcctatgcatcttgttgtttcaatcgcaaatttcacatatcttatgttgccaaagtggcagcctgtggtgcctggtcattgctgcattttaccaattcaggtgacttaa

SEQ ID NO: 45491 - DNA, 255 bp, Glycine max
  Peptide Sequence Number=SeqID_162269
atgaaccacacctgcataactgatgaagaactgaggttcttaaaaggtgttgccctcgtaccacaccgaggagatgccaacctgcgacttggccatgttgtcctcggagagacccacaccatggagcatggcctgggaagtgccctaggacttgggctccgtgatgcggaagttgtacttgttgagcttcattggctcctccatggcggtggagacgtgaacaaagagagagagagagagagagagagagagtag

SEQ ID NO: 45492 - DNA, 366 bp, Glycine max
  Peptide Sequence Number=SeqID_162270
atggattcgcctctcccaccaaagcccttacatccaagttcaccaactccaccgcttttcttctctttaggcctctttcttaatggtggtttggtgcatcatggatgttcatgggttatagtgatgcatgtggcattggtgggtggcaaagtgatggtgggtttggaggtggtgtttgggtgcaaaaatggtgctgaggtggtcatggaggtggtgtttgtagccgtggaggtggggtgcgatggtcatggagatttggggcagaggtggtcatggaagtttgcttgggagagggaaaagaagaaggataaaaaagggatattaggaattttgggggcacatcaagcaacaattagaatgatttga

SEQ ID NO: 45493 - DNA, 561 bp, Glycine max
  Peptide Sequence Number=SeqID_162271
atgtcggttactaaagctaatcttcttaaagtgaaggtcttaattgctgataaagagtatgagagtgctattgctgagtctgggtttcttctcaaggaagatgaaaataatttagaggcattgttgttatgtggctgtgcatattactatttagctgatcatgatattgccacaagaaaggcacattttggattgaaaaatctaccaaaaaagagtaaaagtgttgaagataatgcaaacaagggtaaactatgtgtggtagtggaggaattcaaagcttcacttgctgttgaccctatccatcttgcacacaatgtagatcttcattttggcctatgtaaagtgctagtcaagtatggaagaggaaaagatgccttggacagttgtagtgaagctcttaagattgatgaggagcttgtggaagctcttgttcaggttcactataatcttaaacatcattgtgcatttgtgcttgtttcaacttttaactatagaagactccaagaagattgggtcaaagatgcaagagaagaccctagggttctcatgagccataggtaa

SEQ ID NO: 45494 - DNA, 303 bp, Glycine max
  Peptide Sequence Number=SeqID_162272
atgtggattgaagtgaaaggcaagttcatagaatacaatggcctaaactcaaacaccttgcacaaagttcctttgaagctattgtccttaaatcttacttctccaagatcattttctagatctgtagagatcttgggtgaaggagacctgagcaagaagttgacgttaaaagcccgtgccttttcgacatcagtaaaggagaaacttgagaatgctagttgttccctcaccgaggactttaggttggggacttacatcaaatacatcaacatcacactacataaactcaataatttcctctaa

SEQ ID NO: 45495 - DNA, 528 bp, Glycine max
  Peptide Sequence Number=SeqID_162273
atgtgttataaaagagaaatcaagatagaagctcagacttcagagaaaaacagaaaactggacacagacctgcagcttccaactgcttctgaagttcttggcctattgcatcattttcagcctggaaggaaaaatgcagaaacaattacaccagtcaatcacatgtacactctgaactgtgagttccatacctgtagttctgaaatcctcttaagctgcgcttcttcacctgacacagatattggaagcgctgcaaccaatgcatcaaactgcagaagaaaccaggaatacgaaaaaggtttaacagtgagattttacataaagccaattaattttgttcaagatcaagagcaagtgatcttgttcttactatttcgagatatatcaccaaaagtagaaaactttcctaacaggaaagctcttccaaaaattggccgtatgccgcttgaagtgacaagcacacggtattctttagtaaaaggcgaaagaatagttcgctctgtgcttatcacacggctccgtgagtaa

SEQ ID NO: 45496 - DNA, 2046 bp, Glycine max
  Peptide Sequence Number=SeqID_162274
aatcagtcttcagggcagcaacctcctccccagcctgcagactcggctgttcctgaatcggccccagatagcaacaacggcgtagcagcagcagaaaagcccgatgtttctgcccagtttaaacctgtcaggaaagtacttgacccccctgaagctgaacagtatacagttcgtcttcctgaaggaatcacaggggaagagctggatattataaagcttacagcacaatttgtggctcgtaatgggaaatcttttttgacagggttgacaagtagggaagttaataatccccagttccattttcttaaaccgacccacagcatgtttacgtttttcacttcccttgccgatgcatattcaaaggttttgatgccaccgaagggtttgacggagaagctaaagaagagcgtctctgatatgactactgtccttgaaaggtgtgtgaataggctggagtgggagcgttcgcaagagcaagctaggcaaaaggctgaggatgagatagaacaggaaagaatacaaatggctatgattgattggcatgatttcgtggtggttgaaacaatagattttgctgatgatgaggatgaagagttacctcctccaatgactattgaggaggttataaggagaagcaaggtgacagccatggaagaagacattgttgagccaggaaaggaggtcgaaatggaaatggatgtggaagaggcccagcttgttgaggagggtatgagagctgctagtttggaagaccgtgatgatggaaagcagaatgaagtcagggttaccgaagaccctgaaccaccgatgagaattgttaagaactggaagagaccagaggagaggatttctgcagaaagagattcaaccaagtttgttgtttctcccatcactggtgagttaattcctattagcgaaatgtcagaacatatgcggatttctctcattgatcccaagtacaaagaacaaaaagaaagaatgtttgccaaaattcgagagacaactctggctgcggatgatgaaatttcaagaaacattgttggacttgctcggacccgtcctgatattttcggtactacagaagaagaggtctccaatgctgtcaaagcagagattgagaagataaatgatgagcaaccaaagcaggttatatgggatggccacactggtagtattgggcgtactgcaaaccaagccatgtcacaaaatattggaagcgaggatcaaaatgatgcttctaacaatgaagccaagaaccttctgggtcctgctgcacctcctccaagacctggtatgccttcagttcgtcctctgccactaccacccggactggcattgaatcttcctcgtgttcctgtccaatattctgctcctcatagtggtgcccttccaatgcctccacctagatccatgatgccatctattcggcctgctcttcctcctccaatgccaatgaatactggacagcagtcaattatagctggccaaccacccccaatgcatccatcaattcctatgaataaccatggaattcccatacccccaccaccaggatctcagttcactcctgttccagttccgcgaccttatgttcctctttctgttccaccatcagttatgcctatgatgcatccaccacctttgcctcaaggattgccaccgccaccgccaccagaggaggctcctcctccactcccagaagaaccagaaccaaagaggcagaaacttgatgattctgctctgatccctgaagatcaatttctggctcaacatcctggccctgtccgcatcagtgtatctgttcctaatgttgatgaaggaaatcttaagggacaagttctggaaattacagtgcaatctttgtctgaaactgttggtagtctgaaggaaaaaattgctggggagatccaactccctgctaataagcagaaattgagtggaaagcctggctttctcaaggataatatgtcacttgcccattacaatgttggtggaggtgaaacacttaccctcaccttaagagaacgtggtggtagaaagagatga

SEQ ID NO: 45497 - DNA, 673 bp, Glycine max
  Peptide Sequence Number=SeqID_162275
atgtctcacaaagaaaacaagaatgccattgagttccttgatgaacaagctttctattatgacgaggaagatgagcaatggtttaaggaaaaagatgatcagtggacaaagaacataccatgctacaaagaagacgcggcaaaagtagtcttgaattcaatcgacttcgattttgacatgcaagatttagatgagttcttgaaggttcttggcactgaagattcttcccctgagagagttcctgatcctgttgttcctgttactcctcctatttctggacgggttcaggttccttcccctccgagagttcatgctcctacacctcaaaggatttatacttttgtcgatttggtttctgctacatttgcccctacagctcgggttcttgcgtctcaggagtcaccggaggagacattcaatggcattgcatttggtcaggggcaagaagctggctcattacctatattgccactccctgctcctccctctgatggaaatctaggtcctctccctgagtctcaagtgattgaggaggagcagaacaaatcaaattctgcttctgttccggcgccggcaacagttgtcactcacaccagaacgattggaattatacatccgcctccggatattaggaccattgttgataaaacctcccagttcgtggctaagaatg

SEQ ID NO: 45498 - DNA, 1047 bp, Glycine max
  Peptide Sequence Number=SeqID_162276
atggcatttttgtggtcatccaaaagattcaccacccccaacctcctttccctcccaaaatattcatcagcatcccttccaccttcaattttcgaccaccatcactccatacccacccaaatccccaatgggccttcagaaacccacaagtttgccttccacacggcccaacctcgaccaacccccgacgccgaagcaatctgcagaatcctatccacgacccgcggtttcaccgtcgacgcctctctcgccgccgtttcggcgaagccctcgccggagctcgtcctcgaggtccttaacagactcagcaacgccggcgtcctggcgctgtcgttcttccgttgggccgagaagcaaagcgagttcaaatacaccactgaagccttccacgccttgatcgaaggactgggtaagatcagacagttcaagatgatttggactctggtcaacggcatgaagcaacgaaagttgcttacttctgagacttttgccctcgttgctcgacgatacgcgagagcacggaaggccaaggaagcaatcgagacgttcgagaaaatggaacagtatggtttgaagccgcacgcgtcggatttcaataggttggtcgatgttttatgcaaatccaagtgtgtggaggaggcacacgaggtgtttgataaaatgcggcacttaaggttggaccctgatatcaagtcctacaccattttattagaagggtggagtcagcagcagaacttgattaaagtcaatgaggtgtgtagggagatggaggataaagggtttcagcttgatgttgttgcgtatgggataatcatgaatgcgtattgcaaggctaagaaatttgatgatgccattggattgtaccatgagatgaaagctaagggtttgaggcctagtccccatgtgtattgcactttgattaaaggtttgggttctcataagagattggacgaagctcttgagtttttgaagtatcaaaagctagtggttttgcaccggaggctcccacttacaatgctgttgttggggcttattgctggtctttaa

SEQ ID NO: 45499 - DNA, 420 bp, Glycine max
  Peptide Sequence Number=SeqID_162277
atgcctcatgtttctctcaatctcgttttttcctcttctcctctcaaaactctctctttttcttgcataccaccaaacctgtttcagaaaaataacgatcttagacttattcaccattggattgtcgtgaaatttaagcacaaggttcgaaactcaattctgagcagtctcatcgttgggaattacgaaaaggtgtcagaactgagagaaatactcttcacattggagaaagatgcattgcacataggaccatggaatggaggcttcaattccttttccttttctctaacgtttaggaaccctaacagagcaaccggaggagaagatctagagagcaccagaaatgccacaattgataatggagaacgcttgagtgactacatcaaggtaagggatgagttattcacaattggggattag

SEQ ID NO: 45500 - DNA, 288 bp, Glycine max
  Peptide Sequence Number=SeqID_162278
atgggggaagttattgaagaacaaaatcgtgatattcaattaaacccccaacggctgaccccttccacggcaaaatcaccatattggcacttacctgaggggcgcgttccaccagaatgtgacacgtggtgtggcttgcaggctttggaaagcggtgctgactgggttggaagcgccctgcacgcaggcgctaagggtcgcgccctgcacgcaggtgcgttgacccgtggccttccccgaggcgccttgtttcgcgcccttgccccaggcacgtccagacgcccttaa

SEQ ID NO: 45501 - DNA, 801 bp, Glycine max
  Peptide Sequence Number=SeqID_162279
atggatggagtcagagatatcactaatggcacttgtccaaggccaacagtaaagaaaacacatgtttatctgtcccatgttttctcttctgttagtagagacctcaatttcattgatcacactggtgaccttggatggaaagagagtgataggttccagccaattgtagttgacccgggactatatttagcaaggaaaagtcaaatttttcaagctacagaaaagaggccaacgcctgacgcgttcaaactctttacaggcaaatcttttctctcatgccatttgtgttcaccatgggtcatcttgagccggccctttctggagttctgcatttttggttgggacaatttacctcggaccctactgatgtattttacaaatgtgaaattatctcaagaagggtattttcactcagttgtttgcaatgtgccagaatttaagaacacgacagtaaatggtgacttacgatatatgatctgggacaatcctccaaagatggaacctcacttccttaacgcctctgtttacaatcagatggcagaaagtggggctgcttttgctagacagtttcaacttaataatcctgtgctggacatgattgatgaaaagatcctccaacgtggtcgccatcgagttactccaggagcgtggtgcaccggacggaggagctggtgggtggatccatgctcccaatggggtgatgtcaacactgtgaaaccaggtcctcaggctaagaagcttgaagggtctgtttctaaccttcttgatgaccagaactcacagaccaatcagtgccagtga

SEQ ID NO: 45502 - DNA, 519 bp, Glycine max
  Peptide Sequence Number=SeqID_162280
atgcctcaaaaatgttctttacgatgccattgggatatatcaacggtggttgaagtggaacgcattgatattggtgaacccgagaatactggaatcaaatctggttctaagaggtcatttgatcatctaaatgaactgcccattaatacctcaccagatgctaaaaatgaagtcgaggaacatcaagatatagatattcatgacctttttggcagcgaaacacctgaggatgaccataatgttgaagaaaaagataatgttggatttgacatgaatgttccacacactgatgatgagatcgccgacgtggatgatagtggtgatgaggtggacaaaggacccaatgctgcagaagctctcgaagaccaggtgaatgcactggggagggatgagcagacatctacttctagcagcagtagtggtagtagcagtagtgaaagcggaagtgaaagtggtagtgggagtagcagcaatagtgatagtgaaggcagtgatgaggactcggttcactcaatctga

SEQ ID NO: 45503 - DNA, 1062 bp, Glycine max
  Peptide Sequence Number=SeqID_162281
atgaatatgaaaagctacatcgaagatgttaagggtatgtttagaagtcaagttttggaaggaaagcatagatggactggtcgttatgaagcacatctttgggacaaaagtacctggaaccagaatcagaataagaaaggaaagcaaggggcatatgatgatgaagaggcagcagctagagcatatgaccttgctgctctgagatattggggtccgagtgctctcataaactttccagtgactgattatgcaagagatcttgaagaaatgcagaatgtatccagagaggaataccttgcatctttacggaggaagagcagtggtttttcaagaggactttccaaataccggggactctccagtcgatggaatccaacatatggtcgtatggctggatctgactacttcaacagtagatattatggtgaagattcagctgcagaaaccaaatatctaagtagtttctgcatagaaagaaagattgatttaacaagttacatcaaatggtgggggtcaaataaaagtcagcaacctgattctagagtaagattttcagatgttagaaagcatggttttgctggagatttttgcattgaacacaaaacattggaacaaaacgtccatccttcagaaccataccagttgctagcattaggcatgccctgtgaaaggatcaaacatgaacattcttctgtctcggctttaagtattgtgttacaatcagctgcttacaagaacttgcaacagagagcatcaacgagacaggaaaatagcaattataatgacgagaatgaaaataaagataccatcatcaataagttggaccatgggaaggcagcagagaaatcattgaataatgatggtggcaatgaaagacttgacattgcaatgggaatgagtggatcgctgcctcttcaaagaaatgtttacccaccggcatcgttattgattgctccacttttgactgcctacaacactgttgatccatcggtagatcctgttctctggacgccacaggttcctatactttcggctggcctttctggtgtagctgaggtatag

SEQ ID NO: 45504 - DNA, 490 bp, Glycine max
  Peptide Sequence Number=SeqID_162282
atggggaaatcaagggacaagcctatgtcgattgtcgctctttatgctgctagtgaggggaaaaaggtcgtcaatattgattataacatggatttaatcggttctagtttggtgcctattaggaagttcaatggtcctccttcgtggatgtctttgggcgaagagattgatcatgttattttgtcggaatattgggatatgattcagaagagtaaccatgccgagttggattcaactatctcgatgttgataagggctgttgaggattctttcaacaatgcccttaagcaggttgagtttatgcatcctaaagttcatccaactcatcttggagcttcggggatcgtgaatgaatattttgtgggacacgaaactcctgatgaagagatggcttatgggtttattgataccctagatgctaactttgatgataaaatttctaggacttctaatgctaatgccgacctgagggatcttaaagggcccatat

SEQ ID NO: 45505 - DNA, 300 bp, Glycine max
  Peptide Sequence Number=SeqID_162283
atgcaagtgttgtgtatggtgtgtattttctacttacatttttacctttcccatttgtctattcatgtcctatcgagtctcttatttgagggtattctgggtttggtctcattcttgaagatgtcttcccaaaagatcagtttgaagggatcatttggtcgtggtgccctcagccattctagaaaccctaagaattctccaattgctagtgatagaggtgggggtggcaggaatttttgggacaatgaggatgcgactgagaggggaattgagttgtgtcctcgaaggcatttgaattaa

SEQ ID NO: 45506 - DNA, 441 bp, Glycine max
  Peptide Sequence Number=SeqID_162284
atgatgcacaaaaagggaaagaaatgtgtacttataagcaaaagaggaaggaaaaatgtcaaatcaataaagaagccttctgttgggaatcgcgatagttacaagaacaaagataaaatgtggagaggtgttgaaagacacgttagcacattaattggagccaaagttgaaaacatagaacaatttgtgtttcaaaatagctccaatgtgaagtacttaacaaaggatcatgataaggaagcccaaatctcaaaccaggcttatgaggataaagaatcaagaagaagtggagcaaaaaatggagcaagggcagtcatttataggtcaaggcatacgaccaaaattgacacgcaaaatggcaccgaccaatcaacaaacaagaaaattaaaggaatcatcaatgaatgtcggctgcaatataggagattgttacgcagataa

SEQ ID NO: 45507 - DNA, 117 bp, Glycine max
  Peptide Sequence Number=SeqID_162285
atgaaaaatgagctcttggttgctgcgcaaaccaacattcttcctcagacctgcaaaatgggtgattctattgcaaaacaagctcatgtagttgggattccaattctgctatattag

SEQ ID NO: 45508 - DNA, 189 bp, Glycine max
  Peptide Sequence Number=SeqID_162286
atggaaggtggtgtttggtatcggatatgtgcgcagacaggctttgtggctgatttaggggtggcctttgtggatgattggatgttcttggctgatagggtggtgggaacggtagtcacaacatgggttcctccttccttcttattctctccatttgccccaggcttcttattcatcaaagcaggataa

SEQ ID NO: 45509 - DNA, 265 bp, Glycine max
  Peptide Sequence Number=SeqID_162287
atgctgcccgactatctcgtcccggctaagtaccacattacgcctgtggaacagcaaccgatggaagcagaaaaagaggccagtttcactcaggggaaaagaaagctctctgatttcgagcctgatatattaattggtgtttccgacagcggcaaatcccgtaatatgttgctggaagagcacgatcgccatataaaagaccgcttatttcgtgccatgaaaattgaagccttcgtccatctgctgaatgacctgcaggccgaag

SEQ ID NO: 45510 - DNA, 452 bp, Glycine max
  Peptide Sequence Number=SeqID_162288
atgcaggagttcaataaaacgaaagtgtcgaacgacaccagtgaacccccgcaaccggaacgcatgacaaaagaggaaggtgaagaccatttctctgttttgatgaactccgttacgcctgtctggtactggcgggctcagcgtcgctgtagcgacctcaattcagccgtgtataaatattacgacaatatcaaaaagcgctgtcttaacggtgagaaggtctcttattccgacctggacgtattaaatttgcgccagtgttttcgtgagttcagtctggaagcctacccggagctggtggcgctggtctggccggaatatgcccgtcctgaggttaaccccgacaacgactttatggaacgcttttttgaaaacgccatgtacgcctctcgctggatactggcccccgtctattttggcctttcgctggcccttatcgcgctgtcgattaa

SEQ ID NO: 45511 - DNA, 300 bp, Glycine max
  Peptide Sequence Number=SeqID_162289
atggcgggagatgcatcaaagtttattcatatttctcccaaagatagtgaatatgtgatctatggagacaacaaacaaagaataatcaaacaaggttgctttcaagattacttcaacaaacattcaaaggttaagcattgcttcaagattaagacaaggttgctccaacaaataagcattgcttcaagattcattcaagatcagctttttcctcaaaacacattgtttccaacatatcaaggctctagtaatcgattaccagaagacaagtttgcaaatcaacttcttaaaagggtttga

SEQ ID NO: 45512 - DNA, 358 bp, Glycine max
  Peptide Sequence Number=SeqID_162290
atggaatcgacaaaagaggtagtcatgatattgcacgagattagaagacctaactctctaaaaacagtccccagtggagtcaccaactgtcgcaacctacccttcgacgggagggcgacgtggggctcacgggtgcgtcttccaagggaggaaggtgcgcggagtcgccaccaatgtttattcgaggaaaacgtcggaaaaatcggaaaggtgtggtctacgaactttgagtgtgaaaggagacaagagggaggtggttgccgcccaactagcccaggcgagctcagctcacccaagagagctggattgcttctaccaaaaggcaccatcttctgttggaaccccctggaaggcccaa

SEQ ID NO: 45513 - DNA, 573 bp, Glycine max
  Peptide Sequence Number=SeqID_162291
atgcataaggcattgcgattaaatgctccactaccatatccacagcttgtcactctctttttccgccattttcaaattcctcttgattctgaaccttatgttccaatcaagcgatcttttttaattggtgctgctatgattgcttcttttggttaccacaaagagcgtgatggctcttgggtcaaaaagggtgttccacctgctgatgatgaaggccacataccagttgaagataattccactcttcttcaaaggcttatggacaagtttgatgccatggaattgcaagttgacatgcggttcgatgctatggaatcaaggatcactagggttgaagaagatgtctccttcatccgaacttgctttgatccaccaccaccgcctcctcatcctcttagattatatttctttttgatgttgccaaaaggggagagaacttgggagaacacatatgggtattgtcatcatcaaaaaaggggagattgtagacaaaggatcaagctgaatgttttgatgatgccaaaggattacatgaatcatatgcttctcaaagatttactcaagacaaagtaa

SEQ ID NO: 45514 - DNA, 342 bp, Glycine max
  Peptide Sequence Number=SeqID_162292
tgtccttaccaaactcgtgctagagctagagtattgagtgaagtagaggaggtgcaagaacagatcaaggctgacatggaggccatgaaagagaaaatggccacaatgatggaggccaatataagcatgaaggagataatggaggtcaatgtggctgcattgctgagggatggcccccatgatgtgcaaattcaaaacaagcatgccttcccgccatatggcctgcctcccaactgtacaccacccaatgtggcgtacactcccagtgagaatgtcaataactccactcctatacccattgagagccaacaaccccaaattgatcatgcacatgtctcttaa

SEQ ID NO: 45515 - DNA, 996 bp, Glycine max
  Peptide Sequence Number=SeqID_162293
atgcgtgcagtttcgcttgaaggtaaatccattgatgaatatctgtgtaaaatcaaaggttatgtcaatgagctcactggtgttggagttccggttcaccatgagtatgttgacatgatacttgaaggcctttcgttcgattacacgctgatgatctcagttattgagagcaagaagcatactctgtccattgccgagattgagaccttgctttacggtcatgaaactcatattgtttgctacaataaagaaactcaagcactaagttctccgttcttgaattacactcaaggctattcacaccccaattcatacaagtctggtgattctggtggctctaggggagcgtatggccgcggcagtggtggtcgtggtggttttcttgatcgcggtgccggacgtagtggtggtgccttcgcagaggtcgaggtggtggctgatttaccaattttcagtgtcaaatctgccttaagtatgaccacactgcaaatgtttgtcacttccggtttgatacgttcccaattccaagcctgctgttccagcatcaaatcaaccaatgctatgcttaccaattcctcctctcatggaaatggtcatcctagttccacctggataccagactcttgtgctagcttccatgtgattggtgaatcacaaaatatcaagcagttcactcactttgatggacttgatcaaattttcgtaggaaatggtgaagcttcaagacaaccttctctactgttgtctacttcaacttcaacttcagacaactatttgtctaatgtagctcctgttgtcaataaaaatgttagtgtagcttcgaattctgtaatctcatctcctagcaatgctagtctttggcatgctagacttttgctccttatgctgtatgggaaagtctcagattgtctcatagattgctatctaacacctctacttctgtttaatctcctttggaacttgtctacacagatacacttggatatttcctattaa

SEQ ID NO: 45516 - DNA, 726 bp, Glycine max
  Peptide Sequence Number=SeqID_162294
atggtgaagtcgctttctgaacaaagcgacaatgcgccggcagaaatgtgcgtgcagaacctgtttggcatggagaaacaaggcgtatataggagcatggctcgtcgtttggcaacactgagaccactaacgtgtagatcgtcgaacagcgagtacaacggtgtagtcaccagtcagaaagatcattggaggatggtggcagttgacgaaaaaggagcagctagtagaagggtctactggaatgcggaaaacaaaggaaagaatcatcaacttcttcacttcattcaggatctacagattccgaagggttttgcgacgatcgcgtatcaagatgtcggtcgagtcactaaagcttatcgtgcctgggagcaacaggatcaattgatgctctcgtggcttcaatctattatttcagctttgattttgttcatcagatgcacgagttcgtggttcttgtgggatgtggatttacttttctttgataaagtgagaggaaatgagagagagattggagagaaaactgatattattcactctgaaaagtcagttacagaattagttataaagaggattgtgagcaatggatacagcactttagctgtcacaataaagaacaagaatagtgaagggagcttgcaattctaccaccaagatatcaagtttgggccaagaaagatggcagcccctgaggttgaagaagtaatccatgagacaaggtacaaatga

SEQ ID NO: 45517 - DNA, 1794 bp, Glycine max
  Peptide Sequence Number=SeqID_162295
atgttggacctctattactttcgtatcagagaagtttctcaaatcaaaaagccagggattagtcaggatttgctggcttgtgcttatgaactgtggggattgctacctagcttttgtcgtcatgcaactgatactcaccaacattttactcgtctctctgatgtccttgttacttttctcaaaaaggatccttctatgcatcaaaatgtttccacggcattacagattcttgtgaatgaaaacaaagctgcacttatccctaaaaagagtatggaagattgccatgctgaatatgattttttgtcagagtttggcatgcaacctacttattcaaagaaagctgctaccaaaaacataaagtctttggtgtcttgttcgaatcagttgctttatgttttgtcagatttatttatcagttcacttcctgaaacacgcttttgtttaaagggtgcaattgggtgccttgcttctgtcactgattcttctgtaaccaaagaggtttttgtgtctctgcttaagagttttcaatttgtagattgtgaaggtgaaggtgaaatattgacaagtccagctggagtggtagatagtgatcaaaatgacttgaagggatattctcagaggtgtctgatattggaattagcatattgtcttgttcaaggagcaaaggataatcttattgagataatttacaatttcactatacattcatttcaggcaactgatgagagtgttcatcacgaagcatacaacactctgtgcaaaattttagaggagaatccatgcttatcttctgctcggtacatcgagctaattgatttattacatggcttaaaacctccaacctctattgcatctcttaggagtcgatatgcttgtttccacatgctgatggtgcatgcagtgaaggttagtttagaagaagaggagaactcaaaggcttttcttattcttaatgaaatcattctcacattaaaagatggaaaggatgaaaccaggaaggaagcatatgattacctcttaaatataagttctaccttgagagactcatcattcattggttctattgaaccgtatcacaaactagttagcatgataatgggatatctttctggttcatctccccatataaaaagcggagcagtgtctgcgctgtctgtattgttatacaaggatacaaatcttcctatctccgtttctgatcttgtcccttctcttttatctttgctgcaaacaaaagatgtggaaatcataaaagtcactgttatatttgaaatattattacggaagtgtggttctgctgctgtcaaactggttaccccagagaaatataaggtttttctcaagacagttctagagaatcgacatggcaaatcaagtgaagcagtcactaatgatacaaaaaatatgcctgaagattcatctgccaagagaccagagcggaggaagcctgaaaattcagataacctagagaaaaattcacttaaggacaacaagagaaagagggacaagaaatttgagacagacatgcctggccaaaaggggtcacttatgtctactagtaatgatggattaagattacccaagagaagtaggtattctaacgataaaaatcctaatgtaggaaggccagaagaaagtgaaaaaggcaagaaaagttggaacaagagtttcactggtggtggtgggaagagaaaggtgaaggtaacaagtacaggaaaggataaagcagcttctcatgtacctatacaaccttccaagtctcacaagctgcaaaggaaattcaaaagaaattga

SEQ ID NO: 45518 - DNA, 1323 bp, Glycine max
  Peptide Sequence Number=SeqID_162296
atggaagacgaacacacagagccattcaaggacggtgcggacctctgccagcagctcatggaccgctacgccaactccgccgcgccgcagcaccgccacctcctcgccaccgccgccgcccttcgctccaacctagccgtggagcgcctccccctcacgccgcctgcctacttcgccgccgccatctccgcccttgacgcagcagaggcggcgctggatcccgttgcgctctccgctctcgtgtccttcatggccatcgccctccccctcgtcccgcccggcggcatcgctgcgctgaagtcccacgaggcggccgcgatcctcatcgtggcactggccagggagggggagggagtgggcgtggcgtgcgtgagggccatggtgaagtgtttgggggttttgattgggttttgtgacttggaggattgggatggaattagattaggttttgaaaccttgctcaagttctccatttgcaagcgccccaaggtacgcagatgtgctcaagaatctgttgagaaggttttcaagtctatcaaatcctccacagttaccaaggaagctagcaagtttgttttgtctgagctgaaaagttgcagtgctttggcactgaaattaaatgctttgagcacttctgatgaatgtaaagaagataaggttttgaaacatgaacacctggaggtcctacatttactgaatttaattaatctgattgctccatatctttctgcagaagtcattctgaaagttctttcagaagtgcgtaaattatttagttttaagttttcagaacttgcaaggcatgctcttaaaactattaaagctatttttgaagctttgagaatccaaaatatagtgctagagacagaggacattgtagtctctcttgcttcatttgtatctttgggagataggaaccccttggatactgtgatttttgcagcaaaattattaggagttgcaatggacttactttataacggacagtcaaacttgtggatcaagaatctccctccagtttgtagatctgtgatgggtcttctagcttttgaaggaaacactgcatcacaggcttcaagtattttgaatgatgtgctcaagcatcatgttggttccttaagcttgttaatgggcacagatcaaacatttcatgataattgtcgggaaactgtggaagctaatgcaataaaagcaacatgtgcagtttttgagaatgccctttctgcctctgatggaattccaaatgatcatgttatctggactgaacaagggtgccatgttttagtagaggttgctcagcctcagtttaatcagttaacttaa

SEQ ID NO: 45519 - DNA, 732 bp, Glycine max
  Peptide Sequence Number=SeqID_162297
atgcaaaactgtgatgacaagaaagagaatgaggaagagaagagtgttggactcaagaagaaagttgttgaagagaaaggtattgatggaaggaaaaatgatgtgagaggtgaaaataatcaggaaaaagagaaacaaataatggtcaataaaaaagaattgaatgaccaagaaaaagaaaaagaagtagaaaaagaaaaagaaaataaaaaaattgaaaaggatgaaaaaaatgagaatgaaaagaagagtagaagtgaaatggttgtgaatgaagctgcggaagtaccatattatatggtaccttccaagaaggagaaggaccatcatttggtgagatttttagatatttttatgaagctggagataaccacgcccttcgaagaagccttacagcagatgccactctactccaaattcttgaaggatatgttaacaaggatacataagtacattcaccaggaaaacattgtagtggaaggaaatagtagcgctgtgattcaaaagatccttccacctaagcataaagaccctaggagtgtaactattccttgttcaattggagaagtcactatgggaaaggctcttattgacttgggagccaatataaatttaatgccactctccatgtgtagaaggttgggagagttggagataatgcccattaaaatgactttacaattggctgaccactccattactagaccatatggagtaattgaagatgtgttg

SEQ ID NO: 45520 - DNA, 465 bp, Glycine max
  Peptide Sequence Number=SeqID_162298
atgttcttgtccctcgtcatcacgttggaccaacaacgaggaactggagcagcttcttgcgaatgtgcccaaattaacaattcaaaagagcccagagaatggagggaaatggcaaacatgatgcagaatgtcgcggctccaccaaagattttttttcatactgttcacgctagggaccagatttttggcgaagttaataagttgtctgcccagatcattcccaagatgactctttataccatcaagtgtcaggttctgtcaccttcaaggtttatctcactgagcagaaagttacttgtagccgtctggacgttccaagtaacatgtattattttcttaaagacaaaggttaaactcatttgcacttggagaacgttgcagaatgccagcttgtgttccatcattggaggaagacacttaaaattggagttgtatggaaacatttatgcgaaaccttgtccttga

SEQ ID NO: 45521 - DNA, 540 bp, Glycine max
  Peptide Sequence Number=SeqID_162299
atgttcttggaaagcaccatcttagacttgcccgacatgaaaccagctgtctcgtgccctcactcactactggactacgcacataaccttcaaccctccttgagccgccgttcagtaaccgccgttcaatctacacctttttctagatggggtgatttagtgttcttccagaacggaatgatggagccgtggcttgagagcaaaggtttggaagatgcaaaccaggtgttggcttattttgttgtgtccaaaattggagaaacccctattgatggtaggactgataccaatcctgaacgactcattgctgcatatggcaagtgggcttctattgtagctgctagattaaatgttggaggcctctcttgcaaggttcttgacaaggaggtgtttcaaaagcagatgttggagaaacgtatatggatttgttccgttatgcttgttggagcaactcatggaggggtttcagtaggtgccgtggacattgaattccacactgaagtaagctttgcaatagacatattctcaaagataaaatga

SEQ ID NO: 45522 - DNA, 207 bp, Glycine max
  Peptide Sequence Number=SeqID_162300
atgggaaccagcatcacgctttctgagttcaaccattgcagttttgactatggccttacacgtgatgagacgttcacccttctcactagtcccaaggcgttttgcttaggaaatgcaattcaatgccatggcagtaatttctcctcctatgatcgctccgacggtcgctcgctcaaccgcgacgacagcaacaatgaaggctcatga

SEQ ID NO: 45523 - DNA, 218 bp, Glycine max
  Peptide Sequence Number=SeqID_162301
cgccgccattggctgcttcccttgtcggcattgaggacctgcgccttcattctctagttccaccatcgagagttataggaagagtcataggaagagaggataatcgtgatttagatgatgttttccaacggcgaaggcccacaacatccgcacgtagacaacaggaagttattgttgttgctaaggatgctcctcacggggatgacacagctgaagag

SEQ ID NO: 45524 - DNA, 360 bp, Glycine max
  Peptide Sequence Number=SeqID_162302
atgggggtagggaatggccatgttaatgttaatgggtgctcgaaaaaggttgaaacttgccacgccctgaggtttaaattgaatggaatcaagacaagagagaagatagggggaatttacgtgtttcgcgcggtcctggcctgggaaagagacacagagtcagagagagagagagagattccaccaacacaacgccaaggaagaaacgcagccaccaaaggcatgcagcatcgagtccctgctccgccgccaccaaccatggcggagcatcactgttacttttgctgcctccaccagccacaaataagaaagggaggaggaggagtggatgagaagaaacaacacttcaacggaagctaa

SEQ ID NO: 45525 - DNA, 315 bp, Glycine max
  Peptide Sequence Number=SeqID_162303
atgggaaattctcagacttccatacaagacagaatgggattacttcaggagcccataaacagattatatgatgttttgggggagtacttcactccaaccacaattcacagacttgctgggttagtgacggtaatggccagaacatcctccaacatcccaactgagatcagaagtgatgaagggattgtttccactgaactgactgaagctgctttagcttttgcagctagttctcctgttactgctgctgctatccctgcaatacaatcacacactccagcctctcagttgcagggaaatgccatatccgtttag

SEQ ID NO: 45526 - DNA, 327 bp, Glycine max
  Peptide Sequence Number=SeqID_162304
atgaaggccttttccttcagtggggtttggattttattgtttctgagctcggtttcagctttttctccaactgggtcgattcggcatcccgtcaagtttatcataggagaagaagaggagaatttgggttcatggaagagtgaattcacacaagtggctccagcaccagggcctaaaggtgacgatgttcttattctggcggcaaacaagaccaataggcctgacattctgcgaggattccgacgttatcgaggtggttgggatattgcagatcagcattattgggctgtaagtgccacggttacttccttgaccatcgtgttttaa

SEQ ID NO: 45527 - DNA, 213 bp, Glycine max
  Peptide Sequence Number=SeqID_162305
atgacgccagttatagtgcaaagcaatgaacgactcggtgttttgatccggaaaacaaaagataccaaggaaggagggcaaaagggtcttttccttgcattttctaggccagcatttggctcacctgggccatcaaacaacttcaagggtaaggaaccagctcgcctgggcgagctcatgacttctggactaagcctttgctcgcttgggtga

SEQ ID NO: 45528 - DNA, 345 bp, Glycine max
  Peptide Sequence Number=SeqID_162306
atgcaggttgtggctccaccaggaactatcttgatagttgagcagttcatggagaaggtagcctggctaggaactcagccttctcttgtgaaggaaggtagaggtctcagtgctcaggtacctcagcaggtacaggatgcatcttcagaggccaccatccctgagccatttgtttttgaggcaggagggacactggtagggcaggaggctgctactccagagaggtcaccacagatttcaccagatccaccctcgccagtggaccctgccacaccagtcctgggactgactaccacttcttcagccactcctgtgctacattttacagataaggagggcacttaa

SEQ ID NO: 45529 - DNA, 297 bp, Glycine max
  Peptide Sequence Number=SeqID_162307
atggacagagccaggttggttatgggcttggtaacccacatggatatgaacattggtgccctgatctcagccttgatcactgccctctgcagagctagaggagttacctctgacagtatgacttatcagagcctgagtctggccattaacttggcctacattaggaaaaagtgttggaatgtggatgatctgacagttaactttagaggggcaaggaaggcaagggctcggccagctgatgttccttcttcttctactccaccagctcctccaggcccatctgcccaggacttttag

SEQ ID NO: 45530 - DNA, 618 bp, Glycine max
  Peptide Sequence Number=SeqID_162308
atgcttgagcataaaccaatgcatgagtttcttctacgcatcaaatgcatagtcgatgtgcttggattgtatggagatcttgttcttccatgtgaacaccttgacacagttcttgaaagcctaccagaggagtacagtctagtgatcatagtgattaaaagttacatttcatcttcaaattcttacaattcatccttgaataattcaaattcacaaaatcaatccaattattatggaaatcgtggtgtattcaatcgtggcggtggctacagttgtggaagcaatgactttggccttggtagaggtcgtcatggtggcagtagaggccgtcgttgttatgcaaattttcagtgccaagtttacttcaaattgggttacataacagtggtgtgtcatttttgctatgattctaattttcaaccaaatgcgtctctcactctgatggaaccagtgtttcaaagaaattcatcgatcacctttggtttagaactgaatcaaggaactaattctcataaagacttccaactagtgcaatgttggttaattatgaaaataaagatcctaactctactacctggatacctgattctggtgcttctagtgcatccttccacgtaa

SEQ ID NO: 45531 - DNA, 372 bp, Glycine max
  Peptide Sequence Number=SeqID_162309
atgattatctgcaaagttctatatattgatgcaaatttgaaggaggaacttgcaaggaaagagtgccaaatagaaagggtaaggtggatccaagtagagccaaatcgtaggagtatctataaacaccttcatgtgaggagcctcagtagaaggtatctcaaaaggtgtatgatgcaagctccattggatcttgtaggcctaggatcttcttcatcaatggattcctttgcttcttggaagatgaatggcagcggaatggagaaagggagagagagagaggagacgcctcttcaaggagaagatgagtctagaagaagctcaccaccacaggaggccatggataagagcttggaggaagaaggagatgaatga

SEQ ID NO: 45532 - DNA, 237 bp, Glycine max
  Peptide Sequence Number=SeqID_162310
atgtgtgatgccttggtatatctcaagaatgtaaatgttacatttcaatatgagaaggaaaagtataacatctttgtagatgtgttgagggattacaatgctaaaagaattaatgtggagagtgtcagggatatcgtgaagatcctatttaaaggacaattcttaccaaaatctgaaaccgtgacatgtcagggtgatgtggttgagtgggatcccgaacttcacatgtcatcttga

SEQ ID NO: 45533 - DNA, 576 bp, Glycine max
  Peptide Sequence Number=SeqID_162311
atgatagaagtttctattgaagccattgcatcccttactcaatattatgaccagccgctaaggtgcttcacgtttggggactttcagttagtaccaatcgtagaagagtttgaagggatcttgggatgcccattaggaggaaggaagctctatctgttttttgggttatacccctccatggcaagagtagcaaaggtggtcaagatctcgacacaagaattggaccgagtgaaacaaaatagaaatggggtggatgggataccaaagaagcacttggaagagaaagcgaaagctttggcggatcaaggagagtggacttcattcattgatgttttagcactgttggtgttcgggttcatcctctttccaaatgtggatgggctagtggatctagcgacaatcgatgtttttcttgcttatcactatagcaaggaaagtcccgcaattgttgttttggccgatgcctacgatatgttcgatcagagatgcgagaagagcagcgcgagaattgactgttgcacacccgctctttatgtatggctggtcgctcacatttttcatcatgaaagtagacct

SEQ ID NO: 45534 - DNA, 480 bp, Glycine max
  Peptide Sequence Number=SeqID_162312
atggctaaaggtggcctcatgtcttttagagacttcatggacatgttgtcaaaatcccaaccccgtaagcttcttgcttcttcgttgtcgcctggttggtttcttcgaggcaaatccttaaccttcaaggctgtcgaaatcccaaccccgttgttgtcttgtttgggtctcaaaggtggcgatagaaaaacctcgttgttgcctgaagcacgtcgtcattggaactattcccatggaaaaaagttactcatcgctccactggtgacatcatggactgaggataatctagggaggcatttttatgggtgtgttctatacaaggttacaggtagaaaagggtgtaactattttgagtggcatgatccacttgggaacagttgtgagaagaggatcattgtagcattgatgaagaaggttgatgaattgaagttcagggaaaatggtatgtgttttcttgttggtgtttttattatgcagtaa

SEQ ID NO: 45535 - DNA, 129 bp, Glycine max
  Peptide Sequence Number=SeqID_162313
atgaagccagagatgtccttaaagatcaaagaagaggtgaaaaaggagtttgacgctggctttctggcagtgacccagtaccccgaatgggtggccaatattgtgccggtccttaagaaggatgggaag

SEQ ID NO: 45536 - DNA, 303 bp, Glycine max
  Peptide Sequence Number=SeqID_162314
atgacgaagccccccgagaccattcaagctagatctgacgatgagtcctgtgaagcaaacaaagctgaggatgaagaagatgaagatacggggttttccctggagctggaaaggatggtcactcaggaagatcgagagatgaagccgcaccgagaagaaatggaaatcgtaaacttgggtgttggcgaggaaaggaaagaggtaaaagtgggtacgggcatgaccacactgatccgagataaattggtggttaaaactaccaagacattttcgcttggtcataccaagatatgcccggtttga

SEQ ID NO: 45537 - DNA, 198 bp, Glycine max
  Peptide Sequence Number=SeqID_162315
atgaaatcgcaagggaaatgcaaacggccatatcttttgactcaaatatgtccgattccggagcataatatatcgagatgctcgaaattaaaattgaaagcgcaaggcaaattcaaccggccatatcttttaactcggatgtccgattcaggcaaacaatatatcgagacactcgaaattgaacaacggaagctctag

SEQ ID NO: 45538 - DNA, 285 bp, Glycine max
  Peptide Sequence Number=SeqID_162316
atggccacagatccgacgtctcctccacagtccggtggtcaatcagaggcgacttccaagaggagtagaacaacgacacggctgagaacattgacattaagaaccgtggatcagcccagaccggctgtttatgtggatcccgctaccgggagagcatccggaccgatgcgtgaaaagttccacagctacctaggcgtagtggcgcgagaaaaggttcccattatcaacaataattggaaagacgtacctgaaacgctaaaggagattgtgtggaatgacattcta

SEQ ID NO: 45539 - DNA, 600 bp, Glycine max
  Peptide Sequence Number=SeqID_162317
atgcccaactcaagacatcttcagccaagcaaaataaaagggggggataggggatcaccttgtctaatccctcttttacaatcaaagaagaccgcagctgaaccattaacagataaagaaagctttatccatttgttgcaggttcatcacggaggtgctggcacaacagctgcggggctcaaagctgcttgcccaacaaccatagttccttttttcggcgatcaaccattttggggtgagagagtacatgctagaggagttggtcctccacctatcccagttgatgagttttcacttcccaagttggttgatgcaataaaacttatgctggatcccaaggtaaaggaacgtgcaatcgaacttgcaaaggccatggaaaatgaggatggagtgacaggagctgtgaaagcattttttaagcagcttcctcaaaaaaaatcagagtctgatgcagatccgcaaccaactggttttttctctggacccattcgaattgagatgccttggagatactcggtctataactggaatgacatctttgagtcatccatactgacagggtgcgtgacttcccatttgagtcatgtagaggtggcatga

SEQ ID NO: 45540 - DNA, 678 bp, Glycine max
  Peptide Sequence Number=SeqID_162318
atgtctccaaatgccacctttgaagaaactccctttttcccttcttcaatgcaagatttcaattctgttcaacatgttttacttgtcctattgatccactattgtctccagtacatgaaatccctattatggacacaagtcaagccacctctccaactagcccttcctgcccttcttcatcacctaacactactcaccaccacaaccaacaaaagaaaaccgcctcctccatcactttctgaccatcgaattcttcattggagaaaaccaatcaattcctatgatgccatatacgccatgtcaaagctacccacagtgtttgccacctattctgaatcacaccttccatgcaacagtatgagcgctctattcgtacaacaattccaactgatgacgactctgggtggccaattgctcttaggaaaggctcttgaaagcagtggcacatgggaactagttcccgtaccacctaggaagaagacagttggttgcagttgggtagttagtcaattgcagactcctcacactaatcattggaatgccgtaattcgcattcgtaggtacattaaaagggctccaagacagggattgccgtatgaagacacgggaaatacccatgtttctgggtattgtgatgctgactgggcaggctctcctattggcaggcgctctacttga

SEQ ID NO: 45541 - DNA, 282 bp, Glycine max
  Peptide Sequence Number=SeqID_162319
atgagaaaagaaaggtttccggaacaaaggaaatcaaagcttcaaccaaggggagatggaccatttcaagtgcttgaaagaatcaatgacaatgcttacaaagttgagctgcccgatggagaatccgatttgaggacaaatccttctcaagagggagagaatgatgaggacatgaccaagagcaagggcaaggatccacttgaaggacttggagggcctatgatgtggcgtccccaaaataatgactggtttgatggaagaatgtaccagccattactttag

SEQ ID NO: 45542 - DNA, 1584 bp, Glycine max
  Peptide Sequence Number=SeqID_162320
atggcgaagatctccattgattttttcaatcgggaaaatcaggggcgggttttccttgagtggaaaggtgaggggcgaacgggcggctttggcgcggcggggcgcgtgatgcagggcggccgggctgccgcgagcctggcgtcagcccacgccggcaatcatccgtgcctgccatgggcaacgagcgcccggcaagcgttgccgcgccaggcggcaggcgcatgctgtcacgtcgatttgcgggcgcacgcgggtcaggcgcaggtcggcgccgtagtggccgtggtagtgcggggccaggatctcgaagatgatggcggccaggttctcggcggtggggatgcggtccagcaccacggtcttgtggccgggcatcgagtccaggaagccgcgcacggcggtgtcgccttcgtagaccaggaaggcgtggtcccagacgtcgacgatgtgggccttggcgatgcgcttgatgtcggcgaagtccatcagcatgccgttgtcggactcgcccggggcctggacgatgtcgccggtcagggtgatttcgagcacatagcggtggccgtgcaggttgcggcactggctgcggtggctcaggcgccattgcgggtgctgcatgcagtattggacggcctgttcggtgttggccaggcgggcggggccgtccatgggttgcaggaagaagtggtcgaagtccaggtgttcgaagcgcgggggcagggcgttggcctgggggtagaccagcttgagttcgttgccgcgttcgatgacgacgggggcggtgcccttggggctgacgcagatccagtcgatgccggggggcggctggacggtgccgttggtttcgatggcgacggtgaagccgcgcgcgtggacgacggccagcagcgcttcgtccagttgcagcagcggttcgccgccggtgaagacgatgtagcggttggcggtgtcgggaccccaggcggcctcgatggcatcggcgagcagttcggggctggcgaatttgccgccgccgtcgccgtcggtgccgatgaagtcggtgtcgcagaaggtgcaggcggcgctggcgcggtcgctctcgcggccggtccagagattacagcccgcgaaccggcagaagaccgccgcgcggcccgcgtgggcgccttcgccttgcagggtcttgaagatttctttggcggtctcctcgaggtagcgcatgcggaagcgccggcccttgatgttgctgttggacaggcgcgagaaggcctgcttggcgatcttgcggtccagcgccacgtaggcgttgaactcggtgatgttgatcttgccgacctgctcgaaggccaggccgccgtcgccggtcagggcgcccagcaggtcgccagggcgcagcttatccttcttgccgccctggatgcacagggtcaccatgggcgcgcgcagcggccggtcggccttggggcgcagcgacttgagcgcatttcgtcgggcgagcacaggctcagggccaggcctttctggtcccccgcggccgctgcggccgatgcggtgcacgtggacttcgggtgtcttggtgacgtcgacgttgatgaccgggcccag

SEQ ID NO: 45543 - DNA, 507 bp, Glycine max
  Peptide Sequence Number=SeqID_162321
atggtgaatgggttcaaattccctacttgggtaaaggagaaggatttatggcagatatttcacagatggggtaaggtgtgggaggtgtttatccccaaaaataaaaacaaggaaggccatcgatatggttttgtcaggttcaaagaggtagaagatgaaacgtggctggaacgacaactcgataacaacatttttttcggaaagacgaaaatgtttgttaatcgacccaagttcgaacggggtaagatagtaagaaggaaccaaaaggataacagcacacctgataatggcaagccacaaggtgtgatcaattatgaggaacgagtgccgcgaacaaacatcaatggcggaagacttcggtcctatgctgaggtggttacgatggccccgcctggagatagtgccttgcataatcagggggcagactcctcgcaagccttacaggccgtgcataggccaccggcggttgtaaccacaaacatggagcagaacaaatggatacagtag

SEQ ID NO: 45544 - DNA, 441 bp, Glycine max
  Peptide Sequence Number=SeqID_162322
atggactttatcatttaccccaggccaactactgaatttccgcatcctctatcacgtgtaaagcaacaggctggttataggctttcatatcaaatagttgactctttgatttggcttggaattcgagacatgattaatgatcttaggaagaaaaagttgaagctacgaccagtcacatatttaagtggctcacaaggctctgaaactgatgttccacatgcatatatatggagtcctcatcttgttcctaaaccaaaagattggggaccaaaaattgatgtagtagggttttgctttcttgatcttgcgttaaactatgaacctccagagtcccttgtaaaatggcttgaagaaggagacaaacctatttacattggatttggtagcctggcttttaaggctatgatgttaaggatgatggaagtatactcctttgattaa

SEQ ID NO: 45545 - DNA, 1059 bp, Glycine max
  Peptide Sequence Number=SeqID_162323
atgagtcagtttgaagccaaattctcactacgcttgatattccttcaactgaaaatctcatcacctgtctcttacgtttccatagctcaaaaggtcatggaggatgaggttgcagttgggggtggtagaggaggtcatggtgcagtcaatataactcagtcctgggatgatggaaaggaaattgcacccaagaatacaaaacacaatgtattacatgatgaggagttcaaggacttcatgcaattcaaagcatcacaagcctcaccctcagttacaattgctcatactggtaattctacagtttgtctctctcaatcctcacctattggtccatggattttggactttggtgcttttggtcatgtagccggatcggagtacgaagcagacaattggtacggttatgagtcacgagggttgtactaccttcagtcttccccttcagttgcttgcactatttcagaatctccaagtcttcttcattgtcagttaggtcatccaagtcttcagaagttaagaaagatggctcttaaattgtctcatttgcagtctctaaaatgtgaatctttccagctgggaaaacatgcccattctttcttctccagcagtacccagtcacaagctcatggtcctttggatgtcattcactctgatatatgggggccaaatagagttacttcagttttaagtcataagcacattgtcactttcattgatgaattttctagatgtacatgggtcttacctaaagaaagatcagaactatttagtgtatttcaaactttctttaaggaaattcagaatcagtttgattgttctattcgcattttacaaagtgacaatgcaaaagaatatttttcaacttctaattctgttatggctaataatggaataatacatcagtcttcatgtcctcatactcctcagcaaaataacaaggtgcctcattccgtactattccctgatgaaccagtgttccggattcctcctcgagtttttggctccacttgctttgtccatgatctaactccaggattggataaattggctacccgttaa

SEQ ID NO: 45546 - DNA, 510 bp, Glycine max
  Peptide Sequence Number=SeqID_162324
atgggcaactacgtttcatgcactttggcgcctcctttgatgaagaactccaaggccacgagggtcatcattcccaccggtgaagtgaagcaattcagagagatcgtgaaggctgcggagctcatgctcgaacaccccagctatttcctcgttaattctcgttctttgcatataggaagaagattctctgctctcggtgctgatgaagagttggagtctggcaacgtgtatattttcttcccaatgaggagagtgaactccgttgtcacccccaccgacatggcggtactctttttggccgccaactccgccgccaagagattgtctggtggaaaggcacgtgttctcccggacaactgcgacggcggagcatggcaacataaagaagagagttcaaaagatggaagtttaagtgagattccaaggttgagtttggaaggagtcgagtcagggtttcagtgtagtttgaacgtggcaaaattcaaaatgactactgtctctgtcttctag

SEQ ID NO: 45547 - DNA, 486 bp, Glycine max
  Peptide Sequence Number=SeqID_162325
atggtgatttctctggatcagtctccttcagcagaatcagcactatcctcactgcttctcccaccccttcaactgagtcttcctcagatcttgactcacagaaagcaagactcacaaagtgtgagaaaggagaaatcatattctaaaagtcgacaggatcattcttccgcgacaagagtatcactcttggcagccttattgctaactactgatgcagtgagcgtgaatgttgctccctctcttggtcactatcttgtggcagagagaagagctgaaagtactcacagaaggaataatcaatgttcaaccatttatggacctaatgatttcttcccaattcgagagtcaaactcgctatttgttggtggccaaggtgctcatagttcatcgacttcattaggtgaagattgtggaagagagccaaataaagtattggatcaaagcaatggatatgcagcgccaataatttgttgcgtgtgcagataa

SEQ ID NO: 45548 - DNA, 138 bp, Glycine max
  Peptide Sequence Number=SeqID_162326
atgacaaggtgtcacaacgaagacattgacggtgacaaagacaataaaaaggaggatgagtcatgggaaaaggtgtcctccaatttggagaaggtggtaggggtggcgaagggcaatgtgaaacgatggaaatcatag

SEQ ID NO: 45549 - DNA, 606 bp, Glycine max
  Peptide Sequence Number=SeqID_162327
atggtgatccccaccgtcacaatatgcttcctcctcctcttcctcccgctccttcccctcaccaaaccctcatcttcatcttcttcttcttctgcgacatggtcttcttcttcgctgaatttaacggaagaactagaagtgggtgttccgagattggcgtacatgttgacggcgacgaaaggggagggggcgcagctgaagagggtccttcaggcagtgtaccatcccaggaactactacctgctccatctcgatctagaggcttctgatgcggagaggctggagctggccaaatacgtcaagtccgagactgtgcttgcggcgtttgggaacgtcttggtggtgggtaagcctgatttggtcacctacaagggccccaccatgattgcttctactcttcacggtattgcccttttgctcaagagggccccacactgggactggttaatcaatctcagcgcctctgattatcctctcctctcccaggacggtcagtcactcctctttctttccatgctttgggcgataatatcatttgcatcacgcttacattggtttgtgggtttcttctcaagcaaagaagaaaaaggacattctagtgcttag

SEQ ID NO: 45550 - DNA, 374 bp, Glycine max
  Peptide Sequence Number=SeqID_162328
atgtaccaggagaaagatgaaagcatgaagtccaatccagatttatattttaatagtgctactgttaacaaatatctagagaactaccagagggcccttagtggatttgaggctgctgctttaaaggatccaggtctcaatgctgtagaggaggttcagaagatagtcaatttacttgacaaggtggacaatcttttgaagggacatgtaagagctaagcgaatggcatctttggcatcatcattggttgctgttgatttgaaatcatcatacagaagagttaccatagaccttctgtcagagggtccaaatagagctcttgcagttgaggggaaagtttttttctttgttagcagtgagagtgttgctcccct

SEQ ID NO: 45551 - DNA, 204 bp, Glycine max
  Peptide Sequence Number=SeqID_162329
atggagtcaatgattactatggcttcctccggactcttggacatcatactgtctccagttgaggcatcaaggatcatcttgctgtgcagcatcatcaaagttatggttcgggcacctccacaacaaagctttgaatctttcccacgcctcaaagaggtttgtcaaatccttgggaaaatgtcacgatggcagattttgcgctga

SEQ ID NO: 45552 - DNA, 201 bp, Glycine max
  Peptide Sequence Number=SeqID_162330
atgtcaaacactaaagatttaacctcctcatttaaagggatgttggataaaaaagcatcatcttcacctgataccaagcttggaatgaagtattctgctctccttgagcatgcccttagattcttgacttttctcgccataagcattcctgaaaacgcaaaactgtttgcagctccttttgtgccagaacttcttgattaa

SEQ ID NO: 45553 - DNA, 312 bp, Glycine max
  Peptide Sequence Number=SeqID_162331
atgaaagatagcatacttggtccaatggttgaagttggagcctttggtggatttttcttttcaaggattcaagtgcatggccttgctttctttgaaagaacatcaggtgaatatgacctttatatagaagggttagggttaagggtttgcaacctagggttagtgttagggtttcgagcattggcatactggcttaaagcaaaagtctctctaatgcacttgcgtaaagcaaatgtggctctgacgcactggcttaaagcaaaagtctctctaatgcactggcgtaaagcaaaagttgctctaacgcattga

SEQ ID NO: 45554 - DNA, 1191 bp, Glycine max
  Peptide Sequence Number=SeqID_162332
atggacgccaaacggttcatccagctggttgaggagaagaagaagaaaattatggagagaaaggaagctcctttgaaatgggagcagaagctggaagctgctgctgaagctaaagagaggaagctgaaggttgcaaagcatacaaaaagatctggctctgatagtgacagcgattatgacagtgatgatgagagtagaaagacaagtaaaagatctcacaggaagcacagaaagcattctcactacgactctggtgaccatgagaaaaggaaagaaaaaagttccaaacggaaaacaaagaaatggtcctctgaatctagtgattatagtagtgatgactctgagagtagctttgaggaggagagaagaagaaagaagaagcaaagcaagaagctgagagatcggggttcaagatcagattctagcaactatgattctactgctgatgaattaagcaagaggaaaagacagcacaaacggcaacgcccatcaaaatttagtggatcagactactctactgatgaaggagatagtctagttcagaaaagaaatcatggaatgcatagcaaacgccatcgacaatcagaatctagtgaatctgacttgtcaagtgatgacgctccccataagaaaggccacagaaagcaccataaacatcacaagcgatcacataatgtggagctgaggttgtctgattctgattatcgcagtcatggtcaaagaagcagatcaaagtcattggaagaaaattctgaagatgaaagcaaaaaaagatcaatggataagaagtctggtcgccatcaccaccatcgtcaccaccaccatcgccaccaccaccatcgccaccacttggatgatgagagaaactacatgcagcaacactctcctaaattcaatggaaagcatggcgaggagttagacaaaactgaaactgagaaaaaggatggtggtcatcatgaaagtagagctatggttgagaataatgatgagactgattcgtcaactttagtatctgttagtgttgaaaagacgtgtgaatacttgccgtggacaatcattgcagggtcatcaaagagctctgaaaaaatgcttgggaggtacgtgttgcacgccatgaggaaagctaagaattgcagctacgtgtacgtttgcatgaaatacctacctatggttgtgggcagatttttttag

SEQ ID NO: 45555 - DNA, 243 bp, Glycine max
  Peptide Sequence Number=SeqID_162333
atggttcatcaatttaagagttattttagagttaactgggcccttatcatccagattaaagaaggagatcagctaacattgcttgacccttattttcgtgatgtttatttgtcctggaaggagaagcattaccagttcaaatctatacgcctggatttctatgaacaagtgcttgtaaatggaaaagctttgactcctcaacaagctgttggtacctcaatatatgctcaacataaaccctga

SEQ ID NO: 45556 - DNA, 2842 bp, Glycine max
  Peptide Sequence Number=SeqID_162334
atggccgcgtcgccgtcgtcttccgccgcggcaaacatcatgctggcgatcttcgagaagaaaacgaacagcgtagatctctaccgccctctccgcaactacgtggccttccactactccgagcgcgaggcgcagaaccttgaggacgatctccaaaccctgaagcaactccgctccgacgtggagcgccactccgatccgtcgctcccgacgcgccgtgacctcctccaaacctactacaaatccctctgtctcgtggagacgcggttccctatctcctccgaccccgaccacgtcaacgccctcaccttcgtctggttcgacgccttcaagcccaagcagaaggcctcgcagcaaaacatccacctcgagaaggcctccgtgctcttcaatttgggcgcagtttacagccagattggtttgtcatatgatcggaacaccgtggacggccgccgtcaggcctcccacgccttcatcgcggctgccggatccttcgccttcctccgcgacaacgcctccatgaaggcctctgttgggagttccaccactgtcgatttgtccgtggagtgcgccgggatgctggagaagctcatgctagcgcaggcgcaggagtgcgtcttcgagaacaccattgccaaagggagcactcccggtgtctgtgccaagatctctaggcaggcccgtatgaagtcactttgtcttgggtacggagtgattgtcagctatgagttcaaacttgcacatctggaagatgtattttctgatttcgttgttttttcaactacgccatactcaagagtagaaaaaggcttaactttgaagtctgtgatcattgaccatattgggagaatgttggatcacttatgcaacattttagaagtggatacaggtctgagtgacgttgaagagctccacataggatgggttgggatatattatgaggaagctttagctgcgctcaatgttgcacccttgagccagcattttgataagtcctggatagttcatgtgcagttaaaggcggcactgttttatgcggaagcttgttataggtatggtttggagctgcatgataaagaggagatagcagaggagattgcacgactgcggagtgctgttaatgtgctgactgaggcgaagaagagctctaagggtgctgcggcgcaaattctagatgcaattggaaagttagaggccaatattaaccggaaccttgaaagggcagtcaaggagaatgatagggtttacctcatgagagttccttcaccaagttcgttactgcctcttccggcattttctatggtgaagtccatggtcatgaatgaggtgctagatgcaagcaaagagaagatgtttgcaagtcttgttcccgacaacagtgcaaaggccctctcccggtatactgaaatggtagatgacgttataagaacacaagctgaaaagttgcagcaagctagtgagctaacccgggttaggcttaaggaaatggagctgccagattccattcttgctttggaaggaaattttactctaccaacaagtctcaaagaagatgtggaggctgtgcagatcagtgggggccctgctggtttggaagcagagttgcagcaacttaaggacctaaggagggtgaatcaagagttgctggtccagactgaggaattgttgcagaaggaagcaagggaagattctcaatttagaagccaatttggcactaaatggaccaggcctcaatcaagcaccttgaccaagaacttgcaggataggctaaacaggtttgcaggtaacttgaagcaagctgccgaaagtgatggtaggattgagcgttctgttagagaacattcagctctcatgtcgatccttgatgcccgtccgattgaatctgcacttccaagcttggcaaggccgattatgtcttttgatcaaaatgaagatgctattgtgggatctctcaagcaaagcttgaggcaactagaaactctaggagctcaaagggctggtcttgaagatatgcttaaagagatgaaaagaaaggatgatatattacccaagttgatgacatccaccggttcttatgatgatctcttcaagaaggagatagcaaaatatgaccatatttgtgaagaaatagctcaaaatatcgaggcacaagagcaattgttgctgcagatccaggctcaaaatgatgagttttctgttatctttaatctcgaagattacaaagcttcacgtgaaaaagcctacaaacagattgaagctgccatagcaaaatttagagaaataaaggacaacatcaatgaagggttaaaattctatgttacgctgcaggatgcaatcacaaatgtaaagcagcagagcaacgactttgtaatgacgcggaacatccagtgcagggaaatgattgaagatgttcaaagacaagtggctggtctgagtttccaggataacaaaaacacaggtggttttaacagcaactacccttcagtgggaagccaaaatcaaagatcccctacacaaacagatccggctcgtccccaagcaccttactatcagcagccagttgagcagccaccagttcctccctatggccatcatccccctcccccatatggtggtcctgcacaacatcatcagcctccacctccataccacattccaccatcatcaactgcaccatacccaccccctcaggttcatcaacagccaccagcaaaccatgagtatggccaaccagcatatcccggatggcgtggtccgtactacaatgcacaagcacagcaacctggttctgttcctcggcctccttataccattccatctccatatcctccgcctcaccaaa

SEQ ID NO: 45557 - DNA, 207 bp, Glycine max
  Peptide Sequence Number=SeqID_162335
atggccactgttcaacacctagtaatggataacaagaagaagaggcccattatttgcagaaccaagccagacctcaacaaaactttcaaggaagctaccaaggctataagggtccttctaacaactcttatggaggttcttcaaataagggtccacaacaacaataagctcaaccagacagattgtccaagatggaaaatactttaa

SEQ ID NO: 45558 - DNA, 390 bp, Glycine max
  Peptide Sequence Number=SeqID_162336
atgattatgaggggccaagacatttatagtaaccaagatgaggctactactccaccttcctttagtaaaagtgaagaagcaaaaggggaagaatctagtgaagaaatctacccccaagaagaaggacaacctttaatggttaaggaggagtgggttcccacgaaccctaagagaataaaggtcattcctgaatggtccactccaccaagtgttgagggaagaagcccaaagtttcaagtacctctagatttgaggtcaaatccttttcaagggggagggaatcatgatgtagctccatgtgaagcctataggccttggatcttcttcatcaatggagtcctttgcttcttaaatatgaatggaagcggaatggagatggaagaaagatga

SEQ ID NO: 45559 - DNA, 369 bp, Glycine max
  Peptide Sequence Number=SeqID_162337
atgaccctcctgctcatttacatccttcccagtgaccataactctgatctctcgctacccaaatgtcagttggtctacaacatcatgacccaaatcaatgttcatgtggcacaacttatctcaaatgccatccaccagttcataggtgttgcacctccgagacacccagtggacccagagaagtccaacagggcattgggattttcgacattgatcacaggcacaacagcaggggcagggccaacagcagcagccggcctcagacgcaccaccactgcctccgcatcagccaccatctctagagtccatcttagctcacatgcagaggatagagctccagatgcatgcatacatgcagcatttggctaa

SEQ ID NO: 45560 - DNA, 852 bp, Glycine max
  Peptide Sequence Number=SeqID_162338
atgcggatccttggtttcaccggtggcggtggagaccgcatcgaagccgatgtaggcgaagaacacgatggttgccgcacggaacacgccgctccagccgaattcacccggcacgccggtgttttccggaatgaacggctgccagttggccgggtcgatgtgggccgcgccgatgccgatgaacaggcagatgacggtgaccttgatcgccacgatgatcgcgttgacgaaggccgactgggtcacgcccacgtacagcaggccggacaccgccgccacgatcagcaccgctggcaggttgaacagcttgccggaggcgatgaactcgctgccggtccaggcgatgggcgcggcactgagtgcatccgggaacggcatgtgcagcgtggtggtgatgaagctgatcaggtattccagcaccaggcaccagccgatgaaccaggccatgccttcgccgagggtggcgtaggaataggagtaggcactgccggagaccggcatcattgccgcgaactcggcgtagcacaggcccgccagggcgcaggcgaagccggcgatcacgaacgacagcatcactgccgggccagcatggttggccgcggcctggccggtcagcacgaagataccagcgccgatcaccgcacccacgccaagcaggatgaggtgtttagccgtgagggtccgtttcaacgtggcttcgccgtccaggctgccttcgatgggttcgccagcatcgacgtgcccggccggttcgaccggcttgaccctcaacagagctttcagcatgcagtacttcctagtgatcggatggggtgggacgccgatacgttgccggcaaccctggaatggtga

SEQ ID NO: 45561 - DNA, 768 bp, Glycine max
  Peptide Sequence Number=SeqID_162339
atggctgcctcatccacaatcaacaacttcttctctttcttcttacccacaaaaccaccaccaccctctccaccgcagttcaaccccaccaccaccaccaccactcctatgaacccttcttctcagacccacaaaccctcctcgcagcccctaattgcccaatacaaccctcctcctccttccccttcttcctgttcttcttcttctgaattgtcctctgttatatgcccctccatggcgtactccaacacgctcttcttccagtcgccgtacaacgtgcaggtggtggtggccgaggacgaaaccgaggagaagctcctgggaaggttccgcagagaggtgaccaaggccggcgtcgttcaggagtgtaggaggagacgctacttcgagaacaaacatgaagagaaaaaacgcaagtcgcgcgaggctgccagacgtaaccgcaaaaggattttgaaagtctctgtgaactatgactgcaagtgcagttttaaagctttgggatggtcaaagagaagagcaccagttggtgattcatgctggattgattttgacggtggttctttcatagggataaatgcaatggttgggtctgttaagatttgtttgaaggtatgggacttgagtactacattggaagaatggggttttagtgtgaggctgccaatgtcaaaaactgtaggacagaaaaagcaggacgtcccagcaaccaagagagaagacgatgaggataactgggatctacctgaaggagacactctgtattaa

SEQ ID NO: 45562 - DNA, 153 bp, Glycine max
  Peptide Sequence Number=SeqID_162340
atggatgaagctatcaaaattatggatgctccagggaagatgaagcacatagttggccctttacggattgttcaactttggctaaatgctatcttagccaaccacgctcagcgcgagattggcgctaagctcaaatttacttactcgcgctaa

SEQ ID NO: 45563 - DNA, 780 bp, Glycine max
  Peptide Sequence Number=SeqID_162341
atggttttccaattccagctctattccctctcttccgttccacctcatcaacaaaagattttcggagccgaacaagatactccagtggtcaatgactctgatctcgtagccatttctgacaaactacgactagtctcggtcaacgactccgaaccggaaccaagcgctgccgatttgttgaaatccgatgaggaattggccagactcttgcaggtagaggaggaagcgctaatgttgcagcagtatgtggcaagccaaaatcctcgagaatttgatagtagagtatggccctacgtggatgaattggacaaagcaatttttatagcctctaaagatccttctttgtatggcattgatgaagtggaggtaaaaaaccagaggaagtggaccagtgatactcgcacccagggaatcattgcagaatcgcaagatggctttcattcacatgggggctgcgaaatctatttaatgaaggaattcacaatactctcaagggataacacaaattcaagcacaccaaagatcatctttgttccaggagatgtggatttgaagacattattggctcttttggctttcatgtttggaatgattttgatgtttgcttgcgcattcccacctacatttgcttttgcggctgtgaacaaccttatggagatcaggacagatgcattgaagctgctagtaattttgaggcggcatgttcctcgtgccgctgcaacagtaggagtctggcttaacatatttcaggtaccaaacattctccataagcgagtttag

SEQ ID NO: 45564 - DNA, 258 bp, Glycine max
  Peptide Sequence Number=SeqID_162342
atgactaaagcacgtcaaaagggggtacggaaaggaaaagagggagaagcttgccacccagctcgcccaggcgagctaggttgcttcctccagaaggcaccgccttctggagaacttcctggaaggccgaagtggacctggtttctatttgcacccccgtgttcactaaatacacctcttgccttttttgctgattcttttttcgtaactttacggaaacttatgaattacgtaacgatacttgttttctttctgtaa

SEQ ID NO: 45565 - DNA, 339 bp, Glycine max
  Peptide Sequence Number=SeqID_162343
atggaagaaaacatgtgggccatcattgacaaatacaaagagaagctaagtctagctgcaacccatgaacaaaggttagaggacgagtatgcaaaggtatcggtcctacaagcggaaagagaagcaagagagagagtgatcgactcattacacaaagaagcaatgatgtggatggataggttcgctttcaccttgaatgggagtcaagagcttccaagactaccagccaaagccaaggcaatggcggacgtgtactcggctcccgaggaggttcatgggctcctcgattattgtcagcatatgatcgatttgatgacccatataattaggaaccgctaa

SEQ ID NO: 45566 - DNA, 673 bp, Glycine max
  Peptide Sequence Number=SeqID_162344
atgaagcaaaaatacattatattgtgtatgatgatagcaggtctaagacagccaggaaatcatattaatgtgtatcttactccctttattgaagacttgagaaaattgcgggtagacagggttgatatgtatgatgggaatctccagcagaccttcaagttgcgtgcattgatatttttcaccatcaatgactttccaacttatgggaatttgagtggttacagtgttaaaggacactacacatgtcctatttgtgagaaagagacaagttacatccaactgaaacatggaaagaagacagagattcaaagtgcgccgaaacccttagttggacatcaagtttttgatcgggtcaaggacatcataactatctctgggaagacacaaaagaaggatgcgtctgagaagaacatttggaagaaaagcaaagtcgttgaccctaaaaagttggatgatttggagaatgaggctgccattatcctttgtcaattggagatgtattttctgccttcattttttgacataatgattcacttaattgttcatcttgtgatggagatcagcattgttgaaagctacgtcactgaagaagctattgagttttgttcagagtacatagaaaccactacacctgttaggcttcctcaaagtcatcatgactgcacacagggag

SEQ ID NO: 45567 - DNA, 181 bp, Glycine max
  Peptide Sequence Number=SeqID_162345
atggaaaatagtctcttagataaggactcagagccggagaatccttcagcttcagccataacatggactgtcttttctcaggaaatgaaaagagtgggttatctagcagctcctatgattactgtgactttgtcacagtattttctacagattatttcaatgatgatggttggtcacttgg

SEQ ID NO: 45568 - DNA, 1197 bp, Glycine max
  Peptide Sequence Number=SeqID_162346
atgggaatggctagtggactggaaacaatttgtggacaggcttatggagctcaacaatatcaaagaattggaatgcaaacatacactgctatattctctctcatattggtttctattcccgtgtctatcctttggatcaacatggaaagcatactagttttcataggccaggaccctctaatttcgcatgaagcagggaagttcacaatttggcttgttccagcactttttgcatatgcaattcttcagccgttagttcgatatttccaagtccaaagtttgcttcttcccatgtttgcaagttcttgtgtcacactcattattcatgtacctctttgttgggccttggtattcaagacaagactgagtaatgttggtggagcattggcagtgagcatttcaatatggtcaaatgtgatttttcttggattgtacatgagatactcttctgcatgtgcaaaaacccgcgcacccatttctatggagctgttcaaaggaatgtgggagttctttcgttttgctatcccttcggcagtaatggtttgccttgaatggtggtcatatgagctgcttgtattgctgtcagggctgttaccaaatccacaacttgaaacttcagttctatctgtttgtctaaacaccatttcaactctctatatgattccctttggaattggcgctgcagcaagcacaagggtttcaaatgaactaggagctgggaattcacatgctgcacgtgttgccgtgttagcagcaatgtctcttgcagtaattgagacaagtatagtaagcgcaacactctttgcctgccgcaatgtttatggttatattttcagcaatgagaaggaagttattgattatgtcactgtcatggctcctctggtatgtatatctattatactagacagcatacaaggtgttctcacagggattgctagaggttgtggatggcaacatttaggggtttttgtcaatctaggggccttctacctttgtgggattccaatggctgccttattggcatttttggtgagactgggaggacaaggactttggattggtatacaaagtggtgcttttgttcaaactcttctactttctatcataacaggttgcataaattgggaaaagcaggcaatcaaggcaagaaagaggttatttgatgatcaattttctgctgacaatatattggtatga

SEQ ID NO: 45569 - DNA, 336 bp, Glycine max
  Peptide Sequence Number=SeqID_162347
atggagtctatggaaggggtcttgcgtttaaggccaaatcgtgtgctaaccatgggtgaaagagaggccatgggctacccccacgtgagggtggacatggccatggtgggctccaagatctcgcatgttagactgagagttcctttattaagaggacaagagggaagatctataaaacaaaggactctgacactcaaggatcttggtacacataaagattttgacacccatacttctcatgaggcgtgtaatatagatggattgaacacagtggaggaggagactactactcatgtgagcaaagaaagtgtcagagcaaataatcttgcagtataa

SEQ ID NO: 45570 - DNA, 321 bp, Glycine max
  Peptide Sequence Number=SeqID_162348
atgccacttcaagttgaagatgagtcaagaacaagctcaccaccatcggaagtcatggataagagcttgaaggttactggtgttgggagagatgtgtttgaatctgtagcggtgtgtcatgcattcatgatggaagtggaggagaaagagtacatcgtggtaggaaatgagaagagagagtgtgacgatgaggaacacgatgaatcagggaatggcattcaaaacaatgatggttgcactgaagagcgtgatgggagctcaaaacttgaagaagattcaaatcttgaaggtgattcaaagtgcgaaggtctcaaagcttaa

SEQ ID NO: 45571 - DNA, 345 bp, Glycine max
  Peptide Sequence Number=SeqID_162349
atgcggttttggagttgtcagagagtatcagtatttgtcatggttgttggagaaggattagagccttcgaaaggggtttcatgtctgaggctagaccacatgctaaccatgggtgaaaaagagaggtcacggggtatgttttaccacagccccatggtgggtgctaaatgtagttaccaaaatccggagttgttccacgtcagggtggacatggcgaaggtgggctccaggatcttgaatgctggactgagagtagcctttgttagaaggacaagagaggggacctgcaaaataaaggacttcgacgctcaaagtaaagtgggagttgcaagtccttgtttgtag

SEQ ID NO: 45572 - DNA, 1815 bp, Glycine max
  Peptide Sequence Number=SeqID_162350
atgcacaaagttggtgtttgtgcattgcccgtgcttgatgacctatgttgtaggcatgttagagatatgaaaccaatcatacagcaggatcataaagatgggccatcagtccaacctgaagaaagtggtccctgtgcagttaccgatgaagaaaatgatcaattctggggtttggacgacatcccagttgaagaaaagaattccttggatggtacaacaggcaaagaagtgaatttggaacactttataaaacctcctgcaaatctagttgttcttgaaggtgactgcttggatgctggtggtgatggaggggaattggagtcttttctgttgtccaccacagacctgtaccaggattttattttattggacacatctgatgctgttgcagttcatgagtttttgaagggcagcaaagctgccacaactcaaaatgatgctaatagaggaacctcagctcgtaaaagctttcattctccaggacatactggtggaagtgctcgtagattatccgctgctaagaatcagggtgctaacaactgcacccctaaacttaattgtggttttgatgatgaaaatgtccggcccagttctcctgcttctgctggtcttgatgacttcaattacggatttgatatggatcatggatgtgatgcatctagagattcagacaattcagatgaagataatgatgatccatggaaacctttaaatcctcatgaaccaggcaacttgagggtgaagccattcagaaaattgaacactttaaaaaagaatagcatcaatgtgagacaaccagtttctatgaacaccttgtttccgcttgcaaaattgcatggtcctatcagtccagagctcatggaaatgtgggagatgcgacatcatgtccatgaacgacaaagggattctctagctctattatatgagaagctgaggcaatctcttgttaatgaggggaataaaactggtggcacattttttaactctgaagctgacaatgatgacaacgaatatgatggtggaaatcctgattttgatacgccagacaatgcttacatggaagaagatctacctcctttcagtaatgagcatgaatttgatgatgctcatatcaaccctgatgaagctgtagatctttctcaggctagtttggaagatctttgccgctctcacctgaatgctctcttagcaagcattgctgaaactgagaagcaaactgaaatggctgctagggtttcaacatggaaacaaagaattgagaacaacttggaagaacaggaatcacatccaccatttgatatccaagactatggtgagagaattcttgacaagttctccctgctttcccttgaagcaagcagtagtggtgtcctatccttttctgatttggtgaagggtcaagaaaagcatgatgtggcccgaagtttctcttcccttcttcaactggtaaacaacggagatgtaactttagaaagaaatggagttgatgggtctgtctgctgcacatccgttgatccctttcatgttaggctccttaagcaaagcagtaaggaaggcgacaatgcacagcttcgtttgccaaaaaagagagcaaagtctccaacaaaaaaaccctccacaaaaggtgacaagaacaaaactgtaagagaaaagtctccctcgtcttctagatatggatcaactggggtgtcaccaccaacaaattgcaagttttctgtaaagcttggaaaggtgagtgccatgaagtcccccgaagccaaaagaagacgtagatctcagtatgtggaaccagttaatttgcattcagcagggtga

SEQ ID NO: 45573 - DNA, 381 bp, Glycine max
  Peptide Sequence Number=SeqID_162351
atgacggatactgacactctccaacaactccaaaatcgcattgcggaaatggagcaatgccataaggaggagctcataaagctaaaggctgaccacgatcagttggaggctcgtgtcagacgcccccagggcgatgagcactccgctcacacatttcctgagtgcactcaaagggaatcacaccctcgacacacggtcaacactaaaaataatccaagtctctcgcacatacatcaccctacagggcggactactcgtcgacacccattcatcaatcaaatcatggaaattgacatagccctaggttggaaaccactcaacctaaagtggtatgaaggaaccattaatccaaatgaacatctggacgctttcctcacctag

SEQ ID NO: 45574 - DNA, 537 bp, Glycine max
  Peptide Sequence Number=SeqID_162352
atgtcagtggccaatcccaattcccagggtctaagcagcacaacactagttcccaacgccgtcacccccgtttgtgcagtgaagaagaagaagatggccgtaaaatcgaagaaagagaaagaacacctgaatcttctcctaggttcccaccttactactatccatgaaaccctccaggttttggatcaaacaccgccatcttcttcttccgccaaagtcacctgggacgatgtcattaagatggctgaacaagtctcaaaacaagctaccacggtgggaatgctgtggactggagagaagccagatgccaaagcagttgaggaaaatatggcatcatatttcaacaccctgcaaggtttccttttactttcccatggcagtacagtaggtgcagggcctaccttgtcttctgctgttcatgcatccgtcaagcaagtcgttgattccagcttcagattgatgaaggaaactgtctctttatacgcaaagcaagatgtgagcattagaaatgagaacatgcttatccctagaccatga

SEQ ID NO: 45575 - DNA, 108 bp, Glycine max
  Peptide Sequence Number=SeqID_162353
atggcgataattgttctgcttctttctcattcatccaagaaagatattttagcaataagtggtggaatattccgtgcccatggtagtgttgctatcaagatcccttaa

SEQ ID NO: 45576 - DNA, 1551 bp, Glycine max
  Peptide Sequence Number=SeqID_162354
atgtggattccacattatttttcatcattcttgaggaaagaagagcaaccaaacggcggaaggaagatgaatctcacatttttcgtttcgtctcccttctttccttcctttttggctggtacgaaggagagagaggcagagtatgtgatgagatggagtgtgtttggtgaagaaatgaaaagagtgggttatctagcaggtcctatgatcaatgtgactttgtcacagtattttctacaaataatatcaatgatgatggttggtcacttgggtaaacttgttctctctagcacagccattgccatctctctctgtgctgtctctggcttcagtcttatttttggaatgtcatgtgcactggaaactcaatgtgggcaagcatatggagcacagcaatatcgaaaatttggtgttcaaatatacactgctattgtctctcttactttagcttgtcttcctctgactcttttgtgggtctacttggggaagatactcatttttcttggccaagatcctttgatttcacaagaagctggaaaatttgctttgtgcatgatccctgctctctttgcttatgcaacacttcaggccttggttcgatactttctgatgcaaagtttgaccagtcccctcttcataagttcctccattactctttgcttccacgtagctttttgctggctactggtttttaaatgtggatttggtaacttaggagcagcattttctattggtacttcatactggctgaacgtggttttacttgggttatatatgaaattctctactgaatgtgaaaagactcgggtaccaatttcaatggaactattccatgggattggggagttcttccgctgtgctattccttcagctggaatgatttgccttgaatggtggtcatttgagttgctaaccttgctttctggtcttctaccaaatccagagcttgaaacttcagtcttatccatatgtttatcagtcaccacaacaatctacacaatcccagaagcaattggctcagcagcaagcactagagtttcaaatgcattaggtgctggaagtccacaatcagcccaattgtctgtttctgctgctatgacacttgcagcatccgcggccattctggtgagctcaatcatatttgcttgcaggcaggttgtaggttatgtatttagcagtgagctggacgtggtggattatttcacagacatggttcctcttttatgtctctctgttatactggacaccttacatggtaccctatcaggtattgctagaggatgtggttggcagcacttaggagcatatgtaaaccttggagcttattatgttgtgggaattccaattgctgctatgttgggtttctgggtacaattaagaggaaaaggcctgtggattggaatcctgactggtgccttctgccaaacagttatgctatctctcattacaagttgtacaaattgggagaaacaggttgcttccgcttccaagtctaagctttgcacttggcacagtcctaaaacaccattttcacaatgttatgtcttctga

SEQ ID NO: 45577 - DNA, 1152 bp, Glycine max
  Peptide Sequence Number=SeqID_162355
atgtcatgtgcactggaaactcaatgtgggcaagcatatggagcacagcaatatcgaaaatttggtgttcaaatatacactgctattgtctctcttactttagcttgtcttcctctgactcttttctgggtctacttggagaagatactcatatttcttggccaagacccttcgatttcacaagaagctggaaaatttgctttgtgcatgatccctgctctctttgcttatgcaacacttcaggccttgattcgattctttttgatgcaaagtttgatcagtccccttgtcataagttcctccattactctttgcttccatgtggctttcagttggttaatggtctttaaatctggatttggtaacttgggagcagcattttcaattggtacttcatactggctgaatgtgattttacttggcttatatatgaaattctctactgaatgtgaaaggactcgagtcccaatttcaatggaactattccatgggattggtgaattcttcacctatgctattccttcagctggaatggtttgccttgagtggtggtcatttgagctgctaaccttgctttctggtcttctaccaaatccagagcttgaaacttcagtcttatccatatgtttatccatcatcacaactatctacacaatcccagaagcaattggctcagcagcaagcactagagtttcaaatgcattaggagctggaagtccacaatcagcacgagtatctgtttctgctgccatgactctagcagtttctgaggccattctggtgagctcaatcatttttgctagcaggcaggttttaggttatgtatttagcaatgagcaggatgtggtggattatgtcacagatatggttcctcttttaagtatatctgttatagtagacacgttacacggtaccctttcagcacataggagcatatgtaaacctttgagcttattatgttgtgggaattccaatggctgccatattgggtttctggctacaattaagaggaaaaggcctttggattggaatactgactggtgccttctgccaaacaattatgctatctctcatcacaagttgtacaaactgggaaaaacaggtttgcctccacttccaagtctttatggctctgcacttggcacagtctaa

SEQ ID NO: 45578 - DNA, 840 bp, Glycine max
  Peptide Sequence Number=SeqID_162356
atggccaaggatgttggatttgaaaacacagcgggggctgagaaacaccaagcagtggcacttcgagtaacagcagaccaagcaatgttttataattgtcaaatggacgtgttccaagacaccccttatacccaatctcaacgtcaattctaccatgattgcaccatcactggcaccattgactttgtctttaaagatgcctttggaatgttccaaaactgcaaactaattgtgagaaaacccttacctaatcaacaatgcatggtgacagctggtggcagatccaaagctgaaagccctagtgcccttgtgttccaaagctgccacttctcaggggaaccccaattgactcaactacaacccaagatagcatgccttggaaggccatggaagacatacggccctagtgctgacacttcactaagagttaaatggtcaggtgtcaagaccataacatctgctgcagcaactaattattatcctgggaggttctttgaacttattaattcatcaactgaacgtgatgcttggattgttgatgctaggagtttcatagcaagtacgtcattgttgatgaagaatgtgagcggtgacaagacgagcaaagctaaggtgaggtcaatggggttacatgatagattcatgatttgggcatgggtagagcgaaatgaggagaatgagagtaaaagatggcacatttggaatagcgagagcaatgaggacagtgaggacatagaggtcgagaaagaggaagatcgaaagaggaagggtgaaagatttgtcattcttgggatagatcttaaaccagatttggatctttctttgttgttttcgtgttga

SEQ ID NO: 45579 - DNA, 403 bp, Glycine max
  Peptide Sequence Number=SeqID_162357
atgactaagggtacctcgaaaccggggggtagtggaagcggtggcttccacgcggttcacgcggagcgtgacctagaatcgaattgggaagttgacctcgccaagaaacttgaggagtatttgcttaaaatttgttccggcgagatcattggcgaagaagaaggacatagtcatgtgaacttcgccgaagctgctctgctgcttcagggttccattcaggtgtatagtcgaaaggtggaatatctctacaccttggtcttgcgggctttggagttcctttctcagaaaagccttccccttgtgtatgcaaaaatgctgtttctggattatatcccattggcaactggtcaccaaagtgaaaccgtgcaactttacagttgcactagggcatgccctcagcatg

SEQ ID NO: 45580 - DNA, 411 bp, Glycine max
  Peptide Sequence Number=SeqID_162358
atggcgacagcaggtggcagaaacaaagctgatagccctagtgcccttgtgtttcaaagctgccacttcacaggagaacccgaattggctactgcagaacctaaggtagaattccttggaaggccatggatgtcatactctaaggtggtgatcatggactctcagattgaaaatgtctttttaccagatgggccctatgaatgcccaaattcctacagggctggcccaaagtcctacaggatcagcccaaagtcctacagggtcaaccaaagcatgaggatgggcataacaggaaataacagtgagaatgcgggaagcaacatccaggagtctttcaccacaattttggccttccattatggttctatcacgtatccaaacatgctcgaagatatagtggtgactaattag

SEQ ID NO: 45581 - DNA, 255 bp, Glycine max
  Peptide Sequence Number=SeqID_162359
atgtcgttagttttttccatttgccgcaccttcactgatgacgcaaagacgttgtgtgctgaagcagataattatactattttccctaccatgctgagggcatgccctagtgcaactgtaaagttgcacggtttcactttggtgaccagttgccaatgggatataatccagaaacagcatttttgcatacacaaggggaaggctgtgtataatccccccgcccccccatactttcggaaagcaaggagtctctga

SEQ ID NO: 45582 - DNA, 1191 bp, Glycine max
  Peptide Sequence Number=SeqID_162360
atggctgcaactttctcatatccagcctctacctactttgtaaggtgttgttccatgagagaaaaccatgaccaggttaaccaccaaatgaacagcagcatcagaactaatgggagttttaggtccccggttaaagttgagtcactaagccaaacagcttcaaccatcaccactcttggtcaagctgttacaattggtgaaaatggtctgcgccaaaacatcccaacaaagaagcaattggttgatcctcatcgacaagggctcatcattgaaggtggagttggttatagacagactgttgtcattaggtcctatgaagttggagctgataaaacagccacacttgagagcatcctcaatcttcttcaggaaacagcattaaaccatgtttggatgtctggactgctcagtgatgggtttggagcaacacatggaatggtgaggaacaatctcatttgggttgtctcaagaatgcaagttctgattgattactatcccatctggggagaggtggttgaaattgacacatgggttggagcatcaggcaagaatggaatgcggcgggattggctgataagaagccaagccacaggccacatttttgcacgtgcaacaagcacgtgggtaatgatgaaccgcaaaacaagacgtctctccaaaatgccagaagaggtgagagcagaggtttcaccttggtttattgagaagcaagcaataaaggaagatgttcaagaaaaaatagtcaaattagacaaagaggcaaaatacatgaattctgacttgaagcccaagagaagtgatttggacatgaaccaacatgttaataatgtgaagtatgtaagatggatgctagagaccatcccagaccaaattctagaggagcaccaattatctggtatcacactagagtacagaagggaatgtggaagctcagatatagttcaatcactgtgtgaacctgaggaggatgaaatacttcatggtgtggtagaaccagattactgcacaaatcttctcaatgggttatcatcagatattataaatggtagtggagtcctaacttgccttgagaagaggccattaaggtatacacaccttctacaaaccaaaggagagaaacaaaacgacgaaattgtcagaggaaggactacatggaagaggaagatttctacaatgccattttccacttag

SEQ ID NO: 45583 - DNA, 330 bp, Glycine max
  Peptide Sequence Number=SeqID_162361
atggtaaagaacaacagagaaggtttgccgttcttggcatctcttcaatccttcttgtggcgatggtggccgcggaggaggcttctctctgaggaagaaacacttgtagatgattactcttcctgggtgaatgaagggcaaaggcgtcttctagggcttggaggtattaaacctaatgcaattgtgacacaagatgcgactagccaatttgcaacactcagtgatgctcttaagactgttccccctaaaaatgtgattgtgggcaaggacatgacccatgtcacagttattggagatggtcctatgtacaaagacgagattcaccggtag

SEQ ID NO: 45584 - DNA, 744 bp, Glycine max
  Peptide Sequence Number=SeqID_162362
atgtacaattatcatgagaaaggaagagctcctgatcttgaaagcgtattggcagacttcatgacatatcaagctagctctaaaggtgatggctattcaatgcaacaacaagaaactcagtttgaaaaggactattctttggcaaattatcaatgggagttagaatggcaaccttattatcacaatgaagcagaagggttgtctaatctggatgacttgttaatgcaattcaagggtacattggattcaacgcaacaaggatttaaaagagctgagactcagattggtaagttggtggacgacatgattaaagttatggccagaagagaagaagagtatgcagagattgaaacacatcaagaaagcattcttcaagttaacacaatacatcatcaattgatcaccaaagaagaaacggatgaagtctccattattccagaatatccctatatagcaactactggatatgttgtaggcaaagataaaggtcagttggaactcagtgtagaggatcagaaaatctcctttgacctctttgaagcaatgaagcacacagatatcagtgatgcctgttttgaagaagaagaggtggagcaggagatagaattatcagcttcaaccatggtactgcaattccctttggaaaaagatcctaattatgtgatagactgcctagtttgtgatgaagagcttgatgatccaaaagacaaccctattggtcatgtggttcttgaagaattataa

SEQ ID NO: 45585 - DNA, 237 bp, Glycine max
  Peptide Sequence Number=SeqID_162363
atgtctgtgtcacatgcctcagggcagccctgtgcgtttatttattcagtattgcacgtgaacgaagtgtgggagcgagctaaaaagtgcgaaacttcatccttccctctcctatatttcccatcaaagtcaaaacttgtgataaaaagtggatggcggctcgttgaagaaaccttcaagatgcagccttctgaaatctgtatatatgccctgtattcggatcatagtataatgtag

SEQ ID NO: 45586 - DNA, 222 bp, Glycine max
  Peptide Sequence Number=SeqID_162364
atgaactacataaatcaagagtgtaaatttcccaaggacaaaagttggtatgctaaaatgaaaacattttatcaaatcttaagaggtgatttagaactcttacaagttatagccgatagatatccctatgtggagaagcaaaacttaaaggagctttggcctcaactccctgatcatgaaactcaacaaagactaaaaaaaatcgtaatgataggaagttag

SEQ ID NO: 45587 - DNA, 2955 bp, Glycine max
  Peptide Sequence Number=SeqID_162365
atgcgtgttgattcgttaaaggcattaaggttgaaggaactggctgatgatcttaagaaccaaaggatgaagaagaatagtgatactaagggtcagaaaaaatctaatcagaaggactttgttggaagtgatttaggaggaagtcatgtgaaagagctagatgaaatgtctgtggctaaatatgcagctaaggaggacggaaattcttcgcaggcaacaatattgactacttacaaccaggaggaacttcatgaaatgttggcagcgtctatagctgcagagaaaaatggcatacatgccagaaaaggaatgccgtctattgtaattaatcctttagaggaggaacgtgatgcagacgaacaaattatattgccatcagtaaatgcagaagttgatatggctgtattagctgccttaccacaatcaatgcaacttgatattcttgcacagcttaaaggaaagaaaaccgaaggactagtaaaggaagttgacaatcagaatcaacatgatgtcaattatcggggcaagggtaaggggattctgctcattgaagctgacatggtaggttgtagctccagacatgacaatgttacatcaaggagtgacaatcaacactcaattgatgaaatgttagctgcatctattgctatggaggaaaatgaagagttagtaaataatacatcaacttctgttggggcttccgctattgaggaagaggaagttgactatgatgaagatgaagaaatgatactgccagctatgcatggtaaaattgatcctgctgttctagcctcattgcctccatcaatgcaactggaccttcttgttcagatgagagagcgtttgattgcagagaacagacaaaagtatcagaaagtcaaaaaggatgatttacagttcattttggtatcagcattacttttcctcacttctagttgtgattgcgcactgaacttaatatgtcattcaattggctcgttccaggatccagcaaaattctctgagctacagatacaagcttaccttaaaactgtcgctttcagacgggacatagatgaagtgcagaaagctgcagctgtaggaggagtaggtggtgtacagacttcacggattgcatctgaagccaacagagaatatattttctcgtcttcttttactggtgataaacagcatttctatgtattaattaagtatgatgccttgtggaatttgaatgttgacaacttccttgctcttttcattcctaaatatgtcagagaacttacctccaccagcttagagaaaaataaagatacacaacagaaggtccagggagtacatccttcacagaaccttacagatagcattgtggcaggaaatgattctaatacttcaagcggattggttcacaatgaacctggtgagcctgctgatgaaagtattcagacatatcttgatgagaggggtcggtttcgagttagtagattgagagctatggggatgcgtatgacctgtgatatacaacggaatttggatttgttgaaggagattgagcaggaaagagcatatgtgaacaaggctgcgaatattggaacagtggaaaatgctgagaataatggtccatatgaaagttctgggatccagcttgttggtaaatcacaagagatgaatgttgacttagttggacagaatatgcaaaatgaacaaacaatgcttgacagagatacattgatagagatatcttttgaatatgattgcaagaataagttcgcaaatgatgaggatgatatattttctagtttagtaggaggaaatccagtggcaatctttggtgctgatgatactgcagcaaccgaacaaccttctcattctgattcagattgtgattgggaagaaggaattctcgaaggtaagagtaatgcttatcctgaacatgacgtggtagaattgaagtcttctgttgcagatgatcataaaaataatgaaagagaagtagaatgggaggaaggagattgtgatggtgctaacagcaccttactgtcaggaaaattggcatctcaagggtggttggaggaggagtctgatttgcaagaggcaataaggagaagtcttgaaagtataggggatatgaaacttaaatgcatgccagctgtagatgagcattcaaatacttatgagaacaaattggattgtggtttagaacatggtgatgatctgtattattctgaccctgtggatttaaatgacaacgttgggtttctgaataataaaaatagggaagacagtactgaaaaaaatgaattacatgaaattgaagatggagataaaaagcatgattttgtttctggcaataatgaacaaactttccattttcatggaagtcagtcaaagtcatctgtgacttttaattccaataacactgagatattgatcgacacaccttgcagaatggacagtcactcttgttttgtagattcaatttcagatacaaatgtaatgacgaaggacctagtccctatggttgctgagcaattattggataaacatgatgatggtaaagtgtctttctattgtgacaatacatccaaggttgatccagttggtgcaactgaagaggggaaaaaaaactatattcaagaatctgaaccattgagtaattctactgacactaccaaacctgctattttggtagagtcatccttgaaaggatcaacagaagaccttgatattgagccaaaattgccttcagaggacagtaatagaaatttctacgaggaaaggaatagtagccttggcaatgatgtggttaacaccccgggacattttcctgctcatgcagctgaggttagcttggaggaagaaatgcaaattcttggtcaagaatatatcaacctagaaaatgagcagaggaagctagagcggaatgcagaatctgtaaacagtgaattattcactgaatgtcaggtgtggaactga

SEQ ID NO: 45588 - DNA, 1350 bp, Glycine max
  Peptide Sequence Number=SeqID_162366
atggaagcagaagctcaatgtgcttatttggaacttgagaaactagttgatggtgttgtgactgatgactctgatgtccttttatttggggcacgcagtgtttacaaaaatatatttgatgaccgcaaatatgtagagacatacttcatggaggatattgaaaaggagcttggattgaccagagaaaaattaatacgcatggctctacttcttgggagtgattatactgaaggtgtaagtgggattggcattgttaatgctattgaggttgtgaatgcattccctgaggaagatggcctcctgaaattccggcaatgggttgagtcaccggatcccaccatccttggaaggttggatgcaaatagtggttcaaattccagaaagaaagggtcaaaaattgaagaaaagatgaattcctcaagttgcaatgttaaagagtctgcggtgatgcaaaacatctgccatgctcaggagcaaaatgagttgtcagattacatccaagaaataaaacaaactttcttcaataagcatagaaatgttagcaagaattggcacattccttcttcttttccaagtgatactgttatatctgcttactattctccccatgttgataaatccactgagccattcacatggggaaagccagatcatcttgttcttcgaaaattgtgctgggagaaatttgggtggactggccagaaagcagatgaattgatcctaccagtcttaaaggagtataacaagcgtgagactcaattgcggttggaagcattttacaattttaatgaaagatttgcaaaaattcgtagtaaaagaattaagaaagcggtaaaaggaatcactggtaagcagccttcagatttgatagatgattctgcagaagagttctccaagagtaggaagactgggagagaacctgaggatatcacattggagacttcaaggggaatagagggaaatcttgagggtagaaggaaatcaaaaataaaacagtcaaggaagaatgatactgttgctaaggaacagtcaaagaaaaagaaagtcaatgatgatccctcttcagcacctggtacatctgagattgagaatttacagccaagtctgcagatagaagaagagcaacatgatggtaaggcattgattcggaatagaagtggcagaggaagaggtagaattatgggaataaaaagaggaagggataacaaaggtctcagttttcaatcttgcgaaactgaagcctcatctggtagcagtgacattgatgatcatgggccaagagtgcatgtggatagagttccaaaagatgtgcgaagggtgaaccttcattccgatttttctgatttataa

SEQ ID NO: 45589 - DNA, 570 bp, Glycine max
  Peptide Sequence Number=SeqID_162367
gcaggcaaaacgagagagagccgacgaacggtagcctcttttggccaaacatagtagaagaagaaagggataccggattgattggggacggacgaatcaaagcgacaagggctgaatctcagtggatcgtggcagcaaggccactctgccacttacaataccccgtcgcgtatttaagtcgtctgcaaaggattctacccgccgctcgatgggaattgcgcttcaaggcgtctcgtagggctaatccgcctcacgagggtcaccaacggcacgtgcctttggggggccgaggccccctactgctggtcggcaaacggacggcgggcgcacgcgtcgcttctagcccggattctgacttagaggcgttcagtcataatccaacgcacggtagcttcgcgccactggcttttcaaccaagcgcgatgaccaattctcacgttccctattggtgggtgaacaatccaacacttggtgaattctgcttcacaatgataggaagagccgacatcgaaggatcaaaaagcaacgtcgctatgaacgcttggctgccacaagccagttatccctgtg

SEQ ID NO: 45590 - DNA, 698 bp, Glycine max
  Peptide Sequence Number=SeqID_162368
atgagggagacacatgaagcaccccaagaccacaatctagctgactttgagcctcacctcagacatgccacagaggggaaaacattttgcagcatacccctgccaaacactttgaggggccctcagtattacccacaactacaaccctttcattttgcagtgggaagagtccctcctgctatgatgaaaaggggaaaatttgatcatatagaggaaaggctgaggtccattgaaagaggcaaagattatgcttttgctgacatggtagagttgtgcctagtgcctgacgtcgtcatccctccgaagttcaaggtgctagatttcgataagtacaaggggactacttgccccaagaatcacctgaagatgtactgcaggaaaatgggggcatacgcgaaagatgaaaagttgttgatgcatttcttccaggaaagtcttattggggcagccatcacttggtatagtaatttggaaccttctcgagtcggttcctggaaagacctaatggttgccttcattaggcagtatcactacaattctgatatggctctggatagaatacagctacagaacatggatctagcagttcaagtagcacccccaatgatggagagggagatgataacaatgatagtagacacgttaccggtgttctactatgagaagatggtgggttacatgccttcaagctttgtcga

SEQ ID NO: 45591 - DNA, 1981 bp, Glycine max
  Peptide Sequence Number=SeqID_162369
atggcgaaccggttgatttgggttagatgtactaagctacctttacatgcattggaggaggagatcttggttaaagttgttctgagttttggatccctgtcagtgaggagatattcaagcaaaccatctcagtgcaggtgttgggagtggaaataccagaagtctaccattgatgggtcttcaaatggcagtgagattggtgtagacatcccttcggagtttgctgagtacgaagacatgacacatatagggttggaggaattgatcagagaagacaaagacagagcagaccagcaagacaatgagcgttgtgtaataggtttgatggcagaggtcaggaataaggacaacctagggactgggaaatctatggcaaggggtgatactttgggttgtgaaaaggagatttttcaaacagaaggagatattgaggtaaatggggaagggatcaaggaaaatggggagtcaaactttggtgggatggagtctgaaaggaaatatgggttgtctaaagcccaatcttgtattgagggggagggccactctcgtcagaacccaatcaaggaaactaatacatcattgtctactcttaatgggttaaagacggatgaaaataaaagcaggaggaggaagcttagattcaaaatacattccctaaacaataacattgcaaatggagggataaggaatggagaagctatgtgcaaaagaatcatggacatggaaaatagagacaaacatgcaacttcatcttctagtagaagtcaaaatgaaggggatatagctagtaaggaagagttacaaatgatgtgtcttcaagaaacaaaaaatgatgtgattgagaagaaattttgtcaagggttgtgggaggaaaatgatgggatcgatgtagtgatggttaatgtttatgcttcatgtgaaagagtagcaagaagaagattgtgggaagatttgaagctatggaaagaaaattcagagattaaggagtggtgtgtattgggagattacaattgtgtaagaagggcgtcagagagacaaggtgtgcatagtagggataacaagggaggagaaatgagggagtttttaattttattcatgaaatggagttggaagagggagtggcacaatatgttggaagttagcactcaatatattcttaataggaacatcttcgaccattgtcctatcttgttgaagaacttggtggtggattgggggcctaaaccttttaggattgtggattggtggttggaagagaaagaatgtgtggcacttgtggaaagagaatggggtagcatggaagcatatggattcattgaaggagattgggaaagacctttgttggatggagttcattttaacacgatctctcatggggataataatatgcttgttggatattttgatgaagcggaaatcaaggaagcaatttgggattgtggaagttcaaagagtttgtggcaggataggtataacttcaaattcataaagaaattttggagtacactaaagggtgatattatgagtctcaaagttcgccaaggattagaggattttcaccctatctccatggtaggctgcatgtcccttgtacatagtgtcttagtggctaatgaagtggtggatgaggcaaaaaggttgaagaaggaatggatggttttcaaagtatatttcgagaaggcaaatgatttcggtctaagtggtttgatgagggaggcaacttctaagagccttttcaagggattttgcatggggaaggataatattgaagtcaatcttttacaatatgtgaatgacaccatatttgttggtgaaatatcttggaggaatgtaatgactatcaaggtggaaaatgggagggtaggggttgttgtggagttcttcaattgtagaattctctcatttccttacacatacttggaccttccaattggagctaatcctagaaaagagctgacatgggagcctatcataaaaaaag

SEQ ID NO: 45592 - DNA, 213 bp, Glycine max
  Peptide Sequence Number=SeqID_162370
atggcatttatccacagtgtgacaaactataattctgaagttgataatgaaagtgagatgagaggttctaggagagactttgggagagggtcgagagtaaacacgggaaggggttgcaatggagacagggttgaaaatctgatagaggaaatactcgatgattttgatgagactaaacattggaaaatcttccagagatatgggaaagtttga

SEQ ID NO: 45593 - DNA, 456 bp, Glycine max
  Peptide Sequence Number=SeqID_162371
atgccaaagatacggaaagagaggggcaaaagggtcatttcagggggttttctgaaccctggctcacccaggctagcctctggcttgcctgggcccccaaatagcttatgggtgaaagagaagaagaagaaagaagataaaaatgaggccaaggcgctatcgaattacgaccgtaatcgacttctacatcgttctttgttcgttcttcgttcgtcatccggtccaacgccttatcgattctctccgcttttcatcaaaacatcacttgaggtcgtttctgtggaagcaatgtcttccaaggttattttgttgatgccaatgatgccaaagaatcaagagtcaagcaaattccaaagattcaagaatgaagttttcaagaatcaagtttcaagaataatcaagatcaagattcaacactcaagattcaagaatcaagagaagaatcaatcaagataa

SEQ ID NO: 45594 - DNA, 2544 bp, Glycine max
  Peptide Sequence Number=SeqID_162372
atggcgaggaacacagctgacctcgtaacgcagctcaacgttgctcatcactttccccacgactctctgctccgctattgctcttcccacgtttctggcttccctcatcctccaactcatttcaccgtttcccagtttggacatggacaatccaaccccacgtacttgttgaaagtgggttcacatggctccttggttaagcactatgttctcaggaagaagcctccggggacattgctcgcttcagctcatgccgtcgatagagaatttcaggttctccaagcattgggtgctcatactaaagttccagttcctaaggttttctgtttgtgcaatgatccaactgttatcggaaccgcattttatatcatggaatatttggaggggcgcatatttattgatcccaagttaccgggtgtggcaccggagaataggagggcaatttaccgggcaaccgctaaagccttagcttccttacattctgctaatgtggactccattggtctgggaaattatgggcgacgcaatgattattgcaaaagacagattgagaggtgggctaagcaatatgttgcctcaacccgtgagggtaaacctgcaagttatccaaaaatgtttgccctgattgattggctacggcatcaaatccctcttgaagatacttcaggagcaacaggaggtctggttcatggagattttcgcattgacaatcttgtgttccatcccacagaggatcgagtaattggaatacttgactgggaattatctacccttggtaaccaaatgtgtgatgttgcatatagctgtatgacttatgttgcagatattgggcatgaaaaagtacgtgaaggtatggaacgttctggattatctgagggaattccttcactaccagaatatttggctgattactgttctctagcaggaagaaaatggcctgttgctgaatggaagttctatgttgccttttctttcttccgtgcagcttcaattcatgcaggagtgtataatagatgggttaagggtaatgcatcaggaggtgaacgtgctcgacacacagaagtacttgcaaatggccttatagatactgcttggaaatttattgaacacaaatctgtgcttcctcagcatcctccctcagatgcaaacgctcaagactattcaaaagagttagtgaatgggaatgatatacagggactctcaaatcaggggaagtttgttcctagtcaaaaggttttggcgctgaggaacaaattaattaagttcatggaggaacatatttaccccatggaaaatgaattttataaactcactcaatcagactcacgttggactgtttacccagcagaggaaaagttaaaggagatggcaaagaaagaagggttgtggaacttatggattcctaagcttttcttatccatctatcagtcaagcccaagctcacaaattgatagtgctgtgagagcaagaaatcttctctttgatgggagcaataattatcgctctagtgatgcaaatgacttgttattgggagctggtctcacaaatcttgaatatggatacctttgtgagatcatgggtcattctctttgggctccacaagtgtttaattgtggtgcacctgacacaggtaatatggaggtattactgcgctatggaaataaagaacaactacaagaatggctaattcctttgcttgatgggacaattaggtctggatttgcaatgacagaaccacatgttgcgtcttccgatgcaaccaacatcgagtgttctataaaaaggcaaggagattcatatatcatcaatgggacaaaatggtggacaagtggtgctatggatccaagatgtagaattctgatagtcatggggaaaactgacttcaatgcagtgaagcataaacagcaatctatgatcttagtggatgtccagactcctggcgttcacataaagagaccattgacagtgtttggctttgatgatgcaccgcatgggcatgcagaagtaacatttgaaaatgtttgtgtgcccgcaaaaaacatcatacttggcgaaggacgtggatttgagattgcccaaggtaggcttggtcctggaaggctccaccattgtatgagactgataggtgttgccgagcgaggcatgcatatgatgattcaaagagctgttggcagaagaacatttgggaagttgattgctcaacatggttcatttatttcagatatggccaagctttttgttcttcagtgccggatagagctagagagcaccagattgttagtgttggaagcagctgaccaacttgacaggcatggcaacaaaaaagctcgagggatattagcaatggcgaaggtagccgcaccaaacatggcactgaaggtgcttgacatggcaatacaagtgcatggagcagctggtgtatcatctgacacagtcctggcacatctctgggcagctgcaaggacactgagaatcgcggatggtccagatgaagttcacttggggaccatagccaagttagaactacagaaagccaaactttga

SEQ ID NO: 45595 - DNA, 1668 bp, Glycine max
  Peptide Sequence Number=SeqID_162373
atggtgcatcttctcctagaaatccttcaagctcctgatccaaacaccttagagtcatttctaggaagaattcctatggtgttcaatgtcgtagttgtatcaccccatggttactttggccaagcaaatatcctgggtttgcctgatactggaggacaggactcgggttcaagtcctgggcatgcaactgtgttgaatacttggagagaaagctttgctgcccatagtggtcctatccggctcgaacaggattgtctccgtaatactgtcactcatgatggacagcttgtttatatacttgatcaagtacgtgctttggaaaatgaaatgctgatcaaaattcaaaaacaaggacttgatgtgtctccaaaaattctaatcgttactagattgataccagaggcaaaagggacaacatgcaatcagagactggaaagagttagtggaactgaacactcatacatactgcgagtaccttttagaactaagaatgggattttgagaaaatggatttcaaggtttgacatgtggccttatctagagacatttgcagaggatgcatcacacgaaattgcgggtgagttacaaggaattccagatctgataattggcaactgcagtgatggaaatcttgttgcaaccttgttatcttataagctaggaatcacacagtgcaacatagctcatgccttggagaagactaagcatcctgattctgatatatattggaaaaaatatgaagacaagtaccattttacttgtcaattcacagctgaccttattgcaatgaacaatgcagattttataatcactagtacataccaagaaattgcaggaagcaagaataatgttggacaatatgagagctacactgccttcactcttccaggactgtatcgtgttgttcatggcattgatgtttttgatcccaagtttaatatcgtgtctcctggtgcggacataggcttgttaaatgatagatcaaagccaattatcttttctatggcaagaattgatccagtgaaaaatataacagggcttgttgaatgctttggtaaaagctccaagctgagagagcttgtgaatcttgtggtagttggtggctacattgatgtacagaagtctacggacatagaagaaatgagggagatagagaaaatgcacaatctcatagaagaatacaacttacatggccaattccgttggataaaggcccaaatgaatcgcgctcgtaatggagagctctaccgttatattgctgatgtgaaaggtgcttttgtgcagcctgctctttatgaagcgtttggcctaacagttgtggaagcaatgacatgtggtcttcctacatttgccacttgtcatggtggcccagctgagataattgaacatggcgtttctggatttcatattgagccacatcacccggatcatgttgctgcaattttaattaacttttttgagcaatgccagagtgatcctggctactggaacaagatttctgatgcagggcttaggcgcattcatgagaggtatacatggaagatatactctgagagactattgactttagctggtgtgtatggcttctggaagcatgtgtctaagcttgagaagagagaaactaggaggtacttggagatgttttacattctcaagttcagggatttg

SEQ ID NO: 45596 - DNA, 198 bp, Glycine max
  Peptide Sequence Number=SeqID_162374
atgggaatactcgggtcttcatcgttagtggtcgtggtgacactggactccgatgaggtcttcatcgtcgtgagcctctacaccagaatcgacactcaggcaaagctagggtttgatgtgttcaagtcacagggcaaggccttgaatttcatcaccaatgaatcacggtttgcctgtaggagcaggacgctcgtgagg

SEQ ID NO: 45597 - DNA, 378 bp, Glycine max
  Peptide Sequence Number=SeqID_162375
atgtcctgggctatatggaatacacttcaacttcttgaagaccttttgggagattatgaacgaggatatggtgagattgggttttggagaaaagtgggtgggatggatccgatcttgtttgtcacatctagcttcatttcggtgttagtgaatggaagtcctacattggagttcaaagcacaaagaggacttagacaaggatatcctctagctcccttcttgtttaatattgtggtggaaggtctttgtagcatgacgaggcaagctattgagaagaatatcttctctagcttcttgtgtaagaaacttgtctccacctataaaagaaggaaagagaagaaggaaaagacatacttccttatagaaggcaaaggctaa

SEQ ID NO: 45598 - DNA, 696 bp, Glycine max
  Peptide Sequence Number=SeqID_162376
atggcacctactccagcagacctcaggaagatcggtgctgaaggatttgctctgatagacatgttctatggtccaccgagaaggaacagtgccaattatgcatatattccatgggcgaagaggagaacgttgttgggttcgacaccaccaccggaattcttgcttgggccgccacagtccgccattaaaggagaccttctcaatctcttccttggatcaaacctcttaaccgaatctctgtctcttgaacctaaccagattcatatactttctttcccaccttcaattgaaaaagaatctccggagcaggctagatcgcattcgccaatctccgtgttcttgtggaaaaccttcatttcccatatacaatttttcgacaatgttggtgataaatatgaacatattcaattctattcatcactctataatgataaaaatcattttaaatccattaccggagcacttgtggccaggacccaagagcttgaaagttccttaattataaagacatttgggtctctcaacctttcaagcaacaaaccaaaaactcaagtagcaactacattgataaaatctgttccaacaactccaacatttatggcacctcctcaggcagacctatggaagattggcgcagaaaggctttgctctgatagacaagttctatggtccatcaagggggaacagtgccaatga

SEQ ID NO: 45599 - DNA, 147 bp, Glycine max
  Peptide Sequence Number=SeqID_162377
atggttttcatgggaagaagaagtagtgagaataatatgtggaatgttattggattggttgtgtgcaaacttctaggcacttattctttgaatgtagggtctcatgctacgtttggaattattggtactcatggtatggagatttga

SEQ ID NO: 45600 - DNA, 300 bp, Glycine max
  Peptide Sequence Number=SeqID_162378
atggcaccaccaactgacctgagagttataggttcggaaggctttgctctgatagacggattctatggaccatcagcacgcagaaggcacaatacaaatggggtatttccttcaaggcaaggacgttgggtggttcaaatgccaaatgatgagttggaagatcctatcagtgtcatcaatagcagagacgctgctgctcgctatggtgggattatgattatgaattaccccaagccacaaactcgtcttggaagcagctcgaagaactgcaataagatcttctgtgtagactgcggatag

SEQ ID NO: 45601 - DNA, 282 bp, Glycine max
  Peptide Sequence Number=SeqID_162379
atgtcgatctcgactagaccaatggaccaacgatctgaagaaggtggctactcttcttcagatctgatcgaagaaagaaatggaggaagcacttggactatgacacgtgaaggacacgaaggagatgatggcaggcgtggagtgcctcaccaacttctagaagcttccagaaagaggctatcctcttctaaaacttccagcgttaaacagtgcctctctctagatatcccactgtggactgtggaggacatgaaggagatggagaagaggaagatagaatag

SEQ ID NO: 45602 - DNA, 447 bp, Glycine max
  Peptide Sequence Number=SeqID_162380
atgccttcatatgttggaatatataagagggaaaggcttagagatgaggaaccagaggactttgcgtctgaaactccagaagttgtcccaaggcaatatatgagtgttgaagagagctatcaaaagatggaaatggtagtgattagagccaacatagatgaagataatgaggcaacaatggctcattttttgagtggattgaaccctgatatcagagatgttgtggacctgcaagagtatgtggagttagaagattttttgcacaaggacaagcccaagagggaggaaggatcttcaaccgatcaagggaaatcactagtgaagcctaatacatcagcttcaagcactggaaccagcaacatcaaatgtttcaaatgcttgggtagaggacacattgcatttgaatgtccaaccataaggaccgaccgtgctcatgaaggaagatag

SEQ ID NO: 45603 - DNA, 474 bp, Glycine max
  Peptide Sequence Number=SeqID_162381
atgggtgcgagagagcatgagcctatgtgttgttccgatgattttggtcctaaaaaggatgggacttggaagaagtacactgagtgcaggcctatcaataacattcccaagttaaatgatttgttggatgagttgcatgatgcttgcatattttctatgattaacttgaaaaatggtgctaaaggggcacaactagatgaggaaaaggttaaggttattgaagagtggcctatgcctaagactatgagtgaagtaaggagctttcatggtttggctagtttctataagaggaagtccaagctccaacctagaggagatgggcctttccaagtcttggagaggatcaatagcaatatttacaaaattgatttagcagggaatgatggggacattgaagctcaaggatcaacacaaggattaagaggacatatgaccaaagccagagccagaaaggcagaggagaccctacgataa

SEQ ID NO: 45604 - DNA, 459 bp, Glycine max
  Peptide Sequence Number=SeqID_162382
atgagggagataaaggtgcagaagctcgtcctcaatatctccgttagtgagagtggagatcatctcaccagagccactaaggttgaaaccccttcacacctcacagcttccacaaatggcgatgcaacttttggagagtggtttgaaggtgaaggaatatatgaacttctcagaaggaacatcagtgatactggttgctttggctttggcattcaggagcatattgatttgagaatcaaaaagagtagtgggttttcaatgtacagaggagtgacaaggccagatcgatatgttgcatcgtttggcgagttttcctatcattattcaaaatggagatccagtgtgccatttgttgagcaattgcaagctttccaagaacttatgaatgagggaaaggtacactatatacgtgtttcaaatgaaacttcatatggagtgatggagtttgttcatgcatga

SEQ ID NO: 45605 - DNA, 555 bp, Glycine max
  Peptide Sequence Number=SeqID_162383
atggagttacaagtagtagagggggaggtggtcggcgggcctgaacgtattaatatttcatctcaaggtttgtgtggcagctatgcaaaggaacatatcgcaaaggatggagttggtggaagggttgtggttggatcttgggaagttctagttaatgtacactcactatgtgacttatctcgcaacaaaacacaatgggatgatcttaaggcgacaaaatcttttagtagtattggattgtggtgcatcttgggagattttaatattgtttggggaccttatgaaaaacatggtattgggtatgaagagttgagcctgggaaaaagaagtttgttcaaccagtttattcaagagatggaagttgcaaacgtcctttggttggtagaggttttacttggtacatgcctaatggcaaagctagctaaaagcaagttagacaaattcatggtttcttgtttgtggttcaatatttttcctagtagtactagtttcatccttgagaggaatatctctgaccgttgtcctattattatgaaagatttgagggtggattag

SEQ ID NO: 45606 - DNA, 519 bp, Glycine max
  Peptide Sequence Number=SeqID_162384
atggaatgttacagttatggccttcatgaggaggagcgtcaccttgaggaggtggatctagtggagggagagcttgttcgagtagcagattattatccagagggtgaggaaggcgaaggagaagacagagtagagaatgggaagttgggtctggtcgacagagaggtaatcgcaggggtgtatggagtcggcgtcgaggttgtagagcccggtgtggacaagcatggagagtattcgttggggattgtgacggggttggtgtggttggcggaggcggaggggtttgatctcatagacaggttctatggtgcaccaatcagaaggccagctaacgtgagcaagcagaggcaaggacgttccggagttcaagcaacccaccaaaaccacaaggaagagccagtagttatcaatagcagagaggcagcttctaagtttggtggaattatggttgtgaattattaccccaagactaagccacagaaccgttggggtaagttcatccaagccttcaaaccttga

SEQ ID NO: 45607 - DNA, 421 bp, Glycine max
  Peptide Sequence Number=SeqID_162385
ggggtttcccagctctgattacgggctctgtcagttctacggagtgcccgtcgcccccaacaaggtcattaggccccgcattaaccgggctttcatcaagaaagtactgtgcccccagacgggcgtagggcgagacaccacagtagcattgggatggccggtagcgggcaatagacgcaccgccaccacctctagagttcacctctgctcatccacaaaaaggtttggagtattacctacaccacatggccgaccaataggcgaccaagtccaaagccaaagtcatattgggacacacctagttgctcatgatcctaagaatttaaataaaacgagcacaagctcggaaggtagcaagatacctgggatatgcatgtatatagcaaaaatacctcacaaaaatatacacatgtttaggtag

SEQ ID NO: 45608 - DNA, 480 bp, Glycine max
  Peptide Sequence Number=SeqID_162386
atggcaagtgcttgctacagggtaccacttttacttgaaccggttggtgggtttctcaagagaaagcgtgtcaaagtatggagacaaaataagaagttgtcaaaggttctgggttgtgatactaaatcgtttaccagtatcaaaaaatatttggatgatgtgttggaagataagcccatcatcaaagagtgcttcatggacttaggtttatttcctcaagaccataagatatctattgctgccctcgtcgacatttggacagaacgacagcacaaacctgatgatgatttggacctaagacaactagatgaagaccatgcaatgaacgttgtctatgacttaaccgactggcatttggctaacattgtcgtgagaagcaatgacaatgtcaatcatggtggaagggacaatggtggtggcgattatgacagtcatggtagtagtggtcaccatgatgattatgtatttgagatattttaa

SEQ ID NO: 45609 - DNA, 354 bp, Glycine max
  Peptide Sequence Number=SeqID_162387
atgaccataatttgtctccgcatgtcatcgggctcatcgcctctggatgacaaaaggcgcagaatgaccataatttgtctctgcgtgccatcggacacgatcgtatctggatggccaaaggtgtgcggaatgaccataatttgtctccacatgtcatcgggctcatcgcctcgggatgacaaaaggcgtagaatgaccataatttgtctctacgtgccatcagacacgatcgtatctggatggaaaaagggtcagtatgacagagattgtggggcggccgaaaaaagcgaggctcttgctcctatgtatcctcaatttgagatgaggaactcagacctacgtagttctggataa

SEQ ID NO: 45610 - DNA, 342 bp, Glycine max
  Peptide Sequence Number=SeqID_162388
atgaagagtcgtttggggctgagagtagagggaggaatacctgcatggctggctgagagagaagccaatcttggtagaagtaacccgaaaagggggatccacgcggtgacgtcgttgaacgccactgcggccatggcgacctctcctatgcgcgtggtgaggagcttgagccccgctagggtgcgtgcaagcacagggagtacggtgatagaaagggcgactcccatgaagacgaggatgccgcatatgaaaggaagagaggttccaacggcggcgatgcagaatgcttttcggccgctccgacaaatggagtggagatcaagctccagacccaaaagctag

SEQ ID NO: 45611 - DNA, 300 bp, Glycine max
  Peptide Sequence Number=SeqID_162389
atggagggcataaacatttacaaccttgctctagaaggtgatgacattgaacttgaaatccccactaaacccaatgacaaaacaacaaatgatctatccctatgctttgtggctagattttttactgatagagcaattataagaggcccctggagctttgacaaacacttgcttatcttaggagtgagcaaagaaggtgaagccctagagaatgtaccactctttttagttttgttctgggtccaagtccacggattacctatggggtttatgttagacaagtggcctcagatatcttaa

SEQ ID NO: 45612 - DNA, 123 bp, Glycine max
  Peptide Sequence Number=SeqID_162390
atggttttgcaagaccaatatgaaactgaaagtattgctcagcatggagttgaattgctgtatgcaactatgacaaagatatttagttcattgcaagaagcatacaaaggtcaattttgctag

SEQ ID NO: 45613 - DNA, 559 bp, Glycine max
  Peptide Sequence Number=SeqID_162391
cagagggctacacgccctcgccttcatagagctacactccctcaccttcaaaggactacacatcctcatcttcaaaagactacatgtccgcaccttcagagagctacacgccctcaccattggaggactacacgtcctcaccatcagaggacttcgcgtcctcacctttagagggctgcacgccctcgccttcagaggactacacatcctcgccttaagaggactgcatgtcgtccccttcagggggacacatgccctcgccttaagaggactacacgtcctcgccttcagagggctacacaccctcaccttcagaggactacacgtcctcgctttcagaaggctacacgtcctcgctttcagaaggctacacgccctccccttcagaggactacatgtcctcaccttcggactacacgtccgcaccttccgtgagctacacgccctcacctttggaggactacacgtcctcaccataagaagactacacgtcctcaccttcagagggatgcacgccctcgccttcagagggctacaaccctcgccttcagaggactag

SEQ ID NO: 45614 - DNA, 633 bp, Glycine max
  Peptide Sequence Number=SeqID_162392
ggccaccaggcctactgggtatgcccgctgattgaagaatcagaagccctgcaactacagactgccaatgatacctttgcctatatgcagcaggcttttcccgagttacgtgtgggcttggtgcatggccgcatgaagacggccgaaaaacaggccgtcatgcaggcttttgccgccaacgacattcacttgctggtcgccaccaccgtgattgaagtcggcgtcgatgtccccaatgcgagtctaatggtaattgaacatgccgaacgcatgggcctgagccagctacaccagttacgtggccgcgtcgggcgaggatcagccaaaagtacctgtattctgctgtataacaagcagcaatgttcgcagattggccgccagcgtctcaaggttatttttgaaagcagcgacggcttcgagatcgcacaggcagatttacatatccgagggccgggtgaattactgggtacacggcagagtggtgtgcccatgctcaagattgctgacctggaacgggatgctgacctgctggacatcgccaaaaccatggctgaccagttattgcaacgtgcacctgcggccgtatccgcgcatttgcaacgctggttaagccaggcagaggattgggtcaag

SEQ ID NO: 45615 - DNA, 258 bp, Glycine max
  Peptide Sequence Number=SeqID_162393
atgttaatgtgtaatcatcaattttcaagtgttggtctgattgagttattatgcaccattggtagaacaccagatggtatattaaacatacttgaagccactatgacccctactcgtcaaaatgagtttgttggttacttgctcacaggaataaatcccaaaaagtttgacattccttccggatgtaccatggatgaaccgaaggatttgatcaagcaaattgcgcctcatgggattcccccttatggtattcattaa

SEQ ID NO: 45616 - DNA, 543 bp, Glycine max
  Peptide Sequence Number=SeqID_162394
atggcaccacaagcagattttggaaaatttgggtttgaaatagaaaagctctttggcaggcaaaagagttttggcaatggcaacgctccagccactcatcaaaatctctgccaatacaaattttatccaacgtatggtgctaccaaggtggttcacatgcatgtagaagatgtcaagtgcaatgaagctgcttcaagattcatatcagaaaagagaacggagcttcagatgaaaggtgcaatggccgctacgaagagaattggtgttctaattatgttctttgctctggcttattatgtggatgctatatcaagaacaaagccagttgctagtcctgatatctacaagggtagaaatgtagctaaggataaaattgctcctggcgagaagatagttaatgtcttgagttttggagccaaacctgatggcaagtttgattgcactcaggagtaccacgctataaaagctaaccattgtatttcgaaagtccaagatctttcaaatcctacacgagaatatgatactttctatgagggactctag

SEQ ID NO: 45617 - DNA, 138 bp, Glycine max
  Peptide Sequence Number=SeqID_162395
atgggaattgtggatgtacttagtgaaaaggggctacactggatagttgctgaaagtgaggtaggtgcttacacttccattctgtacaatatgtttcaaacacagatcaatggtaccaagagccttactaaaacctga

SEQ ID NO: 45618 - DNA, 2430 bp, Glycine max
  Peptide Sequence Number=SeqID_162396
atggcgacggagcagttaatgtccggcggcggctcccgctacgtccaaatgaaatcgtctccgccgtcgtctccgccagccgcggcggccgaggagatgtcctcggtcccgtcgttccggcacagcggcgccgaggccaatcggattttcgaggaattgccgaaagcctccatagtctccgtctcccgccccgacgccagcgacatcagccccatgcaactctcttacacaattcaggttcagtacaaacagttcaagtgggagctaacaaagaaagcccatcaagtatttattttgcatttctcgctaaagaaacgtgcctttattgaggaaatccacgagaagcaagagcaggttaaagaatggcttcaaaatctaggaattggagaacacactgctatggtgcaagatgacgatgaaggtgatgatgaaactgtcccgttgcatactgaagaaactcatgaaagtgccaaggacagagatgttccatctagtgctgctctgccaattatacggccagccttgggaagacagcattctattgcagacagggcaaagagagcaatgcaaggatatctgaatcactttctgggaaatatcagtattgtgaactctcatgagggttatttattaagtaaaagtgtagttgtgtttctttactacactggcaattctggaaatagcctctccattcttagggctaaggttgcatgtataagaccttcccaagaccccacaatggtgggagcttgtgcactgggctgcctattggtttgcaagtttttggaggtatcaaagttatctttttcacctgaatatggtcctaagctgaaggaagaatatgtgatggtgaagcatctacccaaaatccagaaggatgatgattccagaaagtgttgtttgtctgactgttttagttgctgtaatgacaattggcaaaaggtatgggctgtactgaaacctggattcttggcattgctggcagatcctttcgatacacagcctctggatatcattgtttttgatgtactgcctgcctcagatgggaatggggatggtcgattatcactggcgagtgagatgaaggaacgaaatcctttacgccattcattcaaggtgacttgtggaatccggagcatcagaattagagtgaaaagtagtagtaaagttaaagattgggttgctgcaatcaatgatgctggactcaggcctcctgaaggctggtgtcatcctcaccgttatggttcatttgctcctccaagaggcctagtcgaagatggaagtcaagcccagtggttcattgatggacgagcagcatttgaggccattgcttcttcaattgaggctgcaaaatcagagatatttatctgtgggtggtggctgtgcccagaactgtacctacggcgacctttccacactcatgcttcgtcaaggcttgataatttgttggaagcaaaagctaagcaaggggttcagatttacattcttctctacaaagaggtggctcttgctttgaaaataaacagtgtttatagcaagaaaaagcttcttagcattcatgagaatgtgagggtattacgctatcctgaccacttttctactggtgtttacctgtggtcgcatcatgaaaaactagtcattattgataatcatatttgctttattggtggactggatttatgctttggtcgttatgacacatctgagcataaagtgggagatttccctcctctaatctggcctggaaaagactattataacccaagagaatctgaacctaattcatgggaagatacaatgaaagatgaattagaacgtgaaaaatatcctcgtatgccttggcatgatgttcattgtgccctttggggaccaccttgccgtgacattgctaggcactttgttcagcgatggaattatgccaagaggaacaaagctccatatgagcaagcaattccattacttatgcctcagcatcatatgagttctcaagagagaagattcattttcctcatcttcccaagacaagatattcctctacttttgcctcaggagtctgatgggttggatactcatgaaggagaccaaaaattgaatggggtaatctccttttcacatcagcttgacaagccaagaaggatcagcagtggtcttccattctcgttccggaaggccaaaattgtagcagttggcccagatacaccaatgaagggctttgtagatgatctagattctgagcatgatcgtgagaaaatgtctcttgatagagtggctcatattgatttacaaagtacaaatccagaatggtgggaaacacaagaacggggtgaccaaggaggttttgctgaagaatcaggacaagttggtcctcttgcttcctgtcgttgccaagtgtgttgctctcatgacctacttaaatataattgtcattga

SEQ ID NO: 45619 - DNA, 171 bp, Glycine max
  Peptide Sequence Number=SeqID_162397
atgtgttcattagtgcaaggcagtgcagtgaatcgttttgaaaaaggggcagggaagattagagaagtttcaggaaacgaattccttggtgccaagagaagtcttatggaaggctctagagaacaaaagtgtttgtatgatagggttacagctagtgttggggtcacttaa

SEQ ID NO: 45620 - DNA, 321 bp, Glycine max
  Peptide Sequence Number=SeqID_162398
atggcgtgtgagaaactcaaacacaagggtaagggattccaagatttctataggaagccttcaaattctaaaggggttatctgtttggacgtttctgtgggtagcaagagaagacctacaatgttcttagtgatttccttgcaagtcaactttaacatgttgttggggagagagtggatacatggggtaaaagcagttccatcaatgatttatcataagcttttctttaggaatgaagatggaaaacttgaaatggtggaagttgaccaatcatcatatggaatctatacaaacagttatattggctcgttaaatggataa

SEQ ID NO: 45621 - DNA, 342 bp, Glycine max
  Peptide Sequence Number=SeqID_162399
atgtatggtccttgtgctcgattgaactatcctgagaatgatgtggaatgcatcaccaagcctgcagcttcactgaatagtgataaactcaagtgttctgaggttggagtgttgcatgatacaaaggaaaaacaggatctttttgaggattatgttgttgacaatgctaaggaggagtccaaggcagtttgcaaaattacccaaaccagaaaggccaggcaggaattcatgactggcctttcaaggaggacattgaagcagacatacctggagaatgtgaacataacagagagaatcataagtttgaaattttatggccatgaaatctggagctggctttag

SEQ ID NO: 45622 - DNA, 3294 bp, Glycine max
  Peptide Sequence Number=SeqID_162400
atggcatatttttttgtcttttgtttattgtgttttgggttgtttttctttgtctgttggttacttcaaaagcttagtgatcctgtagttgaaaaacccgtgtctgaggacaacaaagctcctcaaacaaagtatgatgtttttgttagtttcaggggcaaggacgttcgtggcaactttcttagccatttggatgaaattttcaaaaggaacaaaatatatgcctttgtggatgataaacttaagaagggagatgaaatatggtcatcacttgttgaagcaattgaacaatcattcattttgctgatcatattctcccaaagctatgcttcttcccgttggtgtttaaaagaacttgaggcaatacttgaatgcaataagaaatatggacggattgtaattccagttttctaccatgtggagcctgcagatgtacgacatcaaagagggagttacaaaaatgcatttaagaagcatgaaaaaagaaacaagactaaggtgcaaatctggagacatgctttaaaaaaatctgctaacattgtaggaattgagacatcaaagattcgaaacgaggttgagttgcttcaagaaattgtaaggcttgtgctgaaaaggttgggtaaatctccgattaactcaaaaatacttattggaattgatgaaaaaattgcatatgtagaatcattgatacgcaaagagccaaaagtcacttgtcttattggaatttggggcatggccggtaatggcaagacaacccttgcagaagaagtatttaagaaactacaatctgaatatgatggttgttattttctagccaatgaaagagaacaatcaagtagacctggaatagattctttgaagaaagaaattttttctggacttttagaaaatgttgtgacaatagacgatccaaatgtgtctcttattgatattgatagaagaattggtcgtatgaaagttcttattgttctcgatgatgttaatgatccagatcacctagaaaaattactgggaactcctgataattttggatcaggtagtagaataattataacaaccagatatgtgcaagtacttaacgctaacaaagctaatgagatataccagcttggagagttcagtttagataaagcccttgaacttttcaatttgattgcctttaagcaaagtgatcatcaatgggagtacaatgaactatcaaaaaaggtggtcgattatgccaaaggcaatccattagttcttaaagtcttggctcaacttctttgtggaaaagataaggaagaatgggaaggtatgctagactcacttaaaagaatgcctcctgcagatgtttataaagtaatgaaactgagttacgatgtactagatcgcaaagagcaacagatttttctagatttggcatgtttctttcttagaacgaatacaatggtaaatgtgagcaatctaaaatctttactgaaaggcaatgaaagccaggaaacagtgacttttaggttaggaaggttgaaagaccaagctcttataacttattccgatgataatgttatagctatgcatgatagtttacaagaaatggctatggagattgttcgtcgagagtctagtgaagaccctggaagccgcagtcggttgtgggatccaaatgacatttttgaggcatcaaaaaatgacaagagtactaaggccattagaagcatattgattcacttgccaacattcatgaagcaagagttaggccctcacatatttggaaagatgaacagactacaatttctggaaatttctgggaaatgtgaagaagatagctttgatgaacaaaatattcttgcaaaatggcttcaattttcggcaaatgaactcagatttctttgttggtatcattaccctctaaaatccttgccagagaatttttctgctgaaaaacttgtcatcttgaaattgccaaagggcgaaataaaatacctttggcatggagtgaagaatctggtgaatttaaaagaacttcacctcactgactccaagatgttagaggagctgccagatttatcgaatgccacaaatcttgaagtactggttctcgagggttgttctatgttaactacggtgcatccatctattttctctctgggaaaacttgagaaattgaaccttcaagactgcacgtccctcaccacactcgcaagcaattcccatttatgcagcctgagttatctcaaccttgataaatgtgagaaacttaggaaactctcactgataacagagaatattaaagaactgagattaagatggacgaaagtcaaagcattttcatttacatttggagatgaaagcaagcttcaattgctacttctcgaaggaagtgtcattaagaaactaccttcatctataaaggatctaatgcaactgtcacatctaaatgttagctattgctcgaagctccaggaaataccaaagcttcccccatcccttaaaattctagatgccagatattgctcttcacttcagactctagaggagcttccttcttcccttaaaattctaaaagtgggaaactgcaaatcacttcagatactacaaaagcctccccgtttcctcaaatctctaatagcccaagactgcacatcattgaagactgtagtgtttccttcaacggctactgaacaactaaaggaaaacaggaaagaggttctgttctggaattgcttgaagttgaatcaacaatctcttgaggccattgcattgaatgcgcagatcaatgtgatcaaatttgcaaaccgatgcctctctgcaccaaatcacgatgacgttgaaaattacaatgattatgataaaaaatatcatttttatcaagttgtttacgtgtatccaggaagtagtgttctagagtggttggagtataagacaagaaataattatataattattgatatgtcttcagctccaccttctctcccagtgggcttcattttctgcttcgcccttggtatgtatggagacacatccctggaaagaattgaagctaacattactataagtgatcgtgagggtgaaggtaagaaggacagtgttggaatgtacataggtcttcggaatggcacaattgaatcagatcacctatgtgtgatgtacgaccaaagatgttctgccttcctatatagcagagccaaaaatcaaaaagagtttaaaatcgaggtttcaatggtgttacgatcctcatccaaagaaattttgacactgccgcagcagatgtttaaaggattcgggatcagcctaatagacaccttgggattagca

SEQ ID NO: 45623 - DNA, 309 bp, Glycine max
  Peptide Sequence Number=SeqID_162401
atgggagctgttgaatacatgagtttgaattccttaaataagtcttctcctaaatcttttatactagaccatatcaagaatacacatgaacaataccaggtaatgtatggatcaatattcaaaagaatgccagagccagggaaagtgtcacagcttaagcaatactgtgtttcagtaagaggtaaaggtgatgctgaaggaagaaaatacctgggatgttaccaggcacagcccaattccattcggttaatgaaattgatgcatggagtcgcgcaattccatttgttgaatgaaactgttatatgctga

SEQ ID NO: 45624 - DNA, 171 bp, Glycine max
  Peptide Sequence Number=SeqID_162402
atgtctaacaacaacactcctccaataaagtatgatccatttgttggtgctttgcaaaggaacaaaataaatgctttcgcggctgaccaacttgagaaaggagatgaaatacggccatcacttgttgaagcaattgaacccaagactatgcttcttcacgatggtgtttag

SEQ ID NO: 45625 - DNA, 198 bp, Glycine max
  Peptide Sequence Number=SeqID_162403
atgacccctgagaacactgaactgctccaaaagtccatatatactcttatttttaccctgaagaacattgagaatgttagctcggatattttgggtttcactggcgatgaagctacaagaaagagtttgaaattacttatcaagtccctcagcagaatggaggtgattcttaatgattgtcagtcacacttcagctaa

SEQ ID NO: 45626 - DNA, 159 bp, Glycine max
  Peptide Sequence Number=SeqID_162404
atgaaaagtgggaatttggaaagattggtgactacacaaggaaatgttgtgggcacacacggtggtgtcgggctcgtgtggtggttgttggtagcgagggaggtgaaacgagaacgaagaagggcgcaaccccctttatgtggcagatatgataattga

SEQ ID NO: 45627 - DNA, 3399 bp, Glycine max
  Peptide Sequence Number=SeqID_162405
atggcatatttttttgtattttgtttattttgttttgtgttgtttttctttgcctgttggttacttcaaaagcttagtgatcgtgtagttgaaaaacccgtgtctgaggacaacaaagctcctcaaacaaagtatgatgtttttgttagtttcaggggcaaggacgttcgtggcacgtttcttagccatttgattgaaattttcaaaaggaacaaaataaatgcctttgtggatgataaacttaagccgggagatgaaatatggtcatcacttgttgaagcaattgaacaatcattcattttgctgatcatattctcccaaagctatgcttcttccccttggtgtttagaagaacttgaggcaatacttgaatgcaataagaaatatggacggattgtaattccagttttctaccatgtggagcctgcagatgtacgacatcaaagagggacttacaaaaatgcatttaagaagcatcaaaaaagaaacaagaataaggtgcaaatctggagacatgctttaaaagaatctgctaacatctcaggaattgagacatcaaagattcgaaacgaggttgagttgcttcaagaaattgtaaggcttgtgctggaaaggttgggtaaatctccgattaactcaaaaatacttattggaattgatgaaaaaattgcatatgtagaattattgatacgcaaagagccagaagccacttgtcttattggaatttggggcatggctggtaatggcaagacaacccttgcagaagaagtatttaagaaactacaatctgaatatgatggttgttattttctacccaacgaaagagaacaatcaagtagacatggaatagattctttgaagaaagaaattttttctggacttttagaaaatgttgtgacaatagacaatccaaatgtgtctcttgatattgatagaagaattggtcgtatgaaagttcttattgttctcgatgatgttaatgatccagatcacctagaaaaattactgggaactcctgataattttggatcaggtagtagaataattataacaaccagatacgtgcaagtacttaacgctaacaaagctaatgagatataccagcttggagagttcagtttagataaagcccttgaacttttcaatttgattgcctttaagcaaagtgatcatcaatgggagtacaatgaactatcaaaaaaggtggtcgattatgccaaaggcaatccattagttcttaaagtcttggctcaacttctttgtggaaaaaataaggaagaatgggaaggtatgctagacacacttaaaagaatgcctcctgcagatgcttataaagtaatgaaactgagttacgatgaactagatcgcaaagagcaacagatttttctagatttggcatgtttctttcttagaacgcatacaacggtaaatgtgagcaatctaaaatctttactgaaaggcaatgaaagccaggaaacagtgacttttaggttaggaaggttgaaagacaaagctcttataacttattccgacgataatgttatagctatgcatgatagtttacaagaaatggctttggagattgttcgtcgagagtctagtgaagaccctggaagccgcagtcggttgtgggatccaaatgacatttttgaggcattgaaaaatgtcaagagtactaaggccattagaagcatattgattcacttgccaacattcatgaagcaagagttagaccctcacatatttggaaagatgaacagactacaatttctggaaatttctgggaaatgtgaaaaagatatctttgatgaacataatattcttgcaaaatggcttcaattttcggcaaatgaactcagatttctttgttggtatcgttaccctctaaaatccttgccagaggatttttctgctgaaaaacttgttatattgaaattgccaaagggcgaaataaaatacctttggcatggagtgaagaatctgatgaatttaaaagaacttcacctcactgactccaagatgttagaggagctgccagatttatcgaatgccacaaatcttgaagtactggttctccagggttgttctatgttaactagggtgcacccatctattttctctctgggaaaacttgagaaattgaaccttcaagactgcacgtccctcaccacactcgcaagcaattcccatttatgcagcctgagttatctcaaccttgataaatgtgagaaacttaggaaactctcactgatagcagagaatattaaagaactgagattaagatggacgaaagtcaaagcattttcatttacatttggacatgaaagcaagcttcaattgctacttctcgaaggaagtgtcatcaagaaactaccttcatatataaaggatctaatgcaactgtcacatctaaatgttagctattgctcgaatctccaggaaataccaaagcttcccccatcccttaaaattctagatgccagatattgctcttcacttcaggctctagaggagcttcccccatcccttaaaattctagataccagatattgctcttcacttcagactctagaggagcttccttcttcccttaaaattctaaaagtgggatactgcaaatcacttcagacactacaaatgcttccccgtttccttaaatctctaacagcccaagactgcacatcattgaagactgtagtgtttccttcaactgctactgaacaactaaaggagtacaggaaagaggttctgttctggaattgcttgaagttgaatcaacaatctcttgaggccattgcattgaatgcacagatcaatgtgatgaaatttgcaaaccgacgcctctctgtatcaaatcacgatgatgttgaaaattacaatgattatgataaaaaatatcatttttatcaagttgtttacgtgtatccaggaagtagtgttctagagtggttggagtataagacaagaaataattatataattattgatatgtcttcagctccaccttctctcccagtgggcttcattttctgcttcgcccttggtatgtatggagacacatccctggaaagaattgaagctaacattactataagtgatcgtgagggtgaaggtaagaaggacagtgttggaatgtacataggtcttcggaatggcacaattgaatcagatcacctatgtgtgatgtacgaccaaagatgttctgccttcctatatagcagagccaaaaatcaaaaagagtttaaaatcgaggtttcaatggtgttacgatcctcatccaaagaaattttgacactgccgcagcagatgtttaaaggattcgggatcagcctaatagacaccttgggatttagcagtttcaaacaacaaatggaattgcatgactcgctccatgtttaa

SEQ ID NO: 45628 - DNA, 146 bp, Glycine max
  Peptide Sequence Number=SeqID_162406
agggaggagacaccgcagcgtgccatgatgcagagagcagtgttgttgcagtttgttattcttggcacgtatgtggatgtattgatgggaaagagcagtatctcttgcattcacttactgtcaacgacgaacttctgaagaattaa

SEQ ID NO: 45629 - DNA, 865 bp, Glycine max
  Peptide Sequence Number=SeqID_162407
atggttatgggggatcccatcagcagactctccttccctgaaaacaccgagactttttcaagtctcacaagttatcctgaactacgtaggtctgagttcctcattggaggatacgtaggagcaagagcctcgcttttgtcgaccacaccgccttttgttgccatgactcaagagctgaccaagtttggtcattctgcacacatgatacgcggggataccttacggttatccgcacccctttgctatttagacacagttgttgtccgatggcacgcagagaccaagtttggtcattctgcacccaagatacgcggagataccttacggttatccgcacccttttgtcatccagaggcggcgggcccgatgacaagcagagaccaagtttggtcattctgcacccaagatacgcggagataccttacggttatccgcacccttttgtcatccagaggcggcgggcccgatgacaagcagagaccaagtttggtcattctgcacccaagatacgcggagataccttacgagaccaagtttggtcattctgcacccaagatacgcggagataccttacggttatccgcacccttttgtcatccagaggcggcgggcccgatgacaagcagagaccaagtttggtcattctgtacccaagatacgcggagataccttacggttatccgcacccttttgtcatccagaggcggcgggcccgatgacaagcagagaccaagtttggtcattctgcacccaagatacgcggagataccttacggttatccgcacccttttgtcatccagaggcgggcccagcagagaccaagtttggtcattctgcacccaagatacacggagataccttacg

SEQ ID NO: 45630 - DNA, 252 bp, Glycine max
  Peptide Sequence Number=SeqID_162408
atgaagtcagatgacatgcggggttacccaatacttacctgcaccatacgtcaaccaggggcaaacgagaccattgaggcgcggagactgacatcgtcttctacaccttttgtcgtcctgaccggtgacatgcggtgttacctaatggttacccgcacctttggtcaactagtggcaaagaagcccgttgacgcacagagactagcatcgtctgctgcaccttttgtcgtcctgacccgtgaagtcaggtga

SEQ ID NO: 45631 - DNA, 372 bp, Glycine max
  Peptide Sequence Number=SeqID_162409
atggtttctggcttggcaatgccgcgctcgaagaaaaccggagcgacgtgcgcgaagacgcggcggaaccggttcaaccgtgcggtccggaagttggccaagtcggggaaagtgcttcgggcgcttctctctgcggtgcggaaagaaagtatcggttacgactacgttgattatgaggaattgagagagccgaagccgcagatggagatgtggccgtcgggagagaggagagattcgaagtcggactcgtcgctgagttcggtgaccggagcggcggaggacatggcgggggaagtttatgaaggttgtgttggtggctatgttcatcgtccaggagctgctgctcgttgcggactcgagacgcagcgatga

SEQ ID NO: 45632 - DNA, 477 bp, Glycine max
  Peptide Sequence Number=SeqID_162410
atggagatttccagcttgagtgtggagccatgtgaaggagaaactcttgtggtgacagtctttgagattagaaaatcggagattccagattttatcaagagggaggttgagtttcggtttcttgctgttcttcctgaaacacttgatggcaaggcttttgattttccagcgcaaattggtcatttaatgtggcaatttctcaggtcctttgtgctcgttatagtgatgaggaatttttcgacaatagatgtaaagttttatgtctctgcttggtgggaatgggatgcttacagtaatcaaaatattactagtgtactagcagcaaagaatcttggtgaaacagcctacaacaactttgtggatcacacttatcttgctgaccgtaaaacaaccattcgcgattacttggcaacaacgggctctggcatcatggaagagcagcctcctgaatccctcaagcaccgctatggcggttga

SEQ ID NO: 45633 - DNA, 1116 bp, Glycine max
  Peptide Sequence Number=SeqID_162411
atggcgactgcggccggtgcggcggtgatgctctactacgtgctgagcaggcggatggcgcggaaggaggaggacgatggcgaggatcacggcggtgaggtgccgaaattgagcagatcggttcgccggagaaggctttcacggcggccggcgcaggctccggcaacgctgctggagtcgatcgtgacgctgtcggagactataaggttcacgtattccgagactctcgggaagtggcccatcggcgatttggccttcggcatcaactacttcatgcgcaagcagggtaatttggcagttgcaagtgtgtatgctgggagtgattgtgtgcagctcaaaggagatgagataattgtggagctctatgagttgttgaggcttttgactttgtgtatgcttttctccaagaagccatttcccgtgtttttagattctgctgggttttcccttgatgatgtgctcattcagaagccaaaagctgggatttggttatatatggaaaagctttgtggactctttgagataagggggagctatggtttgtactacctgggtgtattaggcattttgaaagtgactcctattttcttttcctattctaaatttgttaacattaagagaccccttgtggttttacttctgaagcctgcatttacaattatacgtgatacacaatcaaaatgtttacttctattgatccggggtactcatagcataaaagacacgctgacagccgcaactggtgctgttgtcccattccaccattcagttttaaatgacggtgggataagcaacttggttttggggtatgcacactgtggtatggttgctgcagctcgttggattgcaaagctctgcactcctaccctactcaaggctcttggtgaatgtccagacttcaaagtcaagattgttgggcactcacttggtggtggtactgctgcactgttaacatatattcttagagagcagaatgaattctcttcaactgcttgcatgacatgggagttggcagaatcaggaaaacactttatcactactatcatcaatggttctgacttggtgccaacattctcaacttcatctattgatgatctccgttctgaggtgcgctga

SEQ ID NO: 45634 - DNA, 627 bp, Glycine max
  Peptide Sequence Number=SeqID_162412
atgaaccggaagctgggttacggtgcccaactgcgcgctaacctagaccccacaaagggtgttggtcgattaagacagcaggacggtggtcatggaagtcgaaatccgctaaggaggcgcggcggtcgctgcaaaacccagggcgcgagcccgggcggagcggtcgtcggtgcagatcttggtgggacgggggaagcccgtctgatagcgctctgtgcgcgtactccgaaagggaatcggcctgcccaccctggaaacggctcagccggaggtagggtccagcggctggaagagcaccgcacgtcgcgtggtgcaagggaagtcggcaaaaatggatccgtaacctcgggaaaaggattggctctgagggctgggcacgggggtcccagtcccgaacccgtcggctgtcggtggactgctcgagctgcttccgcggcgagagcgggtcgtcgcgtgccggtcgggggacggattgggaacgggcccttcggggcctcttccccgggcgtcgaacagtcaactcagaactgtgctctgaatgtcaaagtgaagaaattcaaccaagcgcgggtaaacggcgggagtaactatgactctcttaaggtagccaaatgcctcgtcatctaa

SEQ ID NO: 45635 - DNA, 273 bp, Glycine max
  Peptide Sequence Number=SeqID_162413
atgtatattattaataaacagaacaataccaaagctcttcattcccgaaaaagtcatggacgagacattattccatacttggtcttggctaagaaaacaaagaggggaacgagcaacaatttgaaggttgtacattcaggaactaaagaattcaaaatagctagtaataagagggatttgtttttgggattttctgagcaccaagagcggctacgcaagaagcttgcacttgaggagggaaggatatttgcagctaatgaacaactttattaa

SEQ ID NO: 45636 - DNA, 210 bp, Glycine max
  Peptide Sequence Number=SeqID_162414
atggaggcacagtcccagtcccagtctcaggattattttggagagtgcgactactatgtgatgcactggatgtccaccatcattttaggaacttttaggaataattgggaagcgtattttaacgatcctagaccattggagccagagagattaaaagcattgcggattcagtgggcacagttttatctccgagatagagatcaggcctag

SEQ ID NO: 45637 - DNA, 624 bp, Glycine max
  Peptide Sequence Number=SeqID_162415
atgttttggatttggagaggccaagaggtggagtatcacgacacctggctgttaaaaaatcttgaccgttcaacgaacaatctgtccggagaaatcgcaccagaactttttggcctcactcaattggggtccttgaacttgtctagaaatcatttgatggggaagataccaagcaacattgatagcatgaaaaatttggagtcccttgatctctcctacaataatctttcaggggaaattcctgccgccatctctgatctgtctttcctaagtttcctcaatttgtcatacgatgatttgatcggacaaatcccattaggcattcaggttgagacattggatgcatggagctatggtgggaatcccagactttatggacgtcctttaacaaagcatttctccaaggatgtaaatcctgatgaggcaaagcaaggtggagcaaatggctctcaaaatgagttgctctatcttgggattggagtaggatatattgtaggcttaaatggattttggtattctttgatcctcaatagagcatggagacacaaatattttcggatcctggatcatattctggactggctttatttgtttgtagctctcaagttaaataaggttggttaa

SEQ ID NO: 45638 - DNA, 591 bp, Glycine max
  Peptide Sequence Number=SeqID_162416
atggaagaacaacttgtctgggatgtttcactggacatttcaaactttaaatcattggtgctaatcaaccttggagaaaatcattttgctggtgttgtaccaacaaagatgccagagagcatgcaagggatgattttaaggtgcaatcaatttactggcaatattccaccacaaaacaaactttctggatttattcctccttgtctgttcaacatcacttccatggatggtgcaagaagaatgagccattatcagttcagtgttgatttgtttttaaaaggttcggagatggagcatcggggtacttggctatttggaagtcttgatctttcaacaaacaacctgtctggagaaatttcaacagaaatttttggcttcactcaatttgtatctttgaacttgtgtagaaatcgtatcatgggaattatatccagcaacattggtggcatgaaaaatttggagatccttgatctctcctacaataatctttcagggaatcccaaactttgtggacctcccttaataaagaatagctctgatgaggaagcaaatcatgacaaggcaaagcaaggtggagcaaacgactcttaa

SEQ ID NO: 45639 - DNA, 522 bp, Glycine max
  Peptide Sequence Number=SeqID_162417
atgcttcatgtggattgcttctacaacttctttcgctatcgtagtgcactggtggatgcaccagattatagacctcgtatagttgatttctacatttggtggacccagcccatgccatcttactaccattttgctgtgcctatgctagaggtcatcattccatccaagtcatactcaccacctgtggacgacacaatgtcctctaccaaatctgattcttcatccaaggacactgatgctacttcatctgcactaatgtctccacaatcggtgttacttgagacttgggtaccacccgaggtaaacctaatggatcttgtgtctaaggatgaaggtaaagttgcggaggaggatacatctagaccgatgtctacacgatcagtgttacctaagtcttgggtaccaccctgggtagacttgatagatcttgtgtttgaggatgaaggtgaggatgtggagaaggatacatctatcaaggaagatacattaatggatgaggagaaacccatcatggagttgtag

SEQ ID NO: 45640 - DNA, 279 bp, Glycine max
  Peptide Sequence Number=SeqID_162418
atgcagtaccaagcccatgattgcaatagtatggcacaaccatccataactctaccaacctccgatgatgcccaacatagttctctatataggcaatggtgcacgcaagatgctaacatgttagcttcaatgcatctcccttacatgtattttctggagggacttctcctagtaactcatcgtataacttatcccaacgtgaaaggtgtgtggttcaggcctccatcgttcaaccaatggagtgatcaatgcaagatcaattttgcactgtttgattag

SEQ ID NO: 45641 - DNA, 261 bp, Glycine max
  Peptide Sequence Number=SeqID_162419
atgaggaggctaggaagcattcggagctatgcaaagcatcttcgtatagatggtgtgaaggatactatagctgttgcctctggcaaaggtggtgttggcaagtcaaccactgctgttaatttggctgttgcacttgcaagaaagtgtcagcttaaggttggtttgcttgatgctgatgtgtatggacccagcattcccaccatgatgaacatcaatacaaagcctgaagtcactcatggtatatccttttctttcttttga

SEQ ID NO: 45642 - DNA, 1609 bp, Glycine max
  Peptide Sequence Number=SeqID_162420
atgacgcatctggcgtggtctattttcgccgggatcgtctgcgggattgtcaccagctgtctcaccatcaagccgacgaaactggcgtggccaatcattacctccctggcgctgatgattgttgcctcgctgctggacagccagtccaacaacctgacccgtccggatcagctgatggtaagccagttcctgctgggcttcggcagcgccttcttcctggcgcccgctatgctggccgccattggcggagtgatcgccgacccgcgtaatctggtcagcttctcggtcatgtttggcatgagccagaacctcggcggtctgctcggttcggcgatcctcggtactttccagacctggcgtgagaagtaccactccagcctgctggcagaccagctcaccacgctcaacccgctggtcaacgagcgcattcagctttatacccagatgtataaaagcctgatcggtgacagttcgctgttggggactcaggcgattacccaactacaaagcgtcaccgcccttgaggcaaatattctggcttacaacgatacttatcttctgacggcaagcatcgctgccgccacgctggtctggattttatggcgcttgctgcgtctgcgcatcactgcccgtatggcgctgaagaacgccaccggcaacaatcagcaggatgccgccaaagagcaggccaacacccgcaaaaatgtgcgcattgtttccgttttcaccgccgctgccatcggtcttgtcggcgtgctggtgatcctttacgcctggcagttaccgccctttacccggcacgtgcagtttaccgacaacgcctacgtgcgggggcaaacgacgtttatcagcccgcaggtgaatggctatatcacagaggtgaaggttcaggactttgtgcaggtcaaaaaaggcgatctgctgctgcagattgatgaccgcatctaccgtcagcgggtgcatcaggccgaggcgcagctggcgatgaaaattgccgccctgaataataacctgcagcagcgtaaaagcgccgaagcgacgattgccaaaaatgaagccgcgctgaaaaatgcccgcgcccagagcctgaaaacccaggcggatttgaagcgcgtgaaggatctgacggcggatgggtcactttccgttcgcgaacgcgatgccgccctggcaagcgcggctcaaggcagcgccgatatcgaccaggcgaaagcaacgcttgagatgtcgcgtcaggatctgcagacggtgattgtgaaccgcggggcgctggaggcggacgttgagaacgccaaagcggcgctggagctggcgcagatcgatctgcaaaacacccgcattgtggccccgcgtgatggccagctggggcagattgccgtgcgtctcggggcgtatgtgaccgccgggacccatctcaccacccttgtgcccccccagcactgggttattgccaatatcaaagagacccagctcgcggagctgcgcgttggtcagccggtgaaattcaccgtcgatgccctgaacgacaaagcgtatcagggccgcgtggagagcatctctcccgcaaccggcgtggaattcagcgcgatcacgccggataacgccaccg

SEQ ID NO: 45643 - DNA, 267 bp, Glycine max
  Peptide Sequence Number=SeqID_162421
atgaagaagatccaaggcctacaagctccacaaggagctacatcacttaccagacgtgtaccaatgagtgaaatcgaagaagtacaggaacaaatgaaggtcgatatggaggccctgaaggaacagatgacaatgatgatggaagcaataatgagcatgagaaagatgatggaggataacactgctacagctgttgctgcaagtactgctactgagatggactcgattcacctggccgatttcaatcaagtgattgtccagtcttag

SEQ ID NO: 45644 - DNA, 658 bp, Glycine max
  Peptide Sequence Number=SeqID_162422
ctcggttaacaccagcaggcgcttgcgacgatcttcctttggctgcacccgtgccagcagctgctgtttcaccagccgatcgaccagcggcaccacactggcttcctccagccccaatagctgtgccagcgcctttgcgtcggcggttcactggcggtcgccacgctggcaattgccagccagctactcatacttaaaccgctctctttcaggcggcgatcaaccgccagccgccacgcatgggcattgcgtcgcctctgaaggtgttgtggatttccaccttcagaggtgtctttttgtgttgggtggtgagtcaggtttttcgcgcctgtccgcgcggaaatatttcatcctggttgtgctggccgctgggccatcagccaatcttaagggcttacacatgcaaaatgccgtcaacagcagcgatattctcgctgacaatttcaaacaggccgttaacagtgaaaccaatgagatggaagtcttaggccatctgattgctgaaatcctgcacagcggtatgccggtgaccaataaggccattattgccgccctgattggccggctggagcaggaagccgatgtcgtccagctggatgtctaccgtcacctgctggaactggtgattcaccacactctggatgatttttcgctgtag

SEQ ID NO: 45645 - DNA, 697 bp, Glycine max
  Peptide Sequence Number=SeqID_162423
atgaaggcattgctgccccaggcggtgttcatcggcttcaccggcacaccgctgctaaaggctgacaagcagtccagccaggaggttttcgggggctacattcacacctataagtttggagaggcggtggaagacgaggtggtactggaccttgtgtacgaggctcgtgatatcgaccagcggctgggctcgtcggcgaagatcgatgcctggtttgaggccaagacgcgcggcttgaatgcttggcagaagcaggagctgaaagccaagtggggcaccatgcagcaagtgcttagctcgcgttcgcgcatggagcgcgtagttgctgacatcgtgttcgatttcagcgtgaaaccacggctatcgaccgaccggggtaacgcaatcctagtcgcctctagcatctttgaggcctgcaagtacttcgcgctgctgcagaagacgccgttcaaggggcggtgcgccgtcgttacctcgtacaccccgcaggccaaagatgtgacgaccgaggaggtcggcgcgaatacagagagcgacaagcagttcattttcaatacctacaccgagctgctcaagagcgtgcaagcgaagccgggaatgagccctaccgagacctacgaggagtgggccaaggcgctgttcgctaccgagcctgcgaacatgaaactcttggtggtggtggacaagctcctgacag

SEQ ID NO: 45646 - DNA, 615 bp, Glycine max
  Peptide Sequence Number=SeqID_162424
atgaccactctagctcaaacatggatcattctttccttttctaacctgattcctacctcccacacatctgatgtgaccttggacagagccaagttgatttatggtatcattatgaagatggatatgaatttggggtacctcatctcccaccaaatctctcttattgcacaacatgatacatctagacttggattccctgccttgatcacaactctatgcaaggccaggggagtccaatcagattctagatccctgcagaacttgagccctgccattaacttggcatatattaagaagaactgtaggaatcttgatgatccaacagtgacatttagagggccaagtaaggccaggtgtaagagatcagaggtccccactactcagcaccaccagagacaacaactcattcttcttccacaactccagtacctcccattcagactccagttattcctccagcatctacacagataccacttccagctcctatatctgcaggactttcagactttgtatttacaccacagatgcttcattccatgctccagagcttacacagggggtagtccatcatcatgtagagccttcagggcttgggcttgccatccatcatga

SEQ ID NO: 45647 - DNA, 111 bp, Glycine max
  Peptide Sequence Number=SeqID_162425
atggagaaggaggaaagcccactaaccgaagatcaaatccaagattctccactaagtgtgcttaggtgtcatgaggcatacttgaataagttgaggtatggcttgaattag

SEQ ID NO: 45648 - DNA, 123 bp, Glycine max
  Peptide Sequence Number=SeqID_162426
atggctgaccaacaggcaaccaagtccagagccaaagccatcaagcgtccagctcaagacgttaaagaagcgctactaggaggcaacctagtagaaggataccttggatatgcatgtatgtag

SEQ ID NO: 45649 - DNA, 493 bp, Glycine max
  Peptide Sequence Number=SeqID_162427
atgggttcgaagatatcaacagtacctaccctaggtctgttggccatgctccttctgatctcctcggaggtcttagccactagtggtggtgcgggtaactttggtggtggtaaccctagtgttggtggtggattacctggtggtggtggtggtgatgttggattacctggtggtggtcgtggtggattccctattggtggtgatgttggattacctggtggtggtcgtggtggattccctgttggtggtggtgttggattacctggtggtggtcgtggtggattcccgattggtggtggtgttggatcacctggtggtggtggtcgtcgtggtggactacctgttggtggtggtgttggattccctgttggaggtggcagtggcttcccgggcattgttggtaccttccctagtggtggtggcacccctcgtggtcgtggtggctcccctcccggacgtggaggttttcctggtggagttggcggtttccctg

SEQ ID NO: 45650 - DNA, 195 bp, Glycine max
  Peptide Sequence Number=SeqID_162428
atgttttctaaggaaaccttactcgtcctaggcctcttggccatggttgctctgatatcctttagcgtgacagttaggaaccttgctgagacttcgtcaatgtgtacaacagttgctaaggagaaaaatgatgtgccagatgtcaaatacggagaaaattcatgttatttttataatgacaaaataatcacgtag

SEQ ID NO: 45651 - DNA, 692 bp, Glycine max
  Peptide Sequence Number=SeqID_162429
atggcggcaaaagacctgtattattacccgaaacaaacaacaaacaaaacaatgttgacgactcgtcaatttaaatgtatgctggagaagcataaattatttttacttccggttcgatttcaatctacttctaactggatttctcactttgcaaatacattggatatgccggaaaataaaagcgagaatcgtgctaaaatagaaagtttctgggaaggtgctttaaaggatatttacgaagaaacactaatgtatgataataatgatgtggtccacagtccggatgaatgcgttgatcctgaaacacgaaaaataaaagtccctaaatcagagtttgttaagacatataaaaatagcgtcttttctcttctggactgttatagatatgaaaataatgatgcacaaacattagaatcgcttcagagagaaattgaggatctgactttgaacttctctgaagatagtatttataaaactagtcctaacattatggtaatgttaactaaaaacaacttgccaagtgctaaggaattccttcgtggaaagtatcttatggataaagaatatcccggcagaatgaccatttatgcagaaagtcgaagtggtgatagtctagaaaccagcggctcagagctatccgatgaggagaataaaaatctaagatgtgtactatctgaaagtgataagtcgtt

SEQ ID NO: 45652 - DNA, 697 bp, Glycine max
  Peptide Sequence Number=SeqID_162430
atggttgctcttatatcctctaacgtgacagctagaaaccttgctgagacctccccaatgtctacaacgggtgaagttgctaaagagaaaaaagtgactgatgtgaaatatgaacaaaatccaagtcatggggtttgttcaacgtcaaattgctttggttggggcattccaggttttggtagtatcttccctggatggggtatccctattggtggtggtgggcctggagttggtgcaccaggaatgggcaagcctggtggtgacggacccggaggtggtggcggacccaaaggtggtacagggtctggtggtggtggacccgtaggtggtggttatggaggcgggcctggaggtggtgcagggcctggtggtggtgcaggtcctagtggtggcggatccgaaggtggtgcaggtcctggtggtggcggacacgaaggtggtacaggacctggtggtggcggacctgtaggcggcggttacggaggcgggcccggaggtggtgcaagtccaggtggtggtgaatctggaggtggtgcaggacctggtagtggcggttatggaggtgggcctggaggtggtgcagggtctggtggtggtggcgggcccggaggtggtacagggcctggtggtggtggttatggaggtgggcctggaggtgtagggcctggtggtggtggcggacctggaggtggtgcag

SEQ ID NO: 45653 - DNA, 180 bp, Glycine max
  Peptide Sequence Number=SeqID_162431
atggagggagataatggaatcgcaccaagacagtacaaatggaggcttcaatcccttctcgttctctctaacgtttgggaaccttataagagcaatcagaggagaaacttgagaaatctcaagaaattgctagagatgccgatatcactgtcggaagacactgagattatgaaatggtga

SEQ ID NO: 45654 - DNA, 258 bp, Glycine max
  Peptide Sequence Number=SeqID_162432
atggtggcgacgaggtctttgtgggggttcaggttaataaaggaggtagcgacgatggtttggatctgtggtggtgacaacaaggttgtcatagggagtttgggtttcaacgcggtggcggggtggggtcgtggtggcagtgatgtggttggtaggtttgggttcatggtgacaatgaggtcattgacaacaaagttaagagagaaactagagattttgagattttgtgaggctagagcaaaaaggagttcaaattaa

SEQ ID NO: 45655 - DNA, 807 bp, Glycine max
  Peptide Sequence Number=SeqID_162433
atgtggagagagagagcgttattggtgatcctgctactgcttctagtccagcaaatttgtgctaccaagaagcaagatcatggttgccccctttcttcctgcggcaaaatcaccaacataacttacccatttcgattaaagggccaccctaaaagctgcggcgacaataggtatgagctagcttgtgaaaacaatgttactgtgttacatttgtactctggaaaatatcatgtgcaggcaatcaactacaataatttcactatccgagtggttgatccaggagtcgatcaacaaacaaattgctcctcccttcctcgctatttcttgtctcgctccaatttcactgatacttacagtgatatttacaacatggatccataccaagctggtcaatattcaggtcgtagtaattgggacaggcttgctttccagcatatagtgtatatgaattgtagcaatccagtgactcagaatgggaagtatgtggatactgcttcatacgtcaactgggactccaaagacaagtacatatacgctattgctggtgacttaaaagcagaggacttccaagttggttgtcacgtaaagctggttgctctgacatcttggtggggtttggatacaaacaattattcctactctgccatgcacacggggctagtctatggatttgagatttcatggatgcgcctcatatgtgagcagcactgtccaagtaaacacggctgctactactacaactgctttttcgactctgtcagccaggagcttaattattgggacggggattcattagggagtgagtga

SEQ ID NO: 45656 - DNA, 2253 bp, Glycine max
  Peptide Sequence Number=SeqID_162434
atgcaactcgtctggaaagcggatcaacctgctgagatcaaattctatacggcaatcgcttcttttcagaataaatttaatgaagaagcggacgcaacggaaatggaagccctgaagttaattatccggaatccacagggacttgatacttattaccacgatcatactatttcagaagccatttcttctaaatccctgattcccgtaaagctcaatctgctgaaagccgaaattctgcttacagtgtttaaaaaagagcctttttatgagattacgggagaattactatttaatgatatttctctttctttcaaaaatgtaataatccgccatgattgtttcatctatcatcagaatacattgaatctcattgacaatcctgatcttcttagggtgatcagattttttaagtccaataatgagattctgctgattcatgcatcaaagtatgaacactttttacatactgttttatctccattagagactcatgtccaaatcaattacagctacattcgtactgccagtccggtacagcttcaggaaaaggatttccaaatggaaaagatcatttatcttcaccaggaaggcaactatatctccatcacacccgtaatgaaatacggatccgtagaggtggcagtatactcccggaagcaattatatgatacggatcagaatggaaatctgtttaaaattgaacgcaattacgaagctgaaacagcacttacatccattgtcatgatacagcatgaggatttacaggaccaactggagggacatgaatatttctacttgtacaaagataaatttctggatgccgattggtttttaagaacttttgaagcatggagaaatgaagggataaccatccttggatttaatgaactcaaaaataacaaactgaaccctcactctgcgaaaatcaacatccaggtgacaagtggtatcgactggttcaatgctaaactaagtgttcgtttcggaggtaaagaagcttctttgaaacaggtacaccgggcccttcgtaataaaacaaagtttatacaactggatgatggcacccagggaattttacctgatgaatggataaagaagatcgacaggtattttcagattggtgatattgacggagagttgcttaaaattccaaaagttagcttttcggaggtttcggattggtttgaaaaagaggttttatcaaaagaggtacagactgaaattcattcttactccaagcaattctctgtgctgaaaaaagcacctgaaattcccgttcctgcaggattgagaactaccctacgagattatcagaaagaaggcctcaattggctggggttactcgaccattataatttcggcggctgtcttgccgatgatatgggattaggaaaaactatacagatcctcgcatttattctatatcgaaaagagaaatatcattccggaacccacctgatcatcgttcctacttccctgttgttcaactggcaggaagagattgaaaaatttgctccttctcttagggtattgatgcattatggtccggacagggaaaaatcaacaaacctttttcaggattatgatatcatattgacaagttatggaatgctcctttcggacatccgttttcttaaaacatttcattttgattatattttccttgatgaatcacaaacaattaaaaaccccaattcagaaaaatataaagctgcacgtctcttacaagccagaaacagaattgttattacaggaacgcctgttgagaacaacacctttgatctgtatggccagctttcattcgcctcacccggattattggggagcaaacaatattttaaagatacgtatgccattcccatcgataagtttgaatacaacaaacgtactattgaacttcaacaaaaaataaatccttttattttaagaagaacaaaaaagcaggttgccaaagagcttcccgaaaaaacagaaatggtaatctactgtgaaatggatgcagagcaacgtaaaatctatgacctttatgagcgtgaattacgcgatttcatatccgcttccacagatgatgaaacactaaaaaacagcatgcatgttttgacaggtcttactaaactccgtcagatatgcaattctcctgtattacttaaagaaggctactcaggcgatcacgctgtaaagatccaattattaacggaacagattgaaataaatcaaaagaacacaaaatccttgtattttcacaatttgtag

SEQ ID NO: 45657 - DNA, 258 bp, Glycine max
  Peptide Sequence Number=SeqID_162435
atggagtttgtttgctcaaaaagaggaattgttgtttccctacagaagtatattctagacctcttggaagaaactggaatgagcggttgtagaccagcagatacccccatcgatcccaatgggaaattgtgggaaaaaggaagtgttcctattgatgttggaagataccaaaggtatttaaagagaaatcctggaaaaggtctgttttttaagaaaaatagtgacttggagaagagcaaatgccttcatacaccatga

SEQ ID NO: 45658 - DNA, 156 bp, Glycine max
  Peptide Sequence Number=SeqID_162436
atgcctgaaacctacaaaaacaagatggtgtggatactttgcaatgattgtggagtaaactctcatgtacaattccaaattatggccttaattgcaactcatacaacacaagacagatacagggagtacctgctacatcaagctcatcttgggtga

SEQ ID NO: 45659 - DNA, 141 bp, Glycine max
  Peptide Sequence Number=SeqID_162437
atggcacgtgttcgtgataagattaagtcgatagatggatcaagggaaactcttaagctttctgtaaggatcactgatctttggttcattgggatccttgaaaagtctgaacaagccaaaatggttattgttgattctgat

SEQ ID NO: 45660 - DNA, 180 bp, Glycine max
  Peptide Sequence Number=SeqID_162438
atgtacttggaggagatgaaagagcatcaactaaatggttctgaggagaaatcaagcaacagtgttgaagatcctgctacaatgttttcaggaattaatgaaacattgggcttaatccggattttggttgtggacttgaagagggcaaataaagcaacgcttaccttagttaatttctaa

SEQ ID NO: 45661 - DNA, 139 bp, Glycine max
  Peptide Sequence Number=SeqID_162439
aatcgattgtggaggacgcatgaacagcgctaggcaatcaattcatgggtcttcgaataagattgagaatggagaattgacgaacagcgctaggcaatcaattcgcggggctccagactcgatggtggtggacgcatga

SEQ ID NO: 45662 - DNA, 666 bp, Glycine max
  Peptide Sequence Number=SeqID_162440
atgggccatggacccaaacccccaccggccgcgccaccgttgctccgccgcatccacaacctcgaccacacaatatccctttacatccacaacctgacacgccccatcgctccacgtcccctcctccgcttcctagagctattagcagacttccgcttcttcttccccgtctccctcgctctatacctcgccgccccctcctcctccactctccggtcccacctcctccttcccctcctcctctgctccctccttgacctcctctttgtcgctctcctcaaattcctcgtccgccgatcccgcccctcctacgcaaatcactcccaatacaacgccgtcgtttctgtcgacaacttttccttccctagcggccactcctcccgcgtctgcttcgtcgcctccgtcttctccctctcccgaaactcactcctcgcggatctcagccgtccacgtgtcgcaatcctcgttcgtcgctggtttgcaagagacgacgctctcgccgttgatctgctcctcgccgccgcttgggcctgggccgtgatcaccgtcatttccagagtcgctctcgggaggcattacgtcattgatgtcttcttcggcgcgtgcttcggtgtcctcgaggcgatgttcacctttcgtgttctcgatttccaaggtttgatttga

SEQ ID NO: 45663 - DNA, 190 bp, Glycine max
  Peptide Sequence Number=SeqID_162441
agcagaatgaaaagtgcattcgacaaaaggatgtgcccacataagttcagcgagggggatcttgttttgaagaaagctttctcgggtggagcactgttactcatgaacatggatgatgaagagctgccttcgcctatgaattttgatgttgtcaagcaatactatgcatgttactgggggcagtttgaag

SEQ ID NO: 45664 - DNA, 237 bp, Glycine max
  Peptide Sequence Number=SeqID_162442
atgaccacaccaattccccattcgggccctctactacaaaattgtcgttgtcaactccaaagtcgatcggttacagtggttgatccaacaacaagacacagtgaacgtcgtgcgaaccaaccgcctcgaaaagttatgcatgacatcaagcttcagatctacaacgttggatcttccttcgatgcgttgaatcttcatgctctaacagtaaacaaaatgatgacgacaaatctatag

SEQ ID NO: 45665 - DNA, 999 bp, Glycine max
  Peptide Sequence Number=SeqID_162443
atgcattcaagtttgcaagcttattctgaacaagattcaccaccctcacctgggaagggctcaagaagcaattcaaggaaaagtactggaaatgtggatgatgtaaggtccaatggttggttagatgccatgaaggcttcttcgcctcctaggaagaagctaattaaagggtccagtaatcaggttgcttcaattgacgatgactttgaagactattgttcatggatgcttgaatatccatcagcactagactcttttgaggaaatcattgaccttgcaatggataagaagattgcaatgtttctagattatgatggcacactttcaccaatagtagatgatccgaattgtgcctttatgtctgaatctatgcgttcaactgtgagaagtgtggcaaaacatttccccacagcaatcatcagtggaagaagccgtgacaaggtttttgatttagttaaactaacagaactctactacgctggtagtcatgggatggacattattggccctgttagtgagactttgtccaaaaatcacccaaattgtgtcaagtctaatgaccatccgatttttagaatcctcgtagagattactaaagatatacaaggagcaaaagttgaaaatcacaagttttgtgtttctgtgcattaccgtaatgtagaagagaataattggacaacgattggacaacgtgtccatgatgtcttgaaagattaccctcttttacgttcaactcatggacgaaaggttttagaagttcgtcctgtgattgattggaataaaggaaaagctgttgaatttttacttgaatctctagggttagctgataggaatgatgtacttcccatttacatcggagatgacaaaactgatgaagatgcattcaagatgttgcgagagagcaatcgaggttatggaattttggtttcatcagttaggaaagaaagcaatgccttctactctcttcgagaccccaatgaggttcaaatctcaacatag

SEQ ID NO: 45666 - DNA, 318 bp, Glycine max
  Peptide Sequence Number=SeqID_162444
atgtcggtttgggaggaagttccttcctttgggtcaaagtatcttcctttttcatctgcccaaaaacatgaaactataagggattatcagtttggatgtgtggatatattgattgtgatgtattatgttgatggtttgatgtggaaatacaaaaatcttgatgtgaacatgttgattcagtgtagtgagctttttgtggtagcttttgatttgatgatgaacgcattcaatgttgtaacatttgtgttaagtggaatggtgttggatataagaaaagttgagtttttgagcgaaaatcaatgtttctgctcctattga

SEQ ID NO: 45667 - DNA, 374 bp, Glycine max
  Peptide Sequence Number=SeqID_162445
atgcagcaagcgctcacgcgaggtgccgggggactggtccacccgcctgctccacttggtcatgccggagcaggtgaagtcgccgcaagcgaagaagagagagggaacgaatgtggagtgttctggatgcaaatgccttcattgtggtgcggagaagacgccacagtggtgaacaggaccgatgggatcgaaaactctatgcaacgcgtgtggcatgaggttcaagtccgggaggctggtaccggaataccagtcggcggcgagttcaacgttcatgtcaacgaagcattcaaatttgcatcagaaggttttggagctcaggcgacagaaggagatgtagcgataacagcatcatcagtcgttgatgagtcaaa

SEQ ID NO: 45668 - DNA, 299 bp, Glycine max
  Peptide Sequence Number=SeqID_162446
ccgcttgggtatctctgtacgtcacctgacttcacgggtcaggatgacagaaagtgcggaagacgatggtgcagaagacgacgttagtctctacatgctactggactctgagtctgacagacagcgaaagagtgtttatacggataaccaattgggtatctccgcctgccacctaacttcacggatgaccacattggcctctgcttgtcaatcgaacttggggtctccgaatgacgaggtgcggataaccgaaaggtgtctccgcatgctaccagactcttgggtcatgatagcaaaag

SEQ ID NO: 45669 - DNA, 942 bp, Glycine max
  Peptide Sequence Number=SeqID_162447
atgaaagggagagatacccatcttctcttttgcaccacaggcattttattaagaagattactagctgatagaaagttaaaaggcgtaactcatgttattgtggatgaaattcatgagcgtgggatgaatgaagattttctgcttattatccttaaagaacttcttccacatcgaccagaactgaaactgattttgatgagtgctaccctagatgctgagctcttctcttcatactttaatggggccccaattatgtttattccgggcttcacataccccgttagaactcactttttggagaacattcttgaaatgacgggctacagattaactccttataatcaaatcgatgattatggtcaagaaaggatgtggaaaatgaacaaacatgccccaagaaagagaaaaagccaaattgcttctgctgtagaggatgcaattatggcagctgatttcaaagattacagcctacagacacaggagtctttgtcgtgttggaatcctgactgtattggttttagtctcatagaatatattttatgcaatatatgtgagaatgaacggcctggtgctgttttggttttcatgactggatgggatgatataagctctctgaaagagaagctcctgacacatactgtcttgggagatgcaaaccgtgttttgttgcttacatgtcatggctcaatggctagttcagagcagagattaatatttgaagagcctgaagatggagttagaaaaatagtgctaacaacaaatattgctgaaacgagtatcacgataaatgatgttgtttttgttcttgactgcggaaaagcaaaagaaacatcatatgatgcactgaataacacgccttgtttgcttcctacatggatctctaaggtttctgctaaacaatattactggacatcatttttgaatctgtcatctttatcctaa

SEQ ID NO: 45670 - DNA, 867 bp, Glycine max
  Peptide Sequence Number=SeqID_162448
atgcaaacgaccaagtacgatgtcttcgccagactcaaagcaaactactccgaaaccgtacttccgccaccaccgccaccgccacaaatcaccccgtcgacgctaatatccttcaccgtggtggtggcggtggtctgcttcgtgggtttcagtattctctgcttcttcaggtgctgtttcgtgaacataagctccaccaccctcgttcatctttctcccaatgcttctcccttcagaggcctcgacccttcacagctgcaagcgttccccacgttcctctacgccaccgtgaaggatctccgcaaggagaagaatcagtattcattagaatgcgccatttgcttgttggagttcgaccatgacagcatgctgagactcttaaccgtttgctaccatgttttccaccaagagtgcatcgatttgtggctaaggtcacataagacttgccccgtttgtcgcacggatcttgatcagtcaccattgatcacaaacaaatctccagaacaccaaaacgaggacaatattgtagaacaagagatcagcacagatcatcatcacgtgtgcattgatgtaaaagaaggtgatgatagtgagggcatgcaggaacagaagattgaatttgcacgttcacactcaacgggacattccatagttatggttagaggagaagggagacatgctgataaatatacgttgagattgccggagaatgtggcgttcaaaattgtaaaaggagggcacaactactccaagagttgttctagttccaaagatatggcaaggcttgctgcaccttgcaggaattgtggttatgttcaaactgtatttcaaagttcctcatcccgtagtgatataaaaaatatttaa

SEQ ID NO: 45671 - DNA, 309 bp, Glycine max
  Peptide Sequence Number=SeqID_162449
atggagagttttaaaacaacctcgacgtcggttacggttccgctttgggcaaagaggtcattgatgtctgccgccgtcagagaccaagacaagttaaccacgtacagcttctttacgttgtctgttggttgcgttagctcaggtgtttcttctgttgctgctacctcttgcaaagtggagcataactggaagcagagtcttcccgttttgaaggaggacttggaagagaagaaaagggaggtggaagcatggagcttgatggagatcggtgcttttgcagagaaacgatggctattggagaaccgttga

SEQ ID NO: 45672 - DNA, 753 bp, Glycine max
  Peptide Sequence Number=SeqID_162450
atgtcccaccagcaacaacatgtcatacagatgatgggaaatttcacagatgcagcctgggaatgggattttaaatggagacgacaactttttgatgacgagatagatatggctgcaaagttcttagaagatttagaaggtatcagcattcacttggatcgagaagacaagtggatttggaaggaagatgcagcgggtgtatacacagtggggaacgcatacaagatgcttatgacatgccacactgatgaaaatcaggatggtgcttttactgagttgtggaaggtcaagcttgcagaggaagcaaagtctcaattctgtggtgcatacagtgatcaccttgcacttgtaagggcatacgaaggttggagagatgctgaaatggaccttggaggatatgaatactgctggaaaaattttctttcctcacaatccatgaaagctattgacgctcttcggagagagttcatatgcctggtcaaggatattggattagttgatagcaacacggccagctgcaatgaatggagctctgatgtaaatcttatccgagcaattatttgctatggtctatatcctggaatttgctctgttgtgatgcctttcccctctaatcaatggtgggttggggtcgggaacatgaggggcagtttcccctccacgcctctctttgctttaacattacatgccattttaacatgtttacaacttgcatctttccctaatgtgtccttcctcaataatctaatctaa

SEQ ID NO: 45673 - DNA, 618 bp, Glycine max
  Peptide Sequence Number=SeqID_162451
atgccaatcttatctttcatttgcatgtttttcgtctgttggagcttggaagtacttggttgtgcctattttgataatgatacatctgctatgtatattcaaaaacacaaggaatacaggcacaggatcatgctgaactatccaccgctatgtaagcagatatatagtatggatgctgagaaatttttcacaccctcatttctcagagcagttgaagaaaattcagaagcaagttttagaagtataatggctgaacctcgtaaaggactttatacatttgaaatgcttcaaccccaattttgtgagatgctgatgtctgaggtggataattttgaaagatgggttcatgacaccaagttcagaatcatgcgaccaaatataatgaatcaatatggtgccgttcttgatgattttggcatggaatccatgctcgagagattgatgaatgatttcataagtcccatatctcgagttttctacactgaaattggtggaacctcgctggactcccatcacgggtttgttgttgaatatggaatcaatcgggatgtggaacttggtaggtttctcaaactaaggtcatcgtattgtggatatgcaattggctggaatctgtaa

SEQ ID NO: 45674 - DNA, 624 bp, Glycine max
  Peptide Sequence Number=SeqID_162452
atgaaaaagaaaggaaaagtgactatcaccttggatgatgtggcatcgttgttgcatctacccattacaagtgtgttccatagctttgagcctcttcatatggacgatgtcgtcttcctcttagtcgaattgcttaaagtgagctctgaagaggcaagagctgagacatgttggatctacgagcactttccttctattggttatgctattgttgctgaggattataatgagagaaaatcacgtgcctgtcgttggaagtttgagaaggcattaccagtatcgacgtatcttaagcgtttggatagattgacattgatgttgtgtactggatttcatacggtgaccatcgtgcattcagagagtttgaggttatctctttatttttcggacatatcagataaggtctatctattgtcatacatcgaccggatagggttgtatgacaatttggatatgcgtagcgcttacacaacgttcatcagactacatggatgtccaactaatgactttgtcaaaaatatccagcacacaattgactttgtcatatcagtaacaatgatcttttcatccttaatcagtcaactaacatatggatgtccaactaatgacttcgccaattcatga

SEQ ID NO: 45675 - DNA, 591 bp, Glycine max
  Peptide Sequence Number=SeqID_162453
atggttttggggggaaagggttgggagggcttccatgtggatgatgcagaagtcaccttaaatatttgcttgggaaacgaattttctggtggagaactgttcttcaggggtgttcgatgtgatgaacatgtaaattcagatatccaaccaggggagatctttgattatccccatgttccaggacatgcaattcttcatcctggtcgtcaccggcatggcgctagacctactacatctgggaatcggatgaatttaattatctggtgtagaagttcggcttttagagagttgaagaaatatcggaaagatttttctagctggtgtggagaatgcagacgcaagaagaaggagaaagagcgcctattagttatggccacccaacagaacgcctgtgcaaaagcacaggaaacaacccagcagagtcccatttccggagttgcgttggacattgcagatttgctgatggacgaagatcagtggatgtatgatagtataatatctgaagaagttgatatgaatgaccaaaatgaagacaaagctggtgtgaatctagtacatgttgattgttctaatgcgttcaatacttcttag

SEQ ID NO: 45676 - DNA, 822 bp, Glycine max
  Peptide Sequence Number=SeqID_162454
atggctgaaccttgtaaaggagtttatacatttgaaatgcttcaaccacaattttgtaaaaaactgatgtctgaggtggatcattttgaaagatgggtccatggtaccaaactcagaatcatgcgacctaatgcaatgaataaaaataaacatggtgttattcttgatgattttgcctttgaagccatgcttgacagatttatgtgtgatttcatacaacctatatctcgagttttctaccctgaacttggtggatcctcactggactctcaccatggttttgttgttgaatatggaattaataaggatgtggaacttggtgatgccggatcaagtattacaattaaggttagtggaagccaaaatcgttctaggccagggtcaaactcaaatatcaaccaatctggccaaaataaaggaaattcatctgtggcattctcaggcttacatgaggatgaggcagaagtcaccttaaatgtttgcttgggaaaagaattttctggtggagacctgttcttccagggtgttcgatgtgatgcacatgtaactacaaatacgcaaccagaggaggccttcaattattcccatgtcccaggacacgcaattcttcatcctggtcgtaaccggcatggcactagacctacaacatctgggaatcggatgaatttaattctctggtgtagaagttcggcttttatagagttgaagcgatatcaaagagatttttatagctggtgtgcagaatgcagacgcaagaaggcagagagagtgcgtttgtcagttgtggccgccaaacaggaattactaaagagcgaaatataa

SEQ ID NO: 45677 - DNA, 402 bp, Glycine max
  Peptide Sequence Number=SeqID_162455
atgtctaacccattggattctcactggacaacaatcaaaagaattctaaggtacctacaaaggtctctttctcatggccttcgactgaaaccagctatttcttctcagcctcttcccctcagaggtgatgctgatgggcatttgaagtggatgataggagctgcagtttacttaggagtcaatcttatttccttgtggtcaaggaaacaacaaatggtagccaggtcaagtaatgaagctgaatatcgaagcttagcacaacactggcttacaatcttgtacttcatacaagggacaaaacacccgaagattgatgtattttctgtccgagaaagagttctaactatacggttgactgtgcatcatatcccaatttctcaagggcaaactcaatgtgcttga

SEQ ID NO: 45678 - DNA, 526 bp, Glycine max
  Peptide Sequence Number=SeqID_162456
atgtctttgaccattacctcctacctctgcatgtggctcatcgctacttacatgcctatctcgtgcaacaccaaccgcaccagaatccctcacgcaatgttccgctccaccaagatttcttcgattgctatttcgcttcagtcgccactagtgagggttttgagaatttcagtttgggaaaaggagttgtcgtggagtggattggagatgtacgatgattgcagtgaagacctctctatgactgtgcttgatttcattcatggcttcgaccaccacctcctgcctttgcacgtggttcgtcactgcttgcatgtgtgtgatgctaactgcaccagaacccctcacgcaatgttccactcctccaagatttcttcgattgttatttcgcttttgttgccactgacgaagatgtatagtgattgctataaggagctctctatgactgcactcgatttgtcagagatcatagtgtttgatcatcagatcgaagagtcgaaagggagtggtgaagtgagtggtggaaatg

SEQ ID NO: 45679 - DNA, 762 bp, Glycine max
  Peptide Sequence Number=SeqID_162457
atggttgaacttcagtttaatgccaaaattaagaatcttcaaactaattggggaggagagttcggacctcttgccctctttctagctaaacttggcataaatcataggttgatatgtccacatacctatcaccaaaatggagtggtggagaggaaggatagacatatagttgagtttggtcttactctactgaaacatgcatccttaccccttaaattttgggactatgctttcactacatatatgattctaataaacagaccttataacaaacataaacttgattacaagtcacaagagtgtctttttctaaggtactcttcttcacataaagactacaagtgcctttcttcttcaagaagattgtttatttccaaagatgtgtttcctctgacactcttccatcatctgctcactatagtctccaatctattcctttggtttcctcttcaccaactccccctctctgttgctaattctacttctggtgagcactctatttcatctaagtctgcaactgatgctagtgctatacctattgatcattctgttgctgttgagaatcataattctgatagcaggttaccttctaatagtggaaccactagttgtaatggtgatcctagtgttgacactattggacattcaactgatatttcagtccctaatgtctctaacactgcctctgttgatcactcagaatctaatacccttgtccatccttctttgcctacaaccagtactaacactcatcctatgtag

SEQ ID NO: 45680 - DNA, 126 bp, Glycine max
  Peptide Sequence Number=SeqID_162458
atggcttttttcagagtgaactcgagttttgatcagaaaagtcctactctgataaattgtaaccatattaagctgcaacacgctggtcatcttcataatgggggtacactagggatgactgcataa

SEQ ID NO: 45681 - DNA, 339 bp, Glycine max
  Peptide Sequence Number=SeqID_162459
atgactaatgtaaaacagtttgcaagaatcattgcattcagtctcaaacaggaatctaaggttcactcaacatcaacaatagttgtttatatagcaaattacattggggtgtgggtgggtgggtgtggggggtggggtgtgtgggtgtgggtgtgtgggtgggggtgggggtgggtgggtgtgggtgggggtgtgtgggtgtgggtgggtgggtgggtgggtgggtgggggtgtgtgcgtgttgtgggggtgtgtgggtgtcatgagggtgtgtgtgatgagggtttgtgtgtgtgtgtcatgagggtgatgagggtggtaaattgtgacataatttag

SEQ ID NO: 45682 - DNA, 579 bp, Glycine max
  Peptide Sequence Number=SeqID_162460
atgcctacctccagtccccaagcaacctgcggtccttggaatttctttcaaccttgtaaaaaaccttttacaagcaaagattcacaagggatgtaccctcccttgttctctttgaacctagtggatgtaccctccactagaactgatccacaagagatgtactctctcttgttctcagtcaaacccaaggaatgggaagaatcaaaagaattctcagactgtgtcgttttgaattctttgacaagggagaaaggagacacaaaagaatttaggcagttagtccttccttcttttggaaaagggagaagagagacacaaaaagaattcaggcgagagaagagaatgaaaaggatgaatagctcaagttttcaaggtttggaaaaccagaaaacttcagaaagcttttggtacaaagaagaagaagaagttcaaagagatttcaagagattcaaggcttgtaaaagattgtatgagtttgttagaaagattggaaaaatgattgattcaaaatgcaaaacaaagccttgcttttatagactcttcatgtctgatcaagaagaccattcagaagagttataa

SEQ ID NO: 45683 - DNA, 876 bp, Glycine max
  Peptide Sequence Number=SeqID_162461
atggagaattacaaagaatccatgaactgcatcctagctatctaccactacagtaccctctactccttccttatggagaatatggatatagagctgacatacttcaccgttatacttcatccaacaaaaaaagaaagttataccatggttgaatatgaaagacttagctacatcagaaacaaccaaaagaaacttagagttgacaagtattgtagcttacaaaattcattggatactggaatagctaaaggcttaaccaaagggaaaagagtcatcttaccttcaatgtttgttgggagcccacgttatatggagacaattcaggatatgcgcaagaaggcacaagccaaccagaaacataacattgcccctcacgtgttgtctcgtgagggttatgaatattcagaaaacaagttgatggatgagaagagaaagaaaaaactagaggaagctgctcaatccggaagcactgacaccgtgattgatcctctatctcccatcagacaacacatgaaatggaagatggcccgcacaaagaaaactgggcaaatgacgtctgaggcagcaaaggaaattgctgagaagattgaatcgttggaggagcaggcgtcatacggtttcttcgttgccattgggcgaccagaacaccgtagtcgtgtaggtgttgttggagttggtgtcacgatcaagaaatactttggactggctccaaggacctcccgtatgtcttcctccatggctcccgaagacctggagcagctgatgcaacaaattagggaccagttggaggagtcgatcactgaaaaagtgactcaacggctaatgttatcctttcaagccacagtccatccagagatccgagcaattgaaatttga

SEQ ID NO: 45684 - DNA, 588 bp, Glycine max
  Peptide Sequence Number=SeqID_162462
atgacaacatggaataaagtggaaagaaaagataaagaacttacgggaagtagcaatgatgtcataggcggctatcacaaatggttgaagtctagaacgcaagggataacttggctcccaaagctgaagagtctgagtggggaaaaggctaaaatgcctgaggagagtgaagaggtgcaagctttgaaagctgagctcgaaaagacaagagtggcgaaggataagctgaaggtggcagtcactagggttaggaaagaatgtgatgagctaaaagatatcaacatgaccgcggctgaagcgttagagcgggacatgaagaaggccagaaaggaaaagtggagcaaaaataagtttcgaggggctttgctaggcagtagtaatgagctcaaacttagaaaggccaagagggacaaatcaaagatggaaagcctgatgttagaggataagttaaagagttgtcaaagtttgaagagaagtttgaaagaacagttgagaaaaacagaagaaaatttgttgataatcattgaccaatataaagagaaggtgaatctagctgctagtcacgagcagatgctggaagacgaatag

SEQ ID NO: 45685 - DNA, 279 bp, Glycine max
  Peptide Sequence Number=SeqID_162463
atgtttcatgattgcctaagtgcggaccctcaaggcaatcctccattctccccctttttcggagccccaggaatgtcattgtctagcgctgttcatgtgtcctccattatcaagcgcggagcctctggtgactgggaaatatgttcttctgttgttttccggatcggttccttcgccaaacatcaaaaaagaaggagtagagacgagaatcgtcatcacggaaagggcaggatggacgaaatccatgtcttatctttgcttccctcttatctccgatga

SEQ ID NO: 45686 - DNA, 270 bp, Glycine max
  Peptide Sequence Number=SeqID_162464
atgcctactttcaacgatgactgtttcggcatcggttctagaatcgatgttgatactccttcagaaccaatcttacccttgacatggatgaattgcgaaggaaggtcacaaagtacatgcagacaaaggaccgctacaacaagaaccaagaatcatgcgaccctcgacatgcccattatacttcgtcaaccaccaacaaagggaaaatatgctgaaggacgcattcaacatcgagctgctccttcctccaagaaggatgtcgaccattaa

SEQ ID NO: 45687 - DNA, 312 bp, Glycine max
  Peptide Sequence Number=SeqID_162465
atgtccgacgatgagcttgttgaacttgcgcagctgcaatttcctagaggagaagtagaattcgcaagatggaaacagagaaatgaggtgaggttgttgaacatcaaccggtcaagaagcttcctagctcggcgacgtgacctgatagaaagagtgaaatggaatgaaaatgaagctcagcataatgcttttgaagaattctatcttacaagcaatcacaaccaatctcagttcctaccccagaaaaagagactaaggtacccaaccctagggttctttgtgaataagagcataagagaaacatacccttag

SEQ ID NO: 45688 - DNA, 207 bp, Glycine max
  Peptide Sequence Number=SeqID_162466
atgaatcaccggcgaggagtgtgtgaatcaccatcaggaggtgctctaaggcctcgtaggttgggtccaactcacgggtgcggatcgcgaagccaccgctttgcctccggtcaattcccgtcgtccatgatggttggaactcttgaaaacggattagggatttcacattttggggaacgagggcagtttcatcatatcaatttctaa

SEQ ID NO: 45689 - DNA, 264 bp, Glycine max
  Peptide Sequence Number=SeqID_162467
atgatgaatcacctcaaggtagaagaaagttgtgcagtaaataggccttacaatagccacaaccttttaatatcggaaatcaagcatatgaatgtagcagagacagaagtgaaataccaattgagaaggctggcagctttaactaagaaaaagagaatgacgacaagtagcaataccacattggccacgaaggacaagaattgtaaccggctccatgccaattctaccgcaacaccacatcaacaactatcacacatcaaataa

SEQ ID NO: 45690 - DNA, 321 bp, Glycine max
  Peptide Sequence Number=SeqID_162468
atgctagcatgcagaaacatatgtttagtgaaaggcaaaaaagagagataccattaccatgaagagatgagaaggaggtttgatatagaaaggcagcagaaaggaagggaagggggagaaagagaggaaaaacagtggtatgggaggtgtagggaagaaatagcatattttgcttatggatattccttcccaatccccccatacccatgccttcccccaattttgtctcccttttcctctctctttttctctggctctggagaatgcttcttttcctcttcaatgttcatgtctcaattcacacggaaggaagccttttga

SEQ ID NO: 45691 - DNA, 408 bp, Glycine max
  Peptide Sequence Number=SeqID_162469
atgaagacatacaataatgaacatgttggtaccttaaaggtccataaacaagaacttcaacaagatgatggagtcaagaaggaaaatctcttgctcttagcactcagaaaacaaggaaaacaccatcgtgagctttgtctagaaaatgagagagctttcaaagaacgagatactttgatgaaggaattccatattttggaaggacatatgacgtctagatgcagagattttcctaagaaaggtgcatccaatacattcagaactaacaagaaaggacctaagaagatttgggaacctaagatcaagattattcatgttgcaaatgtctttaacaacaggaaagacaaacttatcatggtacctaaacaatggttgctcatggcacatgacaagagaaaaggtgtatga

SEQ ID NO: 45692 - DNA, 558 bp, Glycine max
  Peptide Sequence Number=SeqID_162470
atggctgctgaacccaccaaagccaaactaacccttccatggaaagttcatttactcacttccctcctttccactctcggcggcgcctctcgccgctccaacgcaaccatcaactaccgtcttttcaacctcgcagaccgccagtcactgccaaaccccatcctcatagacggtgtttcctcctctgccatcttcgccacctcccttaacgtcgtggtcgtctccgtttactaccgccttgcccccgaacaccgttacccgtctcaataccacgacgatttagacgtgttaaaattcctcgaccaaaatgacaacgttttatccgacgttgctgatgtcagcaaatgttttttggcgggtgatagcatgggtgcaaacctgacccaccatgtggcagttcggatttccaaagagaagctccaaatggtgaatgttattgggttggtgtcggggaaggaattgcagttaatcgattatccaaacacttttcatgggttttacctttttcctgaattgcccaaggagtttatgaccaagcaaatggccattgtgaattga

SEQ ID NO: 45693 - DNA, 2220 bp, Glycine max
  Peptide Sequence Number=SeqID_162471
atggccgaatttctggatctcgaatcccaagacggcgtgcgaatgccgtggaacgtgatccctggcacgaagcaggacgcccaaaacgccgtcgtccccgtctccgccgtctacactcccataaagcacttcacctcgatgccgctcctcaactactcccctctccggtgccgcacttgccgctccgtcctcaaccccttctgcatcgtcgacttcgccgccaagatctggatctgccccttctgcttccagcgcaaccacttcccccctcactacgcatccatctccgacgactccctccccgccgagctcttccctcagtacaccaccgtcgaatacaactccgacgccgtgggccccaccaataccccctccgtgcccccagtcttcctcttcgtcgtcgacacgtgcgtcatcgaagaggagatcgggttcctgcgctcggcgttagcccaggccgtggagcttttgcctgagaactcgctcgttggactcattaccttcgggatgtttgctcatgttcacgaattagggttcggtgcggtgccgaagacttacgttttcaagggatctaaggatgttaccaaggaccagttgctcgagcagatgagtttttttgcgaagaagccgcgcccggcggtcggcgtggtcgctggcgcgagggacgggctctctacggagagtatttcgcggttcctcgtgccggcgtcggagtgcgagttcactctcaattcggtattggaggagctgcagaaggatccttgggcggtgccggcggatcagcgggctgctcggtgcaccagcacggcactgagtattgcggcgagtttgttgggggcatgtgtccctggctctgctgcaagaataatggcatttattggaggaccagctactgaaggacctgctcctgtaagagctactcatgaagcttgtgtagttatgtataagcttggcaatattgtatccaaacaactttctgaaccaattcgctctcacaaggatctggataaagattctgtgccacattaccataactgtgtgaaattctatgatggactttcgaagcagcttgttcatcaaggccatgtactagatctttttgcttgtgctcttgatcaggttggaattgctgaacttaaaacagctgttgaaagaaccggaggtcttgttgtacttgctgaaagttttggccattcagtgttcaaggattcactaaagcgtgttttccaatcgggtgattatgatttgggtctatcttcaaatggaatatttgagataaactgctctaaggacttgaaagtccaaggtattattggcccttgtgcatctcttgaaaagaaaggcccattatgctcagatgttgttattggtcaagggggtacaagtgcatggaagatgtgtggccttgacaaatccacatcattgtgtctatttttcgacgttgtgaggaaggaaactcctgatgcaacaatgcagtccacaagcaatcaattttacttccaatttttgacttatcagaataacagtgggcaaatgagattacgggttacgaccctttcacgtagatgggttgctggaccagaaagtatacaggaccaggacctcttatctgctaagaatttaaagtggctcaagagatgtgcaaggtttgagatgtctgatgatcttatgggtgtgagttttatgaggcttgatattcttatttcttataccaaaattgttgagcaagtttacccagttcagtttaaggagtactatggacaagtctgcattttctcgagtagaggtgaggcaagagtgaggggtagagtgagcttccatgaggatcctcgacggacacacgccggaaacatggatgaacaacagcaaggctacaatcgagcaaattggcgggacaagaaggactggggtgatgtgagggagattttcatctctaagcaaaaaaacaaaaacggcaggagatacgattttgctagattcaaaggagtgaaggacgcacacaagctagcaagggagctggaccaaatggtcatcggcggactgaagatgtacgttaacatacccaagtatgggagagacatggcgaggatggtagcggcacaacctaaaccacagaggtatgaggagaaacatcaaaatacagcagcatattggagacaacctcacgcaacaccagcttcgacctcgtacgtggcagtggtggccagaaacaagcgaggg

SEQ ID NO: 45694 - DNA, 279 bp, Glycine max
  Peptide Sequence Number=SeqID_162472
atggtagcttgcccaggcgagctgagacttagccatgaagcaattgactcgcccaggcgagctggttacttaacatggaagtcttttggtggcccaggcgagctagaggctattctgggcgagcgaggggccaggaaactcaatgaaaagaccattttgcccctccttttggcatatttcccattcttgatcaaaacattgaatgatccttcgttttgtgcggtgactggtatcgaacgatgcagtttggctagcgagaatcaaaaacatcaattatag

SEQ ID NO: 45695 - DNA, 159 bp, Glycine max
  Peptide Sequence Number=SeqID_162473
atgcagggtttattatcgaggacaacaagaacaacaaacttgcgtcagagtgaagaccaacaaagttgtggctggctatggagacttacacaggcaaggttgcggcggagtgaaggacctaggtatgacccaagcaggaaggctaaaatcgcgaattaa

SEQ ID NO: 45696 - DNA, 450 bp, Glycine max
  Peptide Sequence Number=SeqID_162474
atgaagcttcactgttatcaagcgagtcggagacccaacatgaccacagatcgacctccactccttatggctcatatagacccggcggagtcaccatctgtcgcaacctaccctacgacgggagggcgaggcaaaaagccaaaggagcgtcgtccaaaaaggaaaatgtgcgggagtcgccaccaacgtttattcgaggaaaacattagaaaaaccaaaaaggggtctgcgaatattgaaaataagggttcgggagttgtttacgcatggggaagggtattggatagaagacttcaaaaggattgggctagagctgctaaagaaagccctggggttctcatgaacctaagggaggtgagtttagctattagagagcttctcaaggaagttttctcaaagaagcttctcaaggaagttttctcaagaaagcttctcaaggaagctacctag

SEQ ID NO: 45697 - DNA, 864 bp, Glycine max
  Peptide Sequence Number=SeqID_162475
atgggggatgacatggtgttgttacttgggcttacggatgctaaagccaaaagaatgatgcaggaggcacgagagggagaagagtccatgttctactcgttggagaaatggaatccgagcctacgtatgggtcaaagactaacttgggtccaatgttggggaattcctttgctagcttgggataagacgcacatccaaaagattgtcgctgctatcggggatttggtggatgtcgatgacgatgtcgacgcagctcgaagggtggacagagcacgagtgctcattcgcactccatggagccccgcaatacaacgcacgataactgtatacgtaggtggggaggtgtacaaggttcaggtagtggagaaatacagtcaaagcatcgagacatgccactgccggcgaaggagtgttctgtggtcgtcggaggaggtcaagtccgacgacagcagtatcagaacgtcggtatcaggaatgagacgtgccccatacaacgacgacgaggcgcaagccatcacggtgccgccaaacacggctggccgacgacggaccttttccgacttcagtatcaggagagacgacctcgggacagcggctatacccaatggtctaaccatacaccttagtccgctgggtaactgctttaacccgagggtaacggtcacatgcatagataaggacgaagaccaggtggcacgtcaggggttggtggcaaatgagatgagcccagtcaaagaaaggagttttctggggtggagacacgagacttacatcaggatgaaggagtgggtaatagtgggttggactttcctatccacacccccactaaagcaaaaggccatattagtagcagcccacaactaa

SEQ ID NO: 45698 - DNA, 360 bp, Glycine max
  Peptide Sequence Number=SeqID_162476
atggtgaatgaaaaggatgggaagaatcagttggaggaggtagcagttatatggaacatggctcaagagttgggggcaacatgtttaggaaggggggtaaaatgggctgcaattaggagaatgatcaaggaagaacatattgatatgatatgtatccaagagacaaagaaggagaacattgacaagagcatatgccaagcattgtggggggacgctgaagtgagttgggaagtgcagcctgcatctaacacagcaggagggatcttatgtatgtggagtgaagaaactttcaaactacaaagcaaagtcattagaggaggttttattttgctgagaggccaatggcttaaggaggactag

SEQ ID NO: 45699 - DNA, 162 bp, Glycine max
  Peptide Sequence Number=SeqID_162477
atggatccttggtttgagtttgatcgccaaaggctcgttcaagcttggaagaactcaactatggataacaacaactactttaatggagtgataaaagattgtttggctttaatggatttccatgaccttgataggcttgtttttgcttttagaaccagctaa

SEQ ID NO: 45700 - DNA, 1014 bp, Glycine max
  Peptide Sequence Number=SeqID_162478
atggcttccgaaaccccaaagccaaaacccgttctaccgtggaaaacccgcgtttcaatttcctttctctctaccctaacggactatgcacgccgttctaacggcaccgttaaccgccgtctcatgaacttcctcgatcgcaaatcccaacctaacgccaaacccgttaacggtgtttccacccaagacgtcaccgtcgacgccaaacggaacctctggttccgaatctttaaccccgcagccgcctccggcggcggcctccccgtcgttattttcttccacggcggcggcttcgcgttcctctcgccggattcgtttgcctacgacgccgtctgccggcggttctgccggcgagtccccgccgtcgtcgtctccgtcaactaccgcctcgcgccggagcaccggtaccctttgcaatacgacgacggtgaggacatcctcagattcctcgacgagaaccgcgcggtgctgccggaaaatgctgacgtatcaaaatgcttcctcgccggcgacagcgccggcgcgaatttggcacacaatgtggcggttcgggttgccaagtcgggtccgctccgggaagttcgggttgtggggttggtatcgatccaaccgtggtttggcggggaggcacggaccgcggcggaggtgaagttcgagggggcgccgctggtgtcaacggcaaggacggactggctgtggaaggcgtttttgccagacgggtcggaccgtgaccacggggcttcgaatgtgagcgggccgaattctgaggatttgtcgggtttgaattacccggatacccttgtgtttgtgggtgggtttgacccattgcaagattggcaaaagaagtattgtgagtggttgaagaaatcagggaaaaaggctcaattgattgagtattcaactatgattcatgcattttatatatttcctgaattgcccgagtcatctcagttgatctcagaggttaaggatttcatcaccaagagaatttccgatttaaaatcaaatatgtaa

SEQ ID NO: 45701 - DNA, 255 bp, Glycine max
  Peptide Sequence Number=SeqID_162479
atgacgggaagggaggcgatggggacgacggcgaatgaacgaatggataggcggaaggagaggttgcgggtggggtccacagtgacgtcggaggaggaaacgctattaacggtggtggggtttgggggaagtttccgattgaagaggttgaagagacgacggttgacggtgccattggagcggcgagaggcagtggtgaaggtggaaagaggggaaacggcgaacgaacttttcataaaagggagagggttgtga

SEQ ID NO: 45702 - DNA, 329 bp, Glycine max
  Peptide Sequence Number=SeqID_162480
gcgccggcgcagggcgcgatgccgcacggctggtatcaccatgtgttcgccaccaccttcgactggctgacccggccgcgttggctgggatactggctcggcggggcgaacctgcatttgacgcatcatctgttcccgcactggagccaccgccattacccggcgctgagccgcatcatcggcgaggtagcgccgcgtttcggcatcgactaccgcctgctggagttggaggagctgttgcgcctgcagcagcgcttcctcagcgcgatggggcgcaaaccgcattagcgttgcatgcggattgtgcgaggcgttacgcagttcactaa

SEQ ID NO: 45703 - DNA, 342 bp, Glycine max
  Peptide Sequence Number=SeqID_162481
atgaggccagccaggtttatctggaacaggtgttggtcttcgacgaaatggagcgtctgcgcttggcgcgccagatcggcgccttgccgctggtcacgctggtggtttccttctactttcccaccagcgcggccagataaggcgccgcgtcaatgcgacttcatgcccgccgcggtcatcagcaggcggaacagcgaggcgaccacgaacagccccagcacgctggcgctccagatgatcaccagccaaccgatgcgtttccaccagggcgccggcgcggcggttgccgttttatcttgcatagcgtcctcccttctcagtgatagccgtgttcatggctga

SEQ ID NO: 45704 - DNA, 948 bp, Glycine max
  Peptide Sequence Number=SeqID_162482
atgagagcaccatcagccatcctcaggagcctctccttacggcggattcagccgagggccgcctcggccgtggtggccccgttgccggcgacaacccgattcagccgcgaccttgcggcggagctcaccacccttcagccacttggcactagtggtggtgagcatggcatggctcaattgcttgatgcagccatcacaacacaaaaaattgccttaaattcacttgctcaagtttcctacttagccgatgtggaccgtggagcaatggaagagtacctagaaaccaacactgatattctcgatgcatgtaattactttgtggaaagaatagaggacatgaagaagtacgtggaatcattaagaatcgttgcacgttcttgtaccaatgctaccacatcacgtgcattggaccaactggaatcatgtcatggcatagaaaagagattgaaaacaatggagaagcgtggctcttgtttgaagaaaacaatgttgaggcaaaagctaggccaagaaagtgagttcagtgagattgtgtgtgggtctaaggtcatggccttaatgagttgtttttctcttgaacatgccttgtcatttgattgttccaaaggtggatttcccgtggtgaagtgtcaccccatgagttgttcatggttgagaattatgcaggatttggcagagggaagtggtgagaagaagaaaattagaagatctatgattgagttgcagcagatagtggatgcagctagggaattgaaagaacagattaagggtaagagggaaaaagagaaggttgaatattcttgtgttgagagagtgaagagaagttgcggggaattggagggtggacttggttttgttgaagggaaagtgagagatttgtataaaagtttgattgatgttagaatggctttgctgggaattcttttccaggcttttagatcagattaa

SEQ ID NO: 45705 - DNA, 783 bp, Glycine max
  Peptide Sequence Number=SeqID_162483
atgacggaacctggccattggaaccccgtccttgaccgactcgaggccgccattgcccacttcgctgccacccaagcctctatggctgccagactagatgtccttctcctgaaaatagataccccgttaatcagccaacaccctccatcttcttcctttgcacaaccaccttccgcaaacatacccatgccgtcgtcgtcgccgcccatgtcgattccactttcatgccccgtgccgatgcaacaaagccaagcacccatgcttgctcctcacctttcaaccaacagcaagcaccatgtgccccacgcgccttcctccatcttcaaccagctcgttcacgctcgagccgttgattccttcaacaacctcttaagtgttgttgttcattatggttgtgcagtgactcctcatgacaagcttttggaaaatagagacatgacattgtttgagatgagagttgagtcctatgggtctgccatggttgcacgcaagcgccaactagcagcttttgcactatggatggctgctaaaccaagtgagtttcgtcgggacagaccttgggatcctggtattacttttggaagccatggtttgaagccccaacaccttgaggacaaggtgtttttgatgggccaaggaatgttaggagggagaaaacaaactagcagcaaaccactactcagggcacaaccacagtctcaaatggaaaatcgtatcaccaaaacgcttaaggaatttcacataactaattatgttagagcttctgagctggcaggatattag

SEQ ID NO: 45706 - DNA, 1040 bp, Glycine max
  Peptide Sequence Number=SeqID_162484
tactacctcgctcaatcttcgtgaacaagcgacaacaaacaatgtcgtttctccgcaaatccccaaacaaaaccctcaccaccctccgtcgtttcgcaacaaccctagccgcgaaacccttccccgacgaccccaccgccgcctactacgaccagcttgccttcgccgccggcgactcgggcgacttccacgcgctccgcgacgtcctcaacaagcgcatacaagacggcttcctcaacaccaagattaccttcaacttcctcaaagacaccaacttctccccctccgtaatcgacaacctcgtccaaaccctctcccacctaaaccaaggtgccacgcgccgcagcgccctcgactccctcgtcacgcgcctctgcaagctccgtcgcgcggatgaggcgcttcgcgtgatagattctctggcgcgtgacaacgtctgcgcccccgccgcgtgcaccttctacccagtcctcaaatgcctcacccgggaagaaaaatccctcgaccacgcgcggcgcgtggtcgatcacatggccaggctcgggatcgcgctcgacgtgacggcgcacaacatttttctcatggcgcactgctacgccggcgagttggacgcggcggccggagttttgaaaagaatggaggaggacggtgtgggggcggacccgcgtacattcgacgcgctggtgcttggcgcgtgcagggctgggaaggtggagggtgctatggtggtggtgaggaggatggtggatgatggagtgcccatgttgtactcaacacacatgtgtattattgggacccttttgaagatgaagtgctatgaacttgctatgaagtatgttagggtttttgttgggaaggataagttgttggattctgagcttcttgggtgtttggcctgcaagcttgtgaatttgaagagggttaaggagggaatgtctgttttggaggaaatgaagcaaaagggtgtgccaatgggtcataagttgaacaagttttatgaaatgaatgctggaaatgaaaatggtgcaagggttgattga

SEQ ID NO: 45707 - DNA, 237 bp, Glycine max
  Peptide Sequence Number=SeqID_162485
atgtcgagaggggggacggggaaaacccgacccccgtcagggacggggatgggaggtgtatttacacccccatcggtttcgggggcgggggcgggggcggggagggaaatggggagtctggggctggggtggggtaaacaaaatccgaccccgacccgccccgttgccatgcctaggaaagggcagggaaaacaaagggaaatccttgaaaattattcatggcaggatatcttgtaa

SEQ ID NO: 45708 - DNA, 810 bp, Glycine max
  Peptide Sequence Number=SeqID_162486
aaaggaggtggaactattgatcttgaaccttgccttacacatacctcaactgttgagcctacccttgcaccagttgctactgagcggacaattactactagggctgcagcttcgaatgcattgcggcagcaaagatttgtacgcgaagttacaatacagtacaacctctgcaatgaaccatggatcaaatatagtataagcattgttgctgacaagggtctaaaaaagccactctatacatctgctcgtttaaagaagggagaagttctttatctggagacacactcctgcagatatgagctctgttttactggagaaaagatggcgaaggctataccagcaactcagatgcatgacctagatacagagaagtctcaaaatcaccatcaccatcccacaaatggtgacaaagctgattctgataatgttatggttgatgtatttcgatggtctcgatgtaagaatcctctaccccagaaactgatgcgcacgattggaatccctctgcctcttgaacatgtggagaattttttctcctcaattatgacttatgagagtaactcttgtattactgttgaatattttcatttgcctgttagtctacttactcgtttgcttaggtgtacaacctatgaaatgggagaggatggtagcgtgtttttagaaggtaaaggggaaaatcttatggtgctagaggaaaacctggactgggaagatgtacagtggtcgcaaactggcgtttggattgcaggaaaggaatatacccttgctcggggggggggggatagaaggggaacggtgctgggatga

SEQ ID NO: 45709 - DNA, 1566 bp, Glycine max
  Peptide Sequence Number=SeqID_162487
atggcttacgtagatgatgatgcttcttctggctctggagatgatgtgaacttgttggatggacacaagcgtcaggctggcatgccatcgaattcttgcggtgtccgcaagagaggccggaaagctactggggctgctatagttgatgctatgctggagatagcgtctgcttcgaagatgagggcaagtgcaatcgtgaagaatgaggaaagattctctataaacaagtgcatcaaagtgttggatgagatgcaaggtgttgatgaacggatttactttcttgctttggatttgtttgaggaccaccctaatgcccgggaggttttcatctctcttaaggacaaaaaacgattgcggtggttgcagggcaaatgtgatacaccaatcagcatggatgacattgacctagaattggatgagatggaactagttgctgctgctgctggataccattactatagctgtctgaccaaacagcctgcccgtggtttatcacctaggagatgcgaatttatgacagaagtgctgaatgggcatggtgacttttgtcgggaaatgttgcgtatggacaagcatgtatttcacaagttgtgtgacattctccgacagagagccatgttgcgtgatactgctggcgtaatgatagaggagcagctagcaatttttttaaacgttattggtcataatgagcgcaatagagtgattcaagagaggtttcaacactctggtgaaaccattagccgtcattttaacaatgtattaaaggctattaaatcattgtcacgtgaagttttgcaacctcctcagctcaagacacctccagaaattctcaacaatgctagattttatccatatttcaaggattgtataggagtaattgatggtatgaacattccggctcatgttccagccaaagatcaatctcggttccgcaataagaaaggtatcctatctcaaaatgtgctggcagcatgcacatttgacctgcagtttatatttgtttatcctggttgggaaggttctgtcaccgactcacgagtgttaagggcagtccttgataacccagatcagaatttccctcaaatacctcaaggaaagtattaccttgttgacaagggatatttaaatacagaagggtttattgctccttaccaaggggttcggtaccagcattatgagtttagaggcgctaatcaattaccaagaaacgcaaaagagctgttcaatcacaggcattgttttctgaggaatgctatcctgaggtcatttaatgtgttgaaaactagatttccaatcctgaaacttgctcctcagtattcctttcagattcagcgcgatatagtcatagctggatgtgttttgcacaatttcatccgccgtgaagaaagaaatgactggatattcaatagtgttgggggctctccagtagaggaaatttcagatattgatgaacttcccgatgtgccgatgctatcttcaatacaagaacaacttgcattctcatcgagggattcaattgcttcatctatgtgggatgacttcttaactaaatgggatgagtggtga

SEQ ID NO: 45710 - DNA, 1584 bp, Glycine max
  Peptide Sequence Number=SeqID_162488
atgtctagagagagaaactccagcgagagagagtgcagagaggcaaacactggggagtgggagagggttaggtatagagcgaggaacaccgagagaaatggagcgagtggatttcgggttccccatcggatccacgatggcaacagggatggccaaaaactaagctacaatcgagctaactggagggacaaaaatgatatctcgtccttttacttcacacgtatagctgaaggtgtcacagaactggacatctggaaccagttcaggaagtggggggctgtaagggagatttttatttctaagcaaaggaatagaaatggctggagattcggttttgcgagattcactggagtggaggatgcgcacaggctagctaagcaactggaccagataattataggaggtttgaggctgtatgtcaatgtacctaaatatgggagagatgagacaaggaaggtaggggcacaaatgcaacctgaaaggatggacggaaagaagcagaacgaaaacctgcacaggaaacaatatcaagtctcgacggacatgacttcgtatgcggaggtggtggctagaggaaagcgcaacaatagccactcgagcaaacctatcaatcaaagaggagaacctcagtcatcccttcagcttgacattacggcgactgataaggaatggttgcggaacacatgggttgggcgcctgaaaaacttaagatggtatgatagacttgacgaagatccattgtgggactttggagaagatataaccccgaagtatattgggggtgatatggtgctcttactgggcctcacggataaaatggcagagtgcatggcgaaggagataacgaaggcagaagcactgttctattccctggagaagtggcaccctagccttcgacccgggaatagactgacctgggtccattgctggggcattcctcttgaagcttgggataagaagaacattcagaggattgtctcggtgctaggagacatggtggacatcgacgacgatacagaagagtctcgtaggatggatcgagctagggtgctaattcgtacgtcgcggggtccagcaatccaccatacgataaacgtcgacataaggggggacgctcacagagtgcaggttgtggaggaagtaagtcgtagtggtgagacatgccagtgttggagacggcgaacgaaatggtcatcggaggaaatagaatctgaccatagtgcttttggatcaccgataaatgaatcgtttgatccatgcagaggtgaggacaggtttcgaacatggaacctagctgatatgttggagacggcaaggaatccggccaaagatactgcagggaccatcgctgcataccaattgcaggcgccggaagttccaagtccactattacccaaaggtccatccattgatgttggaccaatggataacagcattgttcagcggacacagcttcgaattccgacggtccctgtaacggatacctgcaacgaaaagaggacccaacacgtcatatcgcaggaggcagcaacggagcttcagcaaggggagtttcaacaaaatcaaaagaagaaaggggagcag

SEQ ID NO: 45711 - DNA, 363 bp, Glycine max
  Peptide Sequence Number=SeqID_162489
atgaaaaggataagaggtaaagcagaagtctcttctgttgtttataaagttggtgaaagcatgcaagaactgataaagttgtggaaggaatatgaattatctcaatctcaagttgaaaaaaatagtgaaagctctaatggtggccccactcttgaaatccggataccagctgagaatgttacagctacaaaccgtcaagttagaggtggccagctatgggggactgatgtttacacttatgactcagatcttgttgctggttattgtcgcccaacagcttctccacctcacatggctgtacaagagttgcgcacaaccattcaagtgctacctccgcaagattgtatgtccttacatgaataa

SEQ ID NO: 45712 - DNA, 545 bp, Glycine max
  Peptide Sequence Number=SeqID_162490
atggctactccacccagctctcctcctactccttctccttctttttctcctccttctcttactgaagcagcatcacagtcgccgtttaccttgaagctgacaagaaaagccacacgactaagatcattagcgactagaccagttggggcagacagactgatggtccacgtcgattctgcgatcaggaaggccgacggtccccacaagaagaaattaagaacatatttggggattgtcgctcgtgataaagtcgtcgtgacatacgagaattggaagcaagctgaatttgatatccctggagcatctgacattaggacaaaacagaaaatacttcagactatgggggagcaatggagacagtttaagtctgatttgacgtcaaaatggacacttgcagtcgacaaggatagtgtggatgacactgcaaaaaatacggcattagcaaggagaaatgggcccaattttgttagagccgtagagacccctcgtgggaggatgtgcggagaaaaccataggccatcaagaagcaaaacactgccccccac

SEQ ID NO: 45713 - DNA, 390 bp, Glycine max
  Peptide Sequence Number=SeqID_162491
atgacccctacttatgatgccctactgtattacaacgggaggtggaacatgtcacaccaaaatgagtttgtcggttacttgttcacaggaaaaaatccaaaaaagtttgacattccttccggatgtatcatcgatgaactgaaggacttgatcaagcacgttgcacctcatgggatttccccttatggtattcatgaatcacaaacgctgaaaactaacgatgacgtgctaaaggtcttagtacagtctaactactggaaacattttgagccaatagaaattttagctatttttagtaaacagcctagaccaagttgtataacgttgcattctaactatgtacggagtgagccactgctttgcctgagaatgaccatgtgtactccatag

SEQ ID NO: 45714 - DNA, 1455 bp, Glycine max
  Peptide Sequence Number=SeqID_162492
atgagtggtgttcctaagagatctcatgaggattctgttcatcagtcttcaaagcatccacatcaagattcaggtacatattccaagttgatgccatcagtttcaaatgaccaccatattccttatgatatgagtcaggattcccgggtggcaaagacagtccgtactgaacctcgtgatgcagatagaagatctcatcttcatacagtgtatcggatgccattatcttcaaatgattctcatgcagatcatcccattggacctgagagcaggacagaatctagggattttaaggagagtagagaaccccggtttgagaatcgtgatacgaagacagagaagaaggaattgcatggtgaagccagaagggattctcagattgcaaagagtgagaaggatgtgcgagttgatggcagaggagatgataacaaggatattagatatgaatgggatggccataatgattcgaaaggtgacattaagacagacaaggatggctatggtatggtaagcagcagcagccacttgaattggaaagaatcaaaagagtataggggtaagagattttctgatgcccctggtgggagtttggattcctggcatacatcacgtggaaatacaccaaccgaagttggaaaggacagttcaatggcagaagaaagagactatttggaaacacatgaggctaaaaggagagaagtgatcgcagaagcactacgcccagttaacaataatagtggtgacaacaaagaatctgccaaggaagatagagatgtagaaaaatgggagagggagaggaaagatcttccaaaagagaaagaaagttcaaaagagaaggaaaaggatcatagcaagagggaatccttgaacggaatggagaaagatggtttgaatgatgggaaggaactttgtgaagaaaaaaatactgagctagaaaatgtgttaccagaacaaaagaaacagaaagatgttgacagctggaaaaatgttgatggagaagttagagagaggagaaaagaaagggatgctgatttagaaggagatcggcctgataagcgcagtaaaattgacaagcaatcagaagatggaagtgctcacggggaaggaactggagagaaggagagggaagtccataattataatgttcaacatcgtaaaaggatccaccgatcaaggggaagccctcaggtggccaatcgtgaggctcgttttagatctcatactcaagctccagacaatgaagagaatatggacagacatggaaataagaattctgttcgagaagaagtggagggatctgacagaatgcatgctgtcgtgaggaaaatagtggtggataggctaggatcatggcatcatgcaagaaaacgtgattatgaggggtccagatggggtgaagaagggtattgcgtagtggatcttgctcctagagttatttccaaaatatccttgtga

SEQ ID NO: 45715 - DNA, 534 bp, Glycine max
  Peptide Sequence Number=SeqID_162493
atggttgttgttgttccgatgttctttcgccgttcacttcttccgttggtggtggttctgtgttggatttacgagcattttccgtccgttgcttccattgttgctgccaaggattacaacgagatgagactgcgtgcatgtcgttggacctctagcaaggcactgctcgtttccatgtatcggaggcgtctggatagactgacccttgacgcgttcgactacatccagactattccgtcacaccctgttgtgtcttcgctgtctgctgcagaaattgatgatagatggatgcagtttggtgactacattgcgcctgtagggcaattatgtgcagtgtctggccactgttcgccagattacctggattggttttacatgatcttgcacccattcatgagtccggcacagcaaggggatcctcctagagtaccgtcaattcaacaacatgaagaatttgttgaagcagatatgtatccgcaaccgatggcgacagcggcacctaatgaggcagacattgatcaacatcatctttga

SEQ ID NO: 45716 - DNA, 483 bp, Glycine max
  Peptide Sequence Number=SeqID_162494
atggattcgcctagcactagtggcggcagtgctatgttggagttccacattggcgtgttcaaggacctcgcggcggcgtccaagtcggtgagggaagtcgccgcaaagcaaatggtgatggagttgaaggttgttcataacgcttatgattcacacgagaaggagagtggtgagggtggattgaaattggaagcggagaaagatgatggattggataactgtgctccgtctgtgagatacgttgttcgtaggcttattcgcggtgtttcttcgtccagagaggatcaccaatctgtaatccgtatggtcgtagggattggtgatccgtatgggtcataccaatccgtatgttctttgcatacctcttcttctccgacaacgaaaatcgatcacaatccaccgtatactcctcaccaacacacgtacaccaccggagaacaaatacgcttccaaaccgcccttaacggaagcaatgtacattaa

SEQ ID NO: 45717 - DNA, 351 bp, Glycine max
  Peptide Sequence Number=SeqID_162495
atgttggtgcgcatgatccgcactcgtctctttgcagcggcacgggtgaaatcttgccccagtatgcatagtagctgtgtgatagcctccctctctggttgtgctcgcacagttggccctcctccaatatcagggggtggcccaggaactgttaaaaggaaactactggtgtggatatggagcccactgaaagtgaggatgcgtagtcctctaaaggcgagggcgtgtagccctatgaagttcaggacgtgtcgcctttcgaaggcgagggagtgtagtcctatgatggcaaggacgtgcaatcctctgaaggtgagggcatgcccccctttgaaaatggggaacatgtag

SEQ ID NO: 45718 - DNA, 312 bp, Glycine max
  Peptide Sequence Number=SeqID_162496
atgaagaaaattgaagaggaagtctctactacaagcctgctaagcgagatggtttccattgagcggattataggccgagaagagaaatttggaaattggaaatctgctgagcaagggaggaaaacactgagtgaattggctttcctcaacatgaaattggaatcatgtgtgtatgatcttaaggttgcagaagcgtataggactgcactgaagaacccagttggcttaactcctttccaaatgatttatggaaaactggccacttatcgatggaattggagaataaggcctattgggccatcaagtttctga

SEQ ID NO: 45719 - DNA, 441 bp, Glycine max
  Peptide Sequence Number=SeqID_162497
atggatcttatggggtgttcgttcatgttgtttgtgaggggtgtgtccatgttgaggcaactatgtcatcatcaaagaggagatcactataaaggatctataatgcttaaagcatcctcttgtaccatggcgatgaaaaccacaatgatctatgggacaatcccaatagggggtgttgttgaggagtcggtccttaggtcatcgaaagaccacaaagtgggtcatattgtttggtggtttatgtgtggtggtcgaggactcacccatgcaaccaacatcttgcagatctacatagcatcctcgagatcaaggatccacatgaccacgtggatgcttgacggatattggcttcatgacgtggaaatcctttgtgccacagtgaggatgctagatgaccttgagacaaatgacaccaccctactaccgaatagacgacgctag

SEQ ID NO: 45720 - DNA, 318 bp, Glycine max
  Peptide Sequence Number=SeqID_162498
atgtctgcaagctgcattgaagaagagacaggaatgagctttagtaagcctgcgtttactttgtcccgcacgatatggcagtcgatctcaatgtgtttgggctcggtactccgcctcggaggagctacgagacactgtagactgcttcttggatcgccaagaaatgagagactctccaagataaacgaagaacccaatgatggagcgccgtgtgtctcagcaccctgcccaatcggagtcactgaaggctttgagagtgaggtcaccatgagcaacaaagaaaatgcccgaaccaggagaacttttgaggtagcgtaa

SEQ ID NO: 45721 - DNA, 303 bp, Glycine max
  Peptide Sequence Number=SeqID_162499
cataaatatcctgcacctggagctccacaattggcaagaagggtgaaggaactgctcataaaatctggtttcagccgtgttgatgaagatacaaagccaggacttgaccatggtgctagggttcctctctttttgatgtatccagaagctgacatccctgtttgtcagctatctgttcaatctcagcaagatggaacttaccattataactttggaaaggcattggcacctcttaaagatgaaagtgttttgattattggttctggaagtgctatcctgcacctggagctccctgggctttag

SEQ ID NO: 45722 - DNA, 456 bp, Glycine max
  Peptide Sequence Number=SeqID_162500
atgtcttcttctcattttggtgagggttctggtggggatcagtctctagttttccgtcaaaagtctatgttggccactgagattttgggtattggggaggagacaaagggttattatgaatcttctctttcttttcaagatgaagaggagtttatgcaaatgatgaagggtcttgaaggtgttgggaaaaattcagatgaaaaaattgtttttgataaaatggataccaattgtggtgatatcaccattgttgttgaggatgatgcaggggatgatggagttgaaaatatggaagaggatgttgacacttatgccttctacttccaaagtgctaagtccataaaggaacttgaagataggtccaattttgcttatgtctatgaggatcttttcaaagatttagatataactttacctttcactaacttcgagtgtgagatacttattgagatgaat

SEQ ID NO: 45723 - DNA, 1615 bp, Glycine max
  Peptide Sequence Number=SeqID_162501
atggtatcagagctcttcttgaagaagagttctgctgtgtcacctctctcttttacactcccgtgttttcctctcatctgctttctcaccatgaacgagtcaatgctaagcacagatagttatctttaccttcacccaagtgagaacctagctgttgcactggtttcacctcctttagattctagcaattatcattcatggagtaggtccatgatgacggcattaagcgccaagaacaaagtagagtttgtaaatggaaaagcacccgagccattgaaatatgatagaactcacggggcatggagtcgctgtaataacatggtagtgtcttggttggttcattcagtatccatccccattagacaaagtgtcttgtggatggacaaagcggaagagatttggaatgatctgaagtctaggtgcgcgcaaggggaccttctgagagtttctgaactccaacaagaagcttcatccattaagcaaggttctctctcagtaacagaatacttcacgaagctgcgggtcatatgggatgagattgaaaacttcaggccaaaccccgaaagacaactaggtaaccatcctttatcaagtttcaatctcgaacctaaagaaatatcttccattaacgctgtcaaaagtgtttgtgaattctgtggacgcactggccataatgaaagcgtttgttacaagaaacacggtctacctcccaattacaatggaaaaggaaaaggttacagcgcgaggaaaacatgcacttactgcgggaagcttggacacacaattgatgtttgttacaagaaacacgggtatcctccaggattcaaattcaacaatggcaaagcaatagctaatagtgtagtggcagctgaagggaaggccacaaacgaccagatactatcccaagaatcacaagaacatgttcgtttttcatcagagcagtacaaagcactgctagctttaatacaacagccgtcggccggaacctcagcatccattaaaccacaggttgcctctatttcgtcttgtaccaataacgatccaacagctgaccacactctcaccaaggttaagtatcctcttcactctgttttatcttattcccgcttgtctcattctcacaaacacttcgtcatgtctataaccgccataaccgaacctcgtacctatgctgaggcctctagccatgactgttggattaaagccatgcaggccgagttaaatgctcttcagcagaaccacacttggattctaactccgcttcctccacacaaaaaggccattggatgtcgctgggtttacaaagtcaagcataacgcggatggaagcattaaacgatacaaagcgcgactagttgccaaaggatacactcaacaggaaggtttggattttcttgatacgttttcacccgtagctaaacttactactgtccgtatgcttctagctcttgctgctcttcgaaactggcatcttagacaactcgacgtcaacaacgcttttctccatggggatctcaatgaagaagtctatatgaagcctcctcctggactcgttatggatgaacccaaccttgtttgccgccttcaacgttccttgtatggacttaaacaagcaa

SEQ ID NO: 45724 - DNA, 555 bp, Glycine max
  Peptide Sequence Number=SeqID_162502
atgccgctgccaggcatggaccacgaagaccccgagcatttcgccgaaaagctggctgacctctggcgcggtgatgaaatcacccgaacggccgaagggttcgcgactcttgtaataaccgtgttcagggaccgcccagaggccgagagcgaacatcggggtggagagcaccatgcccattgtcagccagttgccggcgagataaccgatctgggccgccctgaaggcgtagatggcgattgccaggatgatgacgagcacgagcccttcgaggcccgcttcatagagctggctcgggtgccgcgcaaaggggccgcccgtcgggaacacgaccgcccatggcacgtcggcaatgcggccccacaattcaccattgatgaaattggcgatgcgcccgaacagcaggccgatgggcgcgacggcggcgacgacgtcgaacatgctccagaccggaatgccgttcttgcgggcgaagaggatcatggcgatcgtcgtgccgatcaggccgccatggaacgacatgccgccgttccagatctcgatcgccctgatggg

SEQ ID NO: 45725 - DNA, 2031 bp, Glycine max
  Peptide Sequence Number=SeqID_162503
atgcgtgagttcttatcccaaatcaaaaacattgttgatgaactcgcaggtgtcgacaatccggtacctcatgacgaacacgtcgatgccattcttgaaggcctaacacaggattatgcactagtgatctctattattgaaagcaagtttgagactcctccggtctctgaagttgaggctctccttcttgcacatgaatctcgagccaacagatttcgtaaacactcatttgccccctctgtcaattactctcaagggtatgtgttttctaactcaaatgattctagcactcgcaataactctagtggtggatatggccgcgatggtggaggccgtgacaacaacagtggtcgtcgtggtggcggtcatggaaggggccgtggaggacgctttgcgaacttccaatgccaaatttgcttgaaatatggtcacactgctaacatttgtttttacagggctgattcaaattatcaccctcatgagtcgcttgtgctctatgatccccatactctacaacctgtgcaaattaatccttcgcagcccaccaacaaaacttccaacacttggccttctaattcctctcccagctctgctgctgttccttcagagcaacctattttgtcctcaaataacagtctccataatactgaaaccagtcctacatcagtgtcacagcctgaatctgattcctcttcccctcaggaatcctttgaacctgttcctagaactaccaatgttcatcctatgcaaactaggtccaaatcagggatacataatcctcaaattcatcattcattattcttggctcataatgaaccgaaaggtgttaaacaagctcttgctgatccaaattggctttctgccatgcaatttgaatatgctgccctactaaaaaatcacacctgggatttagttcccttgccctctaatagaaaggcagtagggtgtaaatgggttttccggatcaaagaaaatgcagatgggtccatcaacaagtacaaagctcggttagtggccaagggctttcaccaagttcatggttttgactttcatgagacattttctcctgttgttaaacctatcactattaggcttataattactcttgcccttactaataattgggagttgtttcagttggatgtgaataatgtcttcctcaatggtcttttagaagaaacagtttacatggtgcaacctccaggatttgaagttgaagacaaatcccttgtttgtaagcttaacaaggccctttatgggctaaaacaagcaccaaggcagtggtttgatcgactgaaaattacattgattcagtttgggtttcaagctagcaagtgtgatccatctttgttcatgtataagcatcaagctcacactatttttcttctagtatatgtggatgatattatcctcactggcagctcatcttctctcatccaacagattacaactcaacttaattctacattctctctcaaacagttaggtcaattagactatttcttaggtattgagatcaaatatctacctgataggtctcttctcatgactcaaagcaagtacgatcctactctttacagatctatagtaggtgctttacaatatgttactctaacaagaccagaaattgcctttgctggcaccatctcccatggtcttctcatgaaacctgctgctgttgggaaacctttatccattacagccatgtgtgatgctgattgggcttctgatgttgatgacagaagatcaacctctggctctgccattttcttaggtcctaatttgatctcttggtggtcaagaaaacaacaagttacagctcgatcaagtactgaagctgaatatcgcagtatagctcaaacctcagctgagttaacttgggttcaggctctgttacaggaactccaggttcccttctctactcctatgctgctatgtgacaatcagagtgcagtagctattgctcacaatcctgtttttcacagtaaaactaagcatatggagattgatgtcttctttgtgagagaaaag

SEQ ID NO: 45726 - DNA, 165 bp, Glycine max
  Peptide Sequence Number=SeqID_162504
atggaaatcacactaggagaaatgataaccctatttctcacatcctacgaagacttgtataataatcaacaccaagatagatacaatcatgcaaaagaaatattcgcacgtagttcctacccaacagttgcatcactatctcacaagttcccagtcctcttttga

SEQ ID NO: 45727 - DNA, 189 bp, Glycine max
  Peptide Sequence Number=SeqID_162505
atggagacctctctgagatataaaatcatttatggcttggacatttggaaagatcatctccctaaaagcttaagttcgttcattggtgctccaattcttcataattttgactttcagcccaaggatccggcaatcaacaatagggaagagtcctttccaggtctacacccggaggcccaaaactcttaa

SEQ ID NO: 45728 - DNA, 201 bp, Glycine max
  Peptide Sequence Number=SeqID_162506
atggcggacactggcaaatggtggtcattctgtccaaggaaaaccttgttgtctggttttgttccttgcataacaggacttgatgatactccacagcctaaatccaaggctactgctacgtggattatcgttaagaccattggagccagagagattaaaggcgcttcgcatccagtgggcacaacattatctccgacttag

SEQ ID NO: 45729 - DNA, 564 bp, Glycine max
  Peptide Sequence Number=SeqID_162507
atgattctatcaacctgctccagtccacgagtgatgggaagaccttggtatcagaagctggaaagtttgaacttggggttttcagccctggtagttcccagaaacaagacagttgtttgggttgctaaaaccccatcaagattcctcaggcatcttaacactcaacaacacaggcaatcttgtcccaacaactctcacaaacaagcacagaatcctgtggtagtgctcttggacagtggcaatcttgtgataaaaatcaagggacaagcagacccagaagcgtatttgtggcaaagttttgacaattcatctgacacactcttgccaggaatgaagttaggttcgaacctccgaactggtctgaatcggagatacacttcttggaagagtcctgatgatccatccccgggagatgtttgggtttttttgggtttttttctaattcaccctctcacgcccagtactctttggacttggtgcgtggtccttttgaatggatctagaataggctctgatatcaggaaaaaatctgaacctaattcaatcctaaaaattagctcgtga

SEQ ID NO: 45730 - DNA, 591 bp, Glycine max
  Peptide Sequence Number=SeqID_162508
atgaataagctggagttctggacatccaattgtttgatctacagacaattgcaactgccactaatgatttctccaccgaaaataagatcggagaaggtggttttggacctgtatacaaggggtatgcagggaatattagccaacaggcaagaaatttctgtaaacactctatcaaggaattcatggcaaggagtgacagagttcataaatgaagtaaatttgattgcaaaacttcaacatcggaatcttgtaagacttcatggttgttgcattcaaggacaagaaagaatgctaatccatgaatacatgccaaacggcagcctagactccttaatttttggttataatagaagtaaattgctagagtggcctcaacgttttgacatagtgagtggaatctcaagggggcttattgggtatatagcaccggagtatgccgttgatgggtcattttctgtaaaatctgatgcctttagcttcggcattttagcgttggagattgtatgtggcaagagaaacaggggacttaatcagacagataagagtcttaacgtcgttggctgtcagtaccagaagataggcctccaatga

SEQ ID NO: 45731 - DNA, 420 bp, Glycine max
  Peptide Sequence Number=SeqID_162509
atgacaaggcttaaggactcgcgaaggtcaaggtatcaaatggattcccatggcatcatagaggaccgtgatgagagctgggaagtcgagcttggacgagctggtttgggctatctgggtgatttgagaggagatcatgttgtccaagtccatgtctatctttataataataccataaataaggcgggcccagtcgatgttgagatcataggtgtgggaggtatgagcgagaatgaaatgacccccaggcaggtagagcttgacctcaatggcctggtggtcagggaaggtgttcaatgtctaagcatcgaacttgatgaccttccctcgaactttgcaatatttaggcaagccgtcctaagggttatagatgttggactagaactccttcaccaaagctatatcgatgttcttctctag

SEQ ID NO: 45732 - DNA, 1437 bp, Glycine max
  Peptide Sequence Number=SeqID_162510
atgtccaataacagagagctactgtactcaatgaagattctttctttcatgatgttggttatttgcatagttgttccctctctcagaatttgcgtagcaaatgattctgtaaacgtgctccagtctatgagtgatggggagagattggtgtcaaaaggtggaaattttgaacttgggtttttcagcccaggtagttcccagaaacgttatgtgggaatttggtacaagaatatcccaactcagacagtggtttgggttgctaatggggcaaaccccatcaatgattcctcaggcatcttaacactcaacaccacaggcaatcttgttctcacacaaaatggttctattgtgtggtacaccaacaactctcacaaacaagtacagaatccggtggtggagctcttggacagtggcaatcttgtcataagaaatgatggagaaccaaacccagaagcgtatttgtggcaaagttttgactatccctctcatgcactcttgccagggatgaagtttggaagagacctccgaacaggtcttgaacggagatatactgcttggaagagtccagaggatccatcaccaggagatgtttatggggttttgaaaccctataattatcctgagttttatatgatgaagggagaaaaaaagttattaaggcagggaccgtggaacggcctatattttagtggatttccagatctacagaataacaccatttttggcatcaatttcgtcagcaataaggatgagatttactacacctttagccttgtaaaaagttctgtcgttaccataaatgtaataaaccaaacaggtagaacttatcgctatgtgtgggtagagggtgatcaaaattggaggatatacatttcacaaccaaaagacttttgtgatacttatggtctttgtggagcctatgggagttgcatgatttcacagacacaagtgtgccaatgtttgaaagggtttagtccaaagtcaccacaagcatgggcttcatctgactggactcaaggatgtgtccgcaataacccattgagttgccatggcgaagacaaagatggatttgtcaaatttgaaggtttcaaggttccagattcaacacatacttgggtggatgagagtattggtctagaggaatgcagagtcaagtgtttgagtaattgttcttgtatggcctatactaattcagacataagaggtgaaggtagtggctgtgtcatgtggtttggagatctcattgatatgaaacagcttcaaactggtggacaagatctatatatcaggatgcccgcttcagaattagagaaagacaagactgagaaggatggcgttaatttaacaacatttgatttttcatcgatctcctatgccacaaatcacttttcagaaaataacaaattgggacaaggtggctttggatcagtgtacaag

SEQ ID NO: 45733 - DNA, 522 bp, Glycine max
  Peptide Sequence Number=SeqID_162511
atggctaggacatttgggctagatcaagatgaagcaaatacaaatagaataatgggaacatatggttatatgcctcctgaatatgctgtacatggatttttctcagtcaaatcagatgtgttcagttttggtgtaattgtactggagattataagtgggagaaagatcaggggattttgtgacccataccataacttaaatcttcttgggcatgcatggagactatggactgagaaaaggtcaatggaattcatagatgacttattggacaattcagccagattatctgaaataataagatatattcatattggtttgttatgcgtgcaacaaagaccagaggatagaccaaacatgtcatcagtaattttaatgttgaatggtgaaaagttattgcccgaaccaagtcaaccagggttctacacaggaaaagttcactcaaccatgacagaatcttctccaagaaatactgatgcgtattcgttcaatgaaatctctaactcattgttggaggcaagataa

SEQ ID NO: 45734 - DNA, 969 bp, Glycine max
  Peptide Sequence Number=SeqID_162512
atggagattgaggctgccctatgcataccaggccgagggttcatcttgaatgctaagggccatcctgggaggatcctgaggaaggacctgacaactttagcccaggtgtggagtgttctctcatactccaacctggcccccacatcttacacatctgacctgacagtggacagagctaggttgatcttttgtctagtctctcatatggacatgaacataggagctctcatttctggccagatgacttctatagcccaatctaactcttctagacttgggtttcctactctgattatcgccctatgtagagccagaggggttgtctctgacagcctcacttttgagcgcctgtgcccgatcattaacttggcctacatcaggaagaactgctggaatccttatgatctgacagtttttatccgaggggctagaagggcgagcgcgaggccagttgagcttccttccacatctacagctcctactccagcatccacttcaatagctccttcagttccagctcagactgattctcagtgctttgaagccatacttcagagcattcatcagggacagatcattttacttcagagtttacagcctggggcccaaccttctcttcacagggaagatgaaggtcccacagcccaggtaccacaacatgtagaggatgcatcatctaaggccaccattctagagccattcattgtaaaggaggaggcaggtgagacacaggttagacaggaagctagtgctactcctgagaggtcacgagaggtcacaccagtggtggacctatcctcacctcagcatgtagaagacccctccactcctatactcgagataccagaggacccgaccactccagtcctgactctgaacacttctcctccagctactccagcacttcatctgacagatgaggaggatgttcagacacaagacactcaggaccagtcacaggagttttaa

SEQ ID NO: 45735 - DNA, 336 bp, Glycine max
  Peptide Sequence Number=SeqID_162513
atggaaagtgagcaaagtatgcctttgaaggaatcaaatatatatctcactaagaaggtcaagagatcccgatttgatgatgatggcatattctgttcatgtactccttcccctggatctactagtgtatgtggtagagattgccactgtggaatgcttctgtctagctgttcatcaggctgtaaatgtgggagctcctgtctcaacaaaccatttcagaatcgtcctgtgaaaaagatgaaattagtcaagaggtcttcaaaccttgtcaagtgtgtatccttacttacaggaggtattttccttttcttttttttggtcttgaaagttctttag

SEQ ID NO: 45736 - DNA, 333 bp, Glycine max
  Peptide Sequence Number=SeqID_162514
atggcgagaagcttgctgatgtggctgcatggtgagtgtgtcgccagcacaactggcgagaagcgtggtgacgtgggtgtgctgccagcaccactagcgagaagccttccacatatgcagaagccgccaacagcaatggcgagacatgtgccaacgtggaacatgctcgggctgaaccatttgaaggctagttgcagctatgtaagagtcacatgctttgtagctgtgcaaggttcacatggatacagtgtgcctattaaatggccagaagactttggagaaaattggcttcacaggcatgctttaataatggcttgtgtagttttcatttaa

SEQ ID NO: 45737 - DNA, 357 bp, Glycine max
  Peptide Sequence Number=SeqID_162515
atggaggaccaaccattatcatcaaaatcaaagactgctgctttggatcaaacccttcattcaattgggtttgaaattgaagacttgtcaccacaaaaaatctctggtcgtctccctgtcacccagaaatgctgccagccattcaaggtgcttcatggaggggtatcagcattgatagcagagtctttggcaagcatgggagcacacatggcttctggttacaaaagagtggctggaattcaactaagcatcaaccatttgaaaagagcagagattggtgacttggtctacgcggaagctacacctttaaatgtcggcaaaaccattcaggtcatgtttattgccatttatctctaa

SEQ ID NO: 45738 - DNA, 720 bp, Glycine max
  Peptide Sequence Number=SeqID_162516
atggccgccacttcacgtgctccgttctccgttcgtgtcagtatcctaaccacgtcgacgccgctcgccggcgacacaattccggcaccagtaatctcagaacagcagacacccaatttgcagtcgctggtcgcggcagctccgcccactacggtggccagaaatctagggttccgcccctcccctgaattggggcttctctctcatttgttcgttctctccatggcttttggtgcgtttttctcagtagccgtgttttccattgcaacgttaattgtagttgcggttttgataccccaaaaattggggattaatgctactgatttgattggaattgtggcttttggaagattaggatcttcagtgaagaaattgtcaaaggttgtttcggaagaggtgcctggaactttatattctctgaaactttctagcgtggagctgagcgacttacccaacaacttagtaatatcaggcattcataaggaaatgaaggacaggagcactgccagatcaagatcctttcgcaaaaagaatgcaacctcaggttgccaacattgcttcggtgagcaagcttatatgtttctggaaatgagcttggttgaacagcagctcaatgagggtttctatgttgatcctgagactagtaaattaccgacattgactcaatcaatgttggctaatttggggttggcgggtatcgagtttgtctgtggtggatga

SEQ ID NO: 45739 - DNA, 1725 bp, Glycine max
  Peptide Sequence Number=SeqID_162517
atggaaaggatgatgagggagcatataaaggagttatatgggagaattgaacagttagaaaatcaagagaatcgtgaagatgatgggggtagaaggaggaggaggaagagaagagataatgatggtggtgatgctagagaggacaaaattgaaggaaattatgtggagtttgaggacttagtacatcaagttgccaaggtagaacaacaactcaagagaaagggtaccatgagaaaaagctcttctaactttaattctccaagttggaatgacaaaaataagaataaaggaggtcacattgcttctctatgtccaagtaatatgactatgttacttaagaaggttgaagagattataagtgattcttcttcaaattttgttccatctagtgatgaagagggaaaaggagtagaaggagatttgttcatggtgcgaaggttgtcaggtagccaagcaaaggacttggatgaagccaaagagaaaatatttttcacacaaggtgtgtcatccaaggaaaggccttacaaacttcaatggcttaatgaagatggttacatgaccgtgaaaaagcaagttgaagtgaggttttccattgagaaatatgaagatgttgttttatgtgatgtggtgcctatggaggcttgtcacttacttcttgcgtacatctacttgagttgtaatactgagaacaagagagagtacatctcttgtggatcagttcaagtggagcgtacatccacttggttgttcaaagagaacaagggagggtacatcccttgtggatctttgcttgtaaaggattttacaaggttattggaaatctcaagaaccggtggttgcttggggactggacaattcaagggtggagcctatgtttataaagaaaaacttaagcttttgaaaaaggagcttaaggcatggagcatggaaaaatatagggatttagaaggaaaaaagagttttctaatccagcaaataggtgacctggataaaagggaggaagaaggaaatttatctattcaggaagtggcagtgagaagccatccggagccagagaaagtgaaggagaagggaagcaatttttttgcaataggctctgggaagaaagagatcaatgggaatcttttggattctgtggtgattgtgaacgtagtaattcaagatgcaaaactgagaaaaaggccttgtgtgatcttcaaagaggatatcaaaaaagcttacgattttgttaagtggtcttttctatgcactatgcttgggaggttaggattttgcactggatggatttcatggattaagggctatatggaatcatctactatgtcagtattggtaaatggtagcccgatagaggaattttgtaatcagaaaagcctaaggcaagcagatccaatggcatttttcctctttcttgtcattgcagaaggtcttgtgggcttgacgaggatagttgtagccaaaaccttgtttgtaggctcaaaagtgggtggcagggaatatggtggtactcaaagatgtcttaagatggaggaaatcttaaactacaaggttatgcagattccttttgtgtatttggagatgtctgttggtgtaaaccttcgcaaggtgccaatatggaatccgatggtttgtgcagtaaaggagagtggaggattagggatcaagaacttagagttttttaacaaagctttcttgtctatgtggatgtggacgtttatgaactag

SEQ ID NO: 45740 - DNA, 1050 bp, Glycine max
  Peptide Sequence Number=SeqID_162518
ccacaccaggatggtcctgcctattttccagtagtagctattctatcacttggatctcccgttgtcatggacttcactccccatgcaagattcaaacagaatttcgaagaggatattaacaaagatttggatggaggaacttttgagattgggaaagataagtggtttgatggacaccatcaattctccattttactggtgcctcgcagcttactgatctttaaggacaaggcatactcagattacttgcatggtataaaagattgtgcagtacattgctataatggggctgtgaatgaagatgaagctttaaaacacaaggaatcaaatggagacttgtttagctcagaggatgatgcattggaaacacttctccccgcgccactgttgtttgtgccgccaatcactgccaccactgtcgtcttcgtcctcgccttcgtcgaagctgcggttattgctgaagatgttgagcatgtggatcatgcagctgataaggtctatgaacagcttgaagaggcaattgttgatgatgtagttgttgatgcccgaggtttttcaagcgggtcccagaatacgtcagttttgatggactatgttcatcatgaacatcctgagttgaagttgccctcccgtagaaggaaggtagagaaatttggtaggcctgctccagagattgaagtaggagaggtcactatcaccctggatgctatgacatcgttgctacatttgtccattacaagcgtcttccatagctttaaggctcttcatgtggatgaagtcgtggacctgctagttgacttgcttgaatctgagaaggcattactagtgtcgacatttgatattgtgtgttggattccttatggtgactaccgtgcatttagaaagtttgagtgtgcaacagattacaagaagtggttctacatgatatctcatcccttcatgagtctggcacaacctgagaatcctgctagacatccacctgtggtgcacaatgagacatttgtggaactagatcctcctcagcaatcgatcgtcgcaacgactatgtag

SEQ ID NO: 45741 - DNA, 411 bp, Glycine max
  Peptide Sequence Number=SeqID_162519
atgagtgggcaaatttaccagacagagaccattttagaaactatttaccaaacagggtcccttttcaaagtatttgcaaggggggtctatttttttgttgatgccgccagcagaatcggcgagatagttgtgccgccattgtcaatggcgagaagcatggtgagctggagggtaccgccattgtcaatggcgagaagcatgctgagggcaatggcgagacagctgatgtggacgttgtctcgctgctcccatgggcgagaaacattacgtgaagatggtaccgccattggcaatggcgagacagttgacatggacgttgtctcactgctcctattggcgagaagcgtgacgtggactcacgtgaagacagcttcagcatgcacaatgcttttgcagtgtttcatggagtag

SEQ ID NO: 45742 - DNA, 405 bp, Glycine max
  Peptide Sequence Number=SeqID_162520
ttgtgcaatttttcacttcacccaccttccaagctcgaacgaccatctcctcaccgtcgtgtctctccgccgctgccaccacaccttcgacagccccaacagttgtgcaatttttcacttcacccaccttccaagctcgaacgaccatctcctcaccgtcgtgtctctccgccgctgccaccacaccttcgacagccccaacagatttatggagcccctgcatcaaagtggaagatgttgaagaatagaaggctacaaaattggggtatgattcatcactttatgatgcaatcttaccccgcaaagacattggatagaagactccaagtaaattgggccaaagatgcaagagaaggccctagggttctcatgagccttaggagagattttaggcccatgggctaa

SEQ ID NO: 45743 - DNA, 597 bp, Glycine max
  Peptide Sequence Number=SeqID_162521
atgctacctgaacctctcggacgaggagctcatgcggcagagcgaggtggtcagcaccgtaacaagcgtgaatccgcagtgcgcctcaaacacctaccctctggaatcattgctcaggcttcagaagaccgctcccagcacaagaaccgagcttccgcgattaatctccttcgctctcttattgctctcaaagtcaggaaaacagtggatcttgaagcttattcaccacctcgagagcttcttcggatacttcctcctaaatcatccattagagggccagattatggtccacaaattggaccgaataacccaaagtttgcatcgggaatgcaagctcttttggatctcatttttgcagttgcggggtctgtctcagaagctgcaaaatatcttgggttatccactggggcagtgtctcggttaatcctatctgatgattcacttagaaaggaagtaaatgatctgcgggcaacgaagatgggactgttagcactcgacccccaattaggaaatttttacattaggaaaaaaaggaggggcttgaggaatcaagtgggcaagctcctgtttagctctttattaggccttgctacttga

SEQ ID NO: 45744 - DNA, 2110 bp, Glycine max
  Peptide Sequence Number=SeqID_162522
ttgcatgccactgtctgcaatgcgcattggaacaatcattcacaacattgagttgaacccagggcaaggtggcaagctcgtccgagctgctggaactagtgcaaagatcttgaaagagcccacatcggcatactgtttaatccaactgccctcgggtgttaaaaagttgattgattctcgatgtagggccactgttggtgttgtatctaatcctagccatggggatcgcaaacttaggaaggccggacacagccgatggcttggtcgaagaccagttgtccgaggagtggcaatgaatccagtagatcatcctcatggtggaggagagggtaagagcaagagtggtggacgatttgggcgaggatctctcactccttggggcaagccaactaagagtggctacaagactggacccctgaagcgcaaaagtgctgctactactactttcctctatgcgaccaaacctgaaaccacaatgctacttcgcttccatagaacagcctccacctctcgtttacaccccttgatcacatcacttttctattctcaccccttttccacctctccaccacccatttccgacgccgcacaccgaaccctcctcttgaactccatccgcaccctcgaaaccgccgacgccgtcgtcgccgtcgacttcttccaccgaatgctaaccctaactcccttcccctgcatccaagacttcaacctccttttcggcctcgttgctaaatcccagcactacgccaccgccatttccctaatcaaaatccttcactcgctcggcgatggaagtgctgacgtgtgcaccctcaacattgccatcaattgtctctgccacatgcgcaaaacgacgttagggttcgccgttttgggcctcatgaccaaaatcggcttggaacccacgctggtgacacttaacaccattgttaatggtctttgcattgaaggggacgtgaatcatgcactttggttggtggaaaaaatggaaaatttggggtatcactgcaatgctcgaacgtatggggcgttggttaatggtttgtgtaaaattggggatacttctggtgctttggagtgtttgaagaagatggtgaagagaaatttggggccaaatgttgtgcctaatgttgtgacttacaattgcttgattcagggtttgtgtggtgagtttggtgggtggagggaaggggtgggtttgttcaatgagatggtggctgagaaggggattgtgccgggatgtgcaaacgttttcgattttggtggatggattggggtggagccgaatgttgtgacgtataactcgttgattgccgggtattgtttgaggagtcagatggaggaggcgatgagggtgtttggtttgatggttcgtgagggggaggggtgtttgccaagcgttgtgacgcataattcgctgattcatgggtggtgtaaggttaaggaggtggataaggctatgagtctgttgagtgaaatggttgggaaagggttggatcctgatgtgttcacttggaccagtcttataggtgggttttgtgaagtgaaaaagccactggctgcaagggagttgttttttacgatgaaagagcacggccaggttcccaatctccagacctgtgctgttgtgttggatgggttgctcaagtgctggcttgattctgaggcggtgacattgtttagggcgatgatgaagagtggtctagatcttgatattgtgatttacaatattatgcttgatggaatgtgcaagatgggaaaactgaatgatgcaaggaaacttctttcttgtgttctggttaaagggttgaaaattgattcatatacttataatataatgattaaaggtctgtgtagagaaggactgctggatgatgctgaagagttgcttaggaaaatgaaagagaatgggtgcccgcctaataaatgctcttataatgtctttgtccagggactgttgcgaaaatatgatattgcaaggtccagaaaatatcttcaaataatgaaagacaaaggctttccagtagatgctaccacagccgagttgcttatacgtttcttatctgctaatgaagaagataaatcatttaaagagttcccgcagatttga

SEQ ID NO: 45745 - DNA, 1317 bp, Glycine max
  Peptide Sequence Number=SeqID_162523
atgggtgtggatatacaaggtaagcttcgtttagctcttggctcagtgaaagatcatgcctctattggcaaggccatgatgtaccataattaccaacatgatggcttttccaacatagagattgcagtacttcgtgccactggccatgacaatggcaccattgatgacagatacatgcatgaaatcctcttcctggtgtcaaactccccgggctccattccttttctcgcagagaggatttcgtgccgcctaggcaaaaccaaggatcatgttgtggccctcaagacccttgtcttgatccatcgcctccttagaggtggaaacagatcctttgaacaagagctatgcaaggcacatgtctcaggccaccttcaattacaaattagtacaacaaggtgtttcacaaagagttcttcagttgttggtttcctacacaagtatgcagcttatcttgaagagaggatgagttggctaatcaaccaagcagggaaacttgaacctgtcatgtccaaagggttagagtttcggcgatacgacgaaaaatcgattgatatggcattcaggatattgcctaaatgccaaatgcttattgataaggtgctggaatgctcccctcatgatgttttgtgctcagatcatagcttggctcaagctgctatgagcaacaccttgagagaaagcttccaagtttatatgacattctctgaaggaattgcggctcttgtcaacatgttttttgatctaacagcatcagccagaggcctagcttgtgaaatactcaagaaagcttctcttcagagccaaaagcttcatgatctgtatgaaagttgcaaacaagtggttgaaaacaagagtttggattacccttttgttaagataatcagcatgaatcatatagtggcattggaacaacttggtagtccacagaatgaacttgaagcttcacatgtctctctcaaaagcatctcatcaaggccacctccaatttcaggccactttacaaaatctaaagagatagagttggcagtggaagcaaaagaaagcaaaaggagtgaagagagcattggtatagatttgtcaccaacccctactcttctttcatggacactagagactaaaataagcatggtgtgggtggtgtttgaagatgaatttcccaataatgaatcaaaggttaatccagcacagcaaaagcttgcaggtgttgatgctgtttgtgatataaaaagtgaatatggtaggcctagtgtgttcctgaatcctttttcatctagttttcaaacaagcatgtctacaaaggtacaatgttttgggtaa

SEQ ID NO: 45746 - DNA, 627 bp, Glycine max
  Peptide Sequence Number=SeqID_162524
atggttccatcactttgtgctaatggttgtggcttctatggttcttctgccaccaagaacctttgttcaaagtgttacatagattatctcaaagaaaacgtcacgaaatcaaaagagtgtgaaaccaagaacttgagcgaccaagtttttgttcttgatcagtcatctgctacttcttgcaaaccatgtgcttctgaagtttctaacactgatgatgctactatggttgatgtttctcttaccgaccctgagggaataataaacaacaagagaaaaaagaggtgcaagtgctgcaacaaaaaggttgggctattagggttcgagtgtcgttgtggggatgtgttttgtggaacacatagatacccggagaagcatgcatgccacgttgatttgaaggaaattggtcgtcaagtcgacaggcaagatgtggacattgttcttggctctgctcttacaggtccccccaggaagcataacaagcaaccaaggatgaatgatctcatgctgtggaaatccacccagaatcataaaccgtggtttctttcttggggtggagaatggagggagaaggaaggcatgtttgaaacgagtttaagcaaccagaagtttacacacttgacgttctag

SEQ ID NO: 45747 - DNA, 225 bp, Glycine max
  Peptide Sequence Number=SeqID_162525
atgggaagattcaaatcaaatgagaagcacgaaacggttattgaaagatgttggagcttaccgtcagaatgtgccttcgtctgcgaaaaggagcggaggaattggcacggatttggggttccaagtgctagaatagaggcatctcgtgtggggacatggttattgtcggtagtgttcgcggaagatgacgatgctgtgtcgaaactccacaattggcaacgatga

SEQ ID NO: 45748 - DNA, 294 bp, Glycine max
  Peptide Sequence Number=SeqID_162526
atgagggcaaagcctggtgccatcttcacagagacaccattagatattgcatttgtggataagcctaagtgtgctacatcctccaagtgggtggctgttgttgatgatttccctagtaaatggttaggcattggtggtgctcaagaccatccaggcttgaagcagatcataactggaaactttaacattaaaaaatatgatcttggctataagcttgtgttctgcccaccagtactggtccttgttctgacattacgaggcatgatgataagaacgggaggcgtcttctattga

SEQ ID NO: 45749 - DNA, 1356 bp, Glycine max
  Peptide Sequence Number=SeqID_162527
tcagctacaagtgaggttgtcaaggaaatactgcatgatcaactgcgccttactagattaactgagcttgattcaattgccaagcagataaaggctcttgagtccataatgagagaagataacaggaagttcacaaaaagtgaggaagctgattcaccaagattggattctgatgaagaaaatgtgacaagggagtttcttcacatgcttgaggatcaaaaggccagaggtttcaaaatcaaccaatctaaaatcccctcattacaaatggcagaatctgaagtgtatctctcggatcttggcaagggcttggggtgtgtggttcaaacaaaggatggaggctacttgacatcgttgaatcctttagataatgctgtggctagaaatgacactccaaagctagcaatgcagatgtcaaagccttatgtgttggcatcaaatcagttcccaaatgggttagagttgtttcagaaattggctggcattggccttgatgaactcagctctcaagttttctccatgatgcccctagatgaacttataggtaaaactgctgaacagattgcttttgaaggcattgcttctgccatcatacaaggaagaaacaaagaaggagctagttcgagtgctgcacgtatagtttctgccctcaaaggaatggccaatgcaatgagttcaggaagacaagaacggatttcaacaggactttggaatgtggatgaaaccccacttacagcagagaaaattctagccttcacaatgcagaagattgagttcatggcagttgaagggttgaaaatccaagttgacatggcagaggaagaagctccttttgatgtttctccactcagcactgaggaagggaacaaagagaatgaactattagcttctgctgtttcacttgaggattggatcagagaccaaagctacagtgatacatcaaacatcacactcatgtttgttgttcaactgagggatccaatgaggagatttgaagcagttggaggtcctgtggtggttctcattcatgcaacaggtgaagaagacacaaaggggagtgaatgtgatcactaccaagatgatgaggaggagaaaatgttcaaggtaacaagcatgcatatgggaggtttgaaagtgaggagtgttacaaagaatgcatgggacagtgagaagcaaaggctaactgcaatgcaatggttgattgaatatggattgggaaaacttaaggcagggaagaaaggcaagcatgcattgctaaaagggccagattttctgtggagcatttcatcaagaatcatggctgacatgtggctcaaaaccatgagaaatccagatatcaaacttgtgaaggaataa

SEQ ID NO: 45750 - DNA, 279 bp, Glycine max
  Peptide Sequence Number=SeqID_162528
atggggatgggctacggaggggagggttggtggaatcgaagggagaataagagggtgaaggttgggacggaggaacgagacaagcattccccaagcaacattttcctaactctgcatttgcccaaactgcccactgactcaagcgtaatctcgaagctgatgtctccttgttacttgtttctgctggtctatcaacaaacgtcctgtacatctacgaatcgtgcgaagccaaaacgatttccatgtttatccctcttcgccggaataaacacctcttga

SEQ ID NO: 45751 - DNA, 4186 bp, Glycine max
  Peptide Sequence Number=SeqID_162529
atggatggacgtgcccttgcttggttccaatggatgaccagcaatgggcaacttacgtcttggccggttttcctgcaagcactacacgctagatttgctcagtcacaatatgaggaccccacaggggccctcttcaagctcacacagaaggggaccgtaggggattaccttgcagaatttgaggacctcgcaactcgtgtcgtcgggcttccaccgcccttccttctcagctgctttgtttctggattgtcccctgacatccgccgtgacgtccaggcaatgcaaccactcaccttagcccaggcggcgggccttgcgaaacttcagaaggagaagtttctggaccaccgccttccgcctaaacccaggaaccctgcacctacgacccaacgccctttcatccgcccttcccctcccactccctcacccaaatctttcttccccaccccaatttcaaccgcgcctgcacccttactcactgccccgccgcgtaccccacctcccgtgaaacgtctatccccggaagaggtcgcttctcgctgggaacgtggtctgtgtttttcgtgtgacgaaaaataccacagaggacacaaatgtgcctctagggtttttctgatcatagctgctgaagacgaccctcctctacccaatttaaacccagctgacccggaccctgacccacctgatccacccgatatcaacccggcccaaattagccttaacactcttgcgggtaatgtagcccctgaaatgctgcatttggtgggcatcatttcagaccaccacatcatcctccttgttgacggcggcaacactcatagttttatacaagagcagctggtcacgcaattgcggttaccatgtcaagacatacctccattacgggtcatgatcggcaacggtcaacacttggtctgcagtcacatgtgcccacgtgtctccatcacaattcagggagcccaattcacagttgatttgtatgtgcttcctattgccggagccaacgttgtcctaggagttcaatggctcaaatccttggggcccatcctaacggattatacgaccttatgtatgcaattctttcatgagggacgtttggtacaattgaatggcgacagggacgcaagcttgcacatgcttacccttcctcaatttcgtcggttttgtcgccggcatgaagatgctctctacttgcatgtttctatgacatcgtcagaaactcctcaacaaacacctacccaggaaccacattcgttgccaccacccagagagacggaccatcacattcatctccttccccactcttcccctgtgaatgtgcgtccgtacaggtatccccattttcaaaaacgtgaaattgagcttcaggtggagttgatgcttcagaaaggggctctgaattcagttacggtgaaggatagatttcctatccccaccattgatgagcttctcgatgagcttggaggtgcgcgatgcttctcaaaacttgatttgcttagtggttaccatcaaatccgcatgcattcagccaatattccaaagaccgcatttcgcacgcaccatgggcattacgaatttaaggtaatgccctttgggctctacaatgcgccgtcgtcatttcaggcgactatgaacaccatattccggccatatttgcggcagtttgtcatcgtcttctttgatgacatcctgatatatagtggatccctggatgagcatctctctcacctacaaacgacatttcagcctgaagttgagtatcttggccatgtggtctcgataagaggggtggaacctgttgcttctaaagtggagacaattcgtcagtggcctattcctcaatcaaccagagctttacgaagcttccttggcctcgccggattttatcaccggtttatcagaagctatgccactatcgctgaccctctggaagctttatccaccgcccctgttcttatccttccagactttactcagcctttcacggtggagactgacgcgtctggtgtcggtatgggcgccattttgtcgcaacggggaagaccgatagccttctttagtaaacccttttcccctaagctgctacatgcttcgacatatgtatgggaactctgcgccataaccactgcagtgaagaaatggcgacaatacttgcttggtcaacgcttcacaatcctcaccgatcatcaaagccttaaggagttattgacgcaggccatccaaacgctggaacaacatgtctatctcgcacgtttgctgggatatgactatgtcatccactatcggtctggtttgaacaatcaggtggctgacgctctctcacggttgccggaacaattcgccaccaaactcatgatactttcagtcccttctttgactttcatagaagacttgcgctgtcaattgactaatcacagtgggtaccagcagaagcttcaggacattcgcgaatcaccctccactaatcctaaattctcagtaacacgagacctcatcattcataaaggactactatgtccattaccagctccgagcaagccatgggaagacctctcattagatttcattatcggactcccagcgtatcatggtcatacggtcattctcgtagtggtggacaggttttctaaaggaattcacttaggcacgcttccttcagcacacacagcgcacacggtggctctgttgttcatcaacattgtggtcaagctccatggattaccacaaagtttggtttctgatcaagacccgatgagttcggcttatcaccctcaaagtgatggccaaacagaggtgttgaatagggtaattgagcaatatcttcgtgcgttcgtacaccggcggccgggaacttgggggaaattgctgccatgggtggagtggtcccacaatccatcgtggactgctagcactggtacttcaccatatgagataacttatggccgcaaaccattcaatttttcggagtacattgccggaacttcaaaaatcgatgcggtggacgaaattctcatagacagggaccacactttccaagaaattcgaaagaagcttgtcaaagctcaagagcagatgaagaagtatgcggataataagtgcagagaaattcactacaacccaggtgattgggtgttgcttagattgagaccacgacgtcaaacatcggcgaagggttctctgacgagttctgggaaattagccaaacgatattatgggccattccaggttatagaacgggtcggagaagttgcttaccgtctccagctaccggcagaggaaaaaattcattcagtgttccactgttcttgtcttaaaccatttcacaggtcaccggagcaggttgacacatcgcctttaccacagcaattcgtgggagatcaacccatggttactcctttagctatcctggattatagacgctctccggtagacgttaatacatggcaggtcctggttcagtggacggggttatcccctgatgagacaacctgggaagattggaaccaattgcgtgaagactaccaccttgaggacaaggtggttctgcaagggccaagggatgatagaccagcagaaacaagtaagaaggagacatcagctacaagcagtagctggccctcgaagcccagccttagctttttccctaacatttgcatcctatgccttactcttgaaaagcagttctttgtggagaaaaggttgatggtaaatctccctaggcttgccagaggccactcatcgcttcaccagaaagacatcagaaacagagttcgacccaacgtagcacaggaagatgtcaggaggcttggtcttgcagttgttgcagcgtatgctgataactgcctggccataggagaagcatcgcatgataactcttgggccctaaaggtgattctacgcagcttcaaaatggtctctggtttaaagataattccaattggggcaaatccttgtagatatgaaacatggaagccgataattaaagtgtttgactcgagattagcttcctggaaaggaattcagcagagatttctatggaatggccttgttgagaaaaaaggtagttcccagaaacgttgcttgggaatttggtacaagaacatcccatttcagtcagtggtttgggctgctaatagggccaaccccatcaatgattcctcaggcatcttaacaatcaacaccacag

SEQ ID NO: 45752 - DNA, 441 bp, Glycine max
  Peptide Sequence Number=SeqID_162530
atgattctactgaaagagttttgtgactcttatggtctctgtggagcctatgggaattgcatgattacagaaacacaagtgtgccaatgtttgatagggtttagtccaaagtcaccacaagcattggcttcatctgactggagtcaaggatgtgtccgcaatacacagttaagttgcaacgacgtagacaaagatgggtttgtaaaatttgaaggcctgaaagttccagatacaacatatacttgggtggatgagagcattggtctagaggaatgcagagtaaagtgtttgactaattgttcttgtatgacctatactaattctgacataagaggcacagttagtggttgtgtcatgtggtttggagatctcattgacatgagacaatttgaaactggtggacaaggtcttcccatcaactatagtctacgatcactctaa

SEQ ID NO: 45753 - DNA, 1183 bp, Glycine max
  Peptide Sequence Number=SeqID_162531
atggacattttctctgtcatgacgatggttgcttgcatgcttccctctctcagaatttccgtagcaaatgattctattaacgtgtccaagtccatgactgatggggagagcttggtgtcaaaaggtggaaagtttgaactagggtttttcagccctggtaattctcagaaacgttacttgggaatttggtacaagaatgtcccaaaccagacagttgtttgggttgctaatagggaagaccccatcaatgattcctcaggcatcttaacactcaacaccacagggaatcttgttctcacccaaaacaagtctcttgtttggtacacaaacaattctcacaaacaagcaccgaatccggtggcagtgctcttggacagtggcaatcttgtcataagaaatgagggagaaacaaacccagaagcgtatttgtggcaaagctttgactatccatctgatacattcctgccaggaatgaagttgggatggaatctccgaacgggtcatgaatggaaactaacagcttggaagagtccagatgatccatccccaggagacgtttatcgggttttcaaactctataactatcctgagctttatgtaatgaaaaaaacaaaaaagttataccgatttggaccttggaatggcttatattttagcggaatgtctgatctacagaacaacaccgtgcatagcttctattatgtcagcaataaagacgagatatactacgcgtatagccttgcaaatgattctgtcatcgtcagatctgtaacagaccaaactacaagtacagtttatcgttataaatgggttgtgggtgaacaaaattggaggctatccagatccttccctacagagttttgtgacacttatagcgtctgcggagcctacgggaattgcgtaagtagtactcaacctcaagcctgcaattgtttgaaaggtttcagtccaaattctccacaagcatggaaatcttcgtattggagtggcggatgtgtacgcaataaaccattgatctgcgaagaaaaactatcagatgggtttgtcaaatttaaaggcctgaaagttccagatactacacatacttggttgaatgagagtattggtctagaggaatgtcgagtgaagtgcttgagtaattgttcatgtatggcctttgctaattcagatataagaggtgaag

SEQ ID NO: 45754 - DNA, 204 bp, Glycine max
  Peptide Sequence Number=SeqID_162532
atgtctcaatcacgtacctttcgtcctattaagctgatgcctcaacctgaaaagccatcaccaaaacccaccacctctccagtgccctacaccaccaaacatcacagcactgaaaaccaaattcttggtggtgggaaaaagagaagaagcaccaaacccatagccaaacacaatggtgcaccaaacccagatctacggttgtga

SEQ ID NO: 45755 - DNA, 450 bp, Glycine max
  Peptide Sequence Number=SeqID_162533
atgagcaatccacctcctttatcaaacaacccaactttagttgatcagctaaggaatcttaatgatgaagtgaaaaagaaggctacaaaagaagctcgagataagttggaggaggagttccgaggttgtgaaagaacaaaaataatacagtttctggacttgaggcgagttgaaagcattaaaatatcaaccaattgttggaaggacaagagtgagaaggatgacaacattgatttacaagcatttgattttccatccatctctaatgccacaaatcaattttcagaaagtaacaaattaggacaaggtggttttggaccagtgtacaagggcatgttaccaaatgggcaagagattgcagttaagaggctttcaaatatttgtggacaaggattggacgagttcaaaaacgaagtcatgttaattgcaaaacttcaacaccgtaatcta

SEQ ID NO: 45756 - DNA, 1230 bp, Glycine max
  Peptide Sequence Number=SeqID_162534
atggtcgttgatgtcaaatccttcatccacgaatgtcgagtctgccaacaagtcaaacacgtgacccgtaagatagctgggatacttcaaccaatatcaccccccactggtgtctgggaagacctctcgatggattttatcacccatctcccaagctctcacggtttcacagtcattttggtggtcgtcgatagattctcgaagggcctctatctttgtgctttgccaactcaattcacagcttttaaagtagccactcttttcctagagatcatgtgtaagcttcacggtttcccttccagcattatatcggatcgcgaccccgtgtttatcagttcgttttggcgtgagctgttcagacttagcggcaccaccctccgtatgaccaccgcataccatcctcaatcagacggtcaaacagaggtaatgaatcacaccgtcgagcaatacctgcagtccttcgaccacaagcgtccggcagaatggcataagtttctcgctctcgcagaatgggcgtataatacttcgcagcactctggaactggagtcaccccctacgagatattctacgggaaaccaccaccttctgttctgggatacatcatgggttcttcccggaatgacgcagttgacacccttttacactcacggactgagctccacgcctctcttcatcgcaaactccataaagcacaggatgagatgaagcatttcgcaaacaagcggcaccgcgatgttcaatacgagataggccagttagtctatgttaagcttcgccctcatcgccaactctccctccaacgcattggcaacgttgcttaccgtttgcaactccctgaaggatcccgtatacgccccgtcttccactgttttttgttacgacctcatcacggccctctcgaccttccaacctctccccttccggcggatacttcctctccccatcctatacttgagccactagccattctcgattctcggatggactcctccatcaaccctccaactcgtatggtccttgttcaatgggttggtctcacccctgaagactccacgtgggagagatgggacgatgtccgccatgcccatcaccttgaggacaaggtgagtttcgcagggtcggataatgttagcagcaccaacatagataagaaagatagcagtcacgatgaacaaagacgaaggaactccacacgcccgaaacatctagaagattacgtgttatactag

SEQ ID NO: 45757 - DNA, 2529 bp, Glycine max
  Peptide Sequence Number=SeqID_162535
atgcatatcatcattatccaaatatcggagtaccacaaaagctctgacccaatgcacatcctttctttcataattttatttacatgcatacttgtcccctttcccaaaatttccgtagcaaatgattctatcaacttgcgacagtctatgagagacggcgataccttggtatcaaaaactagaaagtttgaacttgggtttttcagcccgggtagttcgcaaaaacgttatctgggaatttggtacaagaatatcccaattcagacagtggtttgggttgctaatagggaaaaccccatcaatgattcctcaggcatcttaacactcaacaacacgggcaattttgttctcgcacaaaatgagtctcttgtttggtacaccaacaactctcacaaacaagcacagaatccggtggcagtgctcttggacagtggcaatcttgtgataagaaatgacggagaaacaaacccagaagcttatttgtggcaaagctttgactatccatctgatacactcttgccagggatgaaattgggatgggaccttcgaaccggtctggaccggagactaacagcttggaaaagtccagatgatccatccccgggagacgtttaccgggatctcgaactctatagctatcctgagttctatataatgaagggaaccaaaaaggtataccggtttggaccttggaatggcctatattttagtggagttccagatcttcggaataacaccatatttggcttcaattttttcagcaataaggaggagagttactacatctttagccccacaaatgatgtcatgtccagaattgtaatgaacgaatcgactacaatctatcgctatgtatgggtggaggatgatcaaaattggaggatatacacgtcacttccaaaagacttctgtgacacttatggtctctgtggagtctatgggaattgcatgaccacacagacacaagtgtgccaatgtttgaaagggtttagtccaaagtcaccagaagcatgggtttcatctggctggagtcaaggatgtgtccgcaataaaccattaagctgcaaagacaaactcacagatgggtttgtcaaatatgaaggcctcaaggttccagatactagacacacttggttggatgagagtattggtctagaggaatgcaaagttaagtgtttgaataattgttcttgtatggcctatactaattcagacataagaggtgcaggtagtggctgtgtcatgtggtttggagatctaattgacatcaaacagcttcaaactgctggtcaagatctatatatcaggatgcctgcttcagagttagaatctgtatataggcacaagaagaagaccacaacgatagctgcttctaccactgctgcaatctgtggggttcttttactgagtagttattttatttgcagaattcggaggaacaatgctggaaaatcattaacagaatatgacagtgaaaaagatatggatgatctggacatccaactgtttgatctaccgacaattacaactgccactaatgacttctcaatggagaataagattggagaaggtggttttggacctgtatacaagtttctactcacggccaatagtatgcagggaatattagttgacgggcaagaaattgctgtaaagactctatcaaggagctcatggcaaggagtgacagagttcataaatgaagtaaaattaattgcaaaacttcagcatcggaatcttgtaaaactccttggttgttgcattcaaggacaagagaaaatgctaatttatgagtacatggcaaacggcagcctggactccttcatttttgatgataaaaaaagaaaattgctaaagtggcctcaacaattccacataatctgtggaattgcaagggggcttatgtatcttcatcaagattcccgactgaggattattcatagagatctgaaagcaagtaatgttctactcgatgaaaattctagtccaaaaatatcagattttggaatggccagaacttttggtggagaccaatttgaaggaaacacaagtagagtagttgggacctgtgggtatatggcaccggagtatgctgttgatgggtcattttctgtgaaatctgatgtctttagctttggcattttagtgttggagattgtatgtggcaagagaaataaaggactttatcagacagataagagtcttaacctcgttggtcatgcatggacattatggaaagagggaagggcactagatttgattgatgactcaaacatgaaggagtcgtgcgttatatccgaagtattacgttgcatccatgttggccttttgtgtgtgcagcagtacccagaagataggcctacaatggcatctgtgattctgatgttggagagtcacatggaattggttgagcctaaagaacatggcttcatttcgagaaattttttaggtgaaggagatttacgctcaaatcggaaagacacaagttcaagcaacgatgtgacaattaccttgttagaagcgcgataa

SEQ ID NO: 45758 - DNA, 1017 bp, Glycine max
  Peptide Sequence Number=SeqID_162536
atggccgaacacgggactcgtcgtaccactaccgacagactagaggacgccatttccatcctctccgagaagcactccgacctcaccagtaaggtcgacgccatgtacgagcaattatctcagatgcactctgcgcctcacccctcgacccagcgctccggtcatccccgacctccagtaaagcttgaagtcccacgctttgatggccatgatccattgggatggatttttaaaatctcccaattcttcgaataccagggaacgccggaagaggatcgcatcacggtggcttcattttacctcgacggagcatccctcagttggttccagtggatgtaccggaatggtttcatcacctcctggtccgcccttcttcaagctattgagactcgtttcgccccatcattctatgatgatcctaggggaaccttattcaagcttatgcagcgcggttcagtcacggaatatctcacagaatttgaaagattagccaaccgcatcgtcggcctctcaccctccgtcttactgagctgtttcatttcgggtcttaaccccgaaatccgccgcgaagttcaagctttgcaactggcgtcactccctcacgctactgctctggcacgactccaggaggataagatcaatgatcgtcggagatcctctcgtccttcgttctccccctcaccaacacccaacccaacaccctcctctcagatagcttcctccacacctcgccctaaaacaccttttatccagagaactcaagaagagatgacatatcgacgagaaaagggacgttgttacaactgggatgagaagtggaactcatcacaccgttataagggtcgcgttctcttcttcattgcggcctccgacaaccctccctcccccgattccaccacaccagacctcacagcacccttccctaacgacccttcccctacctttgatcccacatctcttcatccacacatcagcttacacgccatggccggcgtacccgccactgaaactttctga

SEQ ID NO: 45759 - DNA, 759 bp, Glycine max
  Peptide Sequence Number=SeqID_162537
atggctaggacatttgagctagatcaagatgaagaaaatacgactagaattatgggaacatacggttatatgtctcctgaatatgctgtacatggatctttttcagtcaaatctgatgtttatagctttggtgtgattatattggagataatcagcgggagaaagatcaaggaatttattgacccacatcatgacctaaatcttcttgggcatgcatggagactttggattcagcaaaggccaatgcaacttatggatgacttagcggacaattcagctggtctatctgaaatattaaggcatattcatattggtttgttatgcgtacaacaaagaccagaggataggccaaatatgtcatcagtagttttaatgttgaatggtgaaaaattgttgccccaaccaagtcaacccgggttctacacaggaaataatcatccacccatgagagaatcttctccaagaaatcttgaagcattttcctttagtgaaatgtctaactcagtgttggttggtcttcttcctcaacacccaccagggccaccaacaacaacacaaaccacactattgtcactgactcaccgccattttgaaggttgtgaagccgttgttgatcaatttgcggtatcagggtctttggctgttgatatcaatggcacgggaggagacgagaataatttcctatccgagggagttgagcttttaacctgttcacaaataatccctaatcttccatatgctaaccttccctcttcatga

SEQ ID NO: 45760 - DNA, 1842 bp, Glycine max
  Peptide Sequence Number=SeqID_162538
atggtgggtaacggctccattctggattgccaacaactttcccccgccaccaagctgcttattcaagaccacacctttaccgtcacattacgagtcctactactaagtggagcggacatcgtgttaggtgttgaatggttgcgtaccctgggaccgatcatcacggattattacgccttcaccatgcacttcagccaccaagggcactccatcacccttagcgccggcgtccagtccgacactgatccagtctccgctaatcaggtacgacgtatgctacatactcagtcaacgtctgccctctttcacttatccttattaccagccaaccctatcgaaccaccaccagacccacctcaccccatttccaccattaatgaactcctactccatttcagttctctatttcaccaaccctcttcccttccccctccccgccaacatgaccaccatattaacctccttccatcagctaaccctattaatgtccgtccgtatagatatccgcattttcagaaaacaaaaattgaaaaacaagtcacagcccttctcgaatcaagcttcatccaaccaagccgcagtccgttttcctcccccgtcctactggttaagaagaaggacgaaacatggagaatgtgcatggactacagggcacttaattcaatcactgtgagggaccgttttccacttccgactatagacgaactcctcgatgagctcggccgcgcttcttggttctccaagatcgacttacgtcaggggttccaccaaatattaatggccccagaggacatttctaaaaccgcttttagaactcaccacgggcattatgaatatagggtcatgcccttcggtctttgcaacgcgccgtcgacattcctggccgccatgaacgctgtgcttggtcctcacttgcggaagtttgcaacagtgttctttgacgacattctcatttacagcgagactctcccagatcatcttcttcacctcgaacgtgttttcgcttcactgactcaagctcaatactaccttaagcgttctaagtgtctcttcggcctgcgcaagctcgactatctgggccatgtcgtctctgagaagggcgtccaacccgacccttctaaaatacaggctatccttgacatgcctgcaccacgatcggccaaagaactccgctccttccttggcctcactgggttctaccggaagtttgttaaagattacgccgctattgctacaccgctaactcgtttactttgcaaggacgccttccaatggctaccagaatcacaagaggcttttctcatgttgaaacgcgcaatgatggcagccctagttctcgctcttccagatttttccttgcccttcgccttagaaatagatgtgtccggcacggccatgggcgctgtccttcagcaacagcgccaccctatcgcattctttagcaaacccttttgcccacgaatgcaacaagcctccacaagtggcaccaatacttgctcggccataagtttactatcttcaccgaccaccgcagcctccatgaccttatgtctcaggtcattcaaaccccggaacagcagttttatttggcaaagcttctcggattctctctcacgtattgatcacaccagtcaagcccaatgcctcctcctctccgtgcctcaccacgaattcctcactcagctaaagcaagccctcttagatagtcctgactttcagacgctgaaggaagctattcaggctcacccagaggatcacccacatttcaccatcgccaatgagctcatcttcttcaagaacgccatctggattgactctcgcaatccctgctctattgcatga

SEQ ID NO: 45761 - DNA, 399 bp, Glycine max
  Peptide Sequence Number=SeqID_162539
atgatcattacgattagcatgaacgtcgtcagcttcttcttctccgacgttgttagaagtcatttgtgtagacaaaggactaacataagtgtccatgcagccgtgtctccagcaaaacctccagaaagcccggatgaagaggtcgatgatcccctatacctgatgacattgaccatcccacaattgtttttgaagccgctccaggttatgtgggatgctaccatattcggggtgtttaatcaaaacttcccattgtatataaagcacgaagatctctctgaaattgcacatggtggtcaatgtctcagcatatctgttatacagttgtggattctccatctgactgagacaagtgtgcgagcggggaattctgatgtgtatggattcctcgagccatag

SEQ ID NO: 45762 - DNA, 345 bp, Glycine max
  Peptide Sequence Number=SeqID_162540
atggagcatgaaacattccttgcaacttggttggcagagattgatttctctcccaatggcttggatggtggaagcagtcaacactgtatcatcatcgtgattttacaaagaataatattactcggtgaaagagcagtctatgcaatgatgctggtgtttccacctgaattttctcctttgaaaactattttatttggaaatccttcccaaaacactgttgaatcactgatggaggctttggaggaagattataaagatggaaatgagataaatgaatcaaggcagtttattgaaggagtattggatcttgaaaagagaatcaatagactagatacattgacttag

SEQ ID NO: 45763 - DNA, 294 bp, Glycine max
  Peptide Sequence Number=SeqID_162541
atgacgcactctcgatgtgtgtttgtgtttgggctgattgccattttgtttcagggtgtaacagcacctcctcttccccctcttggtcgtcccacaccctcacaccttcattggcttcttgcacttcttgttctgctcattcatagcttgatccagatcgtgtttggttatatccagatcaagctatctgtaattggacaagatgcgccacatacaataggtggtgaccacaccaaatctattgcatctgcaattaggcctgaaagatgtgcaattgtagatgaggagcaatag

SEQ ID NO: 45764 - DNA, 183 bp, Glycine max
  Peptide Sequence Number=SeqID_162542
atgacaaacaaggccaaaggaaaaggcaaggaggttggcggaaaaggttctgccggcaagcgcaagggcgcattcgacgacgacaagaccggtggcgggcgaaagagaaacaagatgaacatgccagataagggccagagtagcaggccacatgtcgtccctaaagaggaaatgttggcctga

SEQ ID NO: 45765 - DNA, 297 bp, Glycine max
  Peptide Sequence Number=SeqID_162543
atgaatgtagtgaaatatgtatttctcaaagctcgtagtttattgtgccaatttcacattgacaaaaatgtgaaagcgaaatgcaagacgtatgttgctaccaaagaggcatgggaccaagtcatggatgcatgtggtagtcttaaagatgtccctagtcaatctaagtatgaaggatgtctcaagatgtttggaattgttgagtttacgcattggagcttaaagaggttgattcataatagcatagaggacttgtgtaaatgttgggatgccatgaacaacttgatcacattgtag

SEQ ID NO: 45766 - DNA, 321 bp, Glycine max
  Peptide Sequence Number=SeqID_162544
atgcggaaaatacccaaaagagagggcaaaatggtcatttggcgactttttcaggcccctggcttacctaagctagcctctggctcgcttaggccactagaaagcttagggctgaacctagaagtagccagtttgcaagagttagggcagcggatgggtcaactccaacgtcaagctttccgcaagacatatggaaagatctgggatttggctatgatagaagtgtttgatgaatccattgcatccctcgctcaatattacgaccagtctctaaggtgcttcacatttggggactttcagttagtaccaaccgtagaataa

SEQ ID NO: 45767 - DNA, 234 bp, Glycine max
  Peptide Sequence Number=SeqID_162545
atgaaagagagggtggaactggtgcgggtgggtcttcagaagttccttggcagctgtggccagcaacggtggtggtggaggaagatccttttctcttcttggatgattctgccatttgaagatgtttcagatgattttgattggtgggtttggaagagaattgaaaaagatgaagattggactttgtttgaagcggcttctgtaatcgattacaaccttgctgttctaatgtaa

SEQ ID NO: 45768 - DNA, 582 bp, Glycine max
  Peptide Sequence Number=SeqID_162546
atgccgatgatcaatgatttcaatattgagggcgtttttgtacccggtctactgttaatttccctcgtcgcgctcacctggactgaccgaactggggtttttaaaatgaaatcgttactttctctactgggccgctatttgctgacgctcagcgctgtggcggttgctacgcttttggcttttattctctggaaacattatgtgcaaactccgtggacccgcgatggtcgggttcgtgcggatgtggtccagattgcgccggatgtctctggaccggttctgaatgtggccgtccgcgataatcagtgggttaatcggggcgatgtgctctattccattgacccgcactggttgaggttggcagtggtcagcgcccaggctgatgttgaggcgaaacgtcatgaaatgctgatgcgccaggatgcggcgaggcgacgctctcagattaaaggggtgatttccagcgaggatttacaacaaacagccagcgcagcaagcgtcgctgcggctaattaccacggtgcactggctgcgcaggaccttgcagagcttaacttatcgcatgctattgttcgctctccg

SEQ ID NO: 45769 - DNA, 318 bp, Glycine max
  Peptide Sequence Number=SeqID_162547
atgaagtggttggggcgggggggattgggagtggagcatgtggcagaagagggagagagtggaggggtgggcggcgtaggcggtgaagaggtgagtgttgagagaaggaaagtggtcgaagatgaggcttttcttcttcctcccgcacagcttcttcattcttgtcttcttcttcgccgccagtcttcttcttcttcgccgccattgccgccattgttgctgtgtttaggaggaagtttgtcgttcgcgttttggtttttgctggcgatagcgaaaaacgctgtcaggaagttgctgggttgtttacggatcacttga

SEQ ID NO: 45770 - DNA, 402 bp, Glycine max
  Peptide Sequence Number=SeqID_162548
atggttaacgtgaataatgaagcatctaccaatattgttcttgaaggggaccaacaacttgaaagcaacaagcatcttttaatggtggacctagcaattaggcctgctagggttcactacccacacaaacatgttatgcatctcacgggttttatggatttcttgaaagaaatagtaggaaggattcttgggatcttctacggtctctttctcatgacactaatcttccttggtgtatcatgggaaattttaatgatcttttatcaaatggagacaaaaaggggatggttgatcatcatatttgattcaagattttcagataaggcatcacggatgcaaacgttattgatactcctcttaggacgtatccctacacttggtggagaagtgttaacgttttaa

SEQ ID NO: 45771 - DNA, 867 bp, Glycine max
  Peptide Sequence Number=SeqID_162549
atgtctgagagaaatgtggtgtcttttaccgcgatagtttctaggtttaagagggttgggggtgctatgagggtgtttggtgaaatgctagagagggatgtgccatcgtggaatactctcgttgctgggtgcactcagaatggggctttcactaggattaagttgtttaggagaatggtttgtgagtgtaataggccgaatggggttactgtggcttgtgcactttcggcttgtggtcacacggggatgcttcagcttgggagatggatacatgggaagtgtggaagccttggaaaagcaagaaaggtttttgagatgaatcttgagaagaggttgacttcatggaactcgatgattaacagttttgtgttgcacgggcagagtgatagtgcaattgccatttttgagcaaatggtggagggtggcgatggcatgggaccagatgaggtcaccttcattggtttgttgaatgcttgtactcatggtggattatttgagaagggttattggtattttgagttgatgggtatgagcatggaaccaattgaggttgtctgggcctcatttcttaacagatgtaaggttcctggccgaacaaatttggcagaatttgctgccaaaaaactgattgaaatagatccacataatagaggttataggattatgttggctgatgtgtatggggagttagggaagtgggatgaagtgaggaatgtgtggaggacattgaagcaacaaaagtcttataaagttccagggtgcagctgcattgttgatgaccaggttcatcagttctattctcttgataaatcaaatctgaagacaaaaagacttgtacattgtcttagaaagtctagttggttttag

SEQ ID NO: 45772 - DNA, 186 bp, Glycine max
  Peptide Sequence Number=SeqID_162550
atggatcacccaaatttacaaagcctttccattgaagatgatgaagaggaggagatggtgtttcctaacgatgttgttaccaagacaggaacgtatggcaatggtatgagtatggtggaaggagtctcgatcatggagtgttcacgttctagttctatcatcacaaggacatgcagagggttatga

SEQ ID NO: 45773 - DNA, 2394 bp, Glycine max
  Peptide Sequence Number=SeqID_162551
atggagtgcaataaggatgaggctacccgagctaaagaaattgctgagaggaagtttgctgcaaaggatacattgggtgcaaagaaatttgctttgaaggccttaaatttatttccggatcttgagggtatttctcaaatggtagcaacacttgatgtgtatattgctgccgagaataaaacaaatggagaagcagattggtatggtgtgcttggtgtggacccccttgctgacgaagatactgtcaggagacaatacaggaagctagctctccagcttcaccctgataagaacaagtccattggagctgatggggcctttaaactcatttcagaggcatggagtttactatcagataaggctaaaagggcatcgtatgataagagaagtggaagagaccggaaagtttctactaagtttggaggtccatcatcacaaaaagggactaatggtagtttcaatttcactaagaccgccccttcatgtgcaactactcggaagaatactgcaaaagagcatgcttcatcttctactcataagtcaaaatcaaatacattttggactgtttgccgtcgatgcaaaatgcagtatgagtatcttagagtttatcttaaccttaaactcttatgtcccaactgccatgaggcatttgtggctgtagaaactgctcctccacctgcaagtggtattagacctgcaactcaatggagtttttcacagaagcaaaattccagccgccaacctaataaaagcaaatctaatgctggaaagaataacatggcagccccaaatgttggaggagggtcttgtagtaagactgactcctatgaaaaggccaatttccagtgggctccattctcaaaaatatctggtgtttctaatgttgctcaagctgcaagtgtggttcagcaggcatatgataaggtgaagcgagatcgtgaagaggcacaagcagctaggaaaagggaagaggccttaaaaaggaagcagcatgcttctaaaaagggttactataatccttctaagagaagaagggggggcatggaggatgctagtgcgagtaaccatggtaaggaaacaaactcattcagatctaaacagggcaattttgaatataatagggttaatggaatcagcaagaccggccatgtgggagatatctccccagttcaactgaagaatcttcttatggaaaaagctagaaaagaaattagcaataaactcaggcaagttcagtcaaatgctgttgataaaactgcgatgaaagagaatggaaatgacttccaagaagtgagtgagaaaggagaaaaatgttccagaaactctgagatgtgtgctcaggataacattgagaagtcagaagatagaaaaagcggatcccgagccatcaagccatttgcaggttctacaattgctaaagttagccgaaaatttttggaaacaacacctgtagatgtactatatcctgatttccatgatttttgcaaagatcgaactgaaggatcttttggtgaaaatcaagtatgggccgtgtatgataacgatgatgggatgcctcgatgttatgtgctgattcgccgcatcatctccctgaatccgttcaagatgcagatcagttggctcaacccaaataccaacagtgaactgggccccctaaaatgggttgcttcaggcttttcaaaaatttgtggggatttcagaacaagcagacctgaaatttgtggttctaccaattttttctcccataaggttaggtggagaactggtgctgagggagccatttgtatatatccgaggaaaggtgatgtttgggccatatacaggaactggtctcctgactggaatgagctaacagcagatgaggttatacacaagtttgatgtggttgaagtacttgaggattttattgaagggcatggtatagatgttattcctctggtcaaagtggctggattcaggacagtgtttcaccaccacttagatccaaaagaaatcaggatcattccgagggaagagatgtttcgattctctcatcaaataccttcatatgtactcactggtcaagaagctccagaggctccaaagggttgcagggtgctggacccagctgctactccatttgaacttcttcaggtaatagaagttgtgaagaaggaaaacgtggcagacgatgaggatagtgatgtaaaaaaaacaagtgataacatgaaaaaagataatgatgaggaaatgatcgatgctatgggaaaacatggggaagaaaaggaggcaaaagacgaagacatgcaggaagtagaaccaagtgataacatgaaaaaaggcaatgaggaaatgaccaatgataccggaagacttagggaagaaaaggagggaaaggacaaagacatgcaggag

SEQ ID NO: 45774 - DNA, 360 bp, Glycine max
  Peptide Sequence Number=SeqID_162552
atggaggagttgattaacaaaatacaactctttctcaaaataatctcaacgtcatcaagtcggctcggcggctccataaatgaatctcatttctcgtactctactgttatcactctgctcccacgaacaaaggttcgcgatcatcacaggtaccaaccacacggtacaaaaattgcgaggtggatatccaacaaggtcattgcaccccccatgtacatacacaacatatcatcacagtgcatttttaacatcatcaacatttcatctcaacatcaacatcatctcatctcaatgacattaacaacaacaacaacatcatctcatattaacataatcatcaataacaacatcaactcatga

SEQ ID NO: 45775 - DNA, 150 bp, Glycine max
  Peptide Sequence Number=SeqID_162553
atgacgagtaaaataacaatagatacctcagagccctacactggggcaatgggagacaccatgcatgagcctcaagcgaacctagggctagatcagaagttctcacccggtaggtcaaaaaccagaaatggaggcgtaggcaaaaattag

SEQ ID NO: 45776 - DNA, 171 bp, Glycine max
  Peptide Sequence Number=SeqID_162554
atggaggagatacatggagtagacgatgaagaacaaggaattaaactccatgtagagcttgtaggcattggatcttcttatgaatggactcctttgcttcttaaagatcaatggcagcggaatgaagaaggaggaaaggtgaatggagatgtcacttcaatgagaagatga

SEQ ID NO: 45777 - DNA, 135 bp, Glycine max
  Peptide Sequence Number=SeqID_162555
atggctggaagaaaaattgggggcgagggttttcgagagagtgaaaggttgcagggacgcgtcgtaatcgattactcaaatatggtaatcgattaccagagagcaactttgcaagaaataattgcttgtaattga

SEQ ID NO: 45778 - DNA, 760 bp, Glycine max
  Peptide Sequence Number=SeqID_162556
agtgatgagtgaaatagaggaggtgcaagagcagatgaaggccgacatggaggccatgaaagaacaaatggccacaattatggaatccatgataagtatgaaaagaatgatggaggtcaacgcgactacagtcattgtcgcaagtaccgccactgaggtggacccgactcacccatctgatctcaaccaaataaatcatccagccttgaatatggtaggtcagggaggcaaagagttgggaagtgtgtgcggccctcattttgtgcaatttcagaacaagcattccttcccaccatatggcttgcctcctaattatacaccacccaatgttgcacacgctcccgataagaatgtcaataactccactcccatactcattaagagacaacaaccccaatctgatcatgcacatgtctctcaacccatgggggaggcacatgaggcaccccgagaccataatctagtcaactttgagccttacctcatccctcctgctatggtggaaaaggagaaatcggatcatataaaggaaaggctaagggccaaagaagaaggcggagaattcgctaagcacaaccttcagtggctaagcacaaggaagaatccagaagaagatgagctgtcaagttcgctaaacgcactgctccaggtcatcaagcgcaccgcttcagctcatctgctaagcgaaacaagcgtgcttagccaaaatccacttatgcgcgctaagcgatccagatctgcgctaagcgcacgagcatga

SEQ ID NO: 45779 - DNA, 1464 bp, Glycine max
  Peptide Sequence Number=SeqID_162557
atgtcgcgagtcttcggtagatggaagaatgcgaaggaaatggcgttgctttcggggtccctgccacgtgggcaccatcgaaccgggttcaatttttgcccaatttcgacccacctgaacatgatcgccggccaccggtggcgggaggctccggtgggggttcaggagcggtacaagtgggaccgcggcgggtcggacgatacctcgtcccggaagatccgggccgaggcgaattgcccacgttgcaccaaagacatgaaccttgttttctccaatcgccactttcccaccccacaaattgaatctgaattgggtggtggagaaagagaaaagggttaccaatcggtgaacctttgcccaagttgcaaaactgcttattactttcgcccttatgacactacacctttgcaaggtacctttgtggagattggtagggtcactagtactaacaataatggtgttaataatgtaagcggtaaggggccttctcctaggaggatcacacatgggaagggtggtggcaaagagggtagtagtagtagtactaataagggggaggaatttgggggcaagagtaatagtaatgcaagtaaatggcttgaagtgtcattgtgggagactttgatggcttacaatggtggtgctggtggaggtgatggtagtaatggcgagccacctgagtcgtggccgctgccaccagatgatggtagtaatgggaatgggaatgggaatggattggctgtgcatactcctccaggcccaccttttgcacctgggattaatgttatccgggctacggggccacggaatggcggatcgggtggtgcaggtgggggcaagggcgagaagactgcctggggagggtctaatttggggaaggattttccctcgcccaaggaaatctgtaagggtctcgacaagtttgttattggccaacagagagccaagaaggtgctctctgtagctgtttataaccactataaaagaatataccatgccactttacagaaagggtcagccgcagattcaggagcttcagaagtattagatgatgacgataatgtggaactagaaaagagtaatgttctcttgatgggtccaacagggtcagggaagacattacttgctaaaacactagctcgatttgtgaatgtgccgtttgtcattgctgatgcaacaaccttaacacaggcaattggctcacttgtccttagacaaaattttgttgttattgacctaaaagaggattctactttgcaggctggttatgttggagaagatgtcgaatcaatactgtataaactacttgtggcagcagatttcaatgttgcagcagctcaacaaggaataatttacattgatgaagttgacaaaataactaagaaggccgagagcttaaatatcagtcgggatgtttctggtgagggtgttcagcaggcattattgaaaatgctggaaggaact

SEQ ID NO: 45780 - DNA, 249 bp, Glycine max
  Peptide Sequence Number=SeqID_162558
atggctggattgtgcaacacgtgtgaagatatcatccctcagaatccaacgtacctttctctctctgccgctttcattttccttctactgcgcactcctccgcccttcaccacgacgccgccgggtcagcttagggacttcttctcatcgccattgtcgaggttttcatactctctttttttctcttcttccatctcccttgaaaatcctttctcatttcctcgagaaactttccagatccaaatgtaa

SEQ ID NO: 45781 - DNA, 1206 bp, Glycine max
  Peptide Sequence Number=SeqID_162559
atgttgcagtttaactgccaacaattttgcaagggaagatcaacattgccgggagttttagtttgtgccagtcgaaggcccaaaggaactatctggagacgaaaaactttgcagcaaaatgaggatttaccgccaattttaccaaagaataagaaaaagccgtaccctattccctttaaggaaatcaaacaggctggcagggaggacagaaaacttgcacacatgggaatagagaaaccgcttgagcctccgaagaatggattgcttgttccagacctaattcctgttgcctatgaagtatttggtgcttggaagcttttgattaaaggtcttgcccagcttttgcatgtcattcctgtacatggctgtagtgaatgcacagaagttcatgtagcccaaactggtcaccacattcgggattgttctggtactaatggtcggcagcgtcgtagttctcatgcatgggtaaagggttcggtcaatgatatacttgtccctattgaatcctatcatctttttgacccctttggtaggcgtattaagcatgatacacgatttgaatatgaccggattccagctgttgttgagctatgcgttcaagccggtgtagatatcccagaatatccttcacgccgaaggaccaaccccatacggatattagggaggagagtaattgacagaggtggaaatttagaggaacctaaaccatggcgctttgcagacccctcttcactcaatgattttgatacttacagagcttctgagcgatttccactaccatcattgtcagatttacctaaaattgcccaagaaacaatgagtgcatatgaaactgtgaaaaagggtgtcaagaagttgatgaggaagtacactgtgaaagcttgcggttattgcactgaggttcacgtgggaccatggggccacaatgctaagctttgtggtgcgtttaagcatcagtggagggatgggaaacatggttggcaggatgctactgtggatgaagtttttcctccaaattatgtgtggcatgttagagaccctagggggcctcccttggcatctgcactgaggagatattacggaaaggctccggctgtggttgaagtgtgcatgcaagctggtgcacagataccagaagattacaagcccatgatgaggctagacattataattccagacactgaggaggcaagaatgattgcgtga

SEQ ID NO: 45782 - DNA, 204 bp, Glycine max
  Peptide Sequence Number=SeqID_162560
atggagccagttgatggttcagtatttgtagtatatgttgaggagaaaaagggtggagtttccgatggaacaaatgatgcaagagacgagggaggtgcaggtgcagccaaagggaatggaacagtgctagctgctcgtgttgatgttgaagttgctggtggcaatgaagaggaaaaaaggaggaggaggaggactcttaattaa

SEQ ID NO: 45783 - DNA, 162 bp, Glycine max
  Peptide Sequence Number=SeqID_162561
atgaattcctcttcccttgtgtttcgttatcttatatgtggttttccttatgcgatgctactgtgtatgtttctgttaaactctcccagtgttggatatggtcagaatagattctttgcctatgttgagcaacataatgctctgaatgtccttccaatttga

SEQ ID NO: 45784 - DNA, 180 bp, Glycine max
  Peptide Sequence Number=SeqID_162562
atgtttctacaaagccatcaagttcttcgaagtcatcgtcgacgttctccgaagccaccattgtctatctcaaaaattgccagcattgtcatcagaggtttttcttcgtcaccatcgcatgtcttcgatggcatagctgggtttgtcctttcaaatggtattaggccgcatatcagataa

SEQ ID NO: 45785 - DNA, 739 bp, Glycine max
  Peptide Sequence Number=SeqID_162563
atggaagcaccttccattggagatgctcttagtaatccaacgcttcacttggaacagcaattgcgggttttcaaacggccccagctctcgccagccatagcttcttttgcggcttcacttcgaatgacacttgatgatgagatttcttttgaggatgatgggtttggtcagcaagatgtagaacatgtgttgttggatgaggatgggctagatgataatgaatgtttagagaataatgtttcaggtgataatgagttagaagatgaagaagatttcgacaatgaggtttcagatgatgaacattatcacaaaattgttttggaagatgatcctccaaacccctccctctttaacccactcgtcgtcgccaccacaaaaccctttgtcgcagccttaaagacagtcatcaccgtcactgtacaagaaccactcgctcccaaaattcctggtgtcgaaattgcactgcctatgtcaaatggaggtcgtctccgacgacgacaaatgaaggtcgatggtgattgtcatgaagaagccaagttcatgaatgaagaagaaagtaattgtaacactcactttgttcagcaatttgaccgccaaagatttgagtttgaagttgaggcaaaagcaattccagagaggcgtcgcacgggaaaattgactgtgaggcttgatcaaaaaacatgtcattatgggaagcctcaaaaggtgcacatgcaatgtgcatatgtcattgctgcat

SEQ ID NO: 45786 - DNA, 129 bp, Glycine max
  Peptide Sequence Number=SeqID_162564
ccctccatcttggatgaggcggctgaacctgaggttgagttggagatcgacgacctcattcctgatcgacagccgagtagggtgggaaatgttctcgccacagaagccaagtggttcacggctgaacag

SEQ ID NO: 45787 - DNA, 306 bp, Glycine max
  Peptide Sequence Number=SeqID_162565
atggatttgctgggaacttctgatccttatgttaaactaagcttgataggggacaaacttccaacaaaaaaaaccactgttaagaaaaacaatttgaatcctgagtggaatgacaagttcaagcttgttgtaaaggatcctgaatctcaacttcttcgattacaggtttatgactgggacaagctacgggcgttcgaaaacccgcaagtgtcgtttgaagtgaagccgcagaagaagctatggttggggatgggggttgggattgttcgaaaattagggcacaaattccatactcgacacgcataa

SEQ ID NO: 45788 - DNA, 345 bp, Glycine max
  Peptide Sequence Number=SeqID_162566
atggagaagggaaagggagtgatgggatcgggaggacgaagatggggcgttgacttctccgacaattccacttctcgcgatattcccgatcctcccgcttgggaggtagcacaagcccctatgaagaatttgctaatgatggggttcatgatgtggatggctggtagcacagtccacttgttcagcattgggatcactttctcagccctttggcaacccatcagtgccctacagagtgtcggaaagatgtttgagccctacaaagacaataaggtggagcttcttggacctaagttgttattcatagcccttaatttgggcggcctggcactaggtgtttggaag

SEQ ID NO: 45789 - DNA, 363 bp, Glycine max
  Peptide Sequence Number=SeqID_162567
atggcaagcagagaccaagtttggtcattctgcacccaagatacgcggagataccttacggcagacacagttgtgtccgatggcaagcagagaccaagtttggtcattctgcacccaagatacgcggagataccttacggttatctgcacccctttgctaggcagacacagttgtgtccgatggcaagcagagaccaagtttggtcattctgcacccaagatacgcggagataccttacggttatctgcacccctttgctaggcagacacagttgtgtccgatggcaagcagagaccaagtttggtcattctgcacccaagatacgcggagataccttacggttatctgcacccctttgctag

SEQ ID NO: 45790 - DNA, 282 bp, Glycine max
  Peptide Sequence Number=SeqID_162568
atggacccctctggaagtgattttggacagagtgttttggtttctatgtcacgaaaaggagttgagacctttgagattggacatgtgaaccatcatatcatgtggaggcgacttctggaagcacatggagttatgataaacataaaagtagcaattaaaccagggcaaggcacaggcctagaaatggtttgtagggaggacaatggtgacatcatggcagagctacacaactcttacaccactattatcaacccaagttggtcgaggctttggctttcatga

SEQ ID NO: 45791 - DNA, 861 bp, Glycine max
  Peptide Sequence Number=SeqID_162569
atgtggctccaagatgaagagtatgaggatattgtacaatacttgtggatcagaggtgggagaattacaaacaacatctcaagaacatggtgcaaatctggattttggggattctcaaaatttggctcactaaagaagaagattaaggaggctagagacaaaataaaaaaaaggcttaatgggcccaaccaatcaaatgaggatgacacggggagaatcttcaccgaggaagaagacatggaatgtgttgatagggatgagattaaagaatctttgcttcaaattaatcctactaaggcactggtggaggatggctattgcaaaaagattgagagttgtgcttctagagattgtgtggataagactcaaagtgcatttgttgatgatagaaaaattacgaacaatgcattgattggttttgagatgtttcattacatgaagaagaaagtgagaaggagaaagggatgcatggccttgaaagttaatatggccaaggcatatgacaggattgagcagagatttctggaatgtgtacttaatcatataggtttccctactaattttacgaagctagtcataagaatgacaaaagattttaatccagtgctattagctaaacaatggtggcggatgctctcttgtaaggagtcccttatggaaaaagtgttcaaagccaagtatttccctcattctaatgctttggaagctaagaagggaccatgggcgagttatactcagaacatcatacatggggcaaaggaagtgttgaaagaggggactttatggaagggtgggatgagcaaagaattcgagaaatgttccctcaccaagtggcagaaagtatcatggccatacctttga

SEQ ID NO: 45792 - DNA, 1926 bp, Glycine max
  Peptide Sequence Number=SeqID_162570
atggcttgttcagtgcatctccttcttcttcttacttcacttctggctttgttctttaacccaacatgtgtctatggcaatgatgagcttagaacacttttggacttgaaatctagtttggatccagaagggcactttctgtcctcatggactattgatggcaccccatgtggtggttcctttgagggagtggcttgcaatgagaagggtcaagtggcaaatgtgtctttgcagggaaaaggactctctgggaagctctcaccagccattgctggactcaagcacttgacaggactctacttgcactacaactctttgtatggagagattccaagggaacttgctaacttgactgagcttagtgacttgtatttgaatgtgaatcacttgtctggtgaaatcccacctgagattggcatgatggagagtctgcaagagaaatctcctttagagacgctttatgctattgtaaagaccattttggacaaactgatttcttctggtttaattgcaagagttttgcagctttgttataatcagttaacaggaagcatccctacacagcttagtgatttgaaaaagctcagtgtccttgctcttcagtcaaaccagtttgctggagctatccctgctagtctaggtgatttgggaatgttgatgaggctagatttgagctctaataatctctttggttccattcccactaaactcgctgatcttcctttgctgcaagttctggatgttcacaacaatactctctctgggaatgtacctcctgctctgaagagactagaagaaggatttgtgtttgaacataatgtggggttatgtggagttgggttttcatccttgaaagcttgcactgcttcagatcatgccaatctcactcgaccggaaccttatggagctggggttggtggtctttctagagatatcccagaaactgctaatgtaaagttgccttgcaatacaactcagtgccgaaatccatcaagatccaaacaagcggcatctattacagttggcattgttctggttacaattgctgtatcagcaattggtatttttaccttcactatgtatcgtcggcggaaacaaaagcttggaagcacgtttgatatctctgaaggtcgtctaagtacagatcaagccaagagtatatacaggaaaaatggatctcctttggtcagccttgagtactctaatggatgggaccctttggctgatggcaagaatgtcaatggggataggcaagacatgttccagagtttccggttcaacttggaagaagtggagtcagctactcaatatttctcggaactgaatttgttggggaaaagcaacttcagtgcaacgtataaaggagttctaagagatggatctgttgttgctgtcaagagtattagtaaaactagttgcaaatcggatgaggctgaatttttgaagggattgaacatcttgacctcactgaggaatgagaatttagtgaggctgagaggattctgttgttcaaggggacgaggtgaatgcttcctggtttacgattttgtttctaatggaaatctgtcatgctaccttgacgtgaaggaaggtgatggagaagtccttgaatggtcaactagagtttctattgtgaaagggattgctaaaggtatagcatatttacatgcatacaaagcaaagaaacaagctcttgttcaccaaaacatctcagctgagaaagtgctcattgatcagcgatacaacccattgctttcagattctggcttgtacaagcttctcaccaatgacatcgtcttctctgcactaaagggtagtgcagcaaagggctacctagctccagaatacaccactactgggcggttcacagagaaaaatcctcacggggaagcagaagatcacaagcgcaatgcgccttgctgctga

SEQ ID NO: 45793 - DNA, 378 bp, Glycine max
  Peptide Sequence Number=SeqID_162571
atggttaccttgaaaggtcagattagggttttcgttctctaccggaaccgcaagccaagttggaagattccgcttcggttgaagggttcctctcggtgtgggttttcaatggagaacaatgatggtttgtggttgctaatggtggctgtgggtgatggagaaagtgcttggaactttagaaatggctttggaagaaagaaagaagaagaaatgacgtttttcctaagctacaggaaagctaaggctgaaaccaaatttagagaagatccaacggttaacgaaggctgggcagcgtttttaccaaggcagcttcatgtagctttctctagaagcttcattaagaagcttcctccagaagcttcctcgtggcttctttga

SEQ ID NO: 45794 - DNA, 270 bp, Glycine max
  Peptide Sequence Number=SeqID_162572
atgaacccaggcctaactcacaaaaatagttcccggtggagtcgccaactgtcgcaacctaccttttggcgggagggcaacgcggggctcgcgagtgtgtcttccatgaaaggaaaatgcgcggagtcgccaccaacgtttattcgaggaaaacgtcgaaaaaaccaaaggaaaccggtcatgaagcatattccagattcgggagttatctttacgtttgaggaaggtattagcacctctcacgtttgtcccaaaggacaacagccttag

SEQ ID NO: 45795 - DNA, 444 bp, Glycine max
  Peptide Sequence Number=SeqID_162573
atggcctctaggaagaggaaagcaactgcctcccgacctcgagaaccatacgatactaccagatttatttccgaggtcgcttgggagcgttatgagcagaatgttcactcccggaacatccttccgaagaggaaagttaatatttttgttatggagtatgacgagttccgcaaagagctcgagcgaaggcagtggcacaaggccttgaccagacagcctgatggtcgcatcaatgtggccctggtcaaggaattctacactaatttgtatgatcctgaagataagtctcctagagccccgtggttttggagccagggtagcattacactgcttactccagattctgtcacatgcacccagatcctcaggagctcgccgccagactttatattcccgggcgaagtttcattttcaatgctgagggagccccctagaagctcctga

SEQ ID NO: 45796 - DNA, 338 bp, Glycine max
  Peptide Sequence Number=SeqID_162574
gggtcccaggagctctgcactgctgccatgtctacaacataatatgtgtctgcagcaccgtctcctctttaggtgcctcagatggtgtagcagcaggggtaatctatggagtctcctccgcggaggtgccggagagtattggaggtgcaggaatgggagctggtggtgctagtggagttggagcagggggagctgaagaagaaggagttgaagtgtctggtggtgctttgcgggtccccgaaaaagtgagggagtctggtactactcctctagctatgcacaaggcaatgacgagtgcaggaaaacctagtcgacaggagttggactgggccatctaa

SEQ ID NO: 45797 - DNA, 1026 bp, Glycine max
  Peptide Sequence Number=SeqID_162575
atggcaagtgatagttcaagtgcgttgaacacaaattcaacggtgtgggagggtatatggcacgcagaggcatcttcaaggtgcaagaaactcgtgtggcgcgcgtgcagtgagggactacccgtgagatctttgttgttacaaaagggcatcatcaaaggggacgacacgtgtccctgctgccgcacgtgcaaagaaacaaccacacacgctttgttgctatgtgaggaggttaaacccttttggttggggtctccattggggcttagagtcgactggttgcacaatgtggctaatatcactatgtcacaatgggttgatcaatgtttggatgttttggataaaagaggaatgggtatgttatgtgccatggtgtggggtttgtggcacaaacgcaatgcttgggttataagaaagaagaaattggatttcgcacaagttatggccaaggccttgtctgtgtttgctactcaagagtgggtcccacctttagattccaaagttaaggtcaattttgctgtttctgcgatagaggatgttgggactggattcggagtgatttttagaaactctaaagctgaaactatggcatcaggtacatattttctgaaggatgagtgttatgattccgaaattgctgcgacagtatgctataagtgggccatagagaaatcacaggaactctttttcattgatgctaatttcgaaactgattgccaacagttatacaatcagtggaacgaattcacacaggaaaacaacactagttctgcttcttaccttgatgaacttctagaagaatgcagaacaatgatgcagggtacagaagcatctctcacattggtggctcacacagccaataaagtggcacagtgtttagccagattggcttttgattatggtgagaaagattggattgatgaggtgccgaataaggcattagaatctttacaatctgatcttgcagcaattgctgatgcttctgctgatcgatcaataaatgtgaatattgttttgcaggactag

SEQ ID NO: 45798 - DNA, 222 bp, Glycine max
  Peptide Sequence Number=SeqID_162576
atgggagatcgattagaggatataattcgtgatctcggacaagagtcttttcaaaacttcacttcattgcttcaagtagtgctagatatgcttctagaggaaaacactgtagaagcaaagcttcatgatgatgacaaaaagctcaaatgtcaatcaaaggatgagttcaagatattcaagaagaaatcaagagcaaattcaagactcaagaggaaaagttga

SEQ ID NO: 45799 - DNA, 453 bp, Glycine max
  Peptide Sequence Number=SeqID_162577
atgagtagttcaggcaaaccattgcaacgtacatacgacaatatgctagaagcatcgtgcaactctgcctcctcaagtgaagaaatccaacacgctagccatattgtcatcctcttgagctcctccgtcatccccaggggcccctataggtcttgccccggtctcaaaatcggcctgatctccaggccaggccaccatggccccaaactgctcgggggtaggccaggggaaaggattggggtcctgatcctactggtgcatagtgtactgggttctatcctccgtaagtgggaagagatagaccccagggatagtgtctcctataggggtggcggcggtgcatctgctgatttctcaatgaaggctctactgatgggcatgcagtatttctcaatgaaggctctactgatggaaggccggataaggttggtggagttgaccggcactccatag

SEQ ID NO: 45800 - DNA, 1100 bp, Glycine max
  misc_feature (114)..(114): n is a, c, g, or t
  Peptide Sequence Number=SeqID_162578
acggctacccgatcggcgaccggatcatcgtgcatggatatgtgcgcgatgccttcggggcgccggtgcgcaacgcgctggtcgaggtatggcaggccaatgcgggagggcgcnatcgtcacaagaaggatcagtatctggcgcctatcgatcccaattttggcggctgcggcaggatgctgaccgacgacaacgggtattactgttttcgcaccatcaagccgggcccgtacccctggcgcaatcaggtcagcgactggcgtccggcgcatattcacttctcgctctccggcgaggcgttcgcgcagcggttgatcacgcagatgtatttcgaaggcgatccgttgctcgttcgttgccccatcttgcagtcggtaggcagcgacgatgcgatgcgcacgctgattgccgagctggatatgcacgccgccgtgccgctggacagcctggcctaccaaccgtacccagggagccgcgtgatgaaaaagtatttgtctgaaacggcctcgcaaaccgccggcccttatgtgcacatcggtttggcgccgcatgccgccggttttgacatttttgagcgtaatttcacccatgtgttgacgcaaccggaaacgcgcggggaacgcatcgtggtggaagggcatgtctatgacggtaccggcacgccggtgcgagacgcgctggttgaagtctggcaggccaacgccgccgggcgatatcagcatcccgccgacggccaacgagataaacccgacgaccccgcttttcgcggctgggggcgaacctgttcggatttcaccagcggcctgtggcaatttgagacgatcaaaccgggcagagtgatggggcgcgacggccggctgatggcgcctcacctcaatctatggatcgtggcccgcggcatcaacatcgggttgaacacgcgtctttacttcgccgacgaacaggcggcgaacgctgaagatccggtgttgaacctcattgaatgggagaaacggcgcggcacgttattggcgcaaaggcgtcagcgcggcgaccagacggtataccatttcgatatctggttacagggtgagaacgagaccgttttttttgatatttga

SEQ ID NO: 45801 - DNA, 241 bp, Glycine max
  Peptide Sequence Number=SeqID_162579
atggagatttacgtcgtcttccgcgcagactacatctgtcaagcactaacccgtgaggttagggggcaggcggatataccccaagtgatttacgtcgtcctccgtgcagactacctttgtcaagcactaacccgtgaggttggggggcacgcggatataccccaagttgttatccactccctctatcaagcactaacccgtgaggttaaagggcaggcggaaataccccaagtggttatcc

SEQ ID NO: 45802 - DNA, 858 bp, Glycine max
  Peptide Sequence Number=SeqID_162580
atgattattgatgagtctattttcttttctctgacacaactacccagtcagggtgcatcttttgagggcaccattgttgacaactggaagtttgattactctagtcttgatgcccgccgtatggtttgcaatgatcaggcaaatatgaccggcagattacttgccagttcattgacattcgattgtcgcatcatgcactacatcattgtttgcattctattatccagatcctcaaacttagctcaagcctctgaagaggatttaatcttgatgtgggcttttctcaccagtcgtccgatcgactgggcccatttgatcagataccgcattcataaggcattatggtcaaatgcacctctgccttatccacatcttgttaatttgtttcttcatcattttcaaattcccttggataatgagccctttgtgaaagtcaaacgctcctttgcaattggtgccggtgcggtaacctccatcggctaccgtaaggacattgatgggcaatggttgaagaaggatgcacaacctacgcaagacaaacatactccctctcctctgcctcaacgagatgactcctcagccctcatgcatgaagttcttttggagttacgcgacctccgcacctatgttggtgagcgctttgattccttggatggtcgtatcgatgccattgatgctcgctttggaggcatggatactctcatcactcagcttgaggaggatataagttatgaattaaattatcatcatcaaaaagagggagattgtagaagcaaagactttgatgttttgatgatcccaaaggatcatgcgcttctcaagtttaattcaagaggatcatacgcttctcaaggttaa

SEQ ID NO: 45803 - DNA, 312 bp, Glycine max
  Peptide Sequence Number=SeqID_162581
atggtgattttcagtcatggagttgcagtggaagataaaggagaagagcacataggaagctcccttgagaagcaaggaagggtaccctacaaacctaaaatgaccaaaataaaaggcccaaaagaagaaaaaaactattctaatatttgcaaggaaaagtggacccaaccttggcccatgggctcaaaaatctaccaagaggttcatgagaaccataatgccttcttcaacagctctagcctaatcctcgtggagtctcttgctcatggctctggtgactggacccttcctagggaggattgcatcatttga

SEQ ID NO: 45804 - DNA, 555 bp, Glycine max
  Peptide Sequence Number=SeqID_162582
atgggttcgtcgggctttgatcccattccgttccgaagcgttctgctcattgagttttgtaaaaggttccggtctttcttcggtgaatctcgaggtctttctgatggctgcgctcagcctaatgttatctacgttgacccttctcagactagtttacaacggttttcaaagcaagaagcaagtggaaaaacggcttgttacagtgaatccgaaagactcgcagacaacttccaatgccttccaggcagaatgaaaaagctatggaagcttgatatcagaatcgctgaacgtacagcttgtggtacggacttcacgcgggatgtttccgagctagattgcaaaaccgaaagccggggggagggggtcttagcgagtaaaacaagaaggaagacaaacggggaatttagagggagcgaagtgagtgcacggtctctaattcaaagagctaaattcctgggaataggacctcgtcctctttctctttcgatagacttcctaaaggatgatctagctgtggatgatgtcccagctcgagaggtcaaccttgtaatctga

SEQ ID NO: 45805 - DNA, 427 bp, Glycine max
  Peptide Sequence Number=SeqID_162583
atgggggaggcacatgaaattgcccaccacaatctagccgacttcgagccttgcctcggatataccactgaagggcaagcagttggtgccgctcctgctatggctgaaaagggaaaggtggatcatctaaaggaaaggctcagggccattgaaggaggtgaagattatgcctttgctaacctagaagagttgttcctagtacccaatatcatcacccctcccaagttcaaggtgttggactttgacaagtacaaggggactacttgccctaagaaccatctaaagatgtattatcgaaagatggaggcatacgcaaaagatgaggaattgctgatacattccttccaagaaagtcttactaggaaaactgtcacctggtatactaacttaggaaccttcctgagtccattcttggaaggacctaatg

SEQ ID NO: 45806 - DNA, 507 bp, Glycine max
  Peptide Sequence Number=SeqID_162584
atggagaacttaaggttttcatgggctgttcaaagggaatgttttctctacttcatccaactgcagctggtttcagagttgggtctctccacacgtgacacgagtcccctgcgtgtcatggttggcaacggacagcaattggaatgcacgcgcgtctgcgaagatgtctcggtggttattcagagcactcaattcactgttgacttgcatgtgctgcccattgccagtgcaaacgtagttctgggggtgcaatggttgaagtccctcgggccagtcctcaccgactataacacgctatgtatgaagttctttcatgccggcaatttggtcgaattaaaaggagacactgtgatgcaagctccattggagcttgtaggcctaggatcttcttcatcaatggattcctttgcttcttggaagataaatggcagcggaatggagaaggaagagagagaggagacgccacttcaaggagaagatgagtctagaagaagctcaccaccatag

SEQ ID NO: 45807 - DNA, 153 bp, Glycine max
  Peptide Sequence Number=SeqID_162585
atggaaaatatcaagaccgttggacacgatcctgcagcatcatcttcacgagtcttcagcttcaaacgtagtctttcaggcattgctatgctatcatggtcactcttttggcaaagtagtttcaatttttatatccatgtcttacatatatag

SEQ ID NO: 45808 - DNA, 927 bp, Glycine max
  Peptide Sequence Number=SeqID_162586
atggcaaagttaataaaattctttgagttgaacacaggggccaagattccttctgttgggttaggcacttggcaagctgaacctggtgttgtagccaaagctgtcaccatagccattcaggttggatacaggcatattgactgtgctcaagcgtataacaatcaagcagagattggttctgctctaaagaagctttttgatgaaggtgtggtgaagcgtgaggacttatggatcacttccaaactctggtgttcagatcatgttccagaagatgtgcccaaagcattggataaaacattgcaggatttgaaacttgactaccttgatctctatctgatccactggccagtccgcatgaaaagtggatcagttggattcaagaaagaatatcttgatcaaccggatattcccagcacatggaaagcaatggaagcactctatgactcaggcaaggcaagagccataggagttagcaatttctcttcaaagaagcttcaagatttgttggatatagcaagagtgcctcctgctgttaaccaagtggaattgcagccaggatggcagcagcaaaagttgcatgcattctgtgaatctaaaggaattcatctaactggatattctccactaggctccccaggagttctcaaaagtgacattcttaagaatcctgttgtgatagagattgcagagaaattgggtaagacaccagcacaagttgcccttaggtggggattgcaaacaggccatagtgtgctgcctaagagcactaatgagtccagaatcaagggaaactttgatgtctttgactggtctattccagaagaattgttagcaaaattctctgaaattaagcaggcaagtattggtggagggtataaagtggtacaagacagaccagagagtagaattgaggaagatgttgaataa

SEQ ID NO: 45809 - DNA, 3384 bp, Glycine max
  Peptide Sequence Number=SeqID_162587
gtgtgcaatcctttcattccataacttcgagcctgatggaacctggagaattgttgccctaccagtgcagtgttccaatcacgttaacttagcttctggtgtaaatatggatggtttgcaactccttttctctccacctctcaataggttgaagattgatcaatgtaagggtccaagagtgcctcttcctccctatgcttattcagctaaatcatgtactaaaaaaggctttactggttcaaatgtgcgtcgtcgatgtcaaaacaagattgctaacagagcttctaaactgaatgaactccctgacaattcttcttctcaaagttcattagtctgtggccctggcttattccctgatagttctactgcacttaattcatctgataaggacacaagtcattccatggaagatgacaagtcttcgaagaaaaaatcaagaaaaagggcaagaaagaaagttaaacggagtaagaagaagtcaagtgacagtggttctcctgaatgtgaagttcttactgaggaatatgtctgtgtaagtttgacttctgaaacctgcagcagcaatgatgtggataaggagggtgtgggagaattttcaacttctgatgataggttagtaaaatctgattgtgaaaggaatggcaacatcaatgttatgcaagcacctaatagttgcaactcttatcttgatcgggaggcgatttcaaaagctactgcacctattgttcaaagttctgctggagaatgcaccacatttgaacccaagaatcagctccaagataggggccctgattttgaagtcattgatagaggaataaaggacatccaacacgttgagccatgctgttttaatgatgtacatgactctttggtgctggattcagtttcagttggttccagaagtgatgaaagtatcagtgctgatgatataggaaaaccgtcaaacaaggcaaattgcacaatcacttcagattcaggagatggatattctcttggtcaaaacttaacgaatggtattcacaataactgtgaacataatgaggggattgggcatggtggtcaaaattgcatcagtaatgataagaaagttaagcagaagagaacaatgtcaaagagttcaagtttaaacaaatttgggggagctggaattttgcatggtcaaaaagggaaggaaaatattcattctgtatggcaaaaggttcagaagaacagttctgatgaaggtagtggtgacttgaagaaagtaaacacaacttcgccacaatttgcttctactctggaaaaggatccttcagttatcaaagaatgtaattctgttagtgtaaatggtgtatcaaatactgaagataagaaacacttgaaaaataaaattggtaggaaatcaaaaggtatagtggagacagtttcaaaaaaggaacacaacaactattccaagaagagtttccattttaacaggtctttgtcgaatgatcatgggaaggctggtgttcaacagaatgatgtgttgcttatctcttctcaggaaattgatcaacaaggattgaacactgtctctggatttaattctgatattaactgcctgacggatggggtccagaccaatgaagttgaacaggtaacatctgaaataggtcacagtgcaaactttcatctggaggagtcaggtccacaaaaaagtgccagccatataattgcaaacacaaacaatgaaaatatagatagtcaggatagctcattggtaatgccaggtgggaacatcaatcagtcaaatatgtctgaggagctgtctccagattcttgtaatcttgaaggtgatgaggttggtcaaacagagaaagaagtttcatctgcaaactacaatgcagaaatcctcagttctggaactaccctatggaaatgggtaccagttgggaaaaaagatagagggttggaaaaatctgaatctaataattcaccaccagaatattctgatgcatcctctagtaacaattctaactcagaaagcagtgttgaaccagaagtggcctcttctaaaaatcaggattcttcactaaatgcaaccagagcatgcaacggccagatttacgacaaagtgtcttgtctagatgagggtgagaaccataaaatggctagtcagattgcatgtacattgacagagcacagggacaagcatgaagctgctaatcacatgttttatgaatgtgaaaatcaagatatgttagaaaatggttcttacagaatagctcaagctgtgaatgatgcctgtagggcacaactagcttgtgaagcggtacacatggctacaggtggtccagttgcagagtttgaaagactactacatttttgtagtcctgttatttgcaactcactcaattcactcagttgttcaacctgctcacacaaccatgctggtggtgtctcactgtgcagacatgagatccccaacctatctttgggatgcctgtggaagtggtatgagaaacatgggagctatgggttagagataagggctcaggatcatgaaaatccgaagagacaaggaggtgttggtgattttccatttcatgcttattttgtcccttctttatcagcagttcagctgtttaagaaccatgaaaaccgatgtgtaaatagcggggacaagcttccaaattgtgaggtttcagaggcatgcgaaatggttgacatttcagaaaagtcatctactgccagtcaacatttgatattttctgttctctttccttggcctcgcaatcaggatgcaagcagtcaaacaccaaaggagacagcttctatcaataatggatctattccatctatcaactcaaactgctctggtgatttagaacttctttttgaatattttgaatttgagcaacctcaacaaagacgacctctttatgaaaagatacaagaactggttagaggctatataccaatccgatcttcaacttatggggacccaacaaaactggattcaataaacctgcgagatcttcaccctagatcttggttctcagtagcatggtatcctatttaccgcataccagatggcaactttcgtgcatcttttttgacttaccattcacttggacatttggttcgtagaagaactagttcagatttatcaactgtaggttcttgcatagtatctccaactgtggggcttcaaagctacaatgcccagggtgaatgctggttccagctgaagcattctgcacttgcagcagaaatggcgggcttagacccttcgctacttcttaaagatcgtttgaggacacttgaggaaacagcatctctcatggcaagagccgtggtcaacaaagggaacctaacctgtacaaacagacaccctgattatgagtttttcatgtctaggcggcg

SEQ ID NO: 45810 - DNA, 459 bp, Glycine max
  Peptide Sequence Number=SeqID_162588
atggctaatttattgtgtctaaacaatgtggctactgttctttatgtagttatcccagtagtggtttgtaatctaagaggagaaactagttttggtaatatgcacataaggttttcaggaattatactttcttattctgctgtcattttttctattagagctctccccatcaaatggccctgttctacctttccatggccaaatgcaagaaagatgcgttgtgcccctcaagagataggtaataataatccagaagttttagaagcaagaaaggattccataccaacaatatatcaacaacaaaataaactcacatctttagaggattgtcaagaatcttctctttcaaagattaacactgatagtagaatggttctaaggcttataccaaaagctggcagtgttattgattctgtgcatggtgggagggaacataagtccatgttggcattgtcataa

SEQ ID NO: 45811 - DNA, 219 bp, Glycine max
  Peptide Sequence Number=SeqID_162589
atggatcctcagcctgagccagttagctacatctgcggagattgtggaatggagaatacgctgaagcctggtgacgttatacagtgccgtgagtgcggttaccgtatcctttacaagaagcgcactcgtcgcacggtttggttagagatgagtgagtttaaaacgaagtcacgggttctagttgctcgctccagttcagtgtgcaacagtggagagtaa

SEQ ID NO: 45812 - DNA, 492 bp, Glycine max
  Peptide Sequence Number=SeqID_162590
atgaagtcttttgatacctctccggggagatgcttttcttctccacagcatgatgacaatttactacacaaaagcatttctgttgatgcctatacatacaccaacacagaaaaggaaattgccaccaagggcacaggaaaaagcagaagttttacacataggattcatgaccatgtaaaaatgggtcctaatctgtctgagattctgaagggtaagttgagtttgggggcaaggattatacaagaaggaggaagagggagcatcttcaagagtgtttttgggatgcaagaaaaagagcaattgttaaaggcctctcagtgttatttatataccacagctggtcctattgctggaattctctttgtctcaactgaaaaggttgcattttatagtgaaaggcccataaccttctcttctgcgacaggagagttagtcagggcaccttacaaggtaggattcatgtggtacaacccaactttaagctcaaagtaa

SEQ ID NO: 45813 - DNA, 252 bp, Glycine max
  Peptide Sequence Number=SeqID_162591
atgggggataagcttcatcgtcgagagggaaacagcccggatcaccagctaaggcccctaaatgaccgctcagtgataaaggagatgaacggggctaagcgatctgctgaagctgtgggatgtaaaaaagaatcggtaggggagcgttccgccttagagggaaggacccgcgcgagcagtgctggacgaagcggaagcgagaatgtcggcttgagtaacgcaaacgttggtgagaatccaatgcctaaatag

SEQ ID NO: 45814 - DNA, 213 bp, Glycine max
  Peptide Sequence Number=SeqID_162592
atgtcaggcaatagcattactgaatgcaccttgagaagtctctctgtaagtcaatctatgacaggagttaaagtgcagggaaagccagaatggagtgtttctatcaccaacacatgtccatgtgctcaaaggatggtatacttgaattgcaccgattttcaaaccagtgaacctataactccttctgtcttgactgtctcacctaatgcctga

SEQ ID NO: 45815 - DNA, 501 bp, Glycine max
  Peptide Sequence Number=SeqID_162593
atgcatttttcccgaggaacttatcaacctcaacctcacataactcaagagctgttaaatttttctgatgaattcctcacagtcaaacaaattcagcaattcttgggaattttaaattatatcatccccagagcagcccaatataccagctcattgtcaaaacttttgaagaaaaattcttctccatggtcagaagagcaaacaattgcagttaaggaactcaagaagattgctcaaaaatcccccagctttgaagattcctggaacagaccaagcaagactatcaaggtgataacttctactcactccttccttttgatattcatggctatttggtgtaatacagttcaatactctattcccatcgccttaaagcccctgatgacataccacatcttgaccgatccatataaagatgaatattttgttggaccttgtggcctcaataatcttaagaaggataggcttagaatgcaaaagaagcaacaacaatcaatttaa

SEQ ID NO: 45816 - DNA, 141 bp, Glycine max
  Peptide Sequence Number=SeqID_162594
atggatacctcaaagccctacactggggcaatgaggggcatcgtgcatgagcctcaaacaacgattggtaccacagagccctacactggggcaatgaggggcatcgtgcatgaacctcaagtaaacctaggggcagattag

SEQ ID NO: 45817 - DNA, 498 bp, Glycine max
  Peptide Sequence Number=SeqID_162595
atggacagaaacattctcgactctctgttcttaaatatccacttgcatggccttgacatgaaagaaggatcaatcccagcagctttaatctataggatccaatacaaggtcatgaacacttgtgcctctagagtcctgctacaaccacaaaagggagaaacaaccttgtttattactgatatgacaaaagcaaacgtctctttaaaaagaataataaaatgggatgaggtaaccctccccgaaaaatgggtcatggagaaggccacaccgtctgatccccgacccgctccaattattgaggacattaaacaggataactccggaaaggtagaaataaccttcaataggagaaattccttctcatcaaggatagaagcctctaggtctgaatacgagtcagccagaaggtctttttcggttagaacccgttcaatcccaataggtctaaccagatctgagttacataaccagttccctactgtaacctccaaggactag

SEQ ID NO: 45818 - DNA, 411 bp, Glycine max
  Peptide Sequence Number=SeqID_162596
ggactacacgtccttgcctttagagggctacacgccatcgccttcaaaggactacacgtcctggcattcaaagggctacacgtcctcgccttcagaggactacacgtcctcgccttcagagggctacacgccctcgccttcagaggattagacgtcctctccttcagaggtctacacgccctcgacttcagaggactagacgtccttgccttcagagggctccataaagtacgaaaaaggggaaaatccaagccgaggtgcttccgtaacgcttccgtaagcgattctgtggaaattcttcatcattcttcatcgttcttcatcgttcttcattcgttcttcgtcgttcttcattcttcaacaggtaagttcccgaaatcgaatctttcaattcattctatgcacccttag

SEQ ID NO: 45819 - DNA, 566 bp, Glycine max
  Peptide Sequence Number=SeqID_162597
atgggacacttgaacaaatgtgggttgtatgtcgatgatagtcctccccgactagtttctcttggaagactttatgagggattgaagattgtccacaacgttcctttgggcaataatcaagtgaaggataaacaagtagctgagggatcgatgaaaccaatagatatgtcagatcctaacgtcgatcccctgtaccttatgacattgacaatcccgcagcttttcctcaagccattgcaggtgttgtgggatgctagcgtgtttgggggtattgcccttgttcctacgtatccccagggattcgttaaggcattggaccttgaaattatctcagggtacaaggcttgcaagagaaatgatgtaggaaacaatccacggtccagcccccttaaaccctccccctgcatggctatttatcaaaaaagccatttggtgcagggaaagctcgtcttgacgagccagttgcttaggcttaaaggtatcacctcacctaagcgagttggttgcttaaggttgaagccttcccatggcccaggcaagccagatgctggcctgggcaaatttag

SEQ ID NO: 45820 - DNA, 345 bp, Glycine max
  Peptide Sequence Number=SeqID_162598
atggaaattctcgtgactaatgcaagtagtttcgcttggagacatctagtggtagctgtgaaaaagaggctaagttttgaagtgcaaaaagtggcagttggggctaagctcagcagttgggctaagcgtgcatccaccgctaagagcagcttcagtgcgcttagtgcgaagaagaatatggcagaacatcaacatcaaggccgcatgctaagcgtgagatcagtgcgacttggcacactattccagagcgcctatttcgggaaaaaagccctagaagcaattagtgagctggagagtgagtgtgagatgttgagaagaggaggaggaatcccccatcttgtgtaa

SEQ ID NO: 45821 - DNA, 255 bp, Glycine max
  Peptide Sequence Number=SeqID_162599
atggacctaagatggacacacacaactgagaatgcaaagcaagaattgagaggaagagagtgcatcttagatggagataggaagaaaaggcaacacggaagagacaagatgccaccctacaaaaggcgttctagtgagccaattttcgacgaggcttctgctgaaccccaaaatgtagccttgaggggctatggacgtggttgcaattgtggtcagggaagacatggtaggggtggtggaatgtcagagttctga

SEQ ID NO: 45822 - DNA, 207 bp, Glycine max
  Peptide Sequence Number=SeqID_162600
atgagtgacaaagaaaatgcttgtgcattgctgggtatgggaaagcttggaggggttgatggggacccggtactgagaggaacgaggataagggatacatgggggtacgtgagctcagttgatggtgggcaactggggatggtgggttcatgtttgatttgtggatgtgggagagttgatttgcaccatcgcccgatcgccacctag

SEQ ID NO: 45823 - DNA, 504 bp, Glycine max
  Peptide Sequence Number=SeqID_162601
atggcttcgaagaaactctccacgaagaggtctagaagagacgccacaggagaaggatccagtgccgccccagagtttgatagtcatcgtttccagagtgccgagcaccagcaacgcttcgaggccatcaggggatggttgctccacagggagagacgtgtccggctcagggaggatgagtatatggactttcaggaggagatagctcacagacgttggacacccactgcagggaggcggttggtgtatgccatcctgacacggatgagcgtccacatggcccagtcctacgaagttcccatcacccccagtaaagtaatccgactgccgatcacccgagccttcatcaagaagtacagcacgcctaggcaggtccagggtgacgcacatcaggctgcagacacaccgtcaccacctcagcaagccgatccagctgggtcactgggcgtagagcgttatctacagcatttggttcgccagcaggcggccaatcaccgtgggcag

SEQ ID NO: 45824 - DNA, 218 bp, Glycine max
  Peptide Sequence Number=SeqID_162602
agacaaattatggtcattttgcgccctttggtcatctagaggcggcgaagccgatgacatgcggagacaaattatggtcattccgcacaccttttcgccattcggagacaatcgtgtccgatggcacgcagagacaaattatggtcattctgcgccttgtgtcaaccaagaggaacgaattcggcagtatcaggatgatgttggtcgtttggtactga

SEQ ID NO: 45825 - DNA, 180 bp, Glycine max
  Peptide Sequence Number=SeqID_162603
atgagcgcgcacactgtctacttacgtcaaaccacaagtaatgttaataacaaaaagtgcggtgaccttggtcacgtggctccgctccctcccaagaaaccgagcaggtcagtcatatcttcatccatatgggattcatctgcctcaccgggggatcctacaggctcctcccctgcctag

SEQ ID NO: 45826 - DNA, 2865 bp, Glycine max
  Peptide Sequence Number=SeqID_162604
atggagggggagaatattaggtctgggacaaagaagaagcgatccaagaaggaaattggtttcgactccgacgacgacgagcccattgggtcaatgtttaagttgaagaggtccaagaagaagggtagtggtggcggcagtagtgatgctgctgttgttagggagaaagaggatttggggggtatggatgataatgataccttggctagctttaggaagaggctgaagggtcctaagagagatcagggatctggggtcacaagaggaggagcaattcctgctttgcatgtgtctgatgaagatttggttgctttgggacctaaaggtaaggatgagaaaggcgtggcgcccgtgcccttggtgtggggtgatgaggacatgcagatgcaagattgcactgatcaacaacacatggaggatttgttgcccgtgattttcaataaggcacagtctagttcttctaggaaatctcgtagccagggttcgaggcagaaaaaggggattcagaatgtagatagtgaaggttttgtggaagctgtggattctggggttgaaagtagatctggatctgcttctggctcgaaattggttggggggaatgttgagtctgtggaactcttgcctcaagcgtctgaacgggttgttgcatctgtggtggatgatcagaagtgtggtgatgactgttttcaagaggaagctgtgaagggccattgcgatttggacattccagatggaccgtctcagtcgaacaatgtctgccatggagatatgcagcaattgtcttgtgtacaagttgaagatatttcttgtcattctgaccaaaaggttggattgcaggaaagtgctctcagtgatgctttaaaaaatttatctaccacgtcgcatgatgaaatagttgatactatctctctctcaaaagtgggggagggcgaaagaggatttactgaggcaggagagtccgaaaacagattgacggttgaaccagcaaaagtgtgcaacagtgcttcagaacctgatgtttctacttttgctgggaaagaaaatgtcttaacttcttgccacactgaacccttgattaaatcagctgaaactatattgaatgagaataataatatggttgctagaaaagttttccaggaatcctcatggaatggagctctggatttatctggatgtcatatggaagtagacggaggtggaaaatcagaaaccgagttcgtttctgatagaaatttctgtgattatagtagtttagatacaaaggccgaagtgcaagattttgtttcaggtttttcacctaaaagaaataatgtaactgtcagtggtagtttatcttctatggtgtctaacgaagccaatgaagctgaattgactgcccactcaaatcacccagagaaacctctagaaggttgcaatattccaaaagactcaactgcttcaattctaaaatgtagctcagtgttagatccaattcaatctgatggatcctctcttcagtcttctattccagatgaaaatgggaactctgctgaataccgggcccctgtatctgattttgctgataatgagggtaagatatcaagcatcccacgggcggtgcgaaagaccaaaatgcgtaagcatggtgacatgacatatgagggggatgctgattgggaaattttaattgatgatcaagctctaaatgaaagtcaagttatgacagatggtgaccgcactcttagatcaagattgaagcatgattcctctttgaatactggtgaagactctgaaaatgttgcagtagtagcagtatcagctgggctgaaagcccgtaaagctggtccaattgagaaaataaagtttaaggaagtcttgaagcgtaaaggtggtctcaaggaatatttggattgcagaaatcagattttaagtctttggaacagagatgtcacacgtattttgcctcttgctgaatgtggagttagtgatactcattctgaggatggaagtcctcgttcttctcttattagggaggtctatgcatttctcgatcaatatggttatataaatgttggaattgcctctcagaaggagaatgttggaagtaatgcaaggcattgttataaactggtaaaagaaaaaggttttgaggaaagtctcgcagcttcaatggctgactctgaagatggagtttcctttcttgttggtcagaccaaaatgtcagatacttccaatgagattaacaatggtctaacaaaggatggtgatgacctaacacttgaagccgcagaaggcatgaggcatgctaatgaaatgaagacggatttatcaaacatgacacaacaggtagaaagaaaaaaaaatgattaccagggaaatgacagttctgttccttcttccaactttcctgattgcagattgatttctctggtagctaaagagaaaagcaatgactctacctgcataaaatctgccttagatgctcgggtaggttatcatctgcagtctgatttagatcctaggaagagagtaattgtcattggagctggtcctgctgggctaactgctgctcgccacttagaacgtcaaggattttctgtttttgtgcttgaggctaggagtaggataggaggtcgtgtatttactgatcatttgtcactttctgtccctgttgatcttggtgctagcattataactggtgttgaggctgatgtggccactgagagaagaccagatccttcctcattgatttgtgctcagttgggtcttgagttgacagtgttgaacagtgattgccctctttacgacatagtgacaggacataaagttcctgcagatatggatgtagcattggaagctgagtataatagtcttattgatgacatg

SEQ ID NO: 45827 - DNA, 339 bp, Glycine max
  Peptide Sequence Number=SeqID_162605
atgtatgttgatataaatgcagctctgatacctctggctgagttctctgaccctgtgctcatgaagagatatgaactgaaaccagcacctgaagtaattgatattgtgtcaactgctgccaagcaaaagaatattgtggtgctaatgaagatctattggggagatgctcgtgagaggttatgcgaagcaattgatcatgtacctttagactaccttaccttagggaacagaggccttggcacgctccaaagggttataatgggtagcgtcagcaactatgtagtgaataatgccacctgtcctgtcactgtggtgaagagttcagtccacaactattag

SEQ ID NO: 45828 - DNA, 2654 bp, Glycine max
  Peptide Sequence Number=SeqID_162606
atagtccatttgattccaaaaaggatagtactctggaaaaaaaacttggtgaggagattttgagccctcaggaaaggagggttatggattggcactttgctcatttggagtatggttgtgctgctttgcttaaggatgtttctcttccctactggaatcaagatgatgtgtatggaggttttgggggagctcattgtatgattaaagggggttacagctctgttgttgagtctctgggagaaggactgacagttcacttgaaccatgttgtaacaaatgtgtcatatggtatcaaggaacctggccagagtaataaagtcaaagtttctacggaaaatggcaatgagttctttggcgatgctgtccttgtgactgttccacttggctgtttgaaggctgaaactatacagttctccccacctttgccacagtggaaatgttcttctgttcagcgtcttggttatggagttctaaataaagtggttttggaatttcctagtgtattttgggatgatgctgtggactactttggagcaacggctgaggagagaagcagtagaggtcactgctttatgttctggaatgtcaggagaacagttggggctcctgttcttatagcattagtggttggtaaggcagccatagatggtcaaagtttgagctcttctgatcatgttaaccatgcattgaaggttctccgtaaactttttggggaggactcagttcctgatcctgttgcctacgttgtgactgattggggtagggatccttttagttatggttcttattcttacgttgctgttggagcatctggagaagactatgatataatagggagaccagttgataactgcttgttttttgctggtgaagcaacatgcaaagagcacccagatactgtcggtggtgcaatgatgagtggactacgagaggctgttcgcatgattgacatattgagcagtgggaatgattatattgcagaggtggaggcattggaagctgctcggggacagttagacactgaaagggatgaagttagggatataataaagagacttgatgcattagagctttctaacataatgtacaagaactctttagatggtgctcacattttaacccgggaagctttgttaagggaaatgttctttaatacgaaaaccactgctgggcgcttacatgtggccaaacaattgctaactcttcctgttggaaacttgaagtcttttgctggaagtaaagaggggctagccattctcaattcatggatactggactcaatggggaaggatggtacccaactcttgaggcactgtttgcgtcttcttgtccgtgtttcgactgatcttcttgctgtacgattatcaggaatggggaaaaccgtgaaggaaaaagtttgtgtacatactagccgtgatattcgtgctatagcaagtcagttggtcaatgtatggcttgaagttttccgtaagggaaaagcttctaatggtggattgaagatatcaagacaaacatctgctgtagatttatcaaagagaaaatctgtaaaagattcagccttgggaaagccacctctgggcacatatcatggtaccattgagaataaaggaggcttgctgaatcccacctctgctggaagcaattcaccttccactgcacatgtgaagaaattgcacagcaaacaaggaagacaaccagcagcatatgactcaaggcacgaggtcagttcttccaggtctaaaggttcaatagacacagtagttgctgagaaggaggataacctctgcactatatctgaagaagaacaggctgctatagctgctgcagaagctgcccgagctaaagctcttgctgctgctgaggcatatgcctctgcagaagccagatgtaataccctgttacagcttccaaagataccctcattccacaaatttgctagacgtgaacagccttcacaaaatgacgagtgtgatagtagaaaaagatggcctggtggtgtttatggaaggcaagattgtatttcagagattgattctaggaattgcagggtcagggactggtctgttgatttctctgctgcttgtgtcaaccttgataattccagaatgccagttgataacctttcacagaggagtcattcaaatgagattgccagccatttgaatttcagagagcactcaggagaaagtgttgctggggacagcagtatatatacaaaagcttggattgacacagctggtggtattgcaattaaagaccatcatgccatagagagatggcaatctcaagcagctgcagctgattcttatttttccaacccatctattgatttgaaggatgaagaggattcaaatgcctgttcgaagttacccagctggaagcgtgatggtattgcaaatgagagctctatttcacaggttactgtaaataaggaggctcaaaaaggtcattcacgaggagcagatcatattaaacaggctgttgtggactatgttgcatcactacttatgcccttgtataaggcaaggaaactagacaaggatggatacaaggctataatgaagaaaagtgaaacaaaggtcatggagcaagccacagatgcagaaaaagccatgactgttcgtgagtttctagattttaagcgaaagaataag

SEQ ID NO: 45829 - DNA, 1396 bp, Glycine max
  Peptide Sequence Number=SeqID_162607
ggagtcaaggcagtttcctccaaagcattcatcttttcctgataaagagaggtatactccaaggaaaagaatggatgaaaaatcccttatagaaagaaattgcattgatgattttgatgaatgtgagtttgagtttctaaacaagagctatagaatgtccactgttgctgagagagaacaggaatttttagacaataatcgtgaagagcagtttccacatatttatagagattggagaagatctgtccgtaggggaagacgttttgacaagccccctttagttttgaataacttgtgttctgggacaatggaagtcgaagataattgtcagaaatatacacacttccggacttcaaattttaagcatcgtagacaatcttatacagattcagtgaaaaattatgcatatgggtcaagagtaaatggaaatcttgggggttcggggagagataagcatgctagggacaacagagacagcaactggtcgtgtgattatactgacactgctgaagatgaagatttccgaatttgtcctgtaaaagagtatcaattttataggtccccatctaagttcctgaactggacagaggatgaaattatttttatgcgtcatgaaactcatgcaacatctctgtttactaaggttcagagtgatgatttgccattgcagcagcatcagctaagtatgccaaaacgagataatgagaaatattttaaaggtagctctaagattatgtgcagaagtaagggtgggcaggcagtgctgagatgcaggaaatcagttgacttgattcatggggaaggaaagaaatgttgtgttttggacaataaggatgtgtcttttcagtctcaagtgagaagttccagagtctcgtgcaatggaaggcttgaaaatgtcaaccaggggattgctaagaaacggaagagagcttcagtgggttttgatgaatctaataaaaataccttcaaatttgactccccaaaatacgagagcaacctcaaaagtaagaaatgggtgcagaaccttcaagatcaagcgcagaaagaaagctcggacatcgaggaaggtcagattgttgcagaagaaccatacatggagaaggtttctgtatccagaagagatgcttctgaaggtccagcagtgactgacagtgtgaacaagaagagaatgtcacaaaatgaaaatagttctgaccaatatataggtggttacgacagtcaaaggattcttgattcattagccaagatggagaaacgtagggagcgctttaagcaaccaatgacaatgaaaaaagaagcagaagagagtttgaagcttaacaatgattccattgtagatacaggtgaaatgaagcaacacagaccaactcgaaagaggcgttgggttggtaattag

SEQ ID NO: 45830 - DNA, 633 bp, Glycine max
  Peptide Sequence Number=SeqID_162608
atggcttggggcactgtcctacaacgcctaggtggggttgctttgccaatgattggattgactgatggtccttgtggtgctccactcgacattggggttgcactaagacttgtcaccacagttgaagaatggatggtgagaaatggagctgagtatgcattcctagccactgaaaagaataatgatgcatctaaaaacctatttaccatcaagtgcaactatgtgaatctcagctcacttgtcatatttgtccaaccaactagttcccttacaaagcaaatttccagggatataaaaatagagaaagtggacatagatctagcgatttcgttatacagaagaaccatgaggaccaaagatttgtatccattagacatggatgttattctgaaggagaaactcagcctagccatatggggagagaaccttggagagctcatggaatccatgtggagattcacatcaagagtgggagaaggtatgagggactgtagggtggttataactgagttagggtttggggatatcctcttgccaaccacgttcctcagacagattctatgtcatgtatcgatgatctatggtacacaaagagacttccaagccatggtgatgaaaatattgatgaactga

SEQ ID NO: 45831 - DNA, 1548 bp, Glycine max
  Peptide Sequence Number=SeqID_162609
atgtgggcgaagacaagcttcaagaaaaggcgccactttttacgtatacttttgaagtatataattaaacatcaagcacttatatgcgaaatatcttctcgcgatactggaaagacaatggtagatgcctctttaggagaaataatgacaacatgtgagaagataaattggctactatcagagggtgagcagtgcctaaagcctgagtaccggtcctctggaagagctatgcttcataagagatccaaagtagaatttctcccccttggtgttatcggtgccattgtgtcgtggaactatcctttccacaatatttttaaccctatgttggcagcagttttttctggaaatggcattgtgattaagatttcggaacatgcaagttggtctggatgcttttacttccgaatcatccaatcagcacttgctgccataggagctccggaggaacttgttgaggtgataacagggtatagtcttattttgtacccttcattcttccttctcggtttcaatcacatctgcatctatagccttaattggacttttcttaccaggtttgctgaaacaggagaagcactggtagcttctgctgacaaagtcatttttgttggatcccctggggttggcaagatgataatgagcaatgctgctgagacacttatcccagttacactagagcttggtggaaaagatgtatttattgtttgtgaagatgcagatgtggatcatgttgctcaagttgctgtcagggctgctctgcagtcaagtgggcagaactgtgctggggcagagcgattttatgtccacaggaacatatatgcatcctttgtcagtaaagttaccaaaattataaaatctgttacagctggcccaccacttgctggaaagtatgatatgggagctttgtgtatgcatgcacattctgaaaagcttgaagcccttataaatgatgctttagacaaaggagctgaaattattgcacgtggaagttttggacatataggtgaagatgcagttgatcaatatttcccccctacagtgattgtgaatgtgaatcactcgatgagattaatgcaagaagaggcgtttggaccaatcatgccaataatgaaatttagctctgatgaagaggttgtcaggcttgcaaatgattcaaaatatgggcttgggtgtaatgttttctcaggcagtcagagccgtgctagagagatagcttcccagatacattgtgggcttgctgcggttaatgattttgctgcaacatacatgtgtcagtccctgccatttgggggtgtgaaaaacagtggatttggacgattcggtggtgttgagggtttgcgagcatgctgccttgtaaaatctgttgttgaagatagatggtggccattcataaaaactgtgataccgaagcctatacaggagtcgcttgttgaagcactttacgggctcagcgtatgggaccgtttgcaagcattggtgaacgtgttgaaaatgcttactgagcagaactctacaagtggcagcagaaaaaagaaaaatgactaa

SEQ ID NO: 45832 - DNA, 270 bp, Glycine max
  Peptide Sequence Number=SeqID_162610
atgggaggaactagactgtcttcatgccagcagtatgtggactccaacttgtatcttgagatcaaactatggattgttttaggtggattgccaactccaacttgtatcttgagatcaaactatggatgtgctcttgcatcggtcaatggaggatacaagtgcaggttgtggtgctttgaaatctacacgatgaaactggcagtctgccatcgtgcattactttttataaccaaagagttgcttataatttctattgctcatgcagtttga

SEQ ID NO: 45833 - DNA, 1044 bp, Glycine max
  Peptide Sequence Number=SeqID_162611
atggtggttgaaacaccgtttttaaattccgctttctcctttttccactacgatcttcgaaggcaccatcttaaaaccgccttggaatgcttcaaaacaaagacggtcttgggaacaccgtggcgcctcaacttcttcatgtcacacactctctctcttagtggagacgtgaggattgttgacctttacactgatacgcagaacatagccgagagtgggcacccggcggtgcaattggtgctagggtttttgtgggaaatggggctttttagagagcaaatcaaggggaaggcctttcggtaccaccacttcaccgcagagggaggcaacatgcaatcgaagatggaattggtctacaactacacgaggagcgaccactcctgtcctccagccactgaagttgtgagtgcagatttcttgcgtggtttatcatgggggataggtatgctttgtgtttcaactgattgcgctgtgttgtggaacaacccttctggaaagcttgttcagattgagcatgctttgacggttgttgggtctggacaaatgtctttgggaattaaagtttacagtagtgttctgggatttccgattaagttaagtgggattgaggtggctgagggtgctggacaccttgaggtggagggagagaaaactactgtgagactcgccggagatgcatcacacgtcataaaggagaacatgtgtaaacttcaaaggccaaaaaagggtcatgcgtggggtgcatctgacggcatagggaagtttgccaggcaagggcatagcagtcacacgatactatttatcgtaaagaggggtagaaccagcaaaagccatgagggtcgtggtgtggtcgtgattgtgcgcaaaggaggggtggcgaccatggtggtcggtgttggttgtggagttgcgcaaaggcgtgttagggctgctggtggtgtgcgctggcgatgggttggtgggagaggtggttcgacgtgcggatcaggtcttgaagaatatggcggcgcgcacggaccctgtggtgatgagagatctgagtag

SEQ ID NO: 45834 - DNA, 1722 bp, Glycine max
  Peptide Sequence Number=SeqID_162612
atggaaggtttcgacgatgacgatttcggcgaactctacgccgtcgacattgaagttcccaatgccatctcagaagaagaagaagaagaaaaactcgatgtaaacagtaacattttgaatcttgataaggatatggacaacaacaaagttaatgaggactgtgctgctgagagtgacagcgacgacgacgacgatgatctgaaaatcgtgctgaatgacgaggatattcctgtcggagctgatgcttgcgacgacgacggagatggcgacaatggtgatgataacaacggttccagattttttcatcctaagagtgggaggagtcgaggattggcgattttgaataatacgaaggccaatgcatccatgggtatgggttcttacatttcatccttgaataaagggaggaggaatggtgatacctacatccagaaccttgcattgagctcctctcgagtgtgtcttgcagaaaatcctatggctgttcaatgtggatatggattggctcttccttggtactggggtatatttgatgtaaacattgatacattaacggagaagccatggaaggttcctggagttgacataacagattactttaacttcggttttaatgagagctcttggaagctataccgtgcttcattggagcaactttggcgaacatccttgcaaactggtatttctgttgatgactctacaaactggaatcaggaagccatgagagagcaaactgatcaagttgtgtcaggaaatgcattttttccttcatcagattgtggattgccaaaaggcagagcaattcaggttgaggacagcatggttgaacggaaaccaaccatggatgtaaggcgtccacgtaatagggattttaatgttatagagatcaagctgcttgactcctctgatgactgttctggttctggcaatagcactgtaatggatgcatcattagaaggggaatctatggcaggtagtaagagaaatgctctcaattcttctgctgaactcaatgaagtgctgtctgaagatcagttggaagatgtgaaaaaagcagaggactcttctcttcagagaagaagtgggccaattcctggtgtagatggagatgagcatcgggatcaagcagaccaacattctgaagatactgcagaagtgccggagggagaaacagaagcagaggaaggtggtggcatagacacatgtagttcttatccatgttggactgaatcagaattgtctcttggagatcaagagcacagcctgacttcctatactgatggtgattctgaggcaacggataacagtgtacatgttgataatgataaaagtcttagccctttaaaaaggaaatcgttgaattgtgttactgaaatgaaggagtctttggcactttattggaagaactcaaagaacaacagtatcaataaaaaagcagtaagtgcagcttataattcaagaactagaggtcaattcagaaaggaatggaggaaccaaagtggtggatatgaacctcatagttatgatatgaataagcacactgaaaatgataatgatgtctccatcctcaagtcaagtgcaaggaatctgtctctgttggctcaccgacccgttgattatggcagacataaagaccaactgcaagtttttggcagtcataaaagaagagatctttcatgtaatagggaaacaaaacaatcctactattatggcggtgaccag

SEQ ID NO: 45835 - DNA, 420 bp, Glycine max
  Peptide Sequence Number=SeqID_162613
atgcggatcaagttgatccgcgttaagcctatggatcaagttgattcgcaacaagctacaacctatgcggatcatctaacacaaatgcggatcatctacactctacgctatctctacgctatcactgatgctgatcaggtctatgcatacgaggatcaacttgaagaaacacacagaatggaaaagcaaacgacaggggagtggcttacctcgacaatgctgcgagccaaagaagaagaacacaaatgcaccactggacgcgagctcaagaagcagaccaacacaccacggcgccacacaagaaaccagctgggtcaagaagcaagtcgtaacagaaaagaaagaagaagaagacgaagctgcgcgctgggtgaagaagaaagaaagaaggaatgcgaaaagcggggagagagaagctag

SEQ ID NO: 45836 - DNA, 207 bp, Glycine max
  Peptide Sequence Number=SeqID_162614
atggcatttgcagggcacacattttcacaaggtcgtgaacagtctgctggacagtcctctggatcaaattctgttcaaaagacattacttcaacgtttattaattgctagtaatggcatgccattccacgtttttaatatgatggtggacataagagatgaccacattttcatagtaacatggcattccacctttgacaacccttga

SEQ ID NO: 45837 - DNA, 498 bp, Glycine max
  Peptide Sequence Number=SeqID_162615
atggctctcagatatttgtgcgctacaaatatttccatccaacattatcatcatcatgttgctaaaactcttgtttcctcaagtgtttctctaacaagctcacgcatgcagagttccacccctgctgcgagaaacagcaagaacaagtttattactgctaagaacgtgaagagcctcgtcaacaccatcgtgattccttccatttcatccactccactcgagtctctccacagaggcaactggcccaagctcatttgtgttgactgcattgactgtgctgctgatgcatcgtttgttagtgctgtgaatgaaggaattgaagctgctaaagatattgtatgccttagaaggccctgggtgatgatcagtgtcaatgatgataaagatcttcattttcgtaaggccggacttgaatatgtatcaaataattcccaagttgaagaagtctactttggtgagagacttatttacttcaacattgatgaagtgacagtttaa

SEQ ID NO: 45838 - DNA, 234 bp, Glycine max
  Peptide Sequence Number=SeqID_162616
atggatattgccttctcctcttcttctcaaaaaagcagtggtcaaaattggttgagagagaccagtaaaaatattttgctcatacgggaactcaagtacaatgtgtttggaggatggtcagaaggcgtgttaaactttccaccaacttataagtatgaggttaattcagataagtattatggagaggatcccaaggttggaaagcgctcaccagcatggtatgcttttttctga

SEQ ID NO: 45839 - DNA, 336 bp, Glycine max
  Peptide Sequence Number=SeqID_162617
atgaaggcacgtgagcttggaaatttctgcaaacatggaaaacatagttattacgacctcattatcgtgcaacatgtaacaaacgatgtaattcagtcatatgctcaagcaatgccttctccagatcccagaattaaatatttgttagttcaagttgtatttttagatgttgcaaagctcgggcaagttaaagttgatgatgttttagtgactgctttggttgaaaggtggagacttgggtcacacgcatttcatcttcctgttgaagaatgcacaatcaccttggaagatgttactaatccaacatattatgattgggaacagatgtgcacataa

SEQ ID NO: 45840 - DNA, 354 bp, Glycine max
  Peptide Sequence Number=SeqID_162618
atggaaagtgtatccgctcttgtttattgcaatagtggcatgattccaacagatgaagggatagtatttgaatgccctattgatccaaaagtcatcacaataagtgaggacatgtcgcttgctaccttagggaaaacaatttttgacgccaatggaggctatgaaattttgatagatggtttttaccatcaaccaaactacataggtgatggttgtgttgcatacgactataaggagttcaaacacaatgatgatgtcggaaaaatgtattcatctattcaaaatttagtaccaaagataaaatccttgcccagctacgcaaaccaaggaaaccaagaacggctgatgacataa

SEQ ID NO: 45841 - DNA, 2196 bp, Glycine max
  Peptide Sequence Number=SeqID_162619
atggatcctcgtcttcttgggtttagtggttcccctaatgaaatccagttgggaaatcagagatttgaaaatggtttctttgatcaaagtagggaatttggttaccttcagtccaatctactaccaattgacacaccttcttcatcctcggtttggactcatgaggaaccttctccggaggattgtgaattttctgatggaattttgagttacatcagtcagatccttatggaagaagacatggaagataagacatgcatgttacaagattcattggatcttcaaattgctgagagatcattctatgaggtaattggtgaaaagtacccttcttcgcctttagggcatccaagttctgttgatccagatgatgggggtggggtggataatttctctgaaaattatggtacttgttcttacaatgatggtgacctcagtagcatttttactaacaattctttgcgccgaaatttgggggaacttcctaaccagaattttcgaggcaatagcatttcccggtcatcttatagctctccaaatagtgtcataagtagtgtggaagggcctgtagactctccaagcagtattctccaggttcctgatctgaacagtgagactcaatccattttgcaatttcagaagggtgttgaggaggctagcaagtttcttccaagtggaaatggactctttgctaatttgggtgtggctaatttttcaaaactagagcctagagtggggagtgatgaattgcctgttaaggtggagaaggacgagggtgagtcttttcctgctggatccaaaataaggaagcatcatcacagggaagaggggggtgttgaagaaaatagaagcagcaagcaagccgcaattttctctgaacctacattgcgatcatccatgattgatataatcctgcttcatagtttaggggatggcaagaagcattttatggcccgccgtgaggccttgcaaaccaagaatgagaagatagtggtgtcaaatggtaaatcaaaggcttccaatggtggcaaggggcgtagtaagaaacaaaatgggaaaaaggaggtggtagatttgagaacacttttggttctttgtgctcaggctgttgctgcagatgactataaaggtgcaaacgagttgctaaagcagatcaggcagcactcaaacccttttggggatgggaatcagaggttggctcatatctttgctgatggccttgaagcgcgcttgtctggtactggtagccaaatttataaaggacttgttagcaaaagaacatcagctgctgattttctgaaggcctatcatctatatcttgctgcttgcccttttaggaagatgactgcttttatctctaatgttacaataaggaaatcttcagcaaattcaccaagactccatattatagattttggtatcctttatggtttccagtggcctactttaattcagagactttcattagcaggaggagcacctaaactccggattactggaatagactccccacaacctggtttcaggcctgctgagagaattgtagaaactggacgccgcttggcggcatatgctgaatcatttaaggtggaatttgagtacaatgctatagctaaaaaatgggaaacaattcaacttgaggaactcaagattgatagggacgagtacctcgttgttacctgtttttatcgtggtaaaaatgtgctggatgaatctgtggttgtggacagtccaaggaataaattcctcagtttgataaggaagatcaacccgaatatattcattcatggcattactaacggggccttcaatgcgcctttttttgttactcgattcagggaggcactgtttcactactcttcactctttgacatgcttgaagccattgtttctcgcgaggaatgggagaggatgctcattgagaaagaaatatttggtagggaagcattgaatgtcatagcatgtgaaggctgtgagagagtagagaggccagagacatataggcagtggcaagcccgaattctaagggctggatttttgcaacaaccttttgagcgtgagatagtaaagagggcaatagagaaagtaacaactagctaccacaaggattttgtaattgatgaagatagccaatggttgttgcaaggttggaaggggcgaatcatttatgccctttcttgttggaaacctgcatga

SEQ ID NO: 45842 - DNA, 300 bp, Glycine max
  Peptide Sequence Number=SeqID_162620
atggtggacaaagtgaagcagattgtgttggtagagtctatgggtggaacgaacgttaaccatccagtgaacaaaatgttgaaagggaaggctgagcaatatctagctgattctagcatcccatatacaattataaggtatggtggttttgaaaacaaagaaggaggtcttagggaactgattgtagggaaggatgatgagcttctcaagactgaaaccaaaaccatacctagagctgatgttgcagaagcctacattcaggcactaaattatgaggaggctaaattcaaggcattttga

SEQ ID NO: 45843 - DNA, 270 bp, Glycine max
  Peptide Sequence Number=SeqID_162621
atggatgcagttgctaatttgtacctaaagcaacacccaaacatgttcataaaggtagtagtgttaagggtttgggttaataaaagtagtgatcatgggtttgggttcatggtggtgataagtttgttgtggggggaatgggcttgtgatggcagcaaagctataaggggagtttgggtttatggtggcaacgaggtcgtggtaggggtttgggttggtaagggcggcgatggaggtcatgagcatataggcacatcaagactttcgtag

SEQ ID NO: 45844 - DNA, 150 bp, Glycine max
  Peptide Sequence Number=SeqID_162622
atggaggaattccaaaccgcaataaggatgactcactccttaaatgatgttgaagctatacacgcaacaccagaatccatttgcaatcctactaattacgacattggttgtgacgatgttgttaacaaccaaaaaaatgaggctaaatag

SEQ ID NO: 45845 - DNA, 366 bp, Glycine max
  Peptide Sequence Number=SeqID_162623
atggaccttttagggagtgatatcgcgaatgaagaggtgaaaaatgctatatttactatgggaagcttcaaggctccaggagaggatgttggtatcaaacccttaaataagactttggtaacctttattcctaaggtggaggaagtcaatcttttttcccaattaaggcctattagtttgtccaatgtgttctataaagattttactaaggtgttggcttcaagactcataactgtcatggagaagttagttagtcgtactcaatgtaacttcgttcctcaaagacaaagtagggataatatcatcattgctcaagaagtaattcattccatgagaaacaaaaaaaaaggagaaaaggatggatga

SEQ ID NO: 45846 - DNA, 375 bp, Glycine max
  Peptide Sequence Number=SeqID_162624
atgggttttcaagtgtgtcactcacttggaggaggcacgggttctggcatgggaacactgttgatatcgaagatcagggaggagtacccggacagaatgatgcttactttctctgtttttccatctccaaaggtctctgacacggttgtggagccttacaatgctactttgtccgttcaccaactagtggagaatgcagatgagtgcatggttcttgacaatgaagcactctatgacatttgcttcaggaccttaaaactcaccactcctagttgtaagtaccactccctcttggatttggatttctccatgcattcacatgttcaacaattggaaaatgtggataaagttttttcacacaatcaattaccgtaa

SEQ ID NO: 45847 - DNA, 945 bp, Glycine max
  Peptide Sequence Number=SeqID_162625
atggagtacatgaaccagagaccaaaatatgattgccttctttttgatttagatgatactttgtatccactaagcactggtcttgcaaaagcatgtggccaaaatattaaagtgttttactcttttgttggtggtgctgacacgagtggttcaattgatctagactatatggtggaaaagcttggcatagacaaaagcaaaattgatgacttgtccaacctcctctacaagaactatggaacaactatggctggtttaagggcaattggatatgactttgaatatgatgaatatcacagttatgttcatgggagattaccttatgagaatttgaaaccagacccagttctgaggaaccttttgctgagcctgccctataggaaactgattttcacaaactcagacaaagtccatgctgttaaggcactaagcaagcttggattagaagactgctttgaaggaatcatatgctttgagacccttaatcccatccacaaaagttctgtctctgatgatgaagacgacattgagtttgtggggggttcaggcacaacaattccagcaccaaaaaaagatgttaatagctttcaaatctttgacctcattagccattttgctaagcccaatcccaacacagttttgccaaagacaccaattatttgcaaaccatcagaaaatgccattgagttggctctcaagatagccaaccttaatccacagagaactttgttctttgaggatagtgtccgcaacatacaagctggaaaacgtgtgggtcttcacactgtgctggttggaaaatctcagagaattaaaggagcagattatgcattagaaagcatccacaaccttagggaggcagtaccagaactatgggagggtgacataaaatcagaagttgcttatcctggcaagcattctgtggagacatctgtgactgcttag

SEQ ID NO: 45848 - DNA, 741 bp, Glycine max
  Peptide Sequence Number=SeqID_162626
atgtctccaatgaagatccaggcacctggggagaggaagcttttgagctgtggcatttccttcttagttgacaacaatttgcttctacctatggctggcacaaaaggtgttgacacctcaactcatgcctcaggccagctggctagttctaagaaatgcaacttcttttgtggtgctatgaaccatcgtggtgctatgaaccatcgtcgtgcggaggagattaggattattcacgggtacaggcctattgctgatcgtataaaatctaagttggttactcagaagggcgctctcttatccattatgggtcgggttcaactgatcaagtcagtcataaatggcacgttgctttactccttccacatgtactcatggccaagggcccttctcaaggaagttgattgcttcattagaaattttatttggtctggcaccagtggtgcaaccattctcaagctttgttggagctttgtgtattcgggtgatcaatgggttggtgtccttagagctagatttttgcgaaaccattgtcagtatggtggatacaaaaagtattctcttttgtcatcgctgaagcaacatctccctactatttttcgtaataaagcttgggtcatggctccaaaatcaacttttggaataatgcttggtgcatggcggctcctattgttgaatctcttgggatccctttgcgcattcgcagccttctctcatcttcagtcatggactttagaactttga

SEQ ID NO: 45849 - DNA, 2487 bp, Glycine max
  Peptide Sequence Number=SeqID_162627
atggaaacggtgctccctcgcgctggcctcgctttctgcactccgcacccaacaacgacactacaacgtttcacaaaacctaacaaactcctccgttcatcctcccgcggcggcgcttccttatccgccaccagcaaatgggcggagcgcctcattgccgatttccaattcctcggcgacgccgccacttccaccgtcactctcagcccctcctccgtccctcccagcctcgaccctccggagcgctacgtctccatccctctcgacctgtaccgagtcctcggcgccgaattacatttcctcggcgacggcattcgcagggcctacgaggccaagttctcgaagcctcctcagtacgccttcagcaacgacgctttaatcagccgccgccaaatcctccaagccgcctgcgaaaccctagcggaccctgcttctagaagagagtacaatcaaggcctcgtcgacgaccacgaagacgccgccattctcactcaaatccctttcgacaaagttcctggagcgttgtgtgtgttgcaggaagctggagagacagagcttgtgcttgagattgggcagggtttgcttagggagaggttgccaaagacgtttaagcaggatgttgtgttggctatggcgcttgcttttgttgatgtgtcaagggatgctatggctttgtccccaccggatttcattgcggcctgtgagatgctcgagagggcgttgaagcttttgctggaagaaggagcaaccagcctagctccagatttacaagcacaaatagatgagacgctagaagagataaccccacattgtgttttggaacttttagccttgcctcttgatgatgaacatcgagcacggcgtggggaaggtcttcttggtgtccgtaacattttgtgggctgttggaggagggggtgcagcagcatttgctgggggtttcacccgtgaagacttcatgaatgagtcattcttacacatgacagcggctgaacaggttgaactttttgtagccacaccaagtaatattccagctgaaagtttcgaagcatatggagttgcacttgcactggttgcacaagcttttgtgggtaaaaagccgcatcttattcaagatgctgataacttgttccaacaacttcaacagactaagattacagctgtgaggaatgctccctctgtttatattcccaaggagattagagagattgattttgctttagaaaggggtctctgtgcactgcttgttggggagctggatcaatgtcggtcatggttaggactagatactgatagctctccttatagaaacccatctattatagaatttattatggaaaatgaaaaaggtgatgaggacagtgatcttcctggactctgtaaattgttagagacatggctgatggaggtggtttttcctaggtttagagatacaaaagaaacaagattcaagcttggagattactatgatgactcaacagtgctgagatatctagagaggctggagggtggtagccattcacccttagctgctgctgcagccatagtaaaaatcggagccgaggctactgctgtcattagccaggtccaggctagtgtaatgaatgcattgaaaaaggtatttcctgttggttctgaagatcaaattgtgaaacatcaagtaaatggtgtgaatgaggattttggcttttctgaaagtgagaatcctgtgatattatcagatcaggattcttcggtcaatgctgaggtttctggaataaaaaatactactgagacaagtgaaggtgaatttattactgaagaaattaaaaatgcaagtgtgcagatcatgtgtgctggtgtttttttaccttctaggaatggcttgcccatgctttgtaaaacgactggttcagcaatggcatcggatactatcaacttaggttccttgggagatgaagaaaaagtagagcagctaccaaaaatggatgcaagggttgctgaggctctagttcgcaagtggcaaagtgtaaaatccgaagcttttggacctgatcattgcatgggaaggttacatgaggccatgcttttggagttttggaaagcagggattgtgagtagctgggttccagccccctccattgcaacattcgcttgctctttgactggcaacagtcttgacatgaggcagttatgcagtgaattatcatatttctgtgttttggacggtgagatgttgaagatatggacagatcgtgctggtgagattgcagagcgtggttggtcctacgactataccttggaagacctcaacatcgatagtgtgaccatctcacagaatgggcgccgtgcagtggtggaaacaactctcaaagagtctattcacctgaatgccataggtcatccacaacatgatgcttctaacagcagaacctacacaacaagatatgagatgtcttttacaggtccagggtggaaaattgttgaaggagctgtccttgagtcctaa

SEQ ID NO: 45850 - DNA, 281 bp, Glycine max
  Peptide Sequence Number=SeqID_162628
ggggtggcggtggcggtggtggaggagggagtggatggggatggggtggtggaggtggtggatggtggaaatgggggtgtagaagggaagcaagacatggcaaagggaaacaaagagtgaggcattatcacacatcaaataatgaagactataggatgggggagtatgcacaatgcatggcaagaacaaggtgccgaggcttgaggctggattgtcctcttcactgtggtggaccttgtttctatgattgccaccatatgtgcaaggctcattgtcgttga

SEQ ID NO: 45851 - DNA, 1140 bp, Glycine max
  Peptide Sequence Number=SeqID_162629
atgtctcctcatcctcgtattcagaccttgatcaatcaatttggtgccttatttcagccttcatcatctcttccgctggcgagagagaccgaccaccacattcacttacttccccagtctgccccggtcaatgtacgtccgtatcattatcctcattatcaaaaacacgaaattgagcttcaggtggaatctatgctccaaaagggactcatcctccccagcaccagtcctttctcttccccggtgctgctcatcagaaagcaagatggctcctggaggttttgcgttgactacagggccctaaatgcggttacagtacgcgaacgattttcaattcctaccatagatgagcttttagatgagttggtcagagcctgctggttttcaaagttggatttgttgcatggctatcatcaaatcaggatgcatttggaagacatagctaaaaccgcatttcgcatacaccatgggcactacgaattcaaggtcataccctttggattgtgtaatgctccttcctcttttcaagcgataatgaatgtgatttttcggccgtatctccgccactttatcattgtcttctttgacgatatcctgatttatagcttgaccttcgatgatcatgtagctcacctgaagcaaacttttcgggttctcttagacaatcaattcgttctcaaattgtccaagtgctcgttcgcccaaccacaggtggaacacctgggccacttggtctcacaaaggggagttgaacttgtggcttcaaaggtcaatgcttttcgccaatggccggtatcgcagtccactaaagctctgaggagctttttgggcctcgctgggttttatcggaggtttataaaggtgaatgctacgatagcagctccgttggtctcggccactattgtggacccatttcagtggaccacttcagcccaaatagctttcgaacgattgaagcaagcactatcggaagctccagtactagcattgcctggtttccagttgcccttcatcgttgaaaccgaggtgcaagaagtaactagtagtgagtctagtgaagtgataaacaaaggggtgcagcttgaagagaaagcaaaaagaacaatcaccaagccttcatacctgaaggactacgtgtga

SEQ ID NO: 45852 - DNA, 384 bp, Glycine max
  Peptide Sequence Number=SeqID_162630
atggtacggagcgaagcgagtttggaggacctagatgaacacaggataagaagtgaattgaccattactggtcatccactggaactaggcaagtgctctgccatccatgtagaaagaaataatgaaaggcaagggaggaaaacgaagaagcagctcatcaaatttctgagtcatagactagactgtttctccgagggacacctggtgattggtgagcttgagaattgcggctttgaggttattagagggcccagaggtacaggaggggtcggtcatggtgacgagagcaccaaaatgatagggaaggctagtactagtttcgaggaccagttcctcctagaagaaggaaatttagaagataagtatttcattcataatttgtag

SEQ ID NO: 45853 - DNA, 981 bp, Glycine max
  Peptide Sequence Number=SeqID_162631
atggctgggtttttctctctaggaaggcagaacaaggcagaagaacaagaggaagatcaaagggaagacaactgtcaatttttgttcaggaacaacgttaacgaggagatctacaacaagggattcgagatatggccacaatcctcgtaccaccaccaccaccagaacttgaccaacttctactccttcggtgtgggccctagtcgcagaaacaacaacaatagctcctccaacaacaacgttaacgacgaagtttctgtgtctttctcggatgagtcgaaccggttcgggttcaccgtgatgaggtccggtggcggcggcgtaggtggcggcggaatgaactgtcaggactgtgggaaccaagcgaagaaagattgtcaacacctcagatgcagaacctgctgcaagagtcgagggtttcagtgtcagactcacgttaagagcacttgggttcccgcggctaaacgccgtgaacgacagcaacaactttctgcgttgcagcatcagcaacagaatcaacagccacagtttcgtggagatcactcaaaacgacacagagaaaacatcgaaggtgctgctgctggttctctcgcttgcgttccagttcctatcaccaccacagggttggagctggggcaatttccaccagagctaaactctccagcggtgtttcggtgtgtgaaagtgagtgcaatggatgcaccggacgagcgttacgcgtatcaaaccgcagtgaacataggaggacacgttttcaagggaattctttacgaccaaggaacggacggtccttacgcgggtgcaggttgtgagggttcctccggtggcggtggcgaagctcagccactaagtctaatggctgcagccacaaccaccaccgccgccacaacaagcggaaacccttttgaggcttcactctacacggctccgatgaatgcctacatggctggtacgcacttcttcccacccccaagatcctaa

SEQ ID NO: 45854 - DNA, 123 bp, Glycine max
  Peptide Sequence Number=SeqID_162632
atggcaacagcgacgaagtctatttcgctgaagcctttgggaagagacggcaccgcgaggcgccatttggtggaggagattctaattgtggtgcctaggtacgccgtcaagcctctggcaacg

SEQ ID NO: 45855 - DNA, 831 bp, Glycine max
  Peptide Sequence Number=SeqID_162633
atgactttaaacttcgtcggccagttctttcttctggcactcgtcggaatagagcaagtaagattgaaccgaaaagatgggttggctaaggtggcgggaacagtgctatgcgtggctggggcgaccgtgatcacactatacaaaggtccaacaatatacagcccaacaactcgtgtgaacaacagcatgatcatgaacagaagcaacacaacagttataacaccaatgtttgattttgggtcactgtcactgggagacgcaaaggggaagaactggaccctagggtgcttatacctgatcggacactgcttgtcgtggtctggttggcttgtgttgcaagcaccggttctcaagaagtaccctgctcgcctctctgtcacttcctacacctgcttctttggaatcttgcagtttctcgtcattgctttgctccttgaaagagacgctcaggcttggcttttccactctgctggagaagttttcactattttatacgcgggagtggtggcatccggaattgccttcgctgtacaaatatggtgcattgacagaggtggccctgtgtttgttgccgtctatcaacctgttcagacttttgttgtggccatcatggcttccattgctttaggagaagagttctacttgggtgggatcattggggcagtgttgattgtagcgggactgtactttgtcttatggggtaaaagtgaagagaggaagtttgcaatggaacagcttgcgatggcatccactgagcataatagcatcgcaagccacgtcaaagcatcacttgctcagccactcctttcttcatcaacagagaatgtttga

SEQ ID NO: 45856 - DNA, 351 bp, Glycine max
  Peptide Sequence Number=SeqID_162634
atggagtggaacagtctgttctatttggttccaaggtggaaccaaatttgtgtgcatggaacctacagaaagaacctggaatcaattctaggatctggtctgaagcgcatgaagagattgcatgttcatttctcttgtggtttaccaacagatggagaagtaattagtggtatgaggcaggatgtcaatgttctgatctttctagacgttagaaaagcattagaagaatgtatgaagctttacatttctgacaacaaggtgatcttgacagaaggttttgatggtgttgttcctcccaagtattttgaaaagatagaatcatggccgggcaaacagcccattcctttttaa

SEQ ID NO: 45857 - DNA, 405 bp, Glycine max
  Peptide Sequence Number=SeqID_162635
atggagtgcaacatctatggtgtaaaaataaaatctgatggtcctacaaatataggagctagaagtggtatctatgtaggtgtaggaggaataactagagctgaggaaggtactggagttgtggaagaagaaggagctggtgtctcaggtggtgctgaaatgagctgtgatcaagacagggaatccaagtctggatgtgtcatgctattcaatcagagagatctggtgggagatgagattaaacataaatacattcatcatctaaagctgtccaaaatatgggagttttgcaaaatacatagtgtcatccagagcaaaggtgtccaatgtggtggcttcagccacatgtatacattcatcaaattcctatacaataggtctacccatataaaaacaaaagagtaa

SEQ ID NO: 45858 - DNA, 204 bp, Glycine max
  Peptide Sequence Number=SeqID_162636
atgtatgcacttggagttcttgataaggaaggtcagatcctaaagactgtactcattgctatgattaaggggttcaaagggactatatttcttgaatgttttgcactgggtggttcttttagtgttaatatggggatggttggaggggaattttggaaggaggtgcagtggaagatttgtttcagaaacgctttggatggttag

SEQ ID NO: 45859 - DNA, 1518 bp, Glycine max
  Peptide Sequence Number=SeqID_162637
atggggtttctcgaaagaatcagttactcacactccgttggttcctcttgtaccgaaattcggataatggtgtctctaatttcaacatctccaccttcttcatctttcaacattcatcccttcttctctccaaggggcgtccaattcagacacaactgcgtaaattacaaacggaaaacggtacggtgcgccgtcaccagcgccgacgcatctcctccgccgtcaacgtcgttggccaaggaacctcacaaatacttcgaccacgtcatcatcaccgttcgcgccggtgacggcggccacggcgcggtgctgaatcagcagcagcagcagcagcagcagcagcagcaaggaaaaacgaagttgaagaaagggaaaggctcgttgaagagggacttcgacggatccctcattctccccatgggtggccacggaggtgacgtcgtgctctacgccgacgagtccaaagacacgctgctggagtttcacaacaaaggccgctaccacgccaaacgcggtggcaacgttgatgccatgggcgttttgacttcgatgcttcgcgatggacttgctgcaccgacgctgcgtattgctgttcctgtaggtacagttgtgaaaagcaaacgagggaagatgttggctgatctagcacaaccttgggatgaagttcttgttgcgaggggaggacaaggagggattagcttgttagaaatgccacagcataaaaggaaaaagatgatggctctgacaactaatgtgatgagagatgactcggacaaggttttaattcacggtcaacctggggaggaagttaagctggagttgatcctacgagttgttgctgacgttggtctgattggacttccaaatgctgggaaatcaacacttctggcagccattacacttgcaaaacccgatattgctgattatccttttacaacattaatgccaaatcttggacgccttggtggtgatcccagcttgggggcaggaatgtattcatctgaagccacattggcagatttgcctggtcttatagaaggtgctcacttaggaaagggtcttggtcgtaattttttgaggcacctcaggaggacccggctattggtccatgttgttgatgctgccactgagaatcctataaatgactacagaactgtcagagaagagttgcgcatgtataatcctgagtaccttgatcgaccatacgttgtaattttgaataagattgacctaccagaggcaaaggacaaacttccatcattgactcaagaaattatgagaattggcaacgatggtgctgcttccgatccaaaacctagccctgaagttctagatccattgtctgatgaaactgacaggaaggaaaaaagacttgaggactatccacgacctctctctgttgttggagttagcgttctaaagggtatcaggattaacgagatgttaaaggagataaggtcggctttaaggaagtgctcagattccaaagaagcattgtctttcagcgtgccaccttga

SEQ ID NO: 45860 - DNA, 1492 bp, Glycine max
  Peptide Sequence Number=SeqID_162638
atggtcggcaaaaccctgcgccggcgcggtgcggtgtttggcgtgtacgtgctgctgctggccggtgccggcttcatgttccacaccgtgcctggcggctttattccgacgcaggataagctgtacctgattggtggcgtgaagatgccggaaggctcatcgctggcgcgtaccgatgaagtgattcgtaagatgagcgaaatcggcatgaacaccgaaggcgtggcctactccgtcgccttccccggcctgaatgcgctgcagttcaccaatacgcccaataccggcacggtgttcttcggtctgaaaccgttcagcgagcgcagccgcactgcggcggaaattaatgctgagatcaacgcgaaaatttccaaaattcagcagggcttcggtttctccatcatgccaccgccgatcctcggtctgggccagggatcgggctattcgctgtatgtgcaggaccgtgcgggcctgggctatggcgcactgcaaaccgcgattaatacgctgtccggtgcggtgatgcagacgcctggcatgatgttcccgatctcctcctatcaggccaacgtgccgcagctggatgtgcaggtcgatcgcgacaaagccaaagcacagggcgtatcgctgaccgatctgttcacgacgctgcaggtgtatctgggttcctcttacgtcaacgacttcaacaagtttggtcgtacctggcgcgtgatggcgcaggccgacggggatttccgcgacagcgtgcaggatatcgcgaacctgcgcacccgtaacgatcgcggtgagatggtgccgattggcagcatggtgaacatcaccaccacctacggtccggacccggtgattcgctataacggctatccggcggccgacctgattggcgatgccgatccgcgcgtgctctcttctgcgcaggcgatggaaaaactcgaggcgatgtccagccaggtgctgccgaacggcatgaatatcgaatggaccgacctgagctatcagcaggcaacccagggcaacaccgcgtttatcgtgttcccggtggcggtgctgctggcgttcctggtactggcggcgctgtatgagagctggacgctgccgctggcggtgatcctgatcgtaccggtgacgatgctctccgcactggtcggcgtgtggctgaccggcggcgataacaacgtgtttgtccaggttggtctggtggtgctgatggggctggcatgtaagaacgccatcctgatcgtcgagttcgcccgcgaactggagatgcagggcaaaggaattgtggagtcggcgctggaagcctgtcgcctgcgtctgcgccctatcgttatgacctccatcgcctttatcgccggcaccgtgccgctgattctgggcgaaggtgccggcgccgaagtgcgtggcgtcaccggtatcaccgtgttctcgggcatgctaggggttacgctgtttggcctgttcctgacgccggtgttctacgtgacgctgc

SEQ ID NO: 45861 - DNA, 387 bp, Glycine max
  Peptide Sequence Number=SeqID_162639
atggctgatacttctagctcaaattttacccctcaatttgattatattacggaagactacaacatgggatttcctcctcgtgaaaaagttatcaccccagtagatttaactcttggagataatataaaatcaaaagggaaaaggttgcccatagatccgacttttaatatgccatctcttctactaaacataggaagtattgacccccaattacttccaaactacatagaacagtggacttctgctgttataagagactatagagtaaatcatgaaagtcatgcatccaacagtcaagacatgatagcaagagctgaaacatatctaggagatatagctagagcctgttgggaatctttcaaacaaactttcccagaacaaatctag

SEQ ID NO: 45862 - DNA, 894 bp, Glycine max
  Peptide Sequence Number=SeqID_162640
atgggttcggttcccgcagaactgagcttggatttaagacccactttcatccccaaaaccatcaccgatttcctccgccacctctccgacaacaacaacccccccgccaccctccacgatttcctcgcccgcctcgaagacgagctccgcaagatccacgccttcaaacgcgaactccccctctccatgctcctcttaaacgacgcaatttcagttctgaaggcggaatcgcagaaatgcagggtcgcgcgtgattctgcgccggtgctggaggagttcattccgttgaagaaggagcgtggtgatcagagcgaggaggaggaggaagaggaggagaatgatgatgatgacgacaacgaatgccgggataagaggaattggatgagttctgttcagctctggaataacaacactaccactgccaccactaataataacaacccttctgatcgcaaacaactacttcacaaattacaaaccaagaaaagtgaagaagggcaatctgtggttgaggatccttttcagacttgtagtaatataaatgaaggaagaagggcgtttatgcctttttctaggtactcatcttcatcatcatctgtgccggtgacgacagtgggactgggggctgctgcatccaaagaagagaaggaagagagtgttatgaatagactttctcttctgacaccttcttctgtgaaagaggggtgtggttcaaggggatcaaggagcagttccaacagggctgtttcttcttcttctcctcccatggttcagccgagtttgcgtgcgacttcacttcagcagactgctaggaaacagaggagatgctggtcccctgagttgcacagacgatttgttaatgccttgcagaagcttggaggttctcaaggttag

SEQ ID NO: 45863 - DNA, 228 bp, Glycine max
  Peptide Sequence Number=SeqID_162641
atggacagagatacgttggggtatagtggacatagaggtttaaggaacctaggggaattagcgagtggtgactactcgacatttggtgcactcatttggcgtaggagtggaggactcacccctacaacaaacaactttaaggtactgacgatgccgagtacacgaggcttctaccggctatggtcatgcaccgtaacatggactaaatgttacatttgccatacttga

SEQ ID NO: 45864 - DNA, 477 bp, Glycine max
  Peptide Sequence Number=SeqID_162642
atgggtgaattcctagataggttaagatctttacaagtcttatcgagtctccctgaatggtcaatgtatgattatgttaaaggacatacttgggttaatctctcaaaaagtgaaaatctccgtaaagtggagtctgtatttggtatcgatgatcaatggcctgatgatgatgatcttgactttcacttcagagcaatcctagaggcaactcatttaatgcatgaagaggggcagttaattgttttgctgcttgctaggttgtgttcacattcttgccacatcttagacaaaagcattgatgttgaaaaagcacaatgtcctgtggttgtggacaactcatgcgctgtactacccgagtggcaacaacaacggtcatgtactgttggtggtgacgatggtggtcatgacaatgatcacggtggtaatgatggcgacaataacggcaataacattcatgttgatagtggcagcgattga

SEQ ID NO: 45865 - DNA, 552 bp, Glycine max
  Peptide Sequence Number=SeqID_162643
atgatgaactaccggtcttaccaaaaaattttcaccaacctctcgcttggcggactgaagagttattataggtgcaccaatccaaggtgcagtgccaagaagcaagtagagagatccaatgaggacccagacactcttatcataacctatgaagggctccacttgcactttgcttacccgtattttctcatgggccaacttcagcaatctaattcccacccaccaatcaagaagtccaagcccatctctccacaggctcaggcccaagcccatagagaagactatgttcaggaagcccaatcaaatgctacttggggcatgatgtcatccacttcattggactctacactagacatggcccaagaaaatttgggctcacaagggttgcttgaagatatggtgccattcatggttcggaacccgtcaaacaatgtcaatagtgctcacacaaaattttcttgttcttcgtacagttctcctccaacatctcctctttggacttcaacttactccaccacttgctataccgttggcttaaattctagcacttaa

SEQ ID NO: 45866 - DNA, 141 bp, Glycine max
  Peptide Sequence Number=SeqID_162644
atgaagagcaacattgagggaggaagtgcaaaagaggaagatccgtattgtggtgacgaagttgtcgatgcaaaaagggttgaagacagagcaacatgtgcgatagtggagggtgcattgaggggaggtgctttatggtag

SEQ ID NO: 45867 - DNA, 240 bp, Glycine max
  Peptide Sequence Number=SeqID_162645
atgcaacgtttgttgaactgtaacattgaagagatctatggacgaattgaaggattggagaaccaactgaatcagaatgctggaagacattatggtgggaacagatggggcaatgacggatcctggcaaaacagaatggaggggcaaaacagaattgagggagtaaaactcaatgtaccccctttcaaaggcaagagtgacccagacacctaccttgatttggagatgaagattgagcat

SEQ ID NO: 45868 - DNA, 1420 bp, Glycine max
  Peptide Sequence Number=SeqID_162646
cgcatccaggctgttgcgcttgcccgggaacattttacgcgccatcgccaggctatcggtgatctgacagaaggtttctgtcttaccgatgtcgcgctgcagcatggaaaattcgtaatccataaagccgatgtcgaacgaagcgttatggatcaccagctccgcgccgcgaatataatcgaggaattcgtcggcgatttgcgcaaaggtcggtttatcggcgaggaattcatcggcaataccgtgtacgccgaacgcttccggatccaccagccgatcgggcttgagatacatatggaagttgttgccggtcaggcgacggttgatcacctcaaccgcaccgatttcaatgatgcgatgtccttcgtaatgcaccccgatcatgttcatgccggtggtttcggtatcgaggacgatctggcggtagaaatattcaccgatggatcctgcctgggcaatcccggtcccggcggctacggcgccattcttcgctaccgccagcacgagaaattattcagcgccggctaccgccttactaccaataatcgcatggagctgatggcggccattgtggcactggaagcgctgacccagccgtgtgacgtggtgctcagcaccgacagccagtacgtgcgccagggcatcaccagctggattcacaactggaaaaagcgcggctggaaaaccgcagaaaagaagccggtgaagaacgttgatctgtggcagcgactcgacgcggcgctcagcactcatcagattcagtgggagtgggtaaaaggccatgccggtcatccggagaacgaacgctgcgatgagctggcacgcagcgctgctggcaatccttccctcgacgatattggctatcagcgggaaggtgcgcttacgcgcaaccacgatattcagacagcccagcgccggcaggtgcgtgctgatcatcttgccgccctggcggtgccacggcaccacctgaaagcgcgtacgatacaccacttcatagcctttactgatgcccagcaggctaaacggattgaagccgctgataatcatccagccgtcatcaatcagtacacgatccacttcgcgcagtacgcggtgcggatcctggctccaggccagcgtgtgcgccagcagacaggcatctatcgatttggcttcaaacggcaactgcgttgcgctggcgatgacgtgcagcccatcgccctcatcgcccacattaacctgatgcgatatggcacactgtcgggtattgatttctgcgctgaggctgccaattttaagcatatgaaagccgtacagcttgccgagatacggttgcagttgctggaggtgtttatgaatcttaccagtattcccgcgttgcaggataactacatctggacactgagcgatgaacaggggcactgtctgatcgtcgatccgg

SEQ ID NO: 45869 - DNA, 483 bp, Glycine max
  Peptide Sequence Number=SeqID_162647
atggcttccgttgaagaaaagattaaaactggaggagttggaggaggaatggttgttgggggtcaaactcttgttgctgagatgaaactgttgaaagaaatgcaagaacattctggggtcagaaagactttgaattcagagttatggcatgcttgtgcaggccctcttgtgtcactaccccaggttggaagccttgtgttttacttccctcaggggcatagtgagcaggtggcagcttctactagaagaacaacaacatcacagattccaaactaccccaatcttccatatcagttgctgtgtcaagttcaaaatgtcacacttcatgcagacaaggagacaggaaggatgctgattgtaatcaagcatttaatttttcttgatgtcaagaatcacaaaccagaaggtcaggaagtgagtgcagcaggagtaaacattgataatcacatgaattcaggcaatggctggattaactcaacataa

SEQ ID NO: 45870 - DNA, 3198 bp, Glycine max
  Peptide Sequence Number=SeqID_162648
aatccgaggccagagaaaagcagaagccagaaattgaggaagatgatgatgggtaccgagacagggatagaagagataggcgcagagataggtatgaagatgatagaagggattatggcagaagaggcagagatagagatgatgaagatgatagaagggattatggcagaagaggaagagatagagatgatgaagatgatagaagggattacggcagaagaggaagagataaatatgacagggatagagatagatatgagaggcgcaggagagatgaacatgaagaagagcatgggcgtggaagggagaatggggatagagatggtaataggaagggtttacagcacggttctggggttggtccatgtctcacagatggccacccggaggattaccaatgccaaagatgttgtcaagcgtgatcaagaagtgtatgtaaaagtgatctcagtttcaggccagaagttgtctctttccatgagagacgttgatcaacataccggtaaagatctccttccactgaagaagagctctgaggatgatgcgttgaggatgaatccgcaggattcaaaagatgggcctgttgccaggacgggtctttcaggtatcaggatcgtggaagaaggtgatgttggttcttcgcggagacctctgaaaagaatgagctctcctgagagatgggaagcaaaacagttgattgcttcgggtgtcttgagtgtttcagagtatccaacttacgatgatgagggggatggattgctgtaccaagaggaaggcgcagaggaggagcttgagattgagttgaatgaagatgagcctgcattcttgcaagggcagagcagatactcgatggatatgtctcctgttaagatttttaagaatccagaaggttctctgggtcgagctgctgcactccagtctgcacttataaaggagcgtagggaagtgcgagaacaacaacaacgcacaatgcttgattcaattccaaaggatctcaatcgaccttgggaagaccctatgccagagtcaggtgaaaggcatcttgcccaggagcttaggggtgttggtttatcagcctatgatatgccggaatggaagaaggatgcctatgggaaaaccattacctttgggcaaaggtcaaagctttctattcaggagcagaggcagagtttgccaatttacaagttaaaaaaggaattgattcaggctgtgcatgataatcaggtcttggtggttattggagaaactggttcaggtaagactactcaagtcacacagtatcttgctgaagcgggctacaccacaagaggcaaaattggatgtactcaaccccgtagggtggctgcaatgtcagttgcaaagagagtcgcagaagagtttggttgtcgattgggagaggaagttggttatgccattcggtttgaggattgcactggaccagataccgttatcaagtacatgacggatggtatgcttcttagggaaatattggttgatgagaatctgtcacagtattctgttataatgcttgatgaagcccatgaaagaacaatacatactgatgttctttttggactgctgaagcagctagtgaagcgtagacctgaattaagattgattgtcacatctgctactctggatgccgagaaattttcaggatatttctttaactgcaacatctttactattcctggtagaacttttcctgtggaaatactatacactaaacagcctgaaagtgattatttagatgcagctttaatcactgtcctacagatccacttgacagagcctgagggagacattcttctctttttgactggtcaagaagagattgattttgcttgccaatctctctatgagagaatgaaaggattaggtaagaatgttccagagctaatcattttaccggtttatagtgcccttcctagtgaaatgcagtctaggatatttgatcctgctcctcctgggaaaaggaaagtggtagtggctactaacattgctgaggcttctttaactattgatgggatattttatgtgattgatcctggatttgctaagcaaaatgtttataacccgaagcaaggacttgattctttggtgataactccaatttcacaagcatcagccaaacaaagagctggacgtgcagggcgtactggacctgggaagtgttatcgcctctacactgagagtgcttataggaatgagatgtctcctactacaattcctgagattcaaaggataaatctggggatgactacgcttaatatgaaagctatggggataaatgatctgctgtcttttgattttatggatccaccatcaccccaagccttgatttctgccatggagcagctttacagtcttggagcattggatgaagagggccttttaactaaattagggaggaaaatggcagaatttcctttggatccaccgttgtctaagatgttgcttgccagcgtggaccttggatgcagtgatgagattttgaccataattgccatgatccagaccggaaatattttttacaggccaagggaaaagcaagcccaagccgatcagaagagggcaaagttttttcagccagagggtgaccatcttaccctacttgcagtttatgaggcctggaaagccaagaatttttctggaccctggtgttttgaaaacttcgttcaatcccgatcattgagaagagcacaggatgtcaggaaacaacttctcaccattatggataaatacccgaaatattttgactttgggcttcctgttcttgtgattgtaatcagcattttgctatggtacaaattggatgttgtaagtgcgggaaaaaacttcaccaaagtcaggaaggctatcactgcagggttctttttccatgcttctagaaaggacccccaggaaggttacagaacccttgttgagaaccagcctgtgtatatccatccaagttcagctctgttccagagacaaccagactgggtcatctaccatgagcttgtgatgacaactaaggaatatatgcgtgaggtcactgtcatagaccccaaatggcttgttgaattggctccaagatacttcaaagtggcagatcctacaaagatgagcaagcgaaagcgtcaagagcgaattgaaccactttatgacagataccatgagccaaattcatggcgtttgagtaaacgtcgtgcataa

SEQ ID NO: 45871 - DNA, 117 bp, Glycine max
  Peptide Sequence Number=SeqID_162649
atggttgagaaagggaagcccttgatcttggagttgatgtgggttcttggtatgatcaatttctctttggttgaaatcggaagtagcatcaaaagagtgaagaggtttaaagaataa

SEQ ID NO: 45872 - DNA, 729 bp, Glycine max
  Peptide Sequence Number=SeqID_162650
atgaatcctaaaggcaacacgttgaggccggcgtcgattatacagttggttctcgacgcagttttgctcggcacccagcaacgcgggaagtgctttttcttcctcttttctctggtgcttcttcttcctctgttctccggcgacggtgcttgttcatcctcttttgtccgacagtgcttcttcttcctgttttctccgtgggtggttggctggttcgtcgtggtccttggttgctgctgtggtgcttttgtcttcttcgtggctgttgttcctttggtcttcttgatcgcctttgagacagcatatttcaagtcagggatccaccctcttccaggtgctcagatgactcttcagaagttatcaagattttgtagcctatcagttgtaacatcacgacaaaatgcaattaaggaccacataattgagtggctagagaagaattacccaggactgtttcatgatattcactttggtaaccactttgctcttgatggtgtgtcaagaccaaagtcagaaatttgtaggtctttaaatgccaaggttcttattgatgataacccacggtatgccatagagtgtgctgatgttggaattagagtcttactttttgattatgaaaactcatatccttggtgcaagaacgagtctgttgatcagcatccactggtgaccagagttaagaactgggaagaagtggaacgacaattaatgtcactgatagcttcttag

SEQ ID NO: 45873 - DNA, 156 bp, Glycine max
  Peptide Sequence Number=SeqID_162651
atgacgcgatggcgactttggtgcgacggagtgactctcactgcgacacaggaaatgcgaaaaccaattagggctgtcgtctggcaacgaggaaagtgcaaatgggggagggggcgaagaagaataggaaaacaccacaatgactcaggcggctag

SEQ ID NO: 45874 - DNA, 249 bp, Glycine max
  Peptide Sequence Number=SeqID_162652
atggccactccacaaaagtctactatgaaatttgcaatcctgttgcttttcattatctttgcatctgatgtgtacatgaaattagaggcaaggagggacattgtgactcttcgctgccgtattgatgagaattgttataatctttgtccagattgtgactgcaaatgcatcaacacttggtgtaaatgtttcccaacacaaggagaccttctttctttcaccaacaataactacactcaagcaccttga

SEQ ID NO: 45875 - DNA, 225 bp, Glycine max
  Peptide Sequence Number=SeqID_162653
atggtctatgtgcggaatgataggctctctcgccagcatcacgaatcgtgtgacgttgctcggatcatcttggatttcgtccgccatcacgttcaggccatagagctccgccgcttgtgcgctcacaatggtggtgtaagggctgttggaggcactgatgtactgcctgacctcctgttgatggagttgatagcaccaagtagaaaacatgatgaaaaagaatga

SEQ ID NO: 45876 - DNA, 408 bp, Glycine max
  Peptide Sequence Number=SeqID_162654
atggcacatcagtacatccacttggttgttcaaagagaacaagggagggactccattgatgaagaagatccaaggcctacaagctccacatggagctacatcaaacagggagctaaaggaccgatgaaacttgcagataggccagatccggatgtcaatcccttatatctgatgacattgaccatcccacagcttttcctcaagcctttgcaagtgtcgtgggatgctattgtgtttggggtgtataatgataatttccccttgtacataaagcatgaatatttttctgaaatagcacacaatggtcaatgtcacaacatctctgttatacgattgtggattctgcatatgagtgagacaagtatgcgagtgggtaatgcctctgtgtatggatttctcgagccatag

SEQ ID NO: 45877 - DNA, 241 bp, Glycine max
  Peptide Sequence Number=SeqID_162655
accagttgcttacacagaagcgataattatatttgaggttactgttatagtggaagtggctgatgctcttgacatagctgtgaaatttgtgaggtacactcgtggaagcttcattttcaggtataatcataagcctctttttgcaggaggctttgatacggagagcatagaagctttggaagaactaaggagccgcatccatgctccaccaggtgaagataataaccagaaacatagttga

SEQ ID NO: 45878 - DNA, 465 bp, Glycine max
  Peptide Sequence Number=SeqID_162656
atgggaacaacgaagcacttcaagtacttgttctacgttgattttgaggcctccatgactgaggttagggcagtggagaagtgtgagatgaagagagtggggaagacacttggagggaagctcgagaggcttcaggggatagggtttcaaagaagaataaggtttagcccctgcatcaacaggcctcctccttcccttaagaataacaaattggttcatctgctgaaatggatccaaaaatggacgaaaggaagggagggcttggttagagtggcgatgaggctttcttgggcgaggaagaagatgatgattacgagagcatatacaacgacatcaacttttgtggagggttccttcaattgttgcacaagaatgatgatttggggttctgaaacggtgacgttgaagaaaagaagtctttgctactaccgtaagaggttccggatgccgttggggtttcactaa

SEQ ID NO: 45879 - DNA, 651 bp, Glycine max
  Peptide Sequence Number=SeqID_162657
atgccaaaaacaaataaacatgatcgcagggacatatctcacaacgttctcaggggaaacctccaatatctcgcgggcctgcaaaatctcgtggtgctgaacatctcgtacaacaaattcacaggacgcgttccagacatgctattctttgtgaagctgccgctgagcgtgctggcggggaacccagagttgtgcttctccggcaatgagtgcagcggcagagggaagtcggagcagcgggcgagggtggtgcgcgtggcgatggtggttctgctttgcacaatgtttgtgctgctaatggcgatgttgtacatggtggtggcagcgaaacgacgaggggaccgccaaaacgacgtggagttggatggcaaggacaacaatgcggacatggctccaccttgggaaaaaatcctcccgaagctagggttacatatagaggggaatgcagttcagagagaaaacggaagacgaagaattagaaaaagcattcttggcctagggggtgatggagcaagtgcaaccactgtccttggagcaaatttttctactggttttgttgcaggaactttagcatcagctgtccctgccaagaaaaggcagaaatttggacctaacatcatcaggaaaagtaataatcctgtcttcttgtaa

SEQ ID NO: 45880 - DNA, 477 bp, Glycine max
  Peptide Sequence Number=SeqID_162658
atggaggcattgaaagatacaggaatgccaatacaggatcaagtcattggtacaaaagtgttggggactttcatcactaaatgggatgaaggaaaggttgtctgtgatacactgttttcaacaaaggaaactgcacatatgtatgcagaatgtctggtcgagcttgctgttgatctaggctttgatgggtggctagtgaactgttggcctgcactaccagagcataagatgcttctaatgtatgacagtgttacacttgatggtaaattgaattggcaagatcaagtaaatgaacataataagccgttctttgatatatgtgatggaatatttgtgaactatacatggaaggaagactatccaaggctctctactgctgttgccggtaattggaagtttgatgtgtacatgggcattgataagtttgttcatgggatgatagaaggtattcaaaaaattacaactcttaatgggtaa

SEQ ID NO: 45881 - DNA, 1179 bp, Glycine max
  Peptide Sequence Number=SeqID_162659
atggtgccggtcacgctggcggcggtgctggcgacattgctgatgctgcacctgtttttccgcaaagagctaccgctcagctacgatcgcgcccggctgacgtcgcctgcggcggcaattcgggatcgagctactttccgcgcggggtggctggtgctgctcttattgctggctggcttttttgcccttgagccgctgggcgtaccggtgagtgccgtggccgccgcaggcgcactgatgctgtggctggtggcgcgacggggtcaggtgattgatacgcgtaaagtgctgcgcagcgctccgtggcagattgtggtgttttcgctcggcatgtacctggtggtgtatggtttgcgcaacgccgggctgaccgtctggctcaccggcttgctcaacgatttttcttccactggcctgtggggcgcaacgtttgccaccggcttcttcagcgccctgctctcctccatcatgaataatatgccgacggtgctggtgggcgccctggcgattgatgccagcacggcgcagggctctggcaacgctgctatggctgcacgtactggcgcaaaaagagattcgcatcagctggggctactattttcgcgtcggcatcaccctgacgttaccggtgctggccgtgacgctggcagctctggcgctgcgcctttccctttgaccgttaagagactgacaatgactaacattaccatctatcacaacccggactgcggcacctcgcgcaatacgctggcactgattcgcaacagcggcgtcgagcccaccattgtgctttatctggttacgccacccacgcgtgaaacgctgcagcaattgatcgacgccatggggattggtctgcgcgcgctggtgcgtcaaaacaccgacgcctggcaggcgctggggcccgtacgtgaaacgctgagcgatgagcaactgctggatgccatgctggcgcagccgattctcatcaaccgcccgattgtggtgacgccactgggaacgcgtctgtgccgtccttctgagcaggtgctggatatcctgcccgatgcgcagcgcgggccggcgcgtcagtctttagtcggtcagaaatcgtccgggataatctgcttcaatcgcgtgtacctggtcataacggccaaacaggcgatagcgattgcgggcaatcaggttgtagatcag

SEQ ID NO: 45882 - DNA, 300 bp, Glycine max
  Peptide Sequence Number=SeqID_162660
atgagcatagcaaataacattaagtctgctcttcccaaaactgaaagtgcaaaagaatttatgaaatctgtggaagagcactctcaaactgcagataagtctcttgctgggacattaatgagtactttaaccaccatgaagtttgatggttctcatactatgcatgaacatggagttagaaagaaagtcaataagaaacatggaaaggagaaaggaccattaaagattgtcgagtcctctactaagatccagaagaaaaatgacaaatgtcatttctgtgggaaatctggacatttctag

SEQ ID NO: 45883 - DNA, 653 bp, Glycine max
  Peptide Sequence Number=SeqID_162661
ccgccccagcagagcctcaagcccctgaccctgacctttcccttcctttactggatgacaacgctcgtcgcgccgaactaaatgagcgcggggggtttcttcattttggggacttgtcggatcagcagaaagacaaagtgctaaacgcacaagtcaaaatcgaaagggccattgagaaagctctgctctccgacgggtattcccgggatgagctttctcaaaggaacaaaagggatgagattaggggctttttgttctacccgggggtatcctcaaataataacgaggcccgtcccagaaatggggcggggaaggagaagtgggcatgtgggtctccttcacttgactatttagggagtccgtttttcgggataggcaggatatcttggttttggaaaactgacccctgtcaagcctttgattcgactttgggcaatgccacttcgaaagaaaaggaatcggagagatctttgaacagcagaaaagacggatctcagaacatagccatagttacggtttcagggcttagagagactggactggacgcagcactttacgtccccccgctcgccttcagctcacctggtcctttacttgaccaagggaaaatcccgaagaaatgtgccgagcagaatagcagcatcatgctttaa

SEQ ID NO: 45884 - DNA, 377 bp, Glycine max
  Peptide Sequence Number=SeqID_162662
atggagtttctagttgttaagaagagtatcattgaaaacactattgaaatctttatggatgactgttctatttttagtcaatcttttgacgtgtcctttactagcattgaggtagatcccgccaaggagaagttgttgaaagaactattggttaatgctcctgtcattgtttcccccgattggtcattggcgtttgaattaaagtgtgataagtttgacttggagataaaggacaagaaggggtcaaataacttggtagctaaccatttgtctcaccttgacccctttatgagactgactgttgatgacgaagcaatacatgagacattccctgatgaacacttgcttgttgtagctgctctactaagagcacattg

SEQ ID NO: 45885 - DNA, 241 bp, Glycine max
  Peptide Sequence Number=SeqID_162663
atgaatattagaacctaccaacgagagaaagagaaatggagtaggggatgtgagagaggcaatgcagtggtggcacggtgggcacacaacgacacagtgggaaacacagtggtggcaatgtgggcacacaatgacgtggtgggcaatagagtaaggaacagtgttgacgaaattgtaagatcaagagggagagtgacagagggagaacgagagttgcagcaccgggaggaggagagtgaga

SEQ ID NO: 45886 - DNA, 183 bp, Glycine max
  Peptide Sequence Number=SeqID_162664
atggctcccaagcccgtcgccaacaccattgttgacgacattccctctgtgcttggccaattcaccacctccctctctgattctgacctcacactaactacctacgcgatcttcgtcaccccttctctagatccgcagttagcagcgctagatccgatggagggagcgctcaagctcgtgtga

SEQ ID NO: 45887 - DNA, 237 bp, Glycine max
  Peptide Sequence Number=SeqID_162665
atgacggaagtgttggattcgggtcaaggtgacctgacccaacccgccattagccaacaaggatggaaaaccctagagtgtcgtgccccaaaatggcgtggaaggatgcgaaagtcaccacaaagggtgataagcctccctggtgccaccggtgcaaggcctggtagcgcaaggccaccatggggatggcggtggcacgacggtggcagcgcgatagaggtatgggaatgcgaatga

SEQ ID NO: 45888 - DNA, 516 bp, Glycine max
  Peptide Sequence Number=SeqID_162666
atggcccccgaagacctggatatgcaatcacagtttcaaatgcatatgcaatcacagggactcacactgtctcttgagcttaaggttggtccttctactactcatgtcatcacaaaagagagttggtttgatccctcaagacataacccgaacacgggtgagtcaaagaaatatggattgtatgtcgatgaaaatcctccctgtctgggagctgagggatcaacaaaacctacagataggctgaatcctgatgtcgatcccctatatctgatgacattcactatcccacagctttttctgaagtcgttgcaagttatgtgggatgctattgtgtttggggtgtataatgacaacttccccatgtacataaagcatgaagatctatttgaaataacatacagtggtcaatgtctcaacatctttgctatacaattatggattttgcatatgactgagacaagtatgcgagcggggaatgccgatgtgtatggattcctcgagtcacagtccatatag

SEQ ID NO: 45889 - DNA, 429 bp, Glycine max
  Peptide Sequence Number=SeqID_162667
atgttgcaacacacacaaaggctagccaaatcaaggaccctatcttgtgagcctttcacaggtggttatcagggaagtgggcttcaagagaacacactagccacatcatcgtgggttctctcattatcgtgcttgtcattgatcgacccagtcttgtggccatcggctacatctgccaagaggacaatgcatatgtcctcaggcctttatggctacttagatgagatgagggcagggatctatacccattttgatcaaatggagaactacatccaatctcaccatgccactaaggagactcatcttgacaacatgcaagagcgtatagacacttaccaggcgatcgttcagactcgcctggatgcctatgatgccaaattggatggatactttcagcaccaatttcatggaggtgcaccttcctcttga

SEQ ID NO: 45890 - DNA, 474 bp, Glycine max
  Peptide Sequence Number=SeqID_162668
atgtcgtctaacgtcatcagagaagaagaagttgacaacgtgcatgcaaatcgtaatgatcacgatgaaggagaattaattaacattacaagaaaagtgacacgactgagatcattggcgactagaccaattggggcggagagaccactggtccatgtggatcctgcgactgggaaagccgacaatccccacaaaaagaagttaaggacatatttggggattgtcactcatgataaggtggatgtcacatatgagaattggaaacaagtccctgcaactcataaggatttgatatgggaggatattcaggctgaatttgacatccctgaagcatccaatttgaggacgaagaagaaaatacttcagaatatggcaaggagggcgttgatgatattgtatgtgaaaagtatgacactagcaaggagaaggggaactggttttgtcagagctgtagagacccttcgtgagaggtaa

SEQ ID NO: 45891 - DNA, 315 bp, Glycine max
  Peptide Sequence Number=SeqID_162669
atggaacgaaaacaagacaaagagaaggcggacgcggcggcgacggccatgagaacaacaaccaaatacaaaaataagcacaagtacctgacggagacgtcacaggtcacggtggaggaagacagagacacgcagagtggagtcgcagagggagctgagacagagaagaagataacgcgagaagatagggctcgtgttcatacatttttaaatttaagttcaacatcggttttcactaaaaaaactgatgttaatcaattgatgttaacttatcattacttaacatcgatttttgaaagatcaatgttaacataa

SEQ ID NO: 45892 - DNA, 180 bp, Glycine max
  Peptide Sequence Number=SeqID_162670
atgaaggatttcttgaagaaaagttggtacattgatagcagatgctctaaactcatgacgggagatgcatcaaaatttactctaatatctcccaagaaaagtggacacgtgacttatggagacaactacaaagtaaatatgatgattcttggttatggcttagaagaattgttcatataa

SEQ ID NO: 45893 - DNA, 339 bp, Glycine max
  Peptide Sequence Number=SeqID_162671
atgaggcgccattttccggtggatggcggcaaaatgcaacgcacaaagggggagatcgccatggcgacgacaggttataaaatctgggttcacggcagggtgcagggcgtgggcttccgttattacacccaggcgcaggcgaacgcgctgggcgtcaccggctatgcgcataatctggccgatggcagcgtggaggtgctggcggcgggagaaccgcagcaggtggagtcactgattgcgtggctgaaggcgggcggaccgcccagtgcccgggtcgataaggtgctggtggagccgcatcagctggcggagcggccgacgcggtttactaccgggtga

SEQ ID NO: 45894 - DNA, 1515 bp, Glycine max
  Peptide Sequence Number=SeqID_162672
atgcagccaggccatcttctgcaggatcagatgcagccccatcaacgccacgccggcccataccacgatgccgagagaaatgccgaccacgcccatcatcgcctcgcggcgcgagcggctggcagcggtttgcgacacgaaaaagaagtccggccccgggctcatcagcgcaatcagatgcaccagcgccacggtgagaaacagcatcagcatgatttatcgccctcagtcttcgtcattgtcgagatggtcgcggatcatcgccataaagggcgcgccgaaacgctccagtttgcgctggccgacgccgttgacgctcagcagatcgccggccttgatcggcatctgttcggccatttccagcagcgtggcgtcgttgaacaccacatacggcggaatgttctcttcatcggcgatcgatttgcgcagttttcgcagcttggcgaacagcttgcgatcgtaattgccgccgtaggatttttggttggcgctaccgcgcgacttcaggctcgggatacgcggcaccgccagctgcagcgccacttcgccgcgcaacaccggacgcgccgcctcggtcaattgcagcgccgagtgcatggcgatgttctgggtgataaagcccaggtggatcagctggcgcagcacgctggtccagtgttcggtggtctgatcgcggccgatgccgtacaccggcagtttatcgtggccgtattcgcgaatgcgctggttgttggagccgcgcagcacttccacgatgtaccccaggccgaagcgctggccgacgcggtacacgcaggacagcgccttgcgcgcatcctccagcccgtcatagcgcttcggcggatcgaggcagatgtcgcagttgccgcagttctcgtgcttgccttcgccaaagtagttgagcagcaccagacggcggcaggtttgcgcctcggcgaacgcgcccatggcgttcagcttgtggcgttcgatattcagctgctgtccggcgggtttttcctccagacagcggcgcagccaggccatgtcggccggatcgtacagcaggatggcttcggccggcaggccgtcgcgcccggcgcggccggtctcctgataataggattcgatattgcgcggaatgtcgaaatgcaccacgaagcgcacgttgggtttgttgatgcccatgccgaaggcgacggtggccaccaccacctgcagatcgtcgcgctggaacgcttcctgcacctgcgcacggcgatcgttgtccagcccggcgtggtaggcgccgacgctcagcccgcgactctgcagacgcgcggcggtgtcttccaccttggcgcggctgttgcaatagataatgccgctcttgccgcgctgatcctgcacgaagcgccacagctgatcgagcggcttgaatttttccaccagcgtgtagcggatgttcggccggtcaaagctgctaacctgtaccagcggatcctgcaacgacagcaggcgcacgaatcgccgcgggtggactcgtcggcggtggcg

SEQ ID NO: 45895 - DNA, 294 bp, Glycine max
  Peptide Sequence Number=SeqID_162673
atgcactctatcagcttcttgctctgccagtatctcctggctaaggtgtgcgatatacatccacgcattgaattggctaacggccaaaacaaatacgccaaatatagtcattcaaaaagcattcaaatgcctaagctgtgccgtattacactgtggaaagcacctgtagcagatgacaagagtgatgagcaaaatgacggcgacaacgacaaagtatatttcgttgaagcctttgggaagagacggcaccgtcaggcgccatttggtggaggagattctaattgtggtgcctag

SEQ ID NO: 45896 - DNA, 270 bp, Glycine max
  Peptide Sequence Number=SeqID_162674
atgaccagcgcagcctccggtgaagttcaacaatatggtggttatatcactgtcaatgaaactccaggaagagcactgttctattggtttttcgaggccactcacaaaccaaaacaaaaacccgttctcttatggctcaatggatgtactttcttttttactaacccagctcttcataatcacgaaccagaaagtcaagaagtgagtgcagcaggagtaaacattgataatcacatgaatgaaggcagtggctatattaactcagcctaa

SEQ ID NO: 45897 - DNA, 505 bp, Glycine max
  Peptide Sequence Number=SeqID_162675
gtttgaagaattggctaatttggtttcttttgcacttttcactagtgctagagatccttctacttttcaagaggttatgaacaaccatgagaaagacaatatggggattgattatgatgagatttcctcctcaatcgtaagacacacttctattaaggcagtgctagcctcggtagccaatcgtgacatgcacttggagcaaatggatgtgaagataacctttcttgacaatgatgtagagcagcaaatttacatgaagcaacccgagaggtttagtaaaggtggattggatcggctgatttgtaagttgaagaggtgtggtgtcaaagacacttatgtggttgctcaaggctcactagtgcaaatctccttgatgttaaccgcctcggttttcacaaaaattggtatcagagtcaatgtgggtccatgcatggaggctaggaagcaggtcttgcatgtgttgtggcagcacaaggtactagagcatgttggtggaaatggttag

SEQ ID NO: 45898 - DNA, 1452 bp, Glycine max
  Peptide Sequence Number=SeqID_162676
tctcgttcggaagtcaaagagctgcgccgctatgttgaaaacggtgagttcttactggaagccaacgatatcggcaccgtgaacatggcggcagagcgcaaactgccgtttgtcgccggtcccaccctgaatgtgtataacgcgcagacgctccagatgttgttgcaggagggcatgacgcgatggtgcatgccggtggagatgtcacgtgattggatgattcagctgttgcagcagtgccatgacgctggcctgcgcgaccggtttgaggttgaagtgctcggctacggccatctgccgctggcgctgtcggcgcgctgctttaccgcgcgttctgaaaaccgtgccaaagatgattgccagatctgctgtattgattatcccaccgggcgccgcgtgctgtcgcaggagggccagcaggtatttgtcctcaacggcattcagaccatgagcggctactgttacaaccttggcaacgatctcgccggtatgcatggctggatcgatattgtgcgcctgtcgccgcaggatgagagcacgctggcacaggttgatcgcttccgcgctaacgaagcggcaacggttactggcgccgcctggccggaatggcgctggatagcggcggtttacttatcacctgcgccatcctttgctggagtacccatgtctgagaagaaaactgttcgcctgtccgtgctggatctggcccccattccgcaaggctcgtctgcgcgcgatgccttccataattcgctggcgctggcgcgtcaggctgaagcccttggctttcatcgctactggctggccgaacaccacaacatgaccggcatcgccagcgccgcaacgtcggtgctgattggctatctcgccgctaacaccgaaacgctgcgcctcggctccggcgggatcatgctgcccaaccacgcaccgctggtgattgccgaacagtttggcaccctggaatccctctaccctggccgtatcgatctcggactgggccgcgcgcccggctccgatcagcgcaccatgctggcgctgcgccgtcatctttcgagcgcccaggccgacagcttcccggaagatgtggccgatctgatccgctggttcgatgccgaaaagggcgaacatccgccggtgcagccggtgcccggcctcggtctgaaaattccggtgtggctgctgggttccagcctgtatagcgcgcagctggcggcgcagcttggtctgccgtttgcctttgcttcacacttcgcgccagacctgctgttgcaggcgctgcacctcgatcgtgatgcgcgcttcctgttcacctcgatgcaacagcatttcattaatctgcgccgcgtcaagcccggcccgctgccggcaccggtggaaacatgtataacctgtggtctccgtccgaacaatatggggtgcacaggcgctgatcatgtcggtggtgggcgataa

SEQ ID NO: 45899 - DNA, 399 bp, Glycine max
  Peptide Sequence Number=SeqID_162677
atgacacttcttgaagttgttgaggttgctctaaaggaaatcgtagaaattgttcttggctgtatggatttggacttggcattgaggacagaacgaccgatttccactccggaaacctctaatgagatgtcgtctcaagtttcgaagcatgttacagagcaagagtctggtcaggacctgttcgaatcgaaaagagagaagagtcttttgaaagggattcccaggttcaaggaagtatttgcgaagtacaaggctaggacaggaaagagggcttcgaatcattgggcgattcgagttggtgtatggtcgagtcgaagtcaaggcagcaagatttttggacttagcacaatttctgacaaagcttcacaaagccagttcgacttcgagcaatgtggataa

SEQ ID NO: 45900 - DNA, 2354 bp, Glycine max
  Peptide Sequence Number=SeqID_162678
cttctccttcaagtgcgtataagattcaggatgttaaatcccttattcgtgctgaaagagatggtttccaaagccattttcctttagagcaaagacaaaccagttctagaggaaatcaagatatcacatcgcagaaacttagaagggatcctctctttattgaggaagatgaggttgtggggcttgatggccctagaggggtgggaaaaacaactcttgccaagcaagtttatgaccaggtgcgtaacaatttcgagtgccatgcgttgatcacagtttctcaatccttctctgctgaaggattgctgaggcatatgttgaatgagctttgcaaagaaaaaaaggaggaccctcccaaggatgtttctaccatcgaatcgttgacagaagaagtcagaaaccgcttgcgcaacaagaggtatgttgtcttgtttgatgacatatggaatgaaaaattttgggatcacattgaatctgctgtaattgataataaaaatggaagtaggatattaatcacaaccagggatgagaaggttgcagaatattgtaggaaatcatcatttgttgaggtgcataagctagaaaaacctttaactgaagaagaatctttgaaattgttctgtatgaaggcatttcagtatagttccgatggagattgtccagaagaacttaaagatgtatctcttgaaattgttagaaagtgtaaaggtttacctctagcaatagtggccattggttgtcttttgtctcaaaaagatgaaagtgcacccgaatggaaacagtttagtgaaaatctttgtttagaccagttggagaggaattctgagttaaatagtataacaaaaattttaggtctaagttatgatgatttgccgatcaatctcagatcatgtttgttgtatttcggaatgtatccggaggactatgaaattaaatctgatagattgattagacagtggatagctgaagggtttgtcaaacatgaaaccggaaaaacattagaagaagttgggcaacaatatttatcagggttggtccgtagaagcttggtgcaagtatcctcatttaaaattcatggcaaagttaaaaggtgtcatgttcatgacttaatacacgacatgatccttagaaaagtcaaggatacaggattttgtcagtatattgacgggcctgatcaatctgtatcaagtaagattgttcgacgcctgacaattgcaaccgatgattttagtggaagtataggaagctcacccattcggtcaattcttatcatgacaggaaagtatgaaaaattatctcaagacttggtaaacaaattccctacaaattacatggtactgaaggtacttgattttgaaggttctggtttacgttatgttcctgaaaatttggggaatttatgctacttgaagtatttaagcttccggtatacatggataacaagtctaccaaaatccattggcaagctccagaatttggagaccttggatataagagacacaagtgtgtctgagatgccagaggagattagtaagcttaaaaagctacgtcatcttctggctgattataggtgttcaattcaatggaaggatattggaggcatgacatccctagaagagatacctccagtgtttatagatgatgatggagtggtcattagagaggtaggaaagctaaagcagttaagggaactgtgggtggtaaaatttaggggaaaacccgaaaagactttgtgttccgtaataaatgagatgccactcttggagaaactacatatttatacagctgattggagggaagtaattgacttgtacattacgtcacctatgtctacactttggcagcttgtcctatgggggacgttaacaaggttgccaaattggattttacagttcccaaatcttgtgcaactgtctttggtgagctccaggttgactaatgatccattgaattcactaaaaaatatgccaaggttgttgttcctcgatttaagtaacaatgcttatgaaggtgaaactttgaattttcaaagtggagggtttcagaaactaaagcgactggaactcagatatttggatcaattgaagtgcatccttatcgacagaggagcactgtgttctgtggaagaaattgttttacaagacctctcccaactcaaaacagttccctcgggaattcaacacttggagaagcttaaagatctctatatcaactacatgccaactgaattggtgcagcgcattgctcctgatggaggagaagaccactggatcatccaagatgtgccccatgtacgtatttggagcaggggtgctgaagaaccttcgcatatattcggcagaagtcatcattaa

SEQ ID NO: 45901 - DNA, 264 bp, Glycine max
  Peptide Sequence Number=SeqID_162679
atgcgtagtgggggatgcaacatttgtgggggtgcttatgagttaggctcatgcatggttcaagacaacacaaccaacaaggttggaaatcccattaaggaaataacttcaaccaaggagagtaccatgtcacactatatgagtactgatgtagcaatcaggaatctggaggtacatataagccaactagctaagcaaatagatgaatggcccactgggacctttggggtcaatattgagatgaatcttaaagaggagtgcaag

SEQ ID NO: 45902 - DNA, 213 bp, Glycine max
  Peptide Sequence Number=SeqID_162680
atgactgcctataaatttgtcaatcttgatcccatgaactacgcaccgatgctattcactttacaacacattttgctcgtctacgagaactcctttggtttactgccacacgaatcaatgtggcaagaatatgaacgagatcagtggggtccttatccaaggagaaagaggactacaaagagtcttcctgtttcaactcgcattcctacttag

SEQ ID NO: 45903 - DNA, 264 bp, Glycine max
  Peptide Sequence Number=SeqID_162681
gatcgtacttttactgagaccattttgggtttctgcgggaaaggaaaaggctacaatgcgaaagatatttctctcagtttaaataggatatcaaaattccaaacggtgagaatgcttcgaatttgggctgcgaaggtggtgctcaaatttcaccacgatccaacggtgaacgattctgagatcgttgtttttctgagacagattaggtggcctgcgggaaaaaaaagagggttttgggagaagagagaagaaacgaaattgtga

SEQ ID NO: 45904 - DNA, 248 bp, Glycine max
  Peptide Sequence Number=SeqID_162682
gattggctgtgagggttgtgcacgggggtcacagtctcgaacccgtcggctgtcggtggactgctcgagctgcttccgcggcgagatcgggtcgtcgcgtgccggtcgggggacggattgggaacggacccttcggggcctcttccccgggtgtcgaacagtcaactcagaactgtgctctgaatgtcaaagtgaagaaattcaaccaagcgcgggtaaacgtcgggagtaactatgactttcttaag

SEQ ID NO: 45905 - DNA, 375 bp, Glycine max
  Peptide Sequence Number=SeqID_162683
atgctgccacccaaaagccctagggcttccagcctacctcggagtgacaaggaagtcccatggaagtacgcccctcaaaaacccgacggaaggaaggatgaattcgctgaagatgacctatcctctgccaaagttactaacatctctggcataagccatgtgacctgtagcgggcgaatcttcgtagcaccagactcgttggtatggctcaaggacacgaagggaaaggcgaaggtgggcacgaaagaaaacgataaagcaagcctgattctcgatgaggagatcccggctaggagatttgctaaaggagaggaagacttcggcagaaagaagatatccaacaaaaaggaaaatgagttccttcggatcatctag

SEQ ID NO: 45906 - DNA, 1128 bp, Glycine max
  Peptide Sequence Number=SeqID_162684
atgacgatgagtgttgcaaggctgaagaaggacgagatccagaggctaaagaaggagatcgattcgctccggtgtccgacggtggagctgcatgagtcagagacgagtgcggcggctgaagaacctcctcaaagagagagaaagaatggtgacattcctagagacgagcgcaacagcaccaccatcaccatcgccgctgttattcaaaccctaaccctcctcaccctcaccctcaacttgctttgctcgtcttttctggtgggatcgccttcaacggcgtcgtcgaggagctcaagaattttaccacccgcgtcgctcacgttctcctcgtttccgaagatggaggaagcactactaagattgttagtgttctcggtactgcgttatgttaaattaataattatgattactagtggtcctgctgttggagacatacgttctaggtgcctgaggttgtctgatcagagtaccattgaggctctcgcagttcgaaatttgcttggacatcgtctaccacttgatccactgcaagctaaatcagaatggttggaagacttcggaggaggacacccagaccccaatttgacatatgcaaaagagttggttgctcgtatgggattgggcaaatctgaaccccaagatgagcccccagagtttggtgctgcttctgatggtgatgcagatcgcaatatggttcttggtaaaaggttttttgtcactcctttagattccgtggccattatcgctgcaaatcctgttgaagctataccatacttttctgctggtttaaagggtgttgctaggagcatgccaacctctgctgccctggatgttgttgccaaacatctgaatttgaaattttttgaggtccccacgggttggaagttctttggtaatttaatggatgctagattatgttcagtctgtggtgaagaaagttttgggactggttctggccgtattcgtgagaaagatggaatctgggaagttttggcctggctatctatacttgcatataaaaataaagataaacttgaagacaagcttgtcactgttgaagacatagttcgtcagcattgggctacttatgggcgccattattataatcaatatgactatgaagtatga

SEQ ID NO: 45907 - DNA, 165 bp, Glycine max
  Peptide Sequence Number=SeqID_162685
atggcgtgggttacaaaagaagtctcgggagatcctctagggccccctttccttaaaaatcaaaatctgaacatgtacaaagaccctcaataccatgatcagaggtctaagcaggaggagaggagaccaaccttgaaagacatagtgatggatgataactgctaa

SEQ ID NO: 45908 - DNA, 564 bp, Glycine max
  Peptide Sequence Number=SeqID_162686
atggagggcgggctgttggcggtggaaatgttgagccgattcaacagtctcgacggtgatttagccatgccggccgaaattgggattaatttattggcgcctgaacaaaggattgagttatttaatgagcaactgaaacttgcggtgcagcatgcggcttggtttaccggtaacaacgtgcagttgaccatcaatatcgaagaaaccatcgttgagcttattctttccgattcggcgttatgccaacggatcgggcaatatccttttattgcatttgaagtgagtgagagttttccgaatctttcggccgggaagaacaacccgagcgtgcggcgattaagcgaaatgtttacgctgtggctcgatgatttcggttccggtaaagccacgctgaccgcgttgtacgatggtttgtttgactacgtaaagatagacaagcgtttttactggcagctgtttacccatcagggatatgacgtggtcatcgactcgttgttaaagaatatcaacctgttatgtaaaggcgtgatcgtcggaggaatagagaaaaagagtattttataa

SEQ ID NO: 45909 - DNA, 288 bp, Glycine max
  Peptide Sequence Number=SeqID_162687
atgaagtacaaaactcttgagtttatttacaggttgttaaaattgcaaacacttgaccagacacttgtgagaagagagaaacaccaactttgtaaggaaatgcaaagagaccagtcaaaggatcaaggaattgaagtcatggagagtgttggaatgcttggaacttacttgagaaaatttttgcttaagaatggaataattttatttgcttggggacaagcaaaatataaaaattggaggtgtaacaagcaaaaaaggcagaaaattgaagaaaagaagaaaatttga

SEQ ID NO: 45910 - DNA, 483 bp, Glycine max
  Peptide Sequence Number=SeqID_162688
atgggtgaagtagaggagatacaagagaagatgaaggccgacatggaggccattaaagagaaaatggccacaatgatggaggccatgatgagcgtgaagaagataatggaagccaatgcggttgcaattgccgctaccagcgttgttgctaaggtgaacctgatgtccccatccggcatcaaccaaatgaatcatccaacctcagatatgccttggctcggatatgccactgaagggcaagcagttggtggtataccctttgaaaacactttggagggccctcagtttcgcccacaaccacaaccattgcattttgcggtgggaagagcccctcctgctatggccgaaaagggagaggtggatcatctaaaggaaaggctcagggccattgaaggaggtgaagattatgcctttgctaacctagaaaagttgttcccaatacccaaacatggtcattcccaagttcaaggtgctggactttga

SEQ ID NO: 45911 - DNA, 465 bp, Glycine max
  Peptide Sequence Number=SeqID_162689
atggatttgactaagatggccaaagatgaggttaagaagaagaagagtaaaggcttagcactaaaatcctctataccatttagtgatgagagtgatcaagaaaatacagaaggttctgagagtgagaatctaacattacttgttataaactttaagaagtttttgaacaagaagaactccaagggaagatcctttcaacacaagaaaaacattaagaagaatgactcatcctcccctaaagttacttgtttcgagtgtggaaagtcaggccacataaaatctgaatgctccatgtttttaatgaaacaacaaggaggagaaaagaaggcaaagggtcataaaaagaagaaaaaggcttaccttgcatgggaaaagaatgcttctagcacttcaagtaatgaagaagaagccaatctttgtctcatggtagatggcgaagtcaaaagtgatgtatgctctcaatag

SEQ ID NO: 45912 - DNA, 201 bp, Glycine max
  Peptide Sequence Number=SeqID_162690
atggcaaaggaaacatgggatcttatccaagtgactagtgaaggtactctaaaagttagaagagcaaggaagaattatcttatccaagagtatgaaaatttttggatgcaacaaggagaaaccattggagatgttcaaaaaaggttcactcatatagtgaatcatctcaagggctcagggaatgagtttgaggaagaatag

SEQ ID NO: 45913 - DNA, 546 bp, Glycine max
  Peptide Sequence Number=SeqID_162691
atgtataatactacaataaccaatattggtctccactgcagtgtacactggcaaatgttcgccattttgcttaaggaaaatcttgttgtctggttttgttccttgcataacaggccaaataactaccttaaaggaataattaatagtgctttgaaaggacttgatgatactccacaacctaaatccaaggctggtgctaggtggattgttgtcatatgtaatagacaaaaaggaaacactgagtgtggctattacgtgatgcattggatgtccactatgatcttaggaagtttcaggaataattgggaaacgaccattggaagcagagagattgaaggcgcttcgcatccagtgggcacagtattatctcaaactccaagtggagcttgtaggccttggatcttcttcatcaatggagtcttttgcttcttgaagattaatggtagcagaacagagaaggagaaagatgattcgagatgcaacttcaatgagaagatgagtcaagaagaagctcaccaccataggaagccatggataagagcttga

SEQ ID NO: 45914 - DNA, 543 bp, Glycine max
  Peptide Sequence Number=SeqID_162692
tctgatttgacgttaaaatgggtacttgtagccgataaggacaatctggatgacactgtttgtgaaaaatacggcattagcaaagagaaatgggcccagttttgtcaatgtcgcagagacccctcgtgggaggatgtgcggaaaaagtcacaggccatccagaagcaaaacactgccccccacgtgttggctcgtgggggttatgaatatttagaacggaagctgatggctgagaagatagagaaaaaactagaggaagttgctgaatctgaaagcactaaggctgtgattgaccctccatctcccatcagatggcacgtaaagtggaagatggcccgcacgaagaaaactggccacatgacgtctgaggcagcaaaggaaattgctaagaagattgatgtcctgactactgccattgggcgaccagaacaccctggtcgtgtgtgtgctgctggagccaatgtgaccatcaagcaatactttggatcggctccacggatctctcacacttcttcctccatggctcctgaagaactagagtag

SEQ ID NO: 45915 - DNA, 345 bp, Glycine max
  Peptide Sequence Number=SeqID_162693
atgggatcaagtcaaaagccttcgcttaaaaagaggttttatcaagtcaaaatcaagagcttagaggtcaccagtttacgaaagttggggcaattaatgggtcaacttcaacggcaagccttccgcaaagcctatggaattagaccgccaaaggcaagtcgaaaatggggtggtcgaaataccgagaaaatatttggaggtaaaagcaagaatcttggcagaaaaaggcgagtggaccccattcatagatattctcacactgttgattttcgagggagacctctttccaaatgtggatgggttggtggacctggcagcgatcgacgtttttctcgcctatcataa

SEQ ID NO: 45916 - DNA, 198 bp, Glycine max
  Peptide Sequence Number=SeqID_162694
atgtctgcttacagtcctttcgctaagcgcaagcctcgcgctaagcgcatctctgttcatgcgttaagccacgagtctcgagcgcttagtgcccaacccttgcatctaaggctgattcattccgctaagctagccaaggccaagttgagcctaatcgaatttgatctgagttcggctaagcgacagccaaaccgctaa

SEQ ID NO: 45917 - DNA, 246 bp, Glycine max
  Peptide Sequence Number=SeqID_162695
atgtggattgtggcctctggtaatcgattaccaaagatcgtgatggcggcgcagctaatccgtgatcgagtagagatggagtgcctagagggagtttgggagaccctcgaaggcaacacgaggtgccgatttcggggcaccattcgattcacggccacttctttggtgcatccagatgaacccgcacggacgcttcagcgcacggtggagtggacagctccttggattagttttgtatacttttga

SEQ ID NO: 45918 - DNA, 255 bp, Glycine max
  Peptide Sequence Number=SeqID_162696
atgggtgccaagcacctcacgaggaccaaagaatggtcgcacgtcatcgagcaaaggtccccggacgaaattaggcctcaactgccccattcatctttggtcgatagggcgtggaattatggttgtacaacagacaattcttgcaccactcttttcgcatctcaggttgaatgtgtcatatgcatcgaccaaaatagcaatgatcaggctttccttgttgtgatgataagcaagaaaagcatcgatcgctgctaa

SEQ ID NO: 45919 - DNA, 309 bp, Glycine max
  Peptide Sequence Number=SeqID_162697
atgaagatccaaggcctacaagctccacatggagctacgtcatggagtgatgactgtaagatagcgcttgagaaaattaagcagtatttgatgaatcctcttgtactcgcgccactagtgcttggaaggcctttcattttttacatgacggtgttagatgaatcaataggacagttaaagggtactctgatagattacatggcacaacaacccatagatgattatcaacctatgcatcccgaattccctaatgaggatatcatggccctgtttcatgaagaaagtaaggatgaagacaaagataagtga

SEQ ID NO: 45920 - DNA, 471 bp, Glycine max
  Peptide Sequence Number=SeqID_162698
atgggtgttaagcgtctcaaagtgaccaaccaaggaaaagtggtcaagatctcagcacaagagttagaccaagtgaagcaaaataggaatggggtggtagggttaccaaggaagcacttggaggagaaggcagaagctttggcagatcaaggagagtggacctcgttcattgacatattaacactattggtgtttgggaccatactctttccaaatgtaaacgggctagtggatttagcagcgatcgatgcttttcttgcttatcatcacaacaaggaaagcctgatcattgctattttggtcgatgcatatgacacattcaacctgagatgcgaaaagagtggtgcaagaattaaggcggttgcttctggaggaagcaaccctgctcgcctgggcgagctgagctcgcctgggcgagctgagctcgcctgggcgagctgggcggcaaccacctcccctattttgctataa

SEQ ID NO: 45921 - DNA, 1157 bp, Glycine max
  Peptide Sequence Number=SeqID_162699
gtcgacgtacagcaggatgtgttcatcgtcgatgcgggccacctcatggctggccaccagcttgtcgtatagcgtcatgccgggcatttcgcctcgatgccggcgtccttgacgatgccggcccagcgcgtgatctcgcccttgaccatggcatcggtctcggcgggcgtggagaccagcggatcgaagccctcgcggcgcatgcgttcggacagctcgggcgattgcagcgcctgcgccagcctggcgttgagcgtgtccaccaccgcctgcggcgtgccggcgggcgcgctgatcacgaaccaggtggtgaaggcgtagccgggcaggccggactcggcgatggtgggcacgtccggcagcagcggcgaacgcgtggtgccggtgacgcccagcgccttgagcttcttgccgtcgacctgcggcttggccgcggacagcacggggaagctcatctgcacctggccgctgatggtgtccaccatggccggaccgccgcccttgtagggcacgtgcaggatctgcgtgccggacaccgacttgaacagttcggcggccatgtggaaggtgctgccggtgccggccgaaccgaagctcagctcattggcgggacgcgcgcggatgtagtcgagcagttccttgacattgttcaccggcagcgacggcgataccgtcagcacgtgctgcgaggtgcccaccgtgccgaccgaacgcaggtcgcgcgcggtgtcgaacggcatgttgcgaaacagcgccgggttgatcgccagcgacatggtgttgatggccagcgtgtagccgttcggctcggcgcgggccaccgcggccatgccgatattgccggacgcgccggcgcggttctcgacgatcacgctctggcccagggccttgccccaggcgtcggaaatcaggcgggcggcgatatcgacgctgccgccgggcgcgaacggcacgatcaaggtgaccggacgctgcgggaaggcgtcggcggcagtggctggcgtcatccaacaggacgccgcggcggccaacgcgcacaccgtgcgcaacagatgggggggtttcatgggtcgggtctcctcatgggtggccgcgtcaggcggctctgctatcggtcagcccagtgtataagcccgttccattcttataattggtga

SEQ ID NO: 45922 - DNA, 339 bp, Glycine max
  Peptide Sequence Number=SeqID_162700
atgtcgctgcatgttctctatctttatgcgttttctagatttccccccagggatttccggtccgttgtatctcttgttacgatctttcaaagagatgaacatggatttgaggcttttagtcctcacgggcaggatcacctggggctaccttctggagtagagacaaaacatgaacggcagaaaccaatcaaggtacttaaggacgaacgcaaggggggatggggtcacgaccgaccgatcgttgcccttctctgtgcgaaacaagcagagaatgtcgctgcaaggcagccccgtatcctttgtattttgcagctttcttttactttttgtttgttttaa

SEQ ID NO: 45923 - DNA, 1062 bp, Glycine max
  Peptide Sequence Number=SeqID_162701
gtcatcgatggcatcgccttccagaccaatatcctcgcgttgaacgcggcggtcgaagctgcgcgtgctggcgagcagggcagaggctttgcagtggtggccagcgaagtgcgtacgctggcgcagcgctcagcgggcgcggccaaggagatcaagggactgatcgaggattcggtcggcaaggtcgccgacggctcggcgctggtccgccaggccggcaccacgatgggcgagatcgtggcctcggtgcagcgcgtgaccgacatcatggccgatatctctgctgcctcccaggagcagagctcgggcatcgagcaggtcaaccaggcggtggtgcagatggatgagaccacccagcagaatgccgcgctggtcgaagaagccagtgccgcagcgcgctcgatggaggagcaggcgaacctgctggccgaagccgtgtcggtgttccgcacgggggcggtgaccgccgccgccgcagtgcgcccggcgctggcagccgtggcggcatcggttgcgccgagttctagcagagggcaatgccggcagggagacggcgcccatcgcgacggctggtcgcgatgggcgcggattttcttcctgaacgtgcgatggccgatgaagtggcggacacgcgcatttcacttccggttgccaaccgcgggaggacactggtgccataccggaactcaggagatggccatgaagacctcgacccgattgcttgtgctgggcaccctgctggcggcttcgtcggtggccggcgcgcagacctatgggccgcgcgatgagggacgcaagttcaatgacggcagccgcgtggtctgcaagaacgtggaagtgcagcgtaattcgcgcgatcccaaccgcatcgccggtaccgccactggcgctgtgattggtggcctgctgggcaaccaggtgggcggtggcaacggcaagaagctggccaccgtggccggtgccgtagcgggcggcgctgccggccgccagatccagggcaacagccagcagaagaacggcgaccgcgtggtcgaacgccgctgcgaacgcgtttaccgctga

SEQ ID NO: 45924 - DNA, 144 bp, Glycine max
  Peptide Sequence Number=SeqID_162702
atgaaggtgttgtttgcggctgataggaggagaatagcggtgctcggtagtgatgggcggccgcaggccaatgcaggggtcattggaaactgtggagaggaagggagagtaaaatttggtggggaaggaaaggtgttgaaataa

SEQ ID NO: 45925 - DNA, 637 bp, Glycine max
  Peptide Sequence Number=SeqID_162703
atggacatcccactgagaagcactaggaagtaccttttcaaaaaaacagacttgttgagattaagggagctagcatctttagtaagtgatccagttgattttcaagctcaccatgggaagttgctcagaattcttagagtagatgttgaggaaggatgcctagagaccctggttcagttctatgacccgctctaccattgcttcacatttcccgattaccagcttgtccccacacttgaagagtactcctacctagttggcttacctgtgccagacaagatacctttccatggttttgagcctacccctaaaccctccgacatcgcagccgctctccatcttaaaacctccatcatccaagcaaaccttacctctaaaggaggcctccaaggtcttcccacccacttcctctaccaacaagcctccatatttgctgaagcagctagtacacttgccttccattctgtcctagccctccttatatatggccttttactcttcccaaatattgacaacttcatcgatatcaatgccattaaaatcctccttacaaagaaccccgtacccactctactcgccgatacctaccactctatccatgaccgtacccaggctggccgtggaaccatttcttgtt

SEQ ID NO: 45926 - DNA, 263 bp, Glycine max
  Peptide Sequence Number=SeqID_162704
tggtacctggagatatgtcgcgggggtcaggagaccatggggacgtcagggtgatagggcactggtaaccgattaccagttaggtgtaatcgattacacagtgctacctgccactgaggtgccgattccgtggcacaattcgactcactgctacttcattagtacatccggaggaacccgcacgcacacttcagtagcctctggagtggatactacctacacctactccatatcgactagtggagccagttcaagtgatagag

SEQ ID NO: 45927 - DNA, 231 bp, Glycine max
  Peptide Sequence Number=SeqID_162705
atggaggaagcaccaacacatgcatcttctcatgtagagcaacctcgacatgcaatggcttgtcaagcaataactgaaaggttggaacagttgctcaacctaaggatagtgactgaaggcacaaaagcatacaatgtcatggaagactgcttaaggatcataagaggtgtgactgcggattgcaatatatatgtgcggtcgcgacaaaggcagcgtatggaagatgcatga

SEQ ID NO: 45928 - DNA, 219 bp, Glycine max
  misc_feature (6)..(6): n is a, c, g, or t
  Peptide Sequence Number=SeqID_162706
atgtgntccgcagaaggcagtggcgggactgcacacctctctcctagtcagcccatcccgccattgttgttggcggtatcccctctctcctcagcctgtcccgcaaatgccaatagcggcaccccctatcccgccattgtcactggcggttcaagcttcccgccagtgtcaatagcgacacccacgtccagaagtgaccccccttggaatttcttttag

SEQ ID NO: 45929 - DNA, 305 bp, Glycine max
  Peptide Sequence Number=SeqID_162707
cccgaaccaagatagatgtttatgctggcacattgtctatggaatttggtgatattgttgttaattttaacatccttgatgccatgaaacatccatctgaggatcattctatttttcgtgttgagataattgatcagattgttgatgattatatgtttgattttgattttttcttcatgagtgaatttgaatttaagtctggttctgattttctgggtgttgtacctcttgatgttgattttttagagttagaatgcactaaccatgttgtaggaagtacatacacttctgacttgctttatgag

SEQ ID NO: 45930 - DNA, 615 bp, Glycine max
  Peptide Sequence Number=SeqID_162708
atgagcacgttgaagacgattggtttggctgacttaaaggaaggcctttttcacttgatagttggaaaggataaaagcccatctaccaataatatcaccgccaccaacaccaatacctccaagctttggcattttagattaggtcatttatctgacccaatttcacatacgctacctacaccacctcaatttaccccatccacacctatcacaacaaacactgaaccaacaattcctcaacccaatggctcaccatcacttttcccaaatccttcaactcctcctacaatcgacacaccaaatcccaacatcattgatcaacacatccaagaaccaccgactaaccatgctttaccacgtcactccaaccgcgacactcatcctccttcttacctttctgattatcagtttcaaattccttccctcaagtctgctcaatcctcatcaacatgcacatatccaattcagagtttcctctcatacactcatgtctctccttctcatcgccatttccttatgactctgtcatctgagcatgaacccaccagttttcatgaagctgtgaaacatcaatgttggcgtgatgccatgaaatgtgagatcaaggctctatag

SEQ ID NO: 45931 - DNA, 738 bp, Glycine max
  Peptide Sequence Number=SeqID_162709
atggatagttctcttcgactccattatgattcctttggttttcttgatgatctcctatcttatagacgcctagttggaagactagtctatttgacaagcacatgccctgatattgcctttgctacacggcaactaagtcaatttatgtccaaaccaacaaaagcctatcatgttgcagttgtccgcgttcttcgatatctcaaagggtgtccaggaaaaggctcattatttccaaggacttgctctccttatctacttgggtttagtgatgctgattgggcaacatgcaattcgcttgtttcatggaaaaccaagaagcaaactacagtatcgcattcctcttccgaggctgaatatcgagaacttgcttttgcaacttgtgaattacaatggctttcttaccttctaagagatctacgaattcccctttccaagactctcgcactttattgtgataatgatagtgctcttcacattgctatcaatccagtctttcatgaacgcaccaaacacttggatattgattatcatctagtccgtgaaaagttccaagctagactcatgttactgctcctagtcccttcttcaaaccaacttgtggatatattcacaaaggctctccctcctcaatccttcaacaccaatctttccaaattgcagttacaaaacatttttgcacctccagcttgtggggggctaatagaggaaacatataatcctagcttaaatgctacataa

SEQ ID NO: 45932 - DNA, 882 bp, Glycine max
  Peptide Sequence Number=SeqID_162710
aatgcaacaaaaaatagctctcttcagatggctgctctggagcaaaagaaagctgatgaaaatgttatgaaactggctgaagatcaacagaggcaaaaagaactactccatgctaaaatcattcagcttcaaaaacaacttgatatgaaacaagagctggagttggagattcaacaattaaaaggatcattaagtgtgttgaagcacatggaagatgatgaagatgcagaagttctgaagaaggtagatactttacaaaaggatttaagagacaaggaacagtcacttgaagagttagatgcattgaaccaagcactaatcgttaaagagcgtgagagtaatgatgagctgcaggaagctcgaaaagcattggttgatcatctcaatgagatccattccagtgtcactattctttcacatggctcatgggatgggatgaaagagctatcatctcatagcaatattcgtttgaagagaatgggagaaattgacactataccattccttgacgcaatgaagaaaagatataatgaagaggaagctgaagagagagcttcagaactgtgctcattgtgggaagagtatctaaagaacccagattggcatccattcaaagttatcatggttgaagggaaagaaaaggaaattgttagagatgatgatgaaaagctgaatgagttgaaaaatgacttgggtgaaggggcatataaagcagtggtacaagctttgtcagagataaatgaacataatcctagtgggcgatacttaacctcagtagtatggaactataaagagggaaggagagcatctctgaaagaaggagtccaatttctgttgaatcattggaaaggggaatggtgtgaagctataactagatcttag

SEQ ID NO: 45933 - DNA, 1488 bp, Glycine max
  Peptide Sequence Number=SeqID_162711
atggctatggcttcaccctcctcaatcttctctgtttatgcttccatgacagcctccatcatgctcctgcgttcagtaaccaacgacctcattcctcaaccatttcgtggctacctcaccaacgccttccgctacttcttcaaggctcgctgcaaagtcctcaccctcaccattgaagagtactgcagcggcatagctcgcaaccatgtctatgacgctgcagaggtttacttgtctaccaaaatcacccctgaaaatgagagactcaacatcagcaagagtccaaaggagaaaaaactcaccattaggcttgaaaagggtgaagagctagttgattggtttaatgggattaagctcaattggaaactaatctgctcagagtctgagaagagcaatagttccaatgatcacagcagaaacaacccaacaagaacagaaaagaagtactttgagctaagctttgagaagaagcacaaggagatggtgttaggaagttacttgcctttcattcttgagaaagacaaggagatgaaggatgaggagagggtgttgaagatgcacactctcaatacttcatacggttatggagggttcaagtgggattcaattaatttagaccacccttcaacgtttgagacactggctttggaggcagagcagaagagtgccatcatggaggatttgaacaggtttgtgaggaggagggagtattataggaaagttgggagggcttggaaacgcgggtacttgttgtacggccctccggggaccggcaaatcgagcttgatcgcggccatggctaactacttgaagtttgatatctatgatcttcagcttgacaacttagtgaccgattctgatctcagaaagttgttgctggcaactgcaaacaggtctattctggtcattgaagacatcgattgcagcgtcgatctgccagggcgtaggcatggagatggccgtaaacaacctgatgtgcagttgagtttgtgtggattactcaacttcatagatgggctatggtcgagttgtggagacgagagaatcatcatactcaccaccaaccacaaggaaaggctagacccggcactgttgcggccaggaagaatggacatgcacattcacatgtcctattgctcctaccacggcttcaaggttttggcctccaactacctagacattgccccggatcaccgccttgtcggggagattgaagggctgatagaggacatgcagataaccccagcacaggtggcagaggaactgatgaagagcgaagatgctgacacggcactagaagggttcctaaagctgctcaagaggaagaagatggaaggagacgtgtgtgagaatgatggttcagataaaacagaacttcaccaatctaaaaggtccaaagttggttgcaagcagaaaagaccagtttgtatcagcaagagaaaaaatggtgtggggactcaaagaaggacaagaggacgtcctttgtaa

SEQ ID NO: 45934 - DNA, 722 bp, Glycine max
  Peptide Sequence Number=SeqID_162712
atggatatgagaccttggaaggcttcaggacctgatgatttccctgtaggattttaccaacaagcttacaattgcataggtgtcaatgtggatcttgccaaagcttatgacaaaatgagatggagctatattgatcatattctccatgaagtggttttccctcaaaatctcatttcgctcattatgcattgcatttcttcgattcaatcgaacatgatttggactggttataaagcttctcccctcacccctcaaaggggtctttggactcctacaagagctagtaaagatgaccctcaagtctttcatctcatgtttgcggatgatgtgttactttttggggaagcatcaatccaacaaatcaaatgtgtgccaaaaggccatggtaatacaagacgatctcatgttgtggggtggccatctataatgcttcctaagagtaatggtggtatgactatgagcaatctagttgccatgaataaaacttgtcttatgaagttggcttgggctctaaattctggtttgtggagtcaggtgcttcaaggtggttttgccaaaaagcttgagaatgtttcaacttttgtggttgaattatgggagatttttgaggggatgcagcttgtcaaggagaagggatggtatccattaattattcaatctaatttgcaggttgttgtgaagtccctcattggttctggagccggttgtgctactggtcttag

SEQ ID NO: 45935 - DNA, 177 bp, Glycine max
  Peptide Sequence Number=SeqID_162713
atggtggtcgcaatccaggatgcggtggtggtggcagaggtcatttatctaatgtatatggttccatcctctcaatatgctcaacctgttcagtatgttgctcaacctcaatatgcttacattcaaccttcaccgcaggttattcaagctccaaaacaaccaaccaactctccttag

SEQ ID NO: 45936 - DNA, 558 bp, Glycine max
  Peptide Sequence Number=SeqID_162714
gttcactttgtcttaaaagaacttgtgaggaaatcaatagctgaaactcaggaactgagacgtttcccaactctccaagccgaaatagcagcagctacaaatgaggctttagagaggttccgcgaagagagtaagaagacagctatgcggcttgtggacatggaagcttcctatctcactgtggagttcttcaggaaactgcctcaagaaatggagaaagctggaaatccagctaatcaagctactccaaatgtggatcgatatggagaaggacattacaggaggattggatcaaatgtatcttcctatatcagtatgatatcagacactctcaggaatactattccaaaggctgtagtgtattgtcaggtcagggaagcaaaactgtcattgctaaaccatttctacatacaaataggaaagaaagaggctaaacagctatcacaattgttagatgaagatcctgccttgacggggaggaggcaacaatgtgctaaaaggcttgaactatataaagcggcaagggatgaaattgattctgtttcttgggcacgatga

SEQ ID NO: 45937 - DNA, 822 bp, Glycine max
  Peptide Sequence Number=SeqID_162715
atggagcaaggggagagcttgccctcttactccaagtttgttagattgaggcctgatcctcaggggcttgtagcccgactgtgtatccctgggaggggatttgttcttaatgtcaagggtctgccgtggaagctcttgaggaaagatcttaccactctggcccaaacctggagtgttctatctcattctaacttggccccgacatcccatacttttgatcttaatctggatagggccaagttagtgtacgggcttgtaatgaagatgaacatgaacttaggttcacttatttctggagtcaccttagattctcttacctttgagtcactcagcccagccattaatttggcttatattaagaagaattgttggaacctggatgaaccttcagtcacttttccagggacccaaaaatctagggctagaagatctgaggcctccatctacttttgcttttccgtcaccaccagcagctccagttcttccaggtccctccgcttagaggtcaaagccttctgtgtctatgttgcagagcctgcatcagggccaactcctgatcatgcagagtttgcaggatgtggtccagcaacgaccagttatgagcatggaggagtttctgtagaagcccaggagcctcagccagaccaggaggacgacattctggaggcctcagagcccactccacccgagtctttcatttttaagactgatccagtagcagctaccccacaggtgacaccagagccttccactgtagtgctggacatgtcttcttctcagcctgagtcatctgcaccagtgccagacctgacccttccttag

SEQ ID NO: 45938 - DNA, 216 bp, Glycine max
  Peptide Sequence Number=SeqID_162716
atgactcatttggaattgttgagcatctttgttgatgttgtcgatctcactattaagagcattgtgtttctcaatgatgtgtttgttttgcttaagaataagcccgatttgggggagatgttcagtggggttttggggatagggtttatttcgtatgagggacgagaatgggttcagggtgagggggagaatgtatgggtggtgcaaggtgaaaag

SEQ ID NO: 45939 - DNA, 192 bp, Glycine max
  Peptide Sequence Number=SeqID_162717
atgagttcagcatggccaaaggatcctcctagagttctgccagttcagcaatatgacatatttgttgaaccagatgtgcatcaacaaccagtggcggcaacgacacctgatgagacagacgctgatgcgcatcatcttggacatgcagatggtcacagatcgaggcgtaggcggcgtacagatggtcattga

SEQ ID NO: 45940 - DNA, 108 bp, Glycine max
  Peptide Sequence Number=SeqID_162718
atgggaaagttgggtggtgtttgcgtgattgtaacggctacaatgcacgctcttttcgggcacgaaggacttggggatcatgatttccctgcaaaggaggcagtataa

SEQ ID NO: 45941 - DNA, 219 bp, Glycine max
  Peptide Sequence Number=SeqID_162719
atggagcgacgccatgaagaggagttgacaaaggtaaaggctgaccatgaccagttggagactcgtgtcagacgttcccagggtgacgagcaatctacccacactttgcctgaatgcacccaaggggaatcacaccccaacgcatatgcgctaagcgaggcattaagctcgagagttgtcatgcgcgctgagcacgcaacaggcgctaagcgcgcataa

SEQ ID NO: 45942 - DNA, 738 bp, Glycine max
  Peptide Sequence Number=SeqID_162720
atgggaactgttgaagctgcaaacaaggatgcaaatggaagcctcctagagaaaaatcctacagttgtttttgtgttaggttatttgcagaaaactgtttatcttctagacaaaaaattggctgatgagtttggaagtggcccaggcagtggaaagggtacccagtgtgcaaatattgtcgaaaattttgggtatactcacctcagtgctggtgatcttctgcgagcagaaatcaaatctggttctgaaaatggcacaatgattcagaatatgattaaagaaggaaaaattgttccctctgaggtaacaattaagctcttacaaaaagcaatgcaggaaagtggcaatgacaaatttcttattgatggttttccccgcaatgaggaaaaccgtgcagcatttgaaaaagtgacaggaatagaaccagcatttgtcctattttttgagtgccctgaggaagagatggagaggcgactacttagtaggaaccagggtagagaagatgacaatattgagacaataaggaagcgatttaaggttttcttggagtctagtcttcccgtgattaattattatgatgcaaagggaaaagttcgcaagattgatgctgcaaggcctatcgaagaggtatttgagacagtcaaaggaatttttggtccaaagaatgagaagtctttgcatcaatgcaatgactgctttttcgcgcttgagacacgtgaggaactcccgagaagctga

SEQ ID NO: 45943 - DNA, 1242 bp, Glycine max
  Peptide Sequence Number=SeqID_162721
cacgttggcggtgcgccagtgctcatgattggggagtttcctactgagctgtgtgcactgcccgagtttaggtctgagttgcagcttcacgagctcttcgatgggtttcaggtctctatcagaggtgttgtctcatggatctatgttgaattcatcaccctagcttgcttagtagatggtcaaggcttaaatttgagaccctttgtccacactcatgacttgagtgccttcagttgctgtgggatgaggcatgacaggttccttggtggaaggatatgctactaccttcaagctctctgcataacactgttgtgtttgcttttgatatctgatggtgaatctcctggaaagcttgccctgaccgaaggtggtcatcaagtccacgtagcctctggtcttgactctcttgcctacaaagtcgaggagtggatcggcatgaggatggacggtgtcaggggagacctcaagtctctggaaggttttcccatacaggatatctcaggaactgccctgatcgataaggaccttagacaccatgaagtttgcaatgatgatggagacaaccacggggtcatcttggttgacggggttgatgcccttgaagtccctatctgtaaagatggcgtgcatatgacattttcgggactagatggactgtcctctagaggaaaatctagccgcaatggtgttgactacatctctgatttgctgggtcttgctcctgcttggtggttgtctggtctcttaacaaaccggactaagtatccagcctgttgtgtgcttgtcgagcttttgtctggcttggtggactacattctggaatctggacatttcttccatctggatgtagcccttggctcactcgcacagctcgtccatgctatcggggttaagatttcggatctagacgactttatgcccaaatctttccatgaattttctgagggactcgtcgtccacttctcacagactggccaaggcgatcgaggtcatgcggtgagacctactggtaatgtactgtgcattaaattgttcaacgagggtgtcgaagctgtctatagacctaggtgggagtccaccgtaccaggcatccagatgctcgtttggatttgttgtcccatcgtactgctcgaggttgagtggtttccaccccaagagtatgtttgcctccataatacagtcgacaaaaggatgttggaggatggtccgccttgttggacggtgtatgtgggagagatttaa

SEQ ID NO: 45944 - DNA, 201 bp, Glycine max
  Peptide Sequence Number=SeqID_162722
atggaacacagctccaaactcgaaaatggaggacacatgaacgaaaacgcaattcatggggctccggaaaagggtgagaatggaggattgcctttaggctccaaactcaaaagtggaggacacatgaacgaaaacgcaattcacggggctccagaaaaggggttggcgggaccgaacggtccaccgggtttttccacctaa

SEQ ID NO: 45945 - DNA, 1167 bp, Glycine max
  Peptide Sequence Number=SeqID_162723
atggctaacggaagctctgatgaggatactgatattagtgaatctgaaattagtgagtatgaagacaagtcctatgaagaactgaacaatggaagtcagaatgtgaaaacctcggatgagacttttacttgtccatactgccctaaaaagagaaaacgggattatttgtacaatgagctccttcaacatgcttctggggtgggtcagaatagttcacagatgacaaaagctagagacaaggcaaatcatttggctctagtgaagtatttggaaaaagatctaatgactgtagatgttccatcaaaagattcaaagccggtggatgaaaatgagccttctgttaattctgatgagcagtttgtgtggccttggattggaattgtagttaatattccaactaggtggatagatggacactatgttggtgagtccggtaccaagctgagggatgagtacagaagcaggggtttcaatccagttcgagtcactcctctgtggaatttccggggtcactctggaattgctcttgtggaattcaagaaagactggccaggcttagacaatgcgttggcatttgaaagaacatatgaattagatcatcatgggaaaaaggactggtttgctaattctgagcagaagtctggcctttatgcgtgggttgcccgagcagatgactacaaagtgaacaatatctatggagaacaactgcaaaagatgggcgatctcaaaaccatacctgagcgtatggaagaagaagctagaaagcaggatatacttgtctccaatttgactaacattatccaagtcaagaaccagcacttaaaagagattgaagtgagatgccatgagactacgaacaaaatgaaccttgctatgaatgaaaaagataaactcattcgaacttataatgcagagataaagaaaatgcagtcaagtgccagtgatcacctcaaaagaatttttactgatcatgaaaagcttaaatttcaactggaatctcagaaaaacgagcttgagctgcggaaaattgatttggaaaagcgtgaggcacataatgaaagtgaaaggaaaaagttggcagaagaaattgaggaggaggtgatcatgtcccttgttatgtcacagattcacatgagacagcttagattagatggaaatgatatctaa

SEQ ID NO: 45946 - DNA, 129 bp, Glycine max
  Peptide Sequence Number=SeqID_162724
atggaaactgagaaaactctgtatatctgggtggttttgtattgcgtgcggctcacggctcacggctcacggctcacggctcacgagtttatggtgatcttgatattgcaaaacatggctgagcattag

SEQ ID NO: 45947 - DNA, 231 bp, Glycine max
  Peptide Sequence Number=SeqID_162725
atgaagatgctgactctcccatttcgagatgagccaatgaaggaatggttgactcttgaagttggcgtaaggtttcacattggtcctctagtaacaataatgaaggaaattttgaagaagatggtggaaggggtcctttgtaacgttgaagcagccccacatggaacacgggatagattctggcagtggccggaagttccaattcataagccacgaccccaatgtgtttga

SEQ ID NO: 45948 - DNA, 294 bp, Glycine max
  Peptide Sequence Number=SeqID_162726
atggatttgttgacctcctctatttgtttgtcggtttacagatggaaaacaacttctacagtgaagcaagcaaccagagatggtacagaaaatttggacggttacccaataaagtcagcatacttgacaacagttgtgttggcattggaagaggttagagaaggttcagttgtttggtcggactatacttgttctgttggtagacaaggcactgggacacaaaagttggcatcacaagacatcccgaccaatgaagaagttgtgcgaacaagtgttggtttgggtcctgagtga

SEQ ID NO: 45949 - DNA, 1161 bp, Glycine max
  Peptide Sequence Number=SeqID_162727
atggagtttgccagtttccatcttcagcagcatcagctccaagaagaatctgctcagtttagtataatttcaacaaccccaccacctgactctaaaccttccactactatcactaatcaatcatggatcccaagcaacatgtacaatggttataacagtgggtttctaactgatcagagcttcacaaattcaagagaactacaacacaagcacgccatgactgattcacttagaatttcaacaaggcaagcctttggttttaacaatggaaaaagcctcataactcagcatccagttggtgataataatagtctctttcctgcaagaatattcaaaggtgaaatgatcgacaacaccttcatgaaggctatggaggaatcatcactagttccaattcatcatgaaccacgatattcttctcctagtttcttatctagtattggtgtaactgttggtgaagagttttatcctaatgacaagcctatagatggagggaccccaagcaagagatataataatagctttggcgatgttgccttaatttcaaatttaccaaccctagatatggcctcttccttagtttcatgttctttgggattaaaccctaaaatgtttgatctgcatacaagttatggtgggagttgtggaatccaacctggctatgatacttttggtattaacgagagcatatctttgagtcacagctatgagcatggccgtgaaaacagtccatcaaacagcacaagtaaaatttcatcatttgtaagtgaagttgcaacgacgaaaaggccaagcaattgctctccaccaaaagaatctgaagcaaaagctaagaagtcaaggccatcatgcccgcccctgaaggtaagaaaggagaaattaggggataggatccaaactcttcagagactagtggcacctttcggaaagaccagcaccgcctctgtcttgagtgaagcaattggctacatccatttccttcaccaacaaatccagactttgagcattccttacatgaaatccgcgcaaagcaagccctctagagtggtgcagctggattcaaataaggtagatagaagagaattcaagcccgaccttagaagcagaggcttgtgtcttgtgcccctttcttacgcatcattcattcatcgttgtgtttag

SEQ ID NO: 45950 - DNA, 1668 bp, Glycine max
  Peptide Sequence Number=SeqID_162728
atgtctggacccctgtctccaaagacatctcttgaaaagagtgaccgtgttggttcattgaagaaaatgctgaggaattctctaacaaggagtaagaggcgaagcagcagcaaggtcatgtcggttgaaatcgaggatatccgcgatgctgaagagtccaaagctgttgatgagttccgtcaagctcttgtcttggacgagctactccctgagaagcacgatgactatcacatgttgcttagattcttgaaggccaggaaatttgaccttgagaaatctaagcaaatgtggtctgacatgcttcaatggaggaaggaatttggtgctgacaccatcactgaggattttgaattcaaggaactcgatgaagtcctgcaatattatcctcaaggacatcatggagttgataaagatggacgaccaatttacattgagagattgggccaagtagatgccaccaagttgatgcaagtcacaaccatggatcgctatatcaaataccatgtcaaggagttcgagaggacatttgatgtgaaattcgcggcttgcaccattgctgcaaagaaacacatcgatcaaagcacaaccatccttgatgtgcaaggagtggggcttaagaacttcaacaagcatgccagggagctcatcacccgccttcagaagattgacggtgacaactaccctgaaaccttgaaccgcatgttcatcatcaatgcaggttctggattcagaatgttgtggaacaccgttaaatccttccttgacccaaagaccacatcaaaaatccatgttcttggcaacaagtatcaaagcaaattgcttgagataattgatgagagtgagttgccagagtttttgggaggtgcttgcacctgtgctgatcaaggaggctgcatgcgctctgataagggcccttggaaggatgcagatataatgaagatggttcaaaatggtgagcacaaatgttcaaggaaatgtgaggttcctgtcatggaagagaagacaacttctgaggaacacgagactcccaagttggaggcaaatctcgccgcacaattgtcttctgtctttgccgaggttcctgcttctaaggcttacaactacgaggactttgtccccgaggctgataagactgcttggaataaaaagatggaagaaaatgagaaatttgcagtatccaaagctggagcagtcgatgcatacgccatggttgattcgttcaagattcatgaaaaagtgaactctcaaatcttcactggtgtgatggcctttgtgatgggcatagtgacaatggtgaggatgactaagaacatgccaaagaagctcacagacgccaacttctactccaactttggtggcgaatataaagggcaggctccaaatacagaggaaatgactactatgcctaacatctctgctcaagagttcatgactgtgatgaaacgcatggctgagttggaagacagaatggtcaacatgaacaaccagaccacctgcatgccacctgagaaggaggaaatgctcaatgctgctatcagcagagcagatgctttggagcaagaactcttggcaaccaagaaggctttggaggattccctttccaagcaagaggagctttctgcttacattgagaagaagaaaaagaagaagaagttgttcgcttggtaa

SEQ ID NO: 45951 - DNA, 269 bp, Glycine max
  Peptide Sequence Number=SeqID_162729
atggatgcagctcggcacattctgaaatacatcaaaggttgtccggggaaaggtcttttttgctcttcagctagtgacttcaagcttcgaggttttagtgatttagattgggcagcttgcccagaaacaagggaatctatcactggtttttccatcttctttggttcctctcttgtgtcttggaaatcaaagaagcaacctaccgtttctagatcatcattagaggcaaagtatcgggccttgacaatcactgtctgtgaactccaatg

SEQ ID NO: 45952 - DNA, 717 bp, Glycine max
  Peptide Sequence Number=SeqID_162730
atggcgcttccaaattttcaccggacaagcagaaaagagctcttccccaacgacaaaaccctaaacccttctctcctatgcaacgaccttgacgtcaaccttcactcctcgcactcctccctctcccttagggttccgctccccgtcgaccactccgtcctctccgccctcgacacctcccaaaccccgccgccggatcctctcgtttcgcaacctgggcaaactcgggtagtcctgtctatgactgcagttgcttcactttcttccctggttcaaaagcctagttcaaaggtacttccagataaaggcctggaagttggattgtctgggtctgctggcgaagggaagcttcctacaacgttgtcaccatcaatgttgattgttgattggagatgtatggtgaggtggcccgtaataccccatatgaagttaatatcacaatcccagttgaggggaagactgaacaagtatggtgattatgccaatgactataaacaggatccagggggaggtcgtacaagaggatgggcaatatttggagtgctgtcttgcatattttttgtttcttcgacacttttttgttgtggagggttcatttacaagacaaaagtggaacgccagcgtggaattgatgcattgcctggcatgacaattctttctgcgtgcttagagacagtgagttccaagctccttactaatttttattggaacttttga

SEQ ID NO: 45953 - DNA, 189 bp, Glycine max
  Peptide Sequence Number=SeqID_162731
atggtttattcattaagtatctcacgttctgataacaagttgagagctttgtggtggacagactctataaataggatgaggttagtggagttgaacaaggctactcacggccagaagacatcaatagtgcatttggcagttaaacctctatgggaacgtcctcctggtccttctcaaggtgctgcctag

SEQ ID NO: 45954 - DNA, 411 bp, Glycine max
  Peptide Sequence Number=SeqID_162732
ggatgtgatggttcattgttgttagatagcagtgaaagcatcgtcagtgagaaggaatcagatcccaaccgtgattcagctagaggatttatagtcattgatgcaattaaactggcgatagagagagcatgcccttctacagtgtcttgtgctgacatcttgactatagctgcaagagattcagttgttcttactggtggaccaagctgggaagtacccttaggcagaagggactctcgagatgcaagcataagtggctccaacaacaacattccagccccaaatagcatatttccgaccctccaaacaaaattcgagcaacaggggcttaaccttactgatctagttactctatcgggtattctcctaaaatttgtctgtttcaaattctttttagataaatttttctaa

SEQ ID NO: 45955 - DNA, 279 bp, Glycine max
  Peptide Sequence Number=SeqID_162733
atgtcaaatgaagaattgaagttgcaggatccacgatgtcggatacaatgtcctgacatcctgcccgaaaatactggagttgctgcacaatgcataagtcaagataaaatgtcaaatgaagcattgaagctgcaggatccacgatgtcggatacgatattttcaggaaaatgatagatctcatccagcacaagcagttgcagctcagaaacgcacattgctatataaacatgaaggctgcacgagttctgtaccaagtccgggattgaagagttatttt

SEQ ID NO: 45956 - DNA, 402 bp, Glycine max
  Peptide Sequence Number=SeqID_162734
gtgagggcgtgtagccctcagaaggtgagggcgtgcagccctctgaaggcgaggacgtgtagtcctctaatggcaacgacgtgcagtcctctgaaggcgaggacgtgtagccctcagaaggtgaggatgtatagtcctctaaaggcgataggtactagtacccaagggtccacccttatgagaaagcaagagatcaactcatggagagggccgggtcatgcaatgctcaatggaatgccccggggctcctccatgataagcacacattgcgttcgattcgtatcctcggaaaaatggaggttgaggaaacctagcaggggttatggctaccattgcagtatcaagttcgtgctaaaggtggtgtttagcattggttgtgtggaaggtgggtttcgtggttga

SEQ ID NO: 45957 - DNA, 902 bp, Glycine max
  Peptide Sequence Number=SeqID_162735
ctgtcgggaagatcaccaagtcagagagggagcagtccttacatggaaatggaaatcacgattctgaaaggagtctcaatgtgttagggatacaaattttgaatggcaacgagtcacgtgactcacaggaggctgaggagaggattaaaaactacttgggatttcctattcacaccaccaatgaagcattacaaatgtctgatcccagcccaagaaataataaaagggaatggcaggtgtattcgcgaaataggaggtgccaaaagcaaatgggccaggccagtccaaatggtatatggcctgccatagttacaaaagcaattacaaagggtcaacaacaacccaacgtggacttgaataaagctagaaacggtcacaacgacaataatgtcctcatggaaggtccatcaaagcaaaatgaagctgaaaagcaaatgggccaggccagttcaaatgatatatggcctgccatagttacaaaagcatttacaaagggtcaacaacagcacaacgtggacttgaataaagctagaaatggccacagtggcagtaatgtcctcatggaaggtccatcaaagaaaaatgaaactgagaaagtaacaacagacaattatatagtcaacaatgtccaactggaagaggcagaagctcaatggaacatggcaaaagaaatgggggcaacatgtgggtcacagcagggtaaaattattgacaagataagggcaatggaggaaagagataggaaagaggcagagagattgggaaatagagagactaaaaaggagcaaattgagaagacgacatgtcaagcattgtggggggaccctgaatgtggaaaagttcaaattggaaaggaaggtcataggcaatggattcatcctgctgaaagggctgtggattaa

SEQ ID NO: 45958 - DNA, 504 bp, Glycine max
  Peptide Sequence Number=SeqID_162736
atgtactgcacagctagacaggcacaggttggtgacccacaggccccagacgtaccgccgccacctcctcaggctgacccagctgggtcatttgacacggagcggtatttacggcatttggttcgccagcaggcggccaaccacagggcgcacgtgcagacccatgagtgcctctaccagctcagccttagcctgcagagtcagggtttccctccttttccatgccctactccggatcagttcagggcagaggtcgcatggcccggggattggcctgaggcccaggcaggggaggcacctgtagaggcacctatagaggctcccggcaaggcagatgaggcccgcatggacgaggagatgaccgatttgcttgatttcttgggagcaaagccacatgattgggagatccctagatccatattctctttttatgtttcctctattatctgttacgtatcattttatttttgtttaactgagggactaacgtttgtttcgttttga

SEQ ID NO: 45959 - DNA, 591 bp, Glycine max
  Peptide Sequence Number=SeqID_162737
atgcatggcttaatcttgagacaagcatatgactatggcaggatcaaccaggtagcatccgttaatgaccaagcactgccacgagcattgccagcgctagctaataagagtagtagcatcgcgttgacaaagcaagccaggcaagcgtcatccgagacaaccgatttaaggaacaatgtgggggcactagaccacccacgttcactgcatgcaccgcatccgagagaacgtgggatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagtga

SEQ ID NO: 45960 - DNA, 563 bp, Glycine max
  Peptide Sequence Number=SeqID_162738
atgacagatccagatttacatacgaagaggcctgggaccgttgcacggataatgtactcggttggaagatccttccggagagaaatagagttggagaggagaaactggcataaagagctcacaaacttcgcagatgggagcatagatgtggcagtagtgaaggagttttatgcaaatctctatgaccttgaagacacatcacccaagcaagtgagggttagggggcatctgattaaatttgatgttgatgccctcaacaccttcttctatatatcgacggtgattgaggaaggggagagcctcctagcttattccaggtttgccagattgaggctagatctagaagagctggtagtccgtgtatgtatccctggaaggggatttgagttgaatgcagacgggctgcctctaaagattctgaggaagaatctgactactctggcccagacctggagtgtactttctttctctaacttggcccctacctcccacacttcagacattactttggatagggccaggttgatttatgggatcattcagaagatggacatgaacctcgg

SEQ ID NO: 45961 - DNA, 225 bp, Glycine max
  Peptide Sequence Number=SeqID_162739
atgctcacccacaaatgctcgaagatcgtggagctctgtgaggatttcagtcagcagagaagaagcattcctttatggtggaggagatggggaggtaacaacaccgacaccaatggagaaagaccttttaaccttgacatatggttaatcatccaaaggaacattgaaatgatgaagaaaaagagtaacaaggtgggggtacgggagaggtgcatgtgcccgtaa

SEQ ID NO: 45962 - DNA, 504 bp, Glycine max
  Peptide Sequence Number=SeqID_162740
atgttcaagattgaatcaagaacacttcaaggatcaagaggaaatttgatttcaagaatcaagaatcaagaatcaaaattcaaggttcaagcttccaagaaacaagatcaagattcaagaatcaagagaagacttaatcaagataagtatgaaaagggtgcatccactaggttcaaagagaacaagggagggtacatcccttgtggatctttgcttgtaaaaggatttttacaagcgtccgctaagcgcaactctcctgggctaagcgcgaggaagactctggaagaagatgagctgtacagaccagagcttgaagcaggagccggtttgaaagcttgtgatgagtttgtgagtgattgtgagatcctagaggcttcctggtacggaaagctaaatcctctgttggatcttccctgtagtggaaactggtctgactctaaagtccttgatagtacagggctaagttgtcgtactatcatgaggaatcggggtgcgatagcttag

SEQ ID NO: 45963 - DNA, 769 bp, Glycine max
  Peptide Sequence Number=SeqID_162741
gggagaaccgggattcttatttcatgtgggaaatttccaaatgttcccttgatggggacgcggggttccatcaattacaatcccatcctcgctataagacaacttggttaccctatgagaggggcgccatcagaggaaggcctcatacctttccttacacgaggttttaatagcaccaatgcgggggtgcttcagagggtccacaaggcatgggaaatgtcgcaaagaaaggacaaggaacttaggtggagtagcaacgggcccatcggcggctaccgtaggtggttgaaagcctacacgcaagatctggattggctcccgagtttgaggaccactaaggggatagagattgaaactccggaagaagacgaagaggaaaacgccaaactgagatacgtcaatatagccaccactaaggccttggagcaagagaccaagatggcccgtagggaagaacatggccagaacaaatttcgaggggctctgtggggcagtaacagcgagcttatgctccggagagaggaacgggaccaatcgcgagtagacgcccacgagcacaaagtggcaaacgaatacgcccgagtgtacgcggaaaaggaggctagaggaagggtgattgactcgttacatcaagaagcaacgatgtggatgaatcggtttgctcttactttgaacgagagtcaagagcttccccgtttgctggaaaaggccaaagctatggcggacacctacttcgcccccgaggagatccacgggctcctccgctatt

SEQ ID NO: 45964 - DNA, 135 bp, Glycine max
  Peptide Sequence Number=SeqID_162742
atgaactcgctaagcaagcatgctgcgctaagcgagttcatcaatactcattgtatcctcgcgctaatccgagctttcctgggccaagcacgattggttgcggtgtccgctaagctaagcgagcttcactgctaa

SEQ ID NO: 45965 - DNA, 198 bp, Glycine max
  Peptide Sequence Number=SeqID_162743
atgaggaaaatgcaaggatcatgcgtgagcgaacatgaaaaaggtatgcagtttgtagaacaaaaatgccctacgtgtacagttaagaaggtgatatggaccttccggcttcccgtgacaaaggacgagaccaacatacaatgcatgctagagataaaatgtgggagtaacttggtttgcattaatttgctaaagtga

SEQ ID NO: 45966 - DNA, 195 bp, Glycine max
  Peptide Sequence Number=SeqID_162744
atgtcaggagaggctttgaagttatctgctggtgcaagattatggtgtcgtccaagcattgatgagaatgacaaaaaactacaagaggaaatgaaactgagtagtttgcgtctgaagggcatcacaaggggtttgattagagctgtcaaggagatggacaaggaggttgtcgaggctgacatcattgttgcagtg

SEQ ID NO: 45967 - DNA, 348 bp, Glycine max
  Peptide Sequence Number=SeqID_162745
atgtcggtggattgctatgaaggagactttgaagtccatatctacagcgatgtacaagtagcatctggatcgactcaggatttcggatctacgataggggcctgttgccgtcagacaccgactacagagggtcatgcgccagttcagacacatccagagtattcctttagagcctatgataggtggatgcactactcaaaccattttgcaccagcaggcctaggatcttcttcatcaatggatttctttgcttcttgcaagatgaatggcagtggaatggagaaggaagagaaagaggagatgccacttcaaggagaagatgagtctagaagaagctcaccaccatag

SEQ ID NO: 45968 - DNA, 615 bp, Glycine max
  Peptide Sequence Number=SeqID_162746
gccgctacttcgcttgacctaactcaacccgatcttgataatagtggtggcgatgccaatggtaacgacaacggcggtggaggtggaggtggaggtggaggagaaggaggaggtgataatagcaagggcaaggaaggatctgacggtgacaagaggaaaatgcctctattaatgtctcagaaattcattctagcttatgctgcactcgccggagtctgcgagagaaagaagaatggggttaaggccataattgggaaggagaattctgttagagaaggagttgagaatactaacaaaagtcagaatggacacctgtctgaggggattggtcaagaagatcctaacaatcatgaaggagaatgtagatatgaggggcggatcaacaaaatccctacacattacacaagcgcaaaaaaggaagcagaaacagatatgacaccagtgggagaagatgcttacctcgacggtcaacggtggcagtgcaacgaacatggcagtgcaatgaacacggacgaacatggcagtgctcaatgcaactcctcaatgtggtcaaaacacggacaaacatggcagtgcaacgaacacggtagcgaaacaacaagaacaacgacgtag

SEQ ID NO: 45969 - DNA, 306 bp, Glycine max
  Peptide Sequence Number=SeqID_162747
atgacaatgagatcttctttagaaaccttggcaaggtttgaagatctaggaagcaagatgcgaacaataaggaaaagaggtttgtgtaccgtatacgctgttcctatgatgagaacaatgatccagagggaatggagggaggaattggggtttcctgtggcccagaatgccgttgactccgactcgaagtgccattccgcttcttcgatggttctgccatttgagaagttatttcgggatttcaatcggttcaaaagaaagggattgaaaaaagatgaagtttgggctttgtggggagtgatttag

SEQ ID NO: 45970 - DNA, 399 bp, Glycine max
  Peptide Sequence Number=SeqID_162748
atgggctcaaaaatctaccatgaggttcatgagaaccctagggccttcttcagcagttctagtccaatcctcttggagtattctatccaatacccttggggggaaactacaaagaagaagaaagaaatatcaggtgatgaaagtgatgatgaaaaaccccaacaatgtaaaggttcaaggaggaaaacttcaaagaaatccaaaagcaatcttgtcatcaagactgcgaaagcaacctcatctgcaactaaagccaaaaggatcatatctaatgtggcaaagccttcattacataacaaatctgcttccatgacctctggtttgaagcaaagtacttccgcctctaatcccccaaccaaagatacttatccaacaaaggatacaacttcatctaaatga

SEQ ID NO: 45971 - DNA, 303 bp, Glycine max
  Peptide Sequence Number=SeqID_162749
atgttgaacattgtgagtactgttgcaatgccattctactcaaacactgatgtagttgaaaacataaggttggagagtattcctcagtttcaaacaatgcccaagttgggggcaggaccttcgtatcaaggaggccttatgactaacaataaatatagtgacattcctatcaatgtaactattgtgttgaacccattggtgcaaacaactaatgttcatccctcgagtgcagactcaacatggaaattttacacaaaaccttgtagcacttgggggcaccaccaaatgatcaaaacaatgtaa

SEQ ID NO: 45972 - DNA, 250 bp, Glycine max
  Peptide Sequence Number=SeqID_162750
gagcaaaagcctcgcttttgtcgaccgcaccgctttctattaccatgacccaagagttggtagcccgcggagacaccttacggttatccgcacctcgagtgtgattgataagcagaggccaatatggtcatctgcgccctttccggagataggcggcgggcccgatgacacgcggagataccttacggttatccgcacccttgtgtcatccagaggcggcgggcccgatgacatgcagagactgacatag

SEQ ID NO: 45973 - DNA, 318 bp, Glycine max
  Peptide Sequence Number=SeqID_162751
atggaggtagcagatggagtcaggtccaaaacctggaaatgctggtggattgctttaacttggacaatatggcaccatagaaataaggtggtgttccaagatacaacttttcatggaatcaaattgttagaagatgccctattcctactatggtcgtggatcaaagcaatggacaaggattttactcttcattttaaccaatggtcctctaatcttaaggaaggattagaccaaacatacctacgtgaggtggcgaaggagaagaagcacagacttctgacgatgctcgagtgcgacgaacacgatgctcgaccttag

SEQ ID NO: 45974 - DNA, 273 bp, Glycine max
  Peptide Sequence Number=SeqID_162752
atggcccttcgctcaacaaacaagcacaactcatccttcttccagattcttcctcacgctcagccgaggagtgttgcgctcagcggatggctcgctaagccagtagattggctttgcgagaggtcgtattcatcgactaacagtgacccagaagatgttgaggatgcttttttgatagctggctctggtagagccagtgctactcttttgccggaccttcctcctctaccggaggaactcgtcgccttaggtagcatcagtgtttctctgtaa

SEQ ID NO: 45975 - DNA, 483 bp, Glycine max
  Peptide Sequence Number=SeqID_162753
atggacaaggcgcatgtactgagagaagctatcaattacgtgaaacaactacaagaacgtatagaagagctagaagaagatatccgaaagaacggtgtagaatcagcgataaccataataagatctcatctctgcattgatgatgactcgaacactgacgaagaatgctatgggcccaatgaagcacttcctgaagttgaagcaagagtcttaggaaaggaagtgttaatcaaaatttactgtggtaaacaaaagggaattctgcttaaaataatgtctcagctcgaacgtcttcatctctacatatccactagcaatgtcttgccctttgggaatacccttgacatcaccattactgctcagatgggtgacaaatacaacttggtagtgaacgatctagtgaaagaactgagacaagtggctatgatgaatgatctaggtgtttatggaaagcttaaagaaatgtctccgtttctcatgtag

SEQ ID NO: 45976 - DNA, 754 bp, Glycine max
  Peptide Sequence Number=SeqID_162754
atacaagggaggacatgctataatacactggaaagagacgcaccattgctattccctagaagtggaaaccaaaccagtttgggattatgtgggagacaactatgttcatagacttattcagtccaaaactgatgggaagttggttgagctgaacactcggtgtgcacatgcagacaatgaatgtggaagttgcagctgtgaagataatgccatgaatgaggctatacttaataattgtcgcaagattaatttagtagtttgctcaattcctagatttatattgtcgatgagtagaatgaattgcttgctactcaacttaagtgtcctccatttgtcatttaccgtgaacctgccaacattgtcttttgaatccttattacaagaagtaaaagaagaatctgaaagaaaaatttccaaagctgttcagaaggctatcagtcttaaacagcagaagattcagtccaagattgacagatgtaagaaagagaagaaatttctggatgatcttaatgagaatcttgtgaaaaatgaggatatttggaaaacaaagatacttgccattgaagagagggagcttggagatctcatggtttgtcttgagggtgggaagactgtagaacagctgccagtttcagatgagattacagaagggattgtcttggtcaaatcaaaagaatcctcgacaactagtggctctgacctgatttatagaaactacactcgtggattcacagttgacatgttttcactctaa

SEQ ID NO: 45977 - DNA, 1401 bp, Glycine max
  Peptide Sequence Number=SeqID_162755
atgaggcgaaagggtgtgggaacgacgggagtgaagagttggatggtggtgtcggagacagggcatgcgcggcttgaagatgttggaaaacactccataatgcggcgaactgggttgccggcgcgtgaccttagggtcctcgatcccgttctctcgtacccttcttccatcctaggacgcgaaagagctattgttgtcaacttggaacacgtcaaagccatcatcactgcctccgaggtcctcctcatcaactcctccaaccctttctttctttccttccttcaagatcttcacatccgtctttccaatctaaatccctcctcgatgagcaatgacatggatggtggttacgaagaaaaacctctagcgaatgattcccgaaacggttcacctgtgagaatacctgaggactctgatgccgactttcttgtaagagcagatagccttaagagcagtgcagagactggaacaggaacaggaacaggaacaccagctcctaagccgttaccttttgagtttaaagtacttgaggcatgtattgaatctgcttgcaggtgccttgaatctgagtctctttgcatatgcaagggtaagactgcgtacaacatccctcccccataccttccttcccccataccttcgcatagcgaagagcctctggacaatgggacttcaacactggaggtagaggcttacccagctttagatgaattgacctctcaacttagcacactcaatcttgaacgtgttagacaaatcaagagtcgtttggttgcactctccggtcgtgtgcagaaggtagcagatgaactggaacatttgttggacgatgataatgacatggctgaaatgtacttgacggacaagcttaatgctcgtttatgtgatcaaacatcattaaaagaaggctacaattccgaatttgaagataatgatcaaagtgatgaatcaaattcagaaaagtatgacagattcctttgtcctaaacttgacgttgaggaattggagatgcttctagaagcatattttgagcagacaaatggaatcttacaaagattgactagtttgagtgagtacgtggatgacacggaggactacatcaacataatgttggatgataagcaaaacgagcttctgcaggcagcaataatattcgacaccataaacatgatacttaatgccggtattgtggtggtaggattgtttggcatgaatattcagattgacctcttcaatggtcaacctcgtcaattttgggctacaacagggggtacatttggaggatgtctacttctattccttataagtttaataactttcggaatcccggctataaacggggaaaataggaatcacttgcaaccagcatgctacaagttacttattacgcaaggcttttaa

SEQ ID NO: 45978 - DNA, 255 bp, Glycine max
  Peptide Sequence Number=SeqID_162756
atgaaaaaaaccaaaggcaagattacttacgacagcatcggcggtatcgtcgcagcgacaacatcgccatcacgtttcgatgcggcaagcgacgatttgagtgcaagttggtttctgtggaaagtggtgagtgcggagaaaagagaaggtggtggctttgggaagaagtttaggcaccaaagtgctgataaaaaccaaacacggtcagacaaagaacttcgtggacatgaatggcttcaagcatctctccaacag

SEQ ID NO: 45979 - DNA, 300 bp, Glycine max
  Peptide Sequence Number=SeqID_162757
atggttagagaagtgccaacttctacttttgtggcttgctcaattatgaggcctaaggatttttgctctgcactctggcacatgattagaggaagggggaaaggttacaccatgaaaggacatattcatgttgacactaccttcggagcaatgaagttgcccatcagcaaagaaggtgatgtagttccattggagcttttgaatggagaagaagaagagttgagaagatgcgccactttaaaggagaagatgagtcaagaaaaggctcaccaccataggaagccatggataagagcttga

SEQ ID NO: 45980 - DNA, 294 bp, Glycine max
  Peptide Sequence Number=SeqID_162758
atgggaagcccaagtgcaggctatgtacttggacagttgattggggcaagagatgaatctaaaggattggatgaaggaggagacacgggtttgggtcaatattgttgctgctggtgcaacaaagggaataggggaaacaatctggggtgggagttttgtgggcagagtagcattgttctcagccgaaggagagaagaaagggctggtttcaaaccttttgtaggcgaagttccacgttgcttgcctcaattcttcaactggagcttatataatatgttgtgcaacttcacttaa

SEQ ID NO: 45981 - DNA, 513 bp, Glycine max
  Peptide Sequence Number=SeqID_162759
atggatggattgagcaagaagctcttcaagaagattgagtttcaactactctggtcaatgcataaaaatgctatggaattggatctggtggaacttacactttctagaggttctatagttgaagctactaagttggatcaggtggaacttacacttcctagaggttctacatttgaagctactaagttggatcaggtggaacttacacttcctagaggttctacagctgaagctactaagattaaaagacatgccttttttggcccattgacaagtaatcaattgttctatggacctaccaagctagtctcagtagaaagtgttcaattgttctatggacctcttttactgactccaatccttaagcctccaacatcatctccaaaagtatcacctagtgcttctcctactcttgtgatttcacccaaaataagtgagctttatgaaattcctagacctccaagtagtttcccctccaattcaaggcttttaggttctcctaattggaggtaa

SEQ ID NO: 45982 - DNA, 486 bp, Glycine max
  Peptide Sequence Number=SeqID_162760
atgttgggattatacactcatttctcttcaaaaatgattgaaaattgcgtgaacatggtacctaatgcattgttaactaggaaaggatggttcttcgggcgtctcataggaggtgcaagagcagatgaaggccgacatggaggccatgaaagggtagatgaccacaatgtggaggccttgatgagtataggaaggatgatggaggtcaatacgactacagttgttgccgcaagtactgccacagaggtggacccgactcacccacctggctttaatcaagtaaatcatctagcctcgcatatggttcagaacaagcattccttcccaccatgtggattgcctcccaactatacaccacccaatgttgtacatgctccggatgagaatgtcggcaactccgcacccatacccattgagagccaacaacccccatctgatcatgcatatgtctctcaacccacggaggagacacatgaagtaccctga

SEQ ID NO: 45983 - DNA, 408 bp, Glycine max
  Peptide Sequence Number=SeqID_162761
atggatgagtggagttcgaccttgggtcatggttcggtgtatggattccttgagcctcagtccatacacaatgcaaaggatagacgtgttgaatgtcaacattacattgaaacatgggttaaggaatcccaacgaaaggtctacttaggagcttacctgaatcaccaagaatcactcaatgttttggtcaagaaaaaaagctacaaaggaagggagcaaaagggtcattttgtggatttttctagaccccggctggcccatgctagcatctggctcgcctgggccaccaaaagccttcagccacgttgggggagggctttaagggttcaacaagtttgggatagaggaaaaaacgtaggaagaggaagagaagaagaaaaacgaagccaaggcacagtcaaatcgtga

SEQ ID NO: 45984 - DNA, 519 bp, Glycine max
  Peptide Sequence Number=SeqID_162762
atggagcattgtctacgtgtttctaagtttagcaagtgcctcgttattggaaagaggcatgtcgagtgggaacatggttgtgaagcttcatcacaaccttatgatgcaatcctccctaggaagggaccagtcactagagccatgggcaagaggctccaagaggattgggctagagctgctgaagaaggccctagggctctcatgaacctcagggaatccattgatgaagaagatcctaggcctacaagctccaatggagcttacatcaccttatctttgttgttgaagatcttattatgggtttttaggggtgactttcccaagttgggtcatggtgatcatagtgacttgctcgttgatcatcccgttgtgattaatggagcaaccaaggaaatgggaaaggcagcagtagtggcagtgactaaggcatgtagaatggaggtagcaggagcggcagtaggaattgtagttgatttcaccaacccttcctttgtatatgacaacgtgaaacaggtttga

SEQ ID NO: 45985 - DNA, 162 bp, Glycine max
  Peptide Sequence Number=SeqID_162763
atgaccacaaagataggccaaatgagtgtgactaagggaattgcggggatggggtggtacagacatacatggagtagctggaagaatgtcaaggggccaaaaatgtcaagggtactagtaagacacaggagattgaagacatcaagaactgcatacgtgtga

SEQ ID NO: 45986 - DNA, 414 bp, Glycine max
  Peptide Sequence Number=SeqID_162764
atggtggaaagggaaaaatttgatcatataggggaaaggctgagggtcattgaaggaggcagaaattatgcctttgctgacatggtagagttgtgcctagtgcctgacgtggtcattcctctgaagttcaaggtgccggatttcgataagtacaaagggactacttgccccaagaattacctgaagatgtactgtaggaaaatgggggcatacgcgaaagatgaaaaattgttgatgcatttcttcctagaatgtcttattggggtagccatcacttggtatactaatctagaatcttcccaggtccattcctggaaagacctaatggttgtcttcattaggcaatatcagtacaattctgatatggctctagatagaatgcagctacagaacatgtgtaagagggaacattaa

SEQ ID NO: 45987 - DNA, 453 bp, Glycine max
  Peptide Sequence Number=SeqID_162765
atgtatcaatcatgtctaacccaaagtcaagcttcaaaacacagcaacacaaaatctaggtgtccaaaacccctcaatttaatggattttctaggtttgagaagtgaaattgaggatgagcacagcccaagctttctcataagtcctaaaagacattttgagctaggattaactcactctaacctccaaataccacagaatccagatttaaccttccaaccctcaaggtctcactctttttccactcacaacaccatactctcaccttctaaccctagaaacctagcaagactacccatcatatctcccaaaaccccatacccacgaaaatcaaaggagaaagaagtccacccaaacctgaaatttcgaagtcccacacgtagagacgagcttcacgactccgaaaatgccctcctttcgcgatttggagcagaaatgggcaccaaaggttga

SEQ ID NO: 45988 - DNA, 1113 bp, Glycine max
  Peptide Sequence Number=SeqID_162766
atgggttacgtgggagtacgtgagctcagttggaggtgggcaacaggggatggtgggtttatgcgcgctttgtggatgtggaaaactcgttgtgcaccatcgcctgaccgccacctagtaccacatgtgatggagtggtacctggagatatgtcgcgggggtcaggagaccttgggaacgtcaggtggggtgctattgcccaaaaccaagcttgaccaatcccgacccaacccgggcatagtcagtcagtcagaacctgtgatgtacctaaacaggcgagctcctggcagccaacagataaaaggaacaaagaccacaaagcaaggaggcttgcttgaaaacgaggttgtggaggcctctggtaatcgattaccagtctgtgtaatcgattacacagaggaatgggtcactggtaatcgattaccagggatgaaaagccttgagataccccttttacttgcatgtagtggtcatgagacgcattgtgttgcggttggagatggagtgcctagagggagcttgggagaccctcgaaggcaacacgagcgtactgtggagtggatactacccacgcctacaccataccgtctagtggagccagtccaagtgatcgaggtgacgtcatccgaggaagaccctgaggaggatcccgaggagctacctcctgagcctgctgtgtatgctcttgactttctagagggtgatgaggacccacttcctgaggtggattctcccgaggaagtcatgtcgggatctgaggcagactctacggaggatagtggcccgagggagatggcgaccagggaagaacatgttgtagatgtcgactatggggttgtatgtgcaagggtgagtgctgaaaaggtttatgatggtgacgctcaagtccagttgccgatgaagcctgatattcatttcaaagctgcaattaacaatgcaatgaagacattaaagactactttggatggtaaaactgaccaagctgcacctcagtggattatggataagtgttttttgtgtgaccaagctgcccattttgcaagtcactgtcaagttgaggatttggatagccctgatgatagcctaattcacatcaacaagtatgaggtttga

SEQ ID NO: 45989 - DNA, 534 bp, Glycine max
  Peptide Sequence Number=SeqID_162767
atgacaatagtctttcacactgagctggttgatgtagacatcagacatgatatagaagacattattcacaatcttgggcaaaacgattttcagcaagcacatgcaactttgtatgagaaaatagaaaatgattcaaagaagcctttgtattcagggtgcattactttcacaaggttgttaagggtgttggctttggtcaacttgaaggcaagatttgggtggagtatcaaaagcttcactgaattgcttgtgttattgaagaaggtgcttcctgaaaataacatgttgctaaaaaatcactatgaggcaaagaagattttatgtcctataggaatgaagtaccagaaaatatatgcatgtactaatgattacatattgtacagaaatcagtttatcaaaatgcgcaagtgccctacatgtggtgtatcacattacaaagtgaaggataagaaatgcagtgatgatgcaaccacaaacaacagtcgtccagtaaagctggtccaagacagcaaagaaatgatattgatgacttaa

SEQ ID NO: 45990 - DNA, 1821 bp, Glycine max
  Peptide Sequence Number=SeqID_162768
atggccaccaacctaattttatgcttgtctagatataatcaatttttgtcccccacaccaacactaattagtagtactagatttccacaaagtaagaacttcccgcaaaaaacatctcttgccaatctcaaacctcagcgacttatttgtgcagtgagctctcagtttacccaaataacagacgatgatagtcgacgttcagctaattaccaaccaaacctctggaattttgaatttctgccgccgtctctggaaaatgaccataaggtggaaaaactggaagagagagcaaaaaaggtggaggaggaggtgcgtaaggtgatcaacggaatagacacaaaaccactattactggaattgattgatgatgtccagcacctgggattgacgtacaagtttgagaaggacataatcaaagcccttgagaagattgtttccttggatgagaatgaggaacacaaaagtgagctttattatactgctcttagcttccgtttacttagacaacatggctttgaggtctcccaagatgtatttaagagattcaaggacaaggaaggaggtttcagtggtgaacttaaaggtgatgtgcaagggttgctgagtctatatgaagcatcctaccttggctttgagggagacaatctcttggacgaggcaagggccttttcaacaacacatctcaagaacaatctaaaacaaggaataaacaccaaagaggcagaacaagttaatcatgcactggaacttccctatcacagaagattgcaaagactggaagcacgatggtaccttgaaaaatatgaaccaaaggaaccccaccatcagttacttctcgaacttgcaaagctagatttcaatatggtgcaattattgcaccagaaagagctgcaagaactgtcaagatggtggagtgagatgggattagcaagcaagctggagtttgcccgagacagattaatggaggtgtatttctgggcactcggaatggcacctgatcctcaattcagagaatgtcgtaaagctgtcactaaaatgtttggactagtcaccatcatcgatgatgtgtatgacatctatggtaccttggacgagctacaactcttcaccgatgctgttgagagatgggacgtgaatgtcgtaaatacactaccagactacatgaagttgtgctatttagcactctataacacggtcaatgacacagcttatagcatccttaaagaaaagggacgtaacaacctttcctatttgaaaaaatcttggtgtgagttgtgcaaagcattcctccaagaagcaaaatggtcaaacaacaaaattgttccggcattcagcaagtacctagaaaatgcatcggtgtcctcttccggcgtggctttgcttgctccttcctatttttcagtgtgccaagaacaggacatctcattctcagacaaaactcttcattatttaactaatttcggtggccttgtgcgctcttcatgcaccattttcaggctttgcaatgacctaactacctcggcggctgagctagagaggggtgaaacaacaaattcaataatgtcctacatgcatgagaatggcacttctgaggagcatgcatgtgaggagttgagaaatttgatcgacatagagtggaagaagatgaaccgacagcgagtttcggattctacactcccaaaagctttcagggaaatagctatgaacatggctcgggtttcccataacacgtaccaatatggagatggacttggaaggccagactacaacatagagaacagaatcaagtttctactgatagaccctgttcccattaattaa

SEQ ID NO: 45991 - DNA, 249 bp, Glycine max
  Peptide Sequence Number=SeqID_162769
atggatgagtttgatgcccaaccttctctttttggagggggtggggcctccgcagcccaggagcttaagccagaggagccaacaacaacagaaggggaggttgagctcacccctcctgagcacttttattttgatgcaggtgtacacatgactcaggaggaggagacttccacagaccagctcccaaagccatcccaagtacccatacctaatgatgccataccatctgcaccaacatctgagctatag

SEQ ID NO: 45992 - DNA, 519 bp, Glycine max
  Peptide Sequence Number=SeqID_162770
atgagggttcactgtaatcaagcaagtcgaagacctagcatgatcacagattcacctccactccttatgttctcacgaacccgggtatatggccctttttttcaactcaccgtgtgtgcaaatagtgttggtgtttgtgtgcatcaaatgaataaatatttacctcatgcatacattttaaaacacactaaaagcattaaaagagtttatgtacacaagaagataagaaaaaaagacaaagaaaaagaacaaaagggaagtcatggtaaacaaagcacactgattgattggcctaactctctaacaatagtccccagtggagtcaccaactgtcgcaacctacccttcggcgggagggcgacgcgagactcacggatgcgtcttccacaaaaggaaaatgcgcgtagtcgccaccaacgtttatttgaggaaaacgtcggaaaaaccggaaaaagacgtggtctacgaactttaagtgaaagattcgggagttgtatttacgcacggggaaggtattag

SEQ ID NO: 45993 - DNA, 183 bp, Glycine max
  Peptide Sequence Number=SeqID_162771
atggagagggatggcttagaatctctaattatccatggtcagtgcattgatggtgcccgtgtttcatacatttttctcataaggaggaatacttgtacttgggggcatgtcactcggtttggaactccctcaagactcaggctgatcaccgtggagggggggggagttgcctgtgcacaatag

SEQ ID NO: 45994 - DNA, 489 bp, Glycine max
  Peptide Sequence Number=SeqID_162772
atgggtgactcagagaaatgtaggttgaacgtcgaagaaaatcctcctcgccttgtttccctaggaagactttatgagggatcgagaattgttcacaacatccctttgggcaatgatcaactcaaggttggtgttgaggaagttagagatgcagatgctcatattcctatacccactcaagaggttcagttagttgggcagacacttaacacctttattgcttggctgacacatcttgtgaagcgtttctcagaacagggagttgtgggaccggtgaaacctgcagataggtcagatcatgatgtcgatgatcccctatatctgatgacattgaccatctcacaactttttctaaagtcgttgcaagttatgtgggatgctatcgtgtttgggttgtttgatgacaacttccccttgcatatgattgagacaagtctgcgagcggggaattccgatgtgtatggattcctcgagccacaatccatatag

SEQ ID NO: 45995 - DNA, 249 bp, Glycine max
  Peptide Sequence Number=SeqID_162773
atggattgtgcaaagggacatttatttttctatcactgctatccattatgtcctgaggctgaactgactattggaaccaggagccacacagatcctgatttcctctcaattttgcttcaagatcatgttggtggactagaagttttggtccataatcattggattgatatgccccctatttctggagcactagttgtaaacattggaggtctaccacagttcattccactatgcactgttggagcataa

SEQ ID NO: 45996 - DNA, 447 bp, Glycine max
  Peptide Sequence Number=SeqID_162774
atgcatcctataattgactacacacctctgtcaacaacacttggtacaattctcatcaacacagaggaatacaaaatttcacatcttaggacatccacggtccatcacagacgtgtactatcgcaccaatatttgaatgctaagcatttgttggggttatctagcttgatatggaaatcaaatttctcttcatgtagatggaagcggttaagcatggtattaaattgcacttacggtcgcggtatccttaacattgtgggaaattgcaactcacgtatcaacaattgcggtgttgaaggttgcttgcaagatgcagtatatgaaagcaatacggtgtctctcttccagcatccagtgcaaggttctcactgttatgctagtatcggttctagcattaaggatttcttggtgaagaatcggaattcggagttccaacatacgttatga

SEQ ID NO: 45997 - DNA, 558 bp, Glycine max
  Peptide Sequence Number=SeqID_162775
atgacgccgtttcctccgatgcacgccctttcgaggatgagtcgatgcatgccctttcgaggaggagtcgatggtggccgagcacggcagcgtgacgatagtgacggtgaccatgacgatgacaattgggaaggcatggagagcaccaaattggacgaggcgttcagcgtcgcgacggcgttggtggatgccgccgccaccgtcgatcggctctcacagaaggtaggttgcagcctctgtttcattggaaattttcaggaaacaattggtgcaaggatcatcaacaatctgttgctcaatgttgcaatgtctgagtatgttccagctggggtagatggcaaacgttgtctggaaaatgttgtcaatgaagctgtgttgcttgttgctcatagagaagccaaggaagttagaatctataatggaggatttcattgtgcataccaggttgatcatcatgttacagaaatgattgttggtcaggatcttgttgaatggcaaatccttgttgccattggagaagatcttccgttgagtcaatcacatacctttatcaggtga

SEQ ID NO: 45998 - DNA, 243 bp, Glycine max
  Peptide Sequence Number=SeqID_162776
atggacgaagggtctctagtccaagccctagctgtctaccaagcaagcctggacgacaaattcgatgtagatccaagcgacgacgcttctgacagaggcgcaaaacctattgaagagctcatcaagctacaacttgaacacaaaccggacaatccatttgacattctgagaattcaccctaccattatctgccacaagtgtggcgtccccaaaataatgactggtttaatagtaatggtttaa

SEQ ID NO: 45999 - DNA, 596 bp, Glycine max
  Peptide Sequence Number=SeqID_162777
atgagcaccaaaggttggagctttgttggggtttcaatggagaatggaggagaaggaaaaagcaacgctcccgaatgtcatcatggtcaaaaaggccaacgacaaatggttcgaagtactaagcttcctagacatctactccggatgcacgctccaaatgaggagaaaatgacattcatcactgaggatgccaacttctgctataggattggacaaaacattgaggtctatgtcgatgacatggtcatcaagtttcagagcataactcaacacgtggcagacctagaagaagtcttcaaagagctttgcaaatacgacatgtttctccccaagcttgttgaaaaagcgaagccattctacaaattgcttaagaaaattgagccattcccgtgggatgaaacttgtgaacaagccttcttagtcttgaagaagaccattgccacatcgccagtcctgagtcgacccaggctaggagtacccctactcctatatctttcagtagctgacaaagtcgttagcttagcccttgtacaagagaaatggaagcaccagttccctatctatttcaccagccgcatacttcatgacgccaagaa

SEQ ID NO: 46000 - DNA, 372 bp, Glycine max
  Peptide Sequence Number=SeqID_162778
atgcttgtgtggttggctgtggaaagagtagtacagaatgagttctggcttgtgcggtttgaatgttgttttgcttggatgttgtggaagcttgagaggattgatggggacccggtgttgagagaaacgaggatatgggctacgtgggagtacgtgagctcagatggaggtgggcaacaggggatgagtggtacctggagatatgtcgtgggggtcaggagaccttggggacgtcaggcgagctcctggcagtcaacagataaaaggaaaacaagaccacaaagcaaggaggcttgtggtggctggccagctgaggctaagatggtctctggtaatcgattaccaaggggtgtaatcgattaccaggcttga

SEQ ID NO: 46001 - DNA, 123 bp, Glycine max
  Peptide Sequence Number=SeqID_162779
atgaatcaaaacggcgcgtcaatgcgcacgggaggcaacgggggcggtgttagggcaacacgacggcatggcaggggagtgcgacttatggaggcggtgctagcttgcaagttatacttttaa

SEQ ID NO: 46002 - DNA, 288 bp, Glycine max
  Peptide Sequence Number=SeqID_162780
atggaaggtaaaaaagcgattcagattaaacgtagaattagtttcaatgctttgaaaaaaaaattggagataagatttttagtttctggaaaatatgttgcttttcaaatttgtgatgacgaagatgttgaaaccatactcgaaagttttcaacaacaagatcaaatgtcagatatggaattatacatagaaaaggatgtggctggtggttctatgtttcattctgcaaattctcttacatcatgtggaaataatttatctaataatgaggcgcaaccgccaagaaat

SEQ ID NO: 46003 - DNA, 1474 bp, Glycine max
  Peptide Sequence Number=SeqID_162781
ggaatcggccaagtcctatggcttcggcgtggtctggtcgccgctgtctggcctggatttcagtgccgactactacgacatccgcatcgacaacgaggtgaccagcctcgataccagccgcatcctgcgtgacgaggccgattgccgcctgggccgcacgctgggcggcgaagcgcgcgatatcggttcaccgctgtgccaggacgcgctgtcgcgggtgatccgcaacccgtccaacgcaaccgtgcagccggaccaggtgacccgtgtgctgatcaatccgatcaacgccgcctccgaatcggttcgtggcctggacctgaagggcaactggcgtttcgatgccggccgttatggccgcttcaccacgcgcctggcctacacggtggtgctggagcacaaataccggcagttctccgatgatccggagcgtgacatccgcaattcgctggatgactaccagtggcgcagcaaggccaacggcagcatcacctggaaccagggtgactggaccaccacgctgtacggcaaccgcttcggctcgctgccgaagaccgatggcagtggccgcatcgcgccgtacatgacgtacaacgccagcgtgttccgccagttcggcgagaacctgtcggtgggcgtgatcgtcaacaacctgcgcgacagccgcccgccggcggacaagaacggaggcggctggccgttctacccggtcggcaattacgacccgtacggccgccagtactgggcgaacgaaaggcccggcattgccgggcttttctttgtgcagtgcaccggtgctgccgctgcgcgcgtggcatgctgtggcgatacccggaggatgatgcgcatggatgccagagtgtggagtgtgattgccgtgctggccattgccggttgcagcagcaagcaggcggccagtgtggacgatgctgcggaggcggccagcgccgcgcccgtgccgtctctttccaacgcagtgaccgatgctggatcagcgcgcgtgccaacggcatcgacgcgtgcgacggccgggcaagggcctgcggatctggagggacacttccttgagggcgagcgcttgctgttgactgaaggagcactgtcggcggaaaagagcgacgtgatcctgggctcggacaacgcctttgcgcaggcgatcagccagttcgagcaggatgcggcgggccacccggaagtgcaggacctgacccggctctacaggacggctgcgacccggctcatcggcagcgacggcacgctggtgtcttttgcctgtggctacagcctgtgtgtcggcgagatccgcagccgcaccgatgaggatttcagcgcctggtccgaggcgatcggcatggacaaggcaagtccggtctacagcctgaccacggcaccgatgacgtggggcagggaccagcacggcgggcgtttcgtgttttcggtggacccggccgccaacgccatcacgggtcggtag

SEQ ID NO: 46004 - DNA, 513 bp, Glycine max
  Peptide Sequence Number=SeqID_162782
atgggttttcaccgtggacagcgaaatacccagcttcagggcgatgcgcttattgctggcgccttcgcgcaccaggttgacgatctcttgctctttggcggtcagcatctgcgcctcgccgtcgggcagcagatcgcgcgtcgccagctcgatcagcggcagcaccgcgcgcaggcggccgcgctccacttcggtaaacggcgtatcgcggatcagcgataccccggcgacgatgcgcttgcgctggcggatgaagatctccgtcatgtcgcgcatgtcgttcggcagcataaagtcgtggtaatagcggcggttgccggcgatcgccgccgggctcatgccgaccatggtgatgtcctggcgatggaaattggccggttgcagcgggtctatctgttggaagtggttcagatactgctgatgcgttttatcgggcatgccatacaggatgtcgtgatccggccgcaagtcgcgatcgaccagataaaacaccccggcggacaccgggatcag

SEQ ID NO: 46005 - DNA, 159 bp, Glycine max
  Peptide Sequence Number=SeqID_162783
atggtgattttcagccatggagttatagcgaaagataaaagagaagagcacaatggaagcttccttgggaagctaggggaagaaagcttccttgagaagctagagggggctactcacacctctccaatagctaagctcaccccatgtcaagatgcatga

SEQ ID NO: 46006 - DNA, 375 bp, Glycine max
  Peptide Sequence Number=SeqID_162784
atggaaagcgaaaaggctccggaacgcacacttctaaactccacgggagagagagaaatggaaaaaagcaaaacacgtggaaagcgagaaggctcgagaacgcttccagactccacgggagctagaaaagaggggagaatgaaagatcggagagtggtgagattcaggggagaaagcacgcgtctgagatgtacacagaggtgtcgcaacgtgcccttttgcgggcgagcgaaggcgaggctcacgggtgcgctttccaaaggaggaaagatgcgcggagtcgccaccaacgtttatttgtggaaaacgtcggaaaaaccgaaggaaaccggtcaaaatgaaaattctaagttcgagagttgtatttacgtttga

SEQ ID NO: 46007 - DNA, 649 bp, Glycine max
  Peptide Sequence Number=SeqID_162785
gcatggtgctttgatagtccgtcgcctttgtgttcttttgaatgctgagagagtctaccgtgaactttccacaatattagaaggagaaactgatttggattttgcgtcaattatggttcaggctctgaatttgatcttacttacatcatcagaattatctgagattcgagatcttttgaagcaatcactggtaaatcctgctgggaaggacttgtatgtttctctgtatgcctcttggtgtcattctcctatggcaattataagtctttgctttttagctcagcttcttgaacctggaagatatatttggctattcaaggcattgtatggtcttctgatgttgcttcctcagcaaagtgccgcctttaagatactaaaaacgcgtttaaaagctgtgccatcgtattcattcaatggcgagcagttaaagagaatgccttcaggggattcctaccaatttcataatgtccctgatggatttcgaaccattcaggatggtgacatagccgaagacggtggcagctcacgtaatggaataaattttgctgcaaggctacaacagtttcggcaaatacagcaccagcatcggctgctttccaaaacaggcaaaattgtgcaattcttccacttcattgtcaaaggttgctga

SEQ ID NO: 46008 - DNA, 1653 bp, Glycine max
  Peptide Sequence Number=SeqID_162786
atggactcaaactcaaaggctatgtgcttcgtaacccaccaagccatcttcaacgcggttcgatgtggggaccttgaagggctcaagcagcagctgaaaaacaagggtgctgagggggtttctgaggtcatgtctatgcagaacgatgcaggggaaaccattttgtacatagctgctgagattggtcttcgtgaggtgttcagcttcttgcttggtttatgtgacatggaggtgctgaagatcagggccaaatcggatttgaaccccttgcacgttgcagccaaaggtggccatttcgatattgtaagggaaattttgagtacttggcctgaggtttgtaagttatgcaactcctctaacactagtcccttatatttcgctgctgtccaagatcatttggatgtagtgaacgcaatattggatgttgatgtgagttcaatgatgatagtaaggaaaaatggcaaaactgcattgcacaatgctgcaaggtatggcatccttcgcattgtaaaagcactgattgcccgggatcccggaatagtctgcatcaaagatagaaagggtcaaactgcactgcatatggctgtgaaaggacaaagtacttcagtggtggaggagatattacaagctgaccttacgatattgaatgaacgagataagaagggtaacacagctcttcacatggctaccaggaaatgccgtccacagacagtgtctttgtcctctccccctctccccactggttttaagggtacagggttctacttctactgtatagctatgatagtgagccttttgttaacctacacagctctgaatgtcaatgccatcaataatcagaaggaaacagccttggatttggcagataaactgcgatatggagattcagctttggaaatcaaggaggcccttacagaatgtggtgccaagcatgccaggcatattgggaaagtggatgaaaccatggaactaaaaagagctgtgagtgatataaggcatgaggtgcagtcacagctcatacagaatgaaaaaactcgcaaaagagtttccggtattgctaaggaattgaagaaaattcatagagaggcagttcaaaacaccatcaattctgtcacagtggtagctgtcctatttgggtcaatagctttcatggccttattcagtctacctggtcaataccgaaagaagcaaccagacgctggggaagcaaatatagccaatgatgccgccttcagtgctttctgccttttgaatgctacagctcttttcctttcacttgcagttgttgttgctcaaatcactttggtggcttgggatacaaggtctcaaaggcaggttgtgtcagtgattaacaagctaatgtgggctgcttgtgcctgcacttgtggtacttttcttgctatatcattcgtggttgttggagatgaaacatggctggctattagtgtcacacttttgggggcaccaattctacttggtactctagcatacttgtgctactttgtttttaggcgacgctttggacactgcagtgattcccagagattagtcaagagaccaagtggaagcaaatcattctcatggtcttactcagttaacatatcagatgtggatgattatgattctgatcctatgaagatatatgctctataa

SEQ ID NO: 46009 - DNA, 219 bp, Glycine max
  Peptide Sequence Number=SeqID_162787
atgaggaccactaagggaaaaggaaggagatgcttgccacccagctcgcccaggcgagctaggttgcttcgtccagaagcaaccgccttctggaggaacatcctggatggcccaagtgggcctgaacgtgctacaatgccttctttaacttccggcatgtcacggaatttcacgaattgcctaatgatgggtgccaagtacctcgaagtggtcaaatga

SEQ ID NO: 46010 - DNA, 282 bp, Glycine max
  Peptide Sequence Number=SeqID_162788
atgtttatacctgcatttgcattggttgatggaatgttcattcattcagtttcgtctcttctcagggcatctcaacagtggttgtgggtcttctactactccgcaacacattccgatgaagctgagccacattataggttattgttatttgataccatcctttttagttcagtagctgaagcctcgctcattttggaaccaattcagggacttactaagctcacttggctgcaattgccttctgagatatatatgccgataatgcttgtacacataatttga

SEQ ID NO: 46011 - DNA, 1299 bp, Glycine max
  Peptide Sequence Number=SeqID_162789
aagagcatcacagagcaaatagggattcgtacacaccaggttgcagcaaaagtagatgagtatgcaagaggtattataagtggttcagcctgtacatttgttgaagagcttggcctatactacataggtcctgtggatggtcataaaattgaagatctggtcaccatctttgaaaaggtgaaagcaatgcctgccccaggtccagttctgattcactgtgtcacagaaaaaggcaagggatatcccccagcagaaaaagcatctgataaaatgcacggggttgtcaaatttgacccaaaaacaggcgagcagtttaaggcaaaatcctctacactttcatacacccaatactttgctgagtctttgataaaggaggctgaaaatgacaagaagatagtggccattcacgcagcaatgggtggtggaaccggcttaaattatttccataaaaggtttcccgagcgctgtttcgatgtggggatagctgaacaacatgctgtaacatttgcagctggtttagctgcggaagggctcaagccattttgtgccatttattcatcattcttgcaacgcggatatgatcaggtagtccatgatgttgatcttcaaaagctacctgtccgatttgctttggatagggctggtttagttggagcagatggaccaacccattgtggagcatttgatatcacttacatggcatgcctacccaacatggtggttatggctccttctgatgaagctgaactgatgcacatggttgcgaccgcagcagctatagatgatagaccaagctgctttagatttccaaggggaaacggaatcggagccactctgccactaaataacaaaggaaccccacttgagatcggaaaaggtagaattctggtagaaggcagcagaattgccattttgggatatggttctgtggtccaacaatgcaggcaagcctcagaaatgcttaaagaactcggcgttgatgtgacagttgccgatgctagattttgcaaacctctggatactggtctcattaggctattagctaaagagcatgaaatactcatcacagtggaagagggttctattggtggttttggatcgcatgtttcacaattcttgagcttatctggtatcctagatggacctctaaagtggagagcaatgatgcttcctgataggtacattgagcatggatcaccccaagctcaggttgaagatgcagggctttcatcaaagcacattgcagccacagtcttgtctcttatggaaaggccaaaacaagctcttctgttcaaataa

SEQ ID NO: 46012 - DNA, 816 bp, Glycine max
  Peptide Sequence Number=SeqID_162790
atgtctgtcagtcgcagtgcgatcaagaaagagcccgtggcgcgtagcaccatggagctgcaaccgtttgtctgggaggggaccgacaagcggggcatcaagatgaagggcgagcagttggccaagaacgccaacatgctacgtgccgagctacgtaggcaggggatcaacccgggccaggtcaagccgaagccgaagccgctgttcggcgcggccggcaaggctgtgacctcgaaggatgtcgccttcttcagccgtcagatggcaacgatgatgaaatccggcgtaccgatcgtctcggcgctggagatcatcggcagcggacataagaacccgcgcatgaagaagatggtggatgggatccgcacggacatcgagggcggctcttcactgcatgaagccatcagcaagcatcctgtgcagttcgatgagctctaccgcaacctggtacgagctggtgaaggggcgggcgtgctggaaaccgtactcgataccgtcgcgtcctacaaagagaacattgaaactcttaaaggcaaaatcaagaaggcaatgttctacccggccatggtgctggttgtggcgctcttggtcagctcaatccttctcatctgggtagtgcctcagttcgaggaggtcttcaagagctttggcgccgatctgccagcgttcacccaaatggtagtgaacctgtccaggttcatggtgagttggtggtggctgatgctgattgccctcattggcgcaatcgttggcaccttcatgttctacaagcgctcacccaagatgcagcatacggtcgaccggctaatcctgaag

SEQ ID NO: 46013 - DNA, 1155 bp, Glycine max
  Peptide Sequence Number=SeqID_162791
atgaacaacttcctcactgctcaatatcaccataagaccccttatctaacctctaacaaccattcattagcaattccccttgcactcttttttaactgtagcaatactgacaccaagaagatatcagctgtatctatattttttgaaacaatgccatacagattgaatgagagcactggttatatcgattatgaccaggtaggggaagaggaagtagtaggagaggattggggtcatcaggccatgtggacatgtatgaaaggtgtgtggtcattggagaaaagtgcagtactttttaggccaaaattaatagttgctggtgctagtgcttatgctcgcctttatgattatgcacgtgttcgcaaggtctgtgataagcagaaggcagttctgttggctgatatggcacatatcagtggattggttgctgcagatgttgtaacaaccacaacacataagtcacttcgtggaccacgtggggctatgattttcttcaggaagggtgtgaaagagataaacaaacaagggaaggaagtgttgtatgactatgaagacagaataaatcaggctgtttttcctggacttcaaggtggtccacacaatcacactatttctggcttagcagttgcactgaagcaggctatgacaccagaattcaagaattaccaaaagcaagtacttagcaactgctcagcatttgcacagagtttgttagagaaaggctacgaacttgtatctggtggaactgacaaccatttagtgttagtgaacttaagaaacaagggcattgatggttctagggttgagaaggtactggaagcagttcatatagctgccaataaaaatactgttccaggggatgtgtctgctatggttcctggaggcattcgaatgggaacccctgctctcacatctaggggatttgttgaggaagatttcgaaaaagtagctgaatactttgatgcagctgtcaagttagccttgcagattaaggaaaacaccaatggtacaaagttgaaggattttgtggcagctatgcaatcagatgaacaagttcaatctaagattgctaatctccgtcatgaagtagaggattatgctaagcagtttcccacaattggttttgacatagaaacaatgaagtatggcaaatga

SEQ ID NO: 46014 - DNA, 642 bp, Glycine max
  Peptide Sequence Number=SeqID_162792
gtgcataatgtgtctattgttattgatcaatctttgttcttttcattgacaaaattacccagtgaacgtgttccttttgagggcacccttgttgatgactggaagtttgattattctagtcatgatgctcgtcgtatggtctgcaatgatcaggctgatatgaccggcaaattacttgttgggtcattaacctttgattgccgcatcatgcactatattattgttcgtattttacttccccgttcttctaaccttgctcaagccttcgaggaggatttgattcttatgtgggcttttcttaccggtcgtcagatcgactgggctcacttgattcggtaccggatgcataaggcattacgggccaatgcacctctcccttatcctcacctcgtcactctttttcttcatcatttcaaaattgctttggaagatgaaccatttgttcaagtaaaaaggtcttttgctattggtgttggtgcggttatctcgtttagttaccgtaaggatgatgatggtcagtgggttcggaaacaagacttacctcagccaatccatgacgaacgtactctttctcctccaccgcaaagggttgattcctcttcacttctgaacgatgttctctctgaattccacaatctttga

SEQ ID NO: 46015 - DNA, 987 bp, Glycine max
  Peptide Sequence Number=SeqID_162793
gtgggaaaagccgaactggctgtagagctcttggaagagatgtgttataagggtcttaagcctgatctaattacttgcacttcagtagtggggggcctaagtcgtgaaggaaaggttcatgaagcaatcaaatttttccattacttgaaagggtttggtattaaacccaatgcattcatttataactcaataatgatgggactatgtaaagctcagcaaaccagtcttgccatagattttctggttgatatggtggcaaacggatgtaaacctactgaggcttcctatactactctcataaaaggcattacttatgaaggattagctgaggaagcttcgaagttgtcaaatgaattgtactccagaggacttgtgaagaaaagtttgattgtaaaaggggaatcgaaattgaagcaaggggtggtagtacttgacagacagttgcaaagtaagtgttacccagatgtagttacatgcactgaattgattgatgcagcttgtaaagaaagtggagttggtcaggcaatgaagctgctgattgagatgatgagcaaaggatgcaaacctaatgtgctcgatgtgatttcctatactattatcttgcatagcttgtgtagtggtggaaaatggatggatgctatgaaactattggctagcatgcttcgtaacgggttttcccccaatgttgttactttcaataccttgatcaatttcttgtgcctgaaaggcttactaggtaaagcccttaatgtcttggagatgatgccaaagcatggttgtactcctaatttcagaagttacaatccattgattgaagggttttgtaatgaaaaaagtgctgatagaactattgagtactcgagaataatggttggaaaaacagtgcatgttgtggtactctttgaagagatgtgcagaaaaggtcttgaacttgatataattacttacagtgtaatcattgatgtgcagcaaggctctgaagcctaa

SEQ ID NO: 46016 - DNA, 252 bp, Glycine max
  Peptide Sequence Number=SeqID_162794
atggagaaaagttcatcaactcgtagaacaagcttgctttcgtgttgggggtgtctcaaattgaagcttccttggacaaggagaacaagcacttacaaacccgttggtggttttgggtatgaccctttaagctatgctcaaaacttcgatgagggttgcatggacgacgaggaagacgaacctacttcgcgtcgtagattctctgatagatttgctgcccccgtatcaagttcaactaaaactctcaaataa

SEQ ID NO: 46017 - DNA, 615 bp, Glycine max
  Peptide Sequence Number=SeqID_162795
gatggtattatttactctgaggtgcataatgtgtctattgttattgatcaatctttgttcttttcattgacaaaattacccagtgaacgtgttccttttgagggcacccttgttgatgactggaagtttgattattctagtcatgatgctcgtcgtatggtctgcaatgatcaggctgatatgaccggcaaattacttgttgggtcattaacctttgattgccgcatcatgcactatattattgttcgtattttacttccccgttcttctaaccttgctcaagccttcgaggaggatttgattcttatgtgggcttttcttaccggtcgtcagatcgactgggctcacttgattcggtaccggatgcataaggcattacgggccaatgcacctctcccttatcctcacctcgtcactctttttcttcatcatttcaaaattgctttggaagatgaaccatttgttcaagtaaaaaggtcttttgctattggtgctggtgcggttatctcgtttagttatcgtaaggatgatgatggtcagtgggttcggaaacaagacttacctcagccaatccctgacgaacatactctttctcctccaccggagggggggtga

SEQ ID NO: 46018 - DNA, 279 bp, Glycine max
  Peptide Sequence Number=SeqID_162796
atgaggcaagccaacagtgaaacctgcagtaactgccttaatgatagtcaaaatctaagcatccacgacaacaacacaacaccaagggcaaactttcacatagttacttcactagagggaaaaagcggagagagcgagggttttacttacccggtgggtgaagaggttgctctacgacagaggttgtgcgtcagcttagggagacagcagagggttcaatgttcatatatagcgccaagcctaagtggaatcggtttccgcagtagtgcatctgtgtaa

SEQ ID NO: 46019 - DNA, 1222 bp, Glycine max
  Peptide Sequence Number=SeqID_162797
atggcctgcaaatctcacgtatttggtctgtctggtggggttattgactttagaaaacctaagggcacttggtctagaaagcatttgggcaattgtgtgtttgctgtttcgaaatatgaaaattctggtttgaaaggtaatctgcaacattctgaaagattctctaaaggtgctttaaatggggtcaatacatccttgaattttgaggagtctgagattcatcatctctgcaggttgattagaaatggggaattggaggaaggttctaggtttcttgagtatatgactaacaaaggaaaaatccctgatgttgttgcttgcactgctttaatccgtgagttttgcaagattggtaggactaagaatgcaactcgaatcatgggaattctggaggagtctggagctgttattgatgcaaacagttacaatgttttgattaatgcttattgcaaatcaggggagatagaggaagccttgcgggttttagatcacacgagtgttgctccaaatgctgctacatatgatgcagttttgtgtagtttgtgtgatagagggaaattgaagcaagccatgcaagtacttgacaggcagctgcaaagcaagtgttacccagatgtagttacatgcactgtattgattgatgcaacttgtaaagaaagtggagttggtcaggcaatgaagctgttcaatgagatgaggggaaaaggatgcaaacctgatgtggttacatataatgttcttataaaagggttttgcaaagaaggtaggttggatgaagcaattatatttttaaagaaattgccatcctatggttgtcagtctgatgtgatttctcacaatatgatcttgcgtagcttgtgtagtggtggcagatggatggatgctatgaaactattggctaccatgcttcgtaaggggtgtttcccgagtgttgttactttcaatatcttgatcaatttcttgtgccagaaaggcttactaggtaaagcccttaatgtcttggagatgatgccaaagcatggtcatactcctaattccagaagtttcaatccattgattcaagggttttgtaacagaaaaggtattgatagagcaattgagcacttggaaataatggtatctaggggttgttacccagatatagtgacctataatattttgctaactgcattatgcaaagatgggaaggtggatgatgcagttgtgatactgagccagctaa

SEQ ID NO: 46020 - DNA, 132 bp, Glycine max
  Peptide Sequence Number=SeqID_162798
atgcagtctcatctttgggggtggtgcaaaggacgtggttgcttgcatctcgatggtgggtacaatctcttcattggaggtggcacggaggacatggctacttgtatcggggaagttataagggttgcttga

SEQ ID NO: 46021 - DNA, 573 bp, Glycine max
  Peptide Sequence Number=SeqID_162799
gatggtgtcatttttgcttggagaggaagctctaaagccgattctccttttgaactggttgtgtcactcactggccacactaaagcagtggtttgtctggcggttggatgcaagatgctgtactccgggtccatggaccaaagcataaaggtctgggacatggatacattacagtgtacaatgacactaaatgatcatactgacgtagtcacatcccttatctgttgggatcaatatctgttgtcaagttcatctgaccgcacaattaaggtctgggcttgcattgaagcaggatctttggaaaaagatgtggcattgattgagttatgtcctggtggcctcttcttcactggagatgagagtggtttgctgatggtgtggaaatggttggagaaagatgtggcattgattgagttaggtcctggtggcctcttcttcactggagatgagagtggtttgctgatggtgtggaaatggttggagaaagatgtggcattgattgagttaggtcctggtggcctcttcttcactggagatgagagtggtttgctgatggtgtggaaatggttggag

SEQ ID NO: 46022 - DNA, 831 bp, Glycine max
  Peptide Sequence Number=SeqID_162800
atggcatgggtgacaggagatcctctagggttcatcagtgaatttactgctcagacaaataagtcatccttatcaccatctgcttcaagaggaaatagatgggataatacaactccaatgttgaaaggaaacacatgtcaagaggatgccaccttgggtacctccaaccatttccacaccatcagcaaaccactctcatctccagtgaagaagaggccaccaggacctaactcaatcaatgccacatctttctttgataatgatagaaagaatttgaaaacagacttcattacaaaccatgttacttacaatatgaatttactgctcagacaaataaattcatccttatcaccatctgcttcaagaggaaatagatgggataatacaactccaatgttgaaaggaaacacatgtcaagaggatgccaccttgggtacctccaaccatttccacaccatcagcaaaccactctcatctccagtgaagaagaggccaccaggacctaactcaatcaatgccacatctttctttgataatgatagaaagaatttgaaaacagacttcattacaaaccatgttacttacaatatgaatttactgctcagacaaataaattcatccttatcaccatctgcttcaagaggaaatagatgggataatacaactccaatgttgaaaggaaacacatgtcaagaggatgccaccttgggtacctccaaccatttccacaccatcagcaaaccactctcatctccagtgaagaagaggccaccaggacataactcaatcaatgccacatctttcttggcaaataaacgtcccaaaaagtga

SEQ ID NO: 46023 - DNA, 435 bp, Glycine max
  Peptide Sequence Number=SeqID_162801
atgacgactggagacggcggtggacggacggcggtcgttacccgctctgatgccaagttgattttgaatatgaaaatgatgggggaagaactgtcaggcttgacagtcaaagaattacaaaatttggagaaccaattagaaattagccttcatggtgtccgaatgaaaaaggatcaacttttaatgggtgaaatacaagagctaaatcgaaagggaaacctcatacaccaagaaaatgtggaactgtataagaaggtctatggaacacaagatgataacgaaacaaacagagattctgttctgacaaatggtctaggcataggagaggatttgcaagtgcctgtgaatctccagctaagccagccacagcaacagcaacaacactacaaggcatcttcaggaactacaaaattgggcagattgcaattgcattga

SEQ ID NO: 46024 - DNA, 699 bp, Glycine max
  Peptide Sequence Number=SeqID_162802
gcggaagcggtgcccgcccattcgaggctggcggtgacgccggtcaggcgacggattttcgccgcttccatggcgctgagcgccaccgcgacgtgggctttgcctttaacggcggacagctccagggcattgctgtcaaacgccagccgccagtgggggctttgggtgccgaagtgggcgttaagaagctcagggccttggtctgcgggcatgatgattcctcaaaagagcacgggcggccggctgagcgggagaacatcggatcctgtgatgctggtactgacttcccccgttatcggaaaacggttgatgcaaggttgccgtgcaggcgagtaaattatagcgacaccactgccccggcggcggatgcggcgccgatgaaaatgatgcatcacaagggtgaaggcaaaggcggcccgttcgccgggctgaacctgaccgagcagcagcgccagcagatgcgcgatatcatgaaagagtggcaccagaagcgcgggccgggcatgaaagaggagcgccaggcgctgcacaatctggtcgcttccgacagctttgatgaagcgaaggcgaaggcgcaaattgacgcgattggcaaagcgcaatccgaacgcatgctggagcgcgccaaagcggaaaataaaatgtataacctgctgacccctgagcagaaaaaacaatacaatgagaattatcagaaac

SEQ ID NO: 46025 - DNA, 552 bp, Glycine max
  Peptide Sequence Number=SeqID_162803
atggcgctgtatgacgaaggcgcgtttccttcgatcaccgaactggcggcgtatgcgcaggtatcgcgtgcgaccgcctaccgctactttccgacccagagtgcgctgattagcgccgtggtggcggaaagcctggggcctattctggaatggcgcccgcaagacgatgatgccctgaagcgcatccagcagttgctgaccttcgcctatcctcagatggaacggcacgagggggcgttgcgcgcggcgttgcagctctctttgcagcagtgggcgcacgcgacgccgggcgaaaaattcgtgcgcggcaaccgcaagcgtctgttggcgctggcggtagaaccgctgcagggcaaactgccgccggactctctgcagagagtgattcatgctttctcgctgatttacggctcggaggtgttcctggtgctgaaagatatctgggggctggagcttgagagcattcaggacgtcacgcaatggatggccaaagccatccttcgtcaggcggaagaggacgcgacgaaccgcaaaaaaacatcagcaggataa

SEQ ID NO: 46026 - DNA, 231 bp, Glycine max
  Peptide Sequence Number=SeqID_162804
atggctttgccgaaagcaatgaatcgtgaaaaaacaaaaaaaacaaatatgaatacatctgaataccatggtaagacagcagttacatacaaatctactgagagaaagaagctggaggaaaaaggatacaaaatcattggaaacattggagaccaatggagcgatctattaggaaccaacacaggcgataggacctttaagttgcctgatcccatgtactacattagttga

SEQ ID NO: 46027 - DNA, 201 bp, Glycine max
  Peptide Sequence Number=SeqID_162805
atggaaaaatctgacaagagaaatttcaaagaaaagaaagaaaagaaagcatacatcacttgggaagataatgacatggattcttcaagtgattcaaaaaaggaaatcataaatctgggtctcatggctaaaaactgtgaaagcagagaagagatattatatttgaaaaacaaagatgtgtttcttataaggctgaattag

SEQ ID NO: 46028 - DNA, 279 bp, Glycine max
  Peptide Sequence Number=SeqID_162806
atgaagataaagacaaatcatgaagacaagttatttgaaattgtgtgctcctcgaaaagacaagtaatgaatcatcaaaagcttataggtttcgatcaattgcacaaagatggttatcaacggtttttcgacaaagagcgcaaagatatagccacaacggtagtcatttttcctcggttacgaagatcacacaaatacctttacatcaacatgtcgcacaagggaatgactaccaattacaaggaaaaagtgtatgttcgaacctatactgtaatgtaa

SEQ ID NO: 46029 - DNA, 228 bp, Glycine max
  Peptide Sequence Number=SeqID_162807
atgtctcttctttccctcattatcgtttttcctctcctcctccccaaaactctttctttttcccgcagcccacaaaacctgtctcagaaaaatgatgatctcggactcattcactgttggatcatcgtgaaatttgagtaccacatctgcaacccaattccgagcattgccaccgttgggaatttaaaaatcatgtctgagcttagagaaaaacctttcgcattatag

SEQ ID NO: 46030 - DNA, 252 bp, Glycine max
  Peptide Sequence Number=SeqID_162808
atgaccctttgctcagagcaaatgcacagctcatccttcttccagattcttcctcgcgctcagctgaggagtgttgcactcaacggatggctcgctaagtcagaagattggcttagcgagcggatgaaaatcagcacttcacaaactttcctaattaacctaaaattgagaggaaatgatgaaattaatggtgatgttgagaaagaagaggaagttgttctggatttcacaatccatgactctaatgtttaa

SEQ ID NO: 46031 - DNA, 495 bp, Glycine max
  Peptide Sequence Number=SeqID_162809
atgaatttccataaccccaattattctcttcacctacgccaaccagatgatgagaaccatctcaacctagatcttcttcttgagccatcttcttcttcatcatcttcaccttcacctattagtcccgttgagccacggatattctcatgcaactattgccagagaaagttctatagctctcaagcactagggggtcatcaaaatgctcacaagcttgaaaggacactggccaagaagagcagggaactgagttcaaacatgcaatcttatggatcaccggagcaaagatcaaactttggtgcttcacaccatcttggtcgtgctcttggggttgtggataaccaaggacaaagttatgcgaggcttggtggaagaaaagagttcagttatggttccaaggaaggggtaggggtggcttcttcctggtcaaggggttatacttctgaacatgttcaggaggatatgggccaactggacttgtcgttgaggctttga

SEQ ID NO: 46032 - DNA, 285 bp, Glycine max
  Peptide Sequence Number=SeqID_162810
atggtttcctctgcccttcctaaggctgaccctcctattttcaccaactatgtatatgtttggatcatcagaggggcaatccggatgttagagaagcaacaatacccatgcttctacggcgaagcagcctcagaattcgtgctactgcaagtctaccagagaaccgaacacacgctatgtccctgcccaaaaatctctatgggcaagttggatggggccaactatgacacttgggcttctcacatcaagctttggcttaagggtgaaggctatgttgatcactga

SEQ ID NO: 46033 - DNA, 299 bp, Glycine max
  Peptide Sequence Number=SeqID_162811
atgaggaggccaccagggttgatgaggggcgcggagaaagatactaaattcactattgtagtggaagaaatgcaaggcatgtgtgtcaaaaacgagcaaagaaggttgcaaaaacagaaaaaactcgccgagtactcgaaaaagatcccaggtacgatgaagggaaaggggcacgtgtcgctttttatatggagagatgggaaaggaaggttactaaataaggaatccaccggtcacgaccctgtcaaaaaccctgatatttcgatgccgtttgtccgtgaatctgacactagtgtctc

SEQ ID NO: 46034 - DNA, 264 bp, Glycine max
  Peptide Sequence Number=SeqID_162812
atggggagaggtaagatcgtgataaggaggatcgacaattccacgagcaggcaagtgacgttctcgaagcgaaggaacggtttgctgaagaaggcgaaggagcttgcgatcttgtgcgatgctgaagtcggagttatgatcttctccagcaccggaaaactctacgatttcgccagctccaggagtggtgttttcttcaaagatgccgtggctttagaaattagaacagttgtgttggatgaaaagaataggtgcgtggagtga

SEQ ID NO: 46035 - DNA, 276 bp, Glycine max
  Peptide Sequence Number=SeqID_162813
atgcgattcactcttctatcccgtgcgcctgttccttttctttctgccgccttccttaaattcaaacccgttgcaccttccacagcgactttcactagggtttcttgcatggccgcttcaccttcttccgcggcggttcgcgacggcgctccttctgcttcctctgccattgatttcctctcaatctgccaccgcctcaaggtgcttcttcgtaaaccagctttgtattttgaagttatgtacttattcgtttctcagaaatgccgcagaagttaa

SEQ ID NO: 46036 - DNA, 324 bp, Glycine max
  Peptide Sequence Number=SeqID_162814
atgcctagcaagaaaatgaaggtggaagtggatgctgatggctataactttatcacaaggttgaagaaccttcccatcatcaatgaaaccatttatgaaagggacttccaagatcatgtgatttcggtgatgctcaaaagacagttgttgaaaaaagcacaggctgaagttgctgcgaaggatgtggacaacaacattgttaatgaggtcatcattgatctcactaatactggtgtcttggatgaggacccagaagtgtctaaggcagttaaagatgatggggttatgcacacaagtgaaaaaaaggaacctacatccaagtag

SEQ ID NO: 46037 - DNA, 186 bp, Glycine max
  Peptide Sequence Number=SeqID_162815
atggcattaggggtcatggcagctcgcctaggcgagctgttgcttcaacctgaagtaaccttgcttgcccaggcgagctcaagaggttatgttggcggtggtgaagatggtgatggtggtgtaggttcaacaggggcagctggaacacttattgatggtggttggtcaatagcaagtggttgctaa

SEQ ID NO: 46038 - DNA, 360 bp, Glycine max
  Peptide Sequence Number=SeqID_162816
atggaagctgtttcggatcaagacactagtatatgcacccactgtgatcgggctatccctgctgcaaatattgacttgcattatgctcattgctctcggaagcttgaaaaatgcaaagtttgtggtgacatggttcccagaaaaaatgcggaggatcactatttaagaacccatgcgccgtcagggattcttaactgcctaatattgatgagttcaagcaaaatcaaatttgttggaaactcgtcaagagagaagctgcagattgtagcttttagatttttccttgccattgacgtgaaacaaacgccagatgcacatatgcaagtaactgcaaacacagttagtgatgcggtgtcataa

SEQ ID NO: 46039 - DNA, 425 bp, Glycine max
  Peptide Sequence Number=SeqID_162817
atggtgaccaaaggttggagctttgttggagcttcaatggtggaggaagaagaagggatggcaaccacttgccacttgtcccattttgagtggaacaaaaagggcccacctttttctcttgatgtgacttatgcacagccacaagaagaagggaaaaatctgacctttgaaatgctaaaatcctgcctcggcttgcgtgccatttctctggttccagtccctcgcgtttctctgcacccgtcggggccagtttctgaaaataggcaatatgtatatcaaaacgctcagaatgaaaccccgagcgtggttcagaggatgtcacacatgggctcgaaatctaccctaaggctcatgagaaccctagggccttcccttggatctctagcccaatctacttggagtcttttatccaatgcccttgcagg

SEQ ID NO: 46040 - DNA, 270 bp, Glycine max
  Peptide Sequence Number=SeqID_162818
atggcatcaaagctcttgtgtgattttgggatggaaatgcttagtctcattattccagtccctgccaccaaggcaggatcatttatctccatggctttgaatgtgagagaagctgagagagagcaaggtgctagaagaaggcctccactgccgccgcagaacgacttctcaactaaacgccttcttttcacaatagccatcactggtattgctgtcatactgggatcttttttcctacagaagaaggcagagtccagtgacgtgcattag

SEQ ID NO: 46041 - DNA, 1305 bp, Glycine max
  Peptide Sequence Number=SeqID_162819
atgattcaaacttgcaagttaactctagaaggagctggtggtaagtttagtcatgatatgaaagctattcagcatcaggtctctgaagatcaaaaacttttgagagaaaagttgttgcacttgagtggagttgctggaattgatcgtatggaatatgcattatctgaaacaagatctacatactttggagtgaaggatgatggaagtccagtggggtctccaatgattttgtctatgcccacaagcccaactccactttctactactgccagctcaagtgaaacaaatatttcttatgagagtaatgatagggcaagccgagtagttcgctccctctttaaggaaacaaacacttcccctggagagtctaacttctcttcacccagaacaagttcagatagtcagcttggcacatcttctgagaagttgctagtagagaatgaggttcttgtaaatgaatttcttcacgagcatcactatagtgttatcgatgaatttgatgtctctgatcacattcaaaacaatgttgaggggaaaataaagcagacaatggaaaaggccttttgggatggtatcatggaaaatgaagcaggtgtagtaggccttgcatcattttcttctcatgacatgggaactgtggcatgggtggaatatgtgttgtatatcatttgtaatattggtgtcagtagggaattaagtatatatagatgcggacaaagggcgttggattttcaacgacgctggttgcaacgacgcgtcatgaccaacgtagaaaggtattgggatgttgtttggagtgaagctagaagtataggaacaattgagacatttgaacggattgtgggaacaagttttaatgttgtaagtgaaaatgaggaacaggttgaaatctcattcacaagaaagtggaatccatctctgaagggaaagagagcacctctaaatattgacaaaaggtatgcgatgcttcgtaattccacaggcttctactcttatgccatctttgaacacctaaaggagtggcctgctttcaacatacctcaaataaggattgtttacaagcttcgtaaagacaagtatgggatttatgcctctcccaatgatagatcgaggaaaagaggaaaaaaacaagttcccccggaggctgttttgctcgtcaatcctgtggaaccagagtttaagggagaggtggatgacaagtaccaatactcaagtgagatcaaagatcttatggttcacgggtggataagttcccaatccgaaactgatccagccatggttttgggtaatcatacccagcaatga

SEQ ID NO: 46042 - DNA, 297 bp, Glycine max
  Peptide Sequence Number=SeqID_162820
atgtctcctctctctcttccttctccattccactaccattcatcttccaagaagcaaaggaatttattgatgaagaagatcctaggcctacaagctccaatggagcttacatcactcccattggttttacacttctctagattgataggagatggagggaactacttgtttctttgtcacagatgttgttctatttactctggctttctcaggagtaggagatgtttgcttctaagtattagccttcctcttccttggaacaagtgggacattctcatcatcctcaatctcacttaa

SEQ ID NO: 46043 - DNA, 216 bp, Glycine max
  Peptide Sequence Number=SeqID_162821
atgcccaacattgtgaatttaatgtgtttcaacttcagtttcagcgaggcttgtgcgcttagcaagaatcatgcgctaagcgaggcactcagcccgcttagcgagttgggagaatctggaggagaacatgagaagcatctacacactcaacacgtcttcagctcgctcaacgaggcatttgtctcttcctgtgctaagtgcgcccagctcgcttag

SEQ ID NO: 46044 - DNA, 201 bp, Glycine max
  Peptide Sequence Number=SeqID_162822
atggcgacgttcgaactgtaccgcaggtcgacgatcggaatgtgcctgacggagacgctggacgagatggttcagaacggcactctcagccccgagctcgcgattcaggttctggtccagttcgataagtccatgactgaggctctggaaacacaagttaagagcaaggtctccatcaagttagggttggaagtgacttga

SEQ ID NO: 46045 - DNA, 390 bp, Glycine max
  Peptide Sequence Number=SeqID_162823
atgggacatctccatacatatagattttgcgacaatgtttggaccttcatcttgcaagatgctttgttcaagaacgaagacagccaagagaatgttggacgggtaattaatgatgctatattgagaataccgcttgggaattggatgagtctactctcttcttttaagtgtattctgttctattcttctgtgagtaccagctatgcatccctaaaatttcttatgcacccagcctccacctataaccaccaaacaccattgttgcaaccacccaatgtcacctccacaccacaccaaacccaccattgtgttgccacccaaccaccacaatcgccatgtgatccacgaccttgtgcgaggtcgcatcactcccacatagtcaccaattga

SEQ ID NO: 46046 - DNA, 333 bp, Glycine max
  Peptide Sequence Number=SeqID_162824
atgacccatgccgacatccagtcctcaaacaacctcttgagatttcctttccttgtaaaaatcctttacaagcaaagagccacaaaggatgtaccctcccttgttctctttgaacaaccaagtaaatgtaccctctacttgaagcaaaccacaaaggatgtaccctcccttgtgttcactattacaaccaagaagctagtcgcttcttacacagaattctcagacggaagaaggaaagaagaagaagaagagaaaaacagaaggatagcacagtttttgtttttgcagaattttcctttcttcaaggaaatattgaacaaaaacttagaatga

SEQ ID NO: 46047 - DNA, 159 bp, Glycine max
  Peptide Sequence Number=SeqID_162825
atgggcacttggggcaaaggcaacttgcctaggcgagctggagctagcccaggtgagctagagataaaggtgaggactttgagtcctgtgaaagagaaaggtgaggactttgagtcctgtgaaagtaaaagcaaggactttgagtcttgtgaaagataa

SEQ ID NO: 46048 - DNA, 279 bp, Glycine max
  Peptide Sequence Number=SeqID_162826
atgacccctactcatgatgtcctgctatattacaacgggaggtggaacatgccacgccaacacgactttgtgggatgtaccatcaatggactgaaggatgtgatcaagcaagttgcacctcaagggattcccccttatggtattcatgaatcacaaatggcaagacgattttttttacaaccaggtcattatgagtattcagacaaagttatcaaatttaaaattattgacctgaaaactgacgatgacatgctaaaggtcttagtacggtctaactaa

SEQ ID NO: 46049 - DNA, 242 bp, Glycine max
  Peptide Sequence Number=SeqID_162827
ttgcttcttgtatgcgaggtaattcttcagcaggggatttagctcccctagatttggagattgaagctacttgctggagaaataacgcagaaaggaggagaaaagctttgcaagaaaggacagtacaaccaagtgctgagggaactcattcatctgaatcatcttcagcatttccagcagacttgagggaatccgaagttggtgcatctgaagctcacatcatggcggacgagccaccatag

SEQ ID NO: 46050 - DNA, 303 bp, Glycine max
  Peptide Sequence Number=SeqID_162828
atggagaaagagcttagaatgttggaaatggttttggaagaaagaaggagaagaaatgacatttttcctaagctacttggactacaaggctcaaaacacacaagtgagaaatgctctcgggaatggaaacttcgcgcatactccagacatcttctcaaagatcccaacgatccaacggttaacgaaggctgggaagcgtttttatcgagacagcttcatgtagcttccttgagaagcttcattaagaggcttcctcgtggcttctttgagaagctttctcaagaaacttctttgagaagctaa

SEQ ID NO: 46051 - DNA, 585 bp, Glycine max
  Peptide Sequence Number=SeqID_162829
ggtggacctttgggtactagtaccctcacccttagagggctacacgccctcgccatcagaggactacacgtcctcaccttcagagggctacacgtcctcgtcttcagagggctacacgccctcacctttagaggactacacatcctcacctttagaggactgcacgtcgtcgtcttcaaagggctgtttgccctcgccttcagagggctacatgcccttaccttcagaggactacacgtcctccctttcagagggctacacgccctcgcctttagaggactacatgtcctcaccttcaaagggctgcacgccctcgccatcagtgggctgcacggcctcaccttcagaggactgcatgtcctcaccttcagagggctgcacgccctcgccttccgagggctgcacgccctcgccttcaaaggacgacacgtcctgaactttagagggctgcacgccctcgccttcagagggctgcacaccctcaccttcaaagggcgacacgtcctaaacttcagagggctgcacgcccttgcctttagagggctatgctcctcactttcagtgggctccatatccacaccttaa

SEQ ID NO: 46052 - DNA, 1413 bp, Glycine max
  Peptide Sequence Number=SeqID_162830
atgggttggatagaagcaatttacactcttttaaccaaatcattcaccgtcctttcctggcctccagttagttttctttgtccattgttggtttctgttcgggcaatggagagtgattccaggtccagcaaccagcgatgccttgctttttgggttctgttttccttgtgtatgatcgtggaaggggaactttcagtgttatttaactgcctcccatggtggcctcatgtgaaatccatagcaactatcttgctgttgataccttatgttggtgcagcaccatatgtctataaattcttaaccagacactactgtacttggagcctatttacaaggacatcaaacatctacagtgagaagagcacacatttggaatcagatgaggatagtaaacttgttgatgtctctgaccagaaaacaagtcaaatacaagaaaagaaacttgaagcatatcaaatattggtttcaagtttttaccgcagtatttttatgcctttacagcaaattactgtcaacttcagtgagaagagcagacatttggaatcagatgaggatagtaaactttttgacgtctctgaccagacaattacaacaagtcaaatagaagaaaagaaacttgaagcatatcaggagacagatgataccaccggttgtggcaagacagaaagcagttacacaagtctaactagtaaaaatctaatccagaaggaatggagctgtgcattatgtcagattagtacaaccaatgaaaatttcttaagggcacatcttaaagggaggaaacacaaggataaggaaaatgagcttagagttgagttatcctctactcagaaaagaatcaaagggatggttctactaacgaatctcaaccaaattgcaaacattctcgatccagtttccagatccataagatggtgtgaatggacaaagccagagtttggatggacaaaattaaacactgatggttctattcatagtaacactgctagttttggtgggctgcttcgtgattacaggggtgaaccaatatgtgcttttgtctctaaagctcctcaaggagacattttcttggctgagctgtgggccatgtggagaggccttgttctttccttgggtctagggattaaagcaatatgggtggaatcagactccatgagtgttgtgaagacggttaatagaaagcaattttgtccaaaagctgttggctatttgaagcaaatatggaaactgttaaagaagtttgataaatatcaaatttctcacacatggcgtcaaactaatagagcagcagatcatcttgctaagatggatcttttggcaaatgatgtggttttgtggccagttgattttccacctagcctttgcagtatcattaaagatgatgccaaaggaacgaaatatcttagacgatga

SEQ ID NO: 46053 - DNA, 114 bp, Glycine max
  Peptide Sequence Number=SeqID_162831
atggtgattcaaattgtgatgtgggaactcgacaagttgaagggcgacgagttaatgcgcgacgacttaacgagtattgtgatgggaaccactgtggagacccgacgagtttaa

SEQ ID NO: 46054 - DNA, 204 bp, Glycine max
  Peptide Sequence Number=SeqID_162832
atgaaaaccgcccacaaatgcggctctcgccgaaaacagattttgttctctaacgaatatgactctaaccctaagcgcgtgtctcccacactcgctgctgatgccggaactgtacataggagaggaagagccactggcgcttccggtgtttttctaaaaaaagctgtttcagatgaagcgattagattcttggagatgaactaa

SEQ ID NO: 46055 - DNA, 273 bp, Glycine max
  Peptide Sequence Number=SeqID_162833
atggaggacattctgataaggagacttgtgaaacacggtcgagacgcgatatgtgagagattcactgatgttactagcgattctgtcaagttgactcgcgatacaattgatatacgtgatagacagcaagaagagtgtatttcaccattacaaatagcgaaatacattgtgcctattgtcatgtgtatcatctgtatcgtcagcctccttgatgaaatacaaatagcgaaatacattgtgcctatcgtcagtctccttgacgaaataccttaa

SEQ ID NO: 46056 - DNA, 4757 bp, Glycine max
  Peptide Sequence Number=SeqID_162834
atggggactacagtgcatacagaacttggtgaattaaacctcaacttggctaatgaaaatgaagaatgcttgaaagaaagaatttttggtgctgagtcaaagtctggctacattttgcacattactaaagttagtttggattggggcaaaaaggacttgaaatcctctgaagaaggtgctcctaagtgtgtgctaggtttatctgttaatatgaccagcatgggagtttatctaactttcaagcgagtagaatcattcatatcaactgcaatatcctttcaagttctattcaaaagcctttccgcttcaaagaaaaaaacaacgcaaacccgggctcgatcatcaaaaagttcagggaagggaactcaaatgttgaaattcaatgttgaacagtgttcagtatatgtactgggggagactggaatagaaaatgcagttgttcctgatcccaagcgagtcaattttggttcacaaggtggtagagttataataaatgtgtcagcagatggtaccccgcgcactgcaaacataatctccaccgtttccgatgactaccggaagctaaagtactgtatttctcttgaaatctttcattttaagttgagtgtgaacaaggagaaaagatccaaacaggtagaacttggaagggctagatctatctatcaggaatatatggatgaaaataggccagtatcaaaagtggcattgtttaatatgcaaactattaaatttgtacaacgtttaggcggccttaaagagaatgctgcctgttctcttttcagtgctacagaaattacaatgaggtgggagcctgatgtgcatctatcactaattgaactggttctccagctaaaattagtggtacacaatacgaagcttcaggagcatggtaatgatgaacatgtcgaagacatgtctaatgtaaaagatactaataggaaaaatgaagctactgtggaatcagggcattcagaaaagaagaaagaatctgtttttgctgttgatgtagaaatgttaaatatatctgctgggctgggagatggagttgatgctatggttcaggtgcagtcaattttctctgagaatgctcgtataggagtgctccttgaaggactcatgttttattttaatggggccagaatcatcaagagtagccggatgcaaatttcacgaattcctagtaaatctgctgctagtgcatctgatgcaaaggggcctgtagccacaatatgggattgggtaattcaaggtctggatattcacatttgtttgccattcagattgcaattgcgtgctattgatgatgctctagaggatatgttgcgtgcattgaaacttattgttgctgcaaagaccaatatgatttttcctgtgaagaaagacagttctaaagcgaaaaagcctagttcagtaaaatttggatgcgtaaagcttttcgtacgcaagttaacttttgatattgaagaggaaccaattcagggatggcttgatgaacactaccatttgttgaagaaggaagctggtgaattagctgtccggttaaactttttagatgaatttatatccaaggcaaagcaagatccaaaacctactgatgacaccaataattctcctcaagaaaaaaaggtttattttaatgatgttgaggttgatgtaaacaatccttcgactattgaatcaatgcgagaagaaatttataaaaaatcattccgatcatattaccaggcatgccaaaacctagtgttatctgaagggtcaggtgcttgtattgatgatgactttcaagctggtttcaaacctagtacttcaaggacttctcttctttcaatatctgcattagacttagatgtaagcttgacaaaaattgatggtggagatgatgggatgattgaagttctgaggaagcttgatcctgtttgtcttgaatgtgacataccattttccagactgtatgggtcaaatattctcttaaacacaggttctcttgtggcccagattcgagattacacatatcctctttttgctggaagttctggtaaatgtgaaggtcgtcttgtgatggctcagcaggcaactagctttcagcctcaaatgcttcaagatgtctatgttggggcatggagaaaggtatgcatgcttcgatctgctactggtactactccgccaatgaagacatacacagatttgtccttgcattttcagaaaggcgaagtgtcatttggggtgagttatgaaccagtttttgctgatattagttatgctttcactgtgttgctacggagggctaatctaagtgttataaaccccggcccacttattgtgccaccaaaaaaggagaagagtttgccatggtgggatgacatgagaaattacattcatggaagaatttccttattattttctgaaacaagatggcatattttggcaagtacagatccttatgaaaagcttgataaacttatacttctgactagatctatggaaattcaccagtcagatggtcgcattcttctttccgcgaaagatttcaacatttttttgagcagtttggagagtatggcaaaaaagcgtggttccaaaattccgccgggtgtttctagtgctttttttgaagtcccactttttacacttgaagttgcaatggactgggattgtgactctggcaaaccattgaatcattatttattttcacttccagatgaaggaaaacctcgtgagttcgtatttgatcccttcagatccactgctctttcacttcgatggaacctatcttttagatcccttcctccttcatcagaaaaacaatgtccaccctctgttgcaagagatagtatagaaggatatgctactgtatctcagcctcctcacacttctcagaatgtttcaccggcttccccaacaataaaacttggtgctcatgatctagcatggattacaaaattctggaacttgatgtaccttcccccacataaactgcggatgttttcacgctggcctcgttttggtgttccaagaattatcagatcaggcaatcttgcactagataaagtaatgaccgagtttatgattcgtatagattccacaccgatttgtataaagaacatgcctttacatgatgatgatccagccagaggactgaccttcatgatgacaaagctgaagattgaattatgttttggcaggggtaagcaaaagtttacttttgaaagctaccgtggccttcttgatcttgtttaccaaggtattgaccttcatatgcccaaagttttcctaagtaaagaagactgctgtagtgtttctaagttaattagcatggcaacaaaaagctcacaatctgcatccaaggataacgttccctctgaaaaaggttgcatgacgcagaaaaatcctgatgatggatttattttatcctgtgattacttcagtataagaaaacagtccgcaaaggccgatcctgatactttgggagcctggcgtgaagagggaaaaataaatcctgagaagaccacgtgtgtacagtttgagcgtggtaaacagagcgaaactaatgagcatacgcaatcagacccaagcgacgacgatgatggctacaatgtgcttctatggaatattgaaaacagaaatgctgtttgtttctgggttgctgctctttccaaagccgctgcacctgccaagccttctccttctcggcagtatgcacagagaaaattacatgaggacaacaaaaaggatgatgcagccgaaactaatcaagatgatgatgcatgtcaaacccatcaagatgatggagccaaaatccagcaagatgatgaagctgaatcccatcgagatgatggagctgaaacctgtcaagatgaaggagctgagacacataaagatgaagtttcaacatcccttaacactaacagcatctcggattctccctcttctcaggctgccaagaatcctgaattaccttcatccccaccacatttggataatgcggacaacttgccatctactaaaaatgagaatgctgacgacactgaggaggggattcgacacttcatggttaatattattgaacctcagtttaatcttcactcagaggacgcaaatgacataactcaactccacaaaactggcttgttagaggagaacagtccaagccttataagcactagttatgccatatcttcactcagcctttctggtcagccctccatagctatccctttccaagaccctacaaccaattctagcaggccacaattaaggcgggtcagggtgacaacaattaagggtaggtttctgcttgctgctgtaagtggccgcattttagcccagtcatttcactcagtccttcatgttggttacgagatgattgagcaagctcttagtactacagatgtaaatggtagtgaataccagcctgaaattgcatggaaaagatgggagttatctgttatgttggagcatgtgcaggcccatgttgcaccaacagatgttgatccaggggctggagtgcagtggctaccaaaaattctcagaggctctccaaaagtaatgcgtacaggtgctcttcttgagagagtttttatgccttgtgatatgtactttcagttcacaaggcacaaaggaggcactccagaaatgaagacactttctattgaagatgatgaaatggtcgaagaagaagcagatgaggtggtacctgatggtgttgaagaggtggaacttgaaaaaatcaaccttgaaaagaaagagagggaactaag

SEQ ID NO: 46057 - DNA, 1353 bp, Glycine max
  Peptide Sequence Number=SeqID_162835
atgcatccaaacaatttttcacgaataaatttccaatccacttctggtcctattgaatatgtatctattggtgagattaaactcagcttacgcctttccttgcttgagcatggtgtgggttttagtacttgggatccaaagttgcaactaatagtatgcaacttagaagttgttactaggccttcaaacaaaagttccgagaagaagaagaaaactcgaaaatctagtggccgatcttccggcaagggaaagtggaagactataagcaacattgcacgatatttgtcagtttgtatgacaaatcttgttttgaagacacctaaagctactgttgagattgggaagttgaatgtggatatatctaaagttggtggatccgagtcagatttgttagttagggtacacatattacccattgttgttagtgagcctcaagttagttgtaatcagttgtctgatttaagtggtggagaatgcagtgcttctagccaggcctctattgctacaataaaaaaggctcctgcactttttatttgtgaaaaattctgtgtctcatgtgaatttggccatgatagggaagtgggtatacttataaagagtgtggacatttccattggggaagtcacagtgaatttgaatgaggggttgcttgtgaagaaaaagagttcagtggaatcttcttctggctctgagaaaagtgtagggtcaaatgttgattctatgagcgcaaaagagcctcccaagaagcgggaaaaaattataggctatatttctaagtttcctcaaaaggtcagcttcaatctgccaaagctaaatgtgagttttgtgcatcgtgaacgtggtctctctgttgaaaataacatcatgggcatccaattcaaaagcatcaaatcacgaccctcaaaagatgctggggagagtacacgtcttcattttcaacttgaatttagtgaaattcatcttcttagagaagctggttcttccatcctggagatattgagggtgaatttggtcacttttgtgtatgtcccagtacagacaattatgcctattagagctgacatagaattcaagcttggaggtttacaatgcaacatcgtaataagcagattaaagccttggctgctcctacattcatctaagaagaaaaaaatggttattcgggaagaagctcctgttgtaaaaccaaaaccaacaactgatagtagtaagatcatcgtgtggacatgtaatttctcagctcctaagatgacaataattcttttcaatatggctgattctccactgtatcattggtactgccgggtttataaccttgctgcctctaacaccttaagaaaaagcaaaatgtga

SEQ ID NO: 46058 - DNA, 198 bp, Glycine max
  Peptide Sequence Number=SeqID_162836
atggcaatgcaaaaagctgcacagcagcggttaatggagaaggagaagaacaaaagtccttcttatgctatgcgaatatctatgcaaattaacaaagttgtttggagcatgctccttgatggtaaatcctttgctgaaattgagatcaatgacatgctcatccagtcccctgaaaaatctgtttctgacaaagtatga

SEQ ID NO: 46059 - DNA, 1245 bp, Glycine max
  Peptide Sequence Number=SeqID_162837
atgcttcaagttgatgcgagacagggagctccaaaggatggaagttctccctttgaacttttcaaggtagagatttatccccttaagatccatttgacagaaacgatgtacagaatgatgtgggggtatttcttcccggaagaaaaaaaggagtcacaacgccgacaggaggtttggaaggtttcgacgacagctggtgcaaggcgtttgaaaaaaggttcatcggtcaatgaagcttctgcttcaagtgcaacgaaagagtctgaagccccatccaaatccaccatcactgcaatgctatttccctcaagcaatcagtcttctgctcaagttgattctgcccaagcatccaaaacacaaaatgtcaaagctaaccctggtactggtataacccccgagttgaaaaaggcatcttcttttgataagacagaggaagataccgtggcagaatctgtagccgatgaacttgtctcacaagatgaagcatccaagaataaactaaaagattgcaaaggtgctatgccatctgaagagaagaaatctagaccacaaaaaataatggaatttcacaacatcaaaattagtcaggtggaattgtgtattacctatgaagggtcaagatttgttgtgagtgatatgaaattattgatggatcaatttcaccgagttgagtttaccgggacttggcggagactcttctctcgaattaagaagcacattatatggggagtcctgaaatccgtgactggaatgcagggtaagaaatttaaagacaaaggtcagattcagctccctagtgctggtgctccagaaatggaccttactttgagtgacaatgaaggccaagcaggaaaatctgataagcttccaccagcttggcctaagcgtccaaatgaaggagcaggtgatggatttgtaacatccattaaaggaatatttagtaatcagcgccgcaaggcaaaggcattagtgcacaagacaaagaaaggagaagcagagaatgaaactcaaggggattctggtgaaaatgatggagatcagatcgctccttttgctaggcagctcacgatcacacaagctaaaaagcttattaggaagcacaccaagaagttgcagtctaaagcacaaaaaggttcctcctcacaacaagcagaagcactaccatcatcaaaagaggagaccattacatttgacagtgattcttcaagtggatcctcatctgatgatgaagcttttcatgaatag

SEQ ID NO: 46060 - DNA, 525 bp, Glycine max
  Peptide Sequence Number=SeqID_162838
atggtcttaaaggaggagttagctgcttgctcaagatccaagaggagtttggtccagcacttagaagccacggagcaaagcatgctagctataatagggcagtacaaagaagagttaaaccagtctttgacccatgaacaaaaactagtagaggacttcgcacaagcgtacaccgagaaggaagcaagagggagagtgattgatgcattgcatcaagaagcgaccatgtggatggatagggaactcaccataactaaaaaagcgcaaaggcacccctataacacccgatccagaagtaagatggataacgaagagggagtgcaagaacagatgaaggccgacctatcggccttaaaagatcagatggcttctatcacggaggccatgctaaagattcaaaaaactatagaagataatgctacagcggccgcttccaatacagctaggggaagcggaaccgatgctacagcccgcaataaacttggaccgagacagaaacgcgacgggtttcaatcggaggtataa

SEQ ID NO: 46061 - DNA, 453 bp, Glycine max
  Peptide Sequence Number=SeqID_162839
atgacacggatgagcgttcatgtggctcagttgatcgctgatgccatttataagtccaacagggccctgggatttccggcgttgatcacaggactctgccagtcattcggagtccccgtcatacctagtaaggtaattcggccacccatcacccgagcctttatcgagaagtattgcacacagaggcaggctcagggtgattctccacaagccgcaggcgcgcatcccccacctcaccaggctgacccagctgggtcatttgatacggagcagtatttacggcatgtggttcgccagcaggcggccaaccacagggcacacgtgcagacccatgagtgtctttaccagctaagcctcagcatgcagatccagggcttcgctccttttatgtgccctactccagaccagttcagggcagaggtcgcatggctcggggattggcccaaggcctag

SEQ ID NO: 46062 - DNA, 711 bp, Glycine max
  Peptide Sequence Number=SeqID_162840
atgattatgaggggccaagacatttatagtagccaagatgaggctactgcttcaccttcctttagtgaaagtgaagaagcaaaaggggaagaatttagtgaagaaatctacccccaagaagaaggacaacctttaatggttaaggatgcgtgtaaggaggtaagtgtctcctccaagaggttagctaagaaggaaagtcattttgaaataaagacaaatattaaagaaacttgctctcttagacaacctccacatattctcctttgtaaaaagacacttgctagcattggcacacctcttgagcttgatattattcctcaagtaaagaagttgttggatgagggtttgtttcgtaagagcttaaatccttatgatttgttggttcctaaattagaaatctccaacaagaggcttagccttccattgcaagatagcaactttcagcaccaagaagggatttttagaagggaaacagagtgttttaaaaggctcttgaacgtttcaaattttgaaggttcgcttagcgtgatttgcttgctaagcgcaaggtttcccaacgcgctaagcaggctgagtgcctcgcttagcagatgtcactcgctaagcgaacatggctcgcttagcgagacaccagtagctagccttgtcttcaaatggcctgaaactgaagttgattcactattagttcacaaaattgggaatatctactga

SEQ ID NO: 46063 - DNA, 186 bp, Glycine max
  Peptide Sequence Number=SeqID_162841
atggcgtttgagttagagacaatcatgaacaccatgctcgcaacgaggagcctcccggcgacgagatcgtcgacaatctgcctaagaaccatagtggaggaaggtgacggacatggagaggatattgaagcggccatggaaaatgatggtagcgacagtggcacggcgggagtaaaagaaggttga

SEQ ID NO: 46064 - DNA, 3771 bp, Glycine max
  Peptide Sequence Number=SeqID_162842
atgacggatgatagcatggaaaacgcagaagaagaagtcaacgaagtcacagagaacccaagcacacaagctaacacaggggagtcaagtatacaagctgacacaggggagtctaatacgaaggtgcaaatagcaagtgctggaaccctcgaaaaccagttctgctattttatcccttatcatcttggtgctctggttgattcctccatggctgactctccccttactctcgaagaggccattcgcaagctcactacccatcaaatttcccttgctgagacccttcagaccatggctctgaaacttgatgagctcctccatcgtctccctcctgtgctccctgaccccgtagcttcgtcttccccgacccctgttgctcctcctgccatcacctacaaaatcaaattagatgtaccacgtttcgatggtactgaccccatgggttggatctttaagatcacccagttttttgaatatcatcagaccccagaaaatgagagacttaccgtagcatccttttacatggatggccgagctttgtcttggttccaatggatgaatggtaaccgacagttcacttcatggcaaggcttcctacaggcgcttcaaacccgttttgccctgtcgcagtacgaggatccgacggggacccttttcaaattgacgcagcgtggcacggtggctgaataccttgctgccttcgaagaccttgctaaccgcatgattggactccctcctccctttttacttagcagctttttttcgggcctcacccccgaaatccgccgcgaggttcaggctcaccagcctcttaccctcgttcaagcggcgggcctggctcgcttgcaggaggaaaaaatcatggatgcccctcctcgtcccataccacctgccgtcaagcggttgaccccagaggagattgcaacccgcagggagcgcgggttgtgtttcaattgtgacgagcgataccactgggggcatcgctgctcatctcacatttttctcctcatctctgaggatgatgacccttcatccgttcaaataccccagcccaacccgcaacccgaacccgaaacaccaacacccgacccgatagacccgtacccggcccaaattagctttaactcattagctggaaatgtcacgcctgaaacgttgcgtttcatggggaccatcggaaaccgccatgtggtactgctggttgacggcggtagtactcacaatttcatccaacatcagcttgtttctcaattaagcttgatccctcgcacgactactcctttgtgtgttatggtggggaacgaacaacaattagagtgcaccagtgtctgtgaatccgttccggtcaccatccaagctactgaattcatcgtcgacctccatgttcttcctattgcaggggctaatgtggttctgggcgtccaatggttgaaatcattaggccctgtgctcatggattacaactcattgtgcatgaaatttttccatgcaggtacttttgttgaacttcaaggaggcacagagacaacactgaactccttatcgtcatcccagttccatcgtcttcttcataaccaaccagagagtttatactttcatgttgatgtcctccatgacgacaattctatggtcaattccgacattgaccccgtcattcaggaactcattaatcgctttcatcccctctttcaggcccatgagaagcttccgccggcgagacccacagatcatcgtatccacctagttcctaatgctaccccggtgaatgttagaccgtaccgataccctcattttcaaaagcaggagattgaaactcaggtcaagctcatgcttcaaaaaggcttaattcaacccagcaatagccctttttcctcacccattttacttgtgaagaaacacgatgtgaaggaccgatttctgctacccaccattgatgagctcttggatgagctcgggggtgcacgctgcttttctaaattggatttacttcaggggtatcaccaaattaaaatgcatcccaacgatataccaaaaacggcgttcagaactcatcatggtcattatgagttccgtgttatgccatttgggctctgcaatgccctttcttcattccaagcaaccatgaattcattgttccggccgtatcttcatcgtttcattatagttttctttgacgacattcttatatatagcacaacttttgcagagcatctcactcacctcgaggtcgcctttcaggtattgctaagtcatcaatttgttctgaagctttccaagtgtttctttgcacaagcccaggtagagtacttaggacacatggtatcctttgccggagttcaacccgtgccctccaaaatctctgctattcagcaatggccaatccctcaaacgactcgtgctgttcggagtttcttaggcctcgcaggcttttataggtgcttcatcaagggctatgcatctctcgcagctcccttagtagccctcaccactttagacaagtttcaatggtcagcagaggctcaagctgcttttgataatttgaaatgtgctttatcagaggcccctgtccttgcactgctggattttagcttaccttttacggatttgggtaccccgaggatttccgatgatacccactttgatcacgaaggtcttcgagatgacgtcactcgatttgtttctcagtgccttccctgccaacaaacgaagtatgaaacgaagagaagcgcaggtttattatgctccttgccggtaccccaccgtccctgggaagacctttctctcgatttcattgccggacttcctctataccatggcaatactatgattctggttgttgttgatcgtttttctaaaggaattcacttgggaatgcttcctttgtcccacaaagctcacacagtggccactttcttcatggatttagttggtaaaatccatgggcttccccagagcttggtctccgatagggatcccctatttgtcagccaattttggcaggagttattccggtataatgggacgcagctccgaatgagctccgcttaccatccacagagtgatggtcaaacggagatcatgaacagggtaattgagcaatatttaagggctttcgtgcacaacaaaccgcgaacttggggaaaactcctcctatgggttgaatggtgtcacaacactgcgtggaatgccgccattggttcgaccccgtatgaaatcacattcgggcgaaaaccattcaattttcctgattacttgatgggatcctctaagatagacgcggtggaagacatgagtaaggaaagggaagaaacatttcgcgccctcaggaagaagcttctaaaagctcagggagctatgaaaaagtcagccgacaacaagcgccgggaagtaattgagagaattggacctgtggcctatcatttaaaattgccggagcaagctcgcattcatcctgtttttcactgctcactcctgaagccatttcacggcgacccaacctctccagggaccaatgaagccacccaattgcctagtcaatacttccagaatcaaccccttataattccgttagcaattctgagtcacagaaggaatcctcagacgggggaatgggaagtcttggtgcaatgggaaggactttcgccggacgagacttcgtgggaagattggaattctctaaggcaagaatatcaccttgaggacaaggtgcaaatagcaagtaaattcaagaggaaggttatgaggcctgcttacctcaaggatttcgtgtga

SEQ ID NO: 46065 - DNA, 411 bp, Glycine max
  Peptide Sequence Number=SeqID_162843
atggatgtgggagggaaaagagatggtaattgcagtgcattttgggatcaaaattgttattttatgtggttgtggagaaacaagcatgagcacaaagatgatttcattagacctttgaagccttgggaagtcattttgaaggcttgtgatgagtattctaatggtgttgttgttcatgtcatggcttcagggaatactagttcggaagttatgattgtcaacaccgatggtgctgctagagggcaaggcaggtgggcaactagtggtggtcctatcagggttaatgatggccgttggatttgtggttttgctaagaaaattggcagtaccacagcctatgttgctgagttgtgggaagtttcagaagggctcagattagctcattccaggggtgtgaagttcattaattga

SEQ ID NO: 46066 - DNA, 432 bp, Glycine max
  Peptide Sequence Number=SeqID_162844
atgcacgtatttatatctggttggaacttatttgacaagtacgttattgtagacctattagctgagctagctcgaagggaaaaggaagctggaatatttccagaggcagaacttgaccttttcatgaagatattggggcttgatatttgcaaagataccattgtgggtgatgaaatgcagagaggtgtatctggtggccaaaacaagcgtgtaaccacagtcaggacactgcattttgatacctgtggaactgcaaagagtacttggataaggtacacacatttggcagttcgcattatcctgacaactgataatgatccactaggtcaagctttagcggaagagctggcacggtgccttaggcgagaaaggttgtatatcctgtcattgattttctatgttaaacagtctggaatagaggctgcaaggtag

SEQ ID NO: 46067 - DNA, 567 bp, Glycine max
  Peptide Sequence Number=SeqID_162845
atgttgttgccattccaccatccaccttgccacagaagtacaaagatccttgcacttttactattgcttacaccattggagatttgcactttcactaatgccatacttgaccttggagcctcaattaatgtcatgcccacatctgtttacagatcactgcatcttggtgacttaaaacccacgggtgttgtcatccatctagccaatcggagtgatgtgattccacttggagttattgaagacgtgctggttgcaggttctgatcctcctatttctcttccacaatctttcaaccttactttttccttccaccattcagccactgtcgcaacgtgcccttttgcgggcgagcgaaggcgaggctcacgggtgcgctttcccaaggaggaaagatgcgcggagtcgccaccaacgtttatttgtggaaaacgtcgggaaaaccgaaggaaaccggtcaaaacaaaaattctaagttcgggagttgtatttacgcttgaggaaggtcgacaaaaatggggcttttgctcctacgtaccctccatcgaagaggaaatcagacctacgtag

SEQ ID NO: 46068 - DNA, 348 bp, Glycine max
  Peptide Sequence Number=SeqID_162846
atgttgaaagcgttaaagaatcttgagtctatgtctcttgaggaacttgttggtcttagaagaaaaaattctttggctctcagtagcctaaagaacaagaaagaaccattgaccagagaacaagtacggagaagctcctccaaagcacttaaagtcaacgattcatctgatgatgaatttgaagaagactcagataaggatgagctcaccttcatttctcgcaaaatccacaagatgtggagaaacaaaaatgggtctaagtggagaagctcttcaagaaggatgccctgggacaagaaggacaaagacaaaagctccatagtctggctatgggtgcaaagagcctag

SEQ ID NO: 46069 - DNA, 645 bp, Glycine max
  Peptide Sequence Number=SeqID_162847
atgtatgaaaggagaaatggccaaccatctacaaatctttcatggtccaccaggctgagaatcgccaaaggaacagcgaggggcctggcctatctccacgaatgcagtccaagaaaattcgtccatggcgacatcaagccctccaacatcctgctagacaacgactttcaaccctacatatccgattttggcctcaaccgtctaatcagcatcaccggcaacaacccctccaccggtggattcatgggtggagctcttccttacatgaactcatcacagaaagagagaaccaacaattacaaagcccccgaggctcgagtccctggctgcagaaccacccagaaatgggatgtgtattcgtttggagttgtcctgcttgaaatactaactgggaggtcaccagagtcatctcccaccacatcaacttccatggaagtccctgacttggtaaggtgggttagaaaaggattcgatcaagaaagcccattatccgaaatggttgatccatctctgctccaagaagtgcgcgtcaagaaagaggttctggctgtgtttcatgttgcactgtcttgcactgaggaagatccagaggctcggcctaggatgaaaactgtctgcgaaaatcttgataagattggaacgtaa

SEQ ID NO: 46070 - DNA, 189 bp, Glycine max
  Peptide Sequence Number=SeqID_162848
atggcagaaatcaaccaaggtaagacgatgaccggtcacgattggctgcatagtatttgtctcttacttgcaggttcaagtgggcaaacgttaacccataaggaaggaggagacatggttaatgttcccctaaaaaaaaaatggcaggttagctcgcctgggcgagcaacccctgcacccaaattataa

SEQ ID NO: 46071 - DNA, 357 bp, Glycine max
  Peptide Sequence Number=SeqID_162849
atgaaagggagtgaagaggagctgagggaaggagaaggacaagacagcaatttgattcaggaaaagggaaaattgaaaagtgaccaggttgatgtatttaaagtttcaatgttacttcacatcaaatccttacccctcccaacaattgttggaaatcaccttggcaacagcattaaccctccaccttcttctctggtgagaaagagaatgagagaacaacttagtcatgcatttcttctccaacttctttgtgcactctttctttctccctgcctatcaccgctcttctctcctaaaagccttcatcactttctcatcattggtggacttcttctttctacggtggccgccaactaa

SEQ ID NO: 46072 - DNA, 300 bp, Glycine max
  Peptide Sequence Number=SeqID_162850
atgccctttttgacttccggaatgttgtggaacttcacggattacctaatgatgggtgttaagtacctcgaggcggtcaagcgaaggttgcatgccaccaaacaatggtccccggacgaaattagggctaaaggcccaagtggagaaggacgaaggcccaagtggagaaggacgaaggcccaagtggagaaggacaaagcccccgagtggagaaggatgaaggcccaagtggagaaggataaaggcccagaggcagagacattatcaagactattaattgttgttgaaggcccagattaa

SEQ ID NO: 46073 - DNA, 234 bp, Glycine max
  Peptide Sequence Number=SeqID_162851
atggctatcacattggaaattgatctcaacacgacgatgcggaaggaatttcagacaaggaacaaaaactgccgcaaaatgcgaaaatcagcgcctcacctcccaatttctgtgctgaactgcatgacaaaaagtaacgcgcttttctccatttactatcaaacaaccctaccttctaatttctcacctctcacccctattccctatcaaattgatctctgccaaatgagctga

SEQ ID NO: 46074 - DNA, 318 bp, Glycine max
  Peptide Sequence Number=SeqID_162852
atgacaatgttaaatgctattcgtaaaaagatccctccaaccaaaacaagggataaacagagaaggaagggagtaggacaactagaagccaaatcagcaaatctcaactatagattcctatccatctctagccacggcctccgcggtcactctccccgtcgcgctacggatgagagggctgaggtgatgcgagggagaggcatgctccatgtggacagcggcgccgacacatgcccaccagattttggggtcgacgcggttgggctgcagtggagacatgagggggaattgaagtatagagaagagattgagatatga

SEQ ID NO: 46075 - DNA, 216 bp, Glycine max
  Peptide Sequence Number=SeqID_162853
atgaatctcactgccttgagaagacattggttaacgatgaacagagttcggcgcctcaaagcggagttgtttggcatcttcaatggtcttaagattgcaaagtctgctgatttttgcactgttatttatgagacagattctcaaattgccttgcaaatcaacatgcaccaatcatctcttctattcagtcctttcctgaccacgactgggatttaa

SEQ ID NO: 46076 - DNA, 217 bp, Glycine max
  Peptide Sequence Number=SeqID_162854
atggcagaacatgccattgttgaagactgcggagttcaacgtgacgaagtagttgtcgctgttgggcatgaccttagctatgtacttcctaaccaagttggggtacagtttgatagcctcggagatggagcaaaagatgaccccgacctttttaagggtttctttaaaggtggtggcgatggagatgctgtggaagacgcagcttacggcaaagttg

SEQ ID NO: 46077 - DNA, 429 bp, Glycine max
  Peptide Sequence Number=SeqID_162855
atgatgcataaagggaacaacaccaggagtaggactgtggcaaagggtatttgtgctgggagttctaagaactattacaaagggcttgttcaggttcactctaaagtcaagaatttaactaactccttgcaatgtgactctgcttattggggacaatgcaactgccaatacctatccttacatccagaggagaggagtctcgtggtgaaaaatccaacagcaagaattgaacatatgcatgatactactacatccaaacttggacaagatcaattattttactttcaacaaagggggatagactctgaagcaggattgactgctgtgatcaaaggattttgccatgctgtcttagacgaacttcataacaaacttaaatctgaggccgcagaaatcgtgaagtccaagttggtgtggtcagtaggttaa

SEQ ID NO: 46078 - DNA, 555 bp, Glycine max
  Peptide Sequence Number=SeqID_162856
atgtcctctcattctagccaccaaaccaccatggaccgccttgaagaggctgtgtaccacctcacccagaacctatccaccatgaccaccaagattttggagatgaatgccaagctcgatgtcatccttgaccgcctatccgctttcacacccactccattccctcccaaatcacccccacctgtggagaccataataatggaaccacagaacatagacatcaacctctcccgtcttagcttcgatttcaccaccaccacgttccacgttgacaacacatctttgcaaccagtggacaccatgaagtcaccgccaacagatgattcgcgaaggtcacctaaggcttccgcaacaccaacggcaagagaaaaggatgtgagatggcagttggaaggtgacttgaatgccaccatacaaaatgttttccaatacaagatttcggcaaatgcaagttgtgtatcaagacttgaacttgactgtgacccactactacaaaggatatggcacggctcactgccgatcccagacttgtgcttcagtaacttgacaccttga

SEQ ID NO: 46079 - DNA, 534 bp, Glycine max
  Peptide Sequence Number=SeqID_162857
atgttcttttctatccagcctgaatccgagactttgattttgcaaactgcaactttgcctcccgttccaacaagtacaccacagccaccagagtttaaggttagggcccatcacaatccagttacaacttcaatagcttcaacagaggtgtctcataaggtatcttttagaaacaacgcaccttcatggaagcatcatattcttgaagcaaaaacacctttactccaaacgtcactaagagcccgcccacccaaagtgaaaacctcattagaattagagcaagaggagcttaagaagatccctaatgtcaaggcaagacctctaaataagaaggattttgagagaaatttggctttggtatacaaagagggagcagaacacataaccacaaatattgagaccttcgaggaaagagatagaaaacaaagtggaagaaacaagggaatgagaggggagggagaaaaacatagtttcttacaaaaggccttcatgaaaagaattggccaatctcattcaacagacaagaggaagtag

SEQ ID NO: 46080 - DNA, 186 bp, Glycine max
  Peptide Sequence Number=SeqID_162858
atgaatggtcaagcaaagatttctgaatatttgaacatcaagtccgggaccatggcatttcgccattgctgttggcgagaccgggacagcagtaccctcgtccacgtagcacggatatcgccaatagaggctatgaaaccagcatggatttcgccaatagagcctgcaaaaccagcatggaattga

SEQ ID NO: 46081 - DNA, 150 bp, Glycine max
  Peptide Sequence Number=SeqID_162859
atggtggaggaggaagagaatttaattgaagctaggatgaaggaagaggaggtgcagtgtgaggaggcacctgaccttaatggcacacagtttaacaaattggatgagcttttgactcaaaccaaactgatagctgtggggttaacttga

SEQ ID NO: 46082 - DNA, 426 bp, Glycine max
  Peptide Sequence Number=SeqID_162860
atggacatagactatgttataaggaaagacgaaccacctacaatcactgatgaaagtagcccagctgatgttgcactatataagcagtgggagcgatccaaccggctcaacgtgatgttcattaagatcaaaatctcggctgggatacgtggttctattgaccagcatgaaaaggaagaagaaaggcttgtaatggagatgggtgagagtgcattgttgacaactgcttatgggaagaacaaagcaactaaggctcaagctaatcagaaggggaatggtaaaataccacctcaagttgatattaagaaggtggcaaagtgtttcttttgcaagaagaagggacacatgaagaagaattgtaccggatttcagaaatggcttgagaagaaagggtatgaaaaacctaaggaaaccagtaggaagtga

SEQ ID NO: 46083 - DNA, 444 bp, Glycine max
  Peptide Sequence Number=SeqID_162861
atgttatttgtagagaagagaggcgattctgcaaaggtcttcagtgtactatcatggagtaggtattcaaaatcacccccatccaccaaagatggtgctgaattttctggtcgtagggaaccatgcaagcctagagctcattgtgccacacttaaaaaattatatgcggcagagaagaaacttttcaaggcattaaaggaggaggagggagttgttgcattggagttcgacaggaagtccatgttattgcgtaaacaagaggatgagaatctttacatggccaagattgacaaaatgcgatcaagtgttgataagttggagtccgatttaataagcctaaggcaatgcatcagtgacacaacttcatcaattttggaaatgatacatgaggagcttttaccccagctggttgcattaactgtagggtatatttctcagaattga

SEQ ID NO: 46084 - DNA, 504 bp, Glycine max
  Peptide Sequence Number=SeqID_162862
atgcgtatcggacattgtcgtctcctatggagggtttggcgggtgtttcggcaagcgcccgccgcagggcgcggcggcacgttcgttcagatcaagtcccggcgagctttacgacttgcgccggaactccgatgtcatgaaggtcttgaatgtgccgtccggctgcctgacgctgccggagaaactgcggtgattgtcatcatgcagcaccagcacgtcgtgataggtcgcggtgccaccggaaccgtcgaaagcggggccttccgcttccagcgtcagggtcttgccgtcctcttccagccagcccttgtagacccagagatgcgtcatcatcgaccctacccaggtgccgacaaaattgcccttggccggatcgaagccgaccgttatgacggccgtcatccggtcgccgtcaggcatcctgccggtgccttcgccgatgacccacaacccgccgatggagcggacggtctccgtaaaacgctggtccggatcatcaggatc

SEQ ID NO: 46085 - DNA, 711 bp, Glycine max
  Peptide Sequence Number=SeqID_162863
atgtcgttggctggcagaccaaggatttcggctcgccggaaatgccctatctcgtgctggaagccgacggcagggcatgggcggcgtcatggaactgaccgacgagcacaagggccagggcattccgccgaactggacggcctatgtcgatgtcgacgatgtggacgcgacggcaaacgttttgccgaaaaaggtggcgcgatccgacgtccgccgcaggatatcccggaaatcggccgctttgccgtggtggccgatccctatggcgccgtgctctgcatcatgacgccgcagccaatggaaaccggcggtttccctgaggatatgcaggcgaaacagggccatgtcggctggtacgaactcttcaccgacaatgtcgatgaagcgatggccttctacggcgatgtcttcggctggaccaaggaccatgatttcgacatgggcgaaatgggcccgtaccgcatcttcgcccataacggcaaagccgttggcggcataatgaaacgcatgccgcatgttcccgtctgccattggggttattacttcaatgtggatggcatcgatgacgccatcactcgcgtcagcaccggcggcggacaggtcgtcaacggcccgatggaagtgcccggcgacagctggatcgttaactgcgtcgatccgcagggcgcctatttctcgctggtctcgcagaataaatcagtctgttgctga

SEQ ID NO: 46086 - DNA, 189 bp, Glycine max
  Peptide Sequence Number=SeqID_162864
atgtcatcgtggcatagttctacggagtgcacgtcatccccagcaaggtcatcaggcctcctactaaccgagctttcatcaagaagtgttgcgcccccaggtaggcacagggcaaggcatcacggcggcgggcaacagatgcaacgccaccaccttcagagcccctcagctcatccacaaaaaggttag

SEQ ID NO: 46087 - DNA, 264 bp, Glycine max
  Peptide Sequence Number=SeqID_162865
atggatatgaatcttggatccttcatttctagtcagattacattcatagcacagtgtcacaacctacccttcagcgggagggcgacgcgagactcatgggtgcatcttccaagaaaggaaaatgtgcggagtcgccaccaaagtttattcgaggaaaacgtcggaaaaatcggaaagggtgtgggtgtttcccttgctcctacatattcctcaattgtgataaggaaatcagacctacgtagttctttcagaactgaacgttag

SEQ ID NO: 46088 - DNA, 347 bp, Glycine max
  Peptide Sequence Number=SeqID_162866
ttctatttctcgatggaggcaagggatataactcagcggtagagtgtcaccttgacgtggtggaagttatcagttcgagcctgattatccctaaacccaatcgaactccagtcgaatatgaagcgcctggatacaagttatgccttggaatggaagagaattccgaatcagctttgtctacgaacaaggaagctataagtaatgcaactaggaatctcatggagagttcgatcctggctcaggatgaaacgctggcggcatgcctttacacatgcaaagtcggacgggaagtggtgtttccagttggcggacgggccggaggagcaaaaggaggaatccgcccgagg

SEQ ID NO: 46089 - DNA, 177 bp, Glycine max
  Peptide Sequence Number=SeqID_162867
atgaaggacatatcacaagtttggcgatccttgttgtatggctccgcctcctccaaggaagctctggaatcggtgtttgtcaaagcctgtgtcggcttgtggggccgcaccagaaccctcttcaatggtgcccttcctggactgctacgcggggagcttcttcgtagccaattctag

SEQ ID NO: 46090 - DNA, 138 bp, Glycine max
  Peptide Sequence Number=SeqID_162868
atggattctggaggtggtggcggtgcatctgtaacatcctggaaatttctacccggaatttttggaaacgattgtatatgcatatatgttcttggaagaaataggagtagtgggggcaagatacgcgggttaggctaa

SEQ ID NO: 46091 - DNA, 1113 bp, Glycine max
  Peptide Sequence Number=SeqID_162869
atggatactggccggcgcaaggccctgcaggcgctgaccgaagccgccgacgcgttctcgcagggtgtggccgccctgttcgaacgtgtcgacgagatgggtcgtggtgatgccggcctcgccgcgcagctgcagcaggccgccgataccctgcaggtacaggtggatgcgctgcagcggccgtcgttggcgttgtcactgcagaagatgcgaaggcaggaggcactgctgctgctcgacggtgactccactcacgccgaccgcgccagcgaggaaaagctgccgttcgacctcgcgctggcgggccttcccgcagatgcgcaggacaccctgcgcaccgggatggaggcgtatcaggccgcattgctggggtataccgctgcccgcgtcggcctggatgtggaagcgcagtcgctgctggataccgccgcgggcgtagcaccggcgctggccgccttccagcaggcgcaggtggcggcgctggccacggcgcaggcgcgccagcaggccggcgcacgcacgatgagcgtgctgttcgcactgaccctgctgctggtggccggcgtgctgatcaccagcctgatgctggtgctgcgtgcggtgcgccagccgatccaggacaccctgcgtttcgccagcgatatcgctgacgaccgcctcgacaccaccctgcgcgtctacaacgccaatgatgagatcggccagctggcccagcgcctggtcgacatgcagcagcgcctgcgtgcgcgcatcgagaccgagcgtgccgtggcgcgcggcaatacccgggtgcgccaggcattggacagcgcgcagaccgggctgatggtgattgatgcggaagggcaggtcgcctacgccaatccggcgctgctggagcagcttgacctccaggttgaagatctggtggcgagcgatgcggtgcgcctgcatccggcactggccagcctggccggtgtgcgccagcgcgaggagcgcgagatcggccatgcaggggtgcgctaccagctgattgccaacgccatcatcgacgaaggtcacttccttggtgtggcggtggagtggcgcagccgtgcgctggaaaccctgttggaaaccgaagtggccgcactg

SEQ ID NO: 46092 - DNA, 451 bp, Glycine max
  Peptide Sequence Number=SeqID_162870
tttaacagcctgcccacccttgaaacggctcagcgaagtagggtccagcggctggaagagcaccgcacgtcgcgtggtgtccggtgcgcccccggcggcccttgaaaatccggaggaccgagtgcctccacgcccggtcgtactcataaccgcatcaggtctccaaggcaagggaagtcggcaaaatggatccgtaacctcgggaaaaggattggctctgagggctgggcacgggggtcccagtcccgaacccgtcggctgtcggtggactgctcgagctgcttccgcggcgagagcgggtcgtcgcgtgccggtcgggggacggattgggaacgggcccttcggggcctcttccccgggcgtcgaacagtcaactcagaactggtacggacaaggggaatccgactgtttaattaaaacaaagcattgcgatggtccctgcggatgttga

SEQ ID NO: 46093 - DNA, 282 bp, Glycine max
  Peptide Sequence Number=SeqID_162871
atggctagtgtttgtacccatttaaggttgggtatgtgttcttgcactttcagttgtgccccaagctttggttcttcttcttccacgaagaagaggaagctttccaacaaagccaatgttggttcaagaaataagaagttcaagaatgatgatgatgatgaggtttggaagatcaagaaagtgttggaaaagagcaatattgggacaatgagcaggttgatactaaggagagagatggaagaggagtttgtgttgcctgtgttgggggatgatgctgattag

SEQ ID NO: 46094 - DNA, 348 bp, Glycine max
  Peptide Sequence Number=SeqID_162872
tggcgtctcctctctctcttccctctccattccacttccattcatcttcaaagaagcaaaggaatccattgatgaagaagatcctaggcctacaagctcaaatggagcttacatcacccaccctacttgccaagtaaacagcaaattcccaggtagatgcaacaatggagtcaccatctgttgcaaccttcctcacaacgggacaatgaagaaaataagagaaggtgaaaagaaaatgagtgggagtttccaccaacgtttattcgaggaaaacattagtaaaaccaaaaagaagaggtctgtgaattttgaaaataacagtgcgggagaggtttacgcatggggaag

SEQ ID NO: 46095 - DNA, 453 bp, Glycine max
  Peptide Sequence Number=SeqID_162873
atgagtaggagggcgcggcggtcgctgcaaaacccagggcgcgagcccgggcggagcggtcgtcggtgcagatcttggtgcctgcccaccctggaaacggctcagccggaggtagggtccagcggctggaagagcaccgcacgtcgcgtggtgtccggtgcgcccccggcggcccttgaaaatccggaggaccgagtgcctcccacgcccggcaagggaagtcggcaaaatggatccgtaacctcgggaaaaggattggctctgagggctgggcacgggggtcccagtcccgaacccgtcggctgtcggtggactgctcgagctgcttccgcggcgagagcgggtcgtcgcgtgccgtcggggacggattggaacgggcccttcgggcctcttccccgggcgtcgaacagtcaactcagaactggtacggacaaggggaatccgactgtttaa

SEQ ID NO: 46096 - DNA, 213 bp, Glycine max
  Peptide Sequence Number=SeqID_162874
atggcttctccacctgcctcgcctccccctcctcctccttctcgtcctccacctccacctcctccttcaaacgcatcagcttcgctgtctgccgtgaagtggacactattggatttcccctgcagttgctttttgttccactttttcttcgttcaaatatattcaagggaaatccggtttgtcggaaagtgcactggatcgtcaagtatttaa

SEQ ID NO: 46097 - DNA, 249 bp, Glycine max
  Peptide Sequence Number=SeqID_162875
atggagcggtatttacaacacttgattcgccagcaggtggccaaccacagggggcagctgcagatccatgaatgtctctaccagctcagcctcaatcagttcagggcggaggtcgcatggcccagagattggcctgaggctcaggcaggggaggcacccacagaggctcccggcgacgcgaatgaggcctgcatggatgaggagatgacagatttactcggtttcttgggagggagtggagccacatga

SEQ ID NO: 46098 - DNA, 297 bp, Glycine max
  Peptide Sequence Number=SeqID_162876
atgtctaagtttaaagattatttcagagggcaggagctaatgctggcggtgtgtgttctaaattctaattacatcaaaggagctacagtgaacaacaccaaatctaattatgaggagctcaaagctattggcaattggcacaggattgaggaaaccatttctaaaagcattctcagtgtgacaccggacttgagaactttaggagcaagagaaaccaagttgagaagcgaaagcttttttcagtcttctacttacaaagatgcatcattagatctcatagctccaaggacaacctag

SEQ ID NO: 46099 - DNA, 294 bp, Glycine max
  Peptide Sequence Number=SeqID_162877
atgaatccaaatatgcacttagttattgtgcgaatgtcaaatgatatagcattggataaggataacctgtgcctctatggacatccaaatgaggcctgggaagtaactctgccagcggaggaagttccgccagagctcccggagccggctcttggaatcaattttgctagggatggcatgaaccgcagggactggctttctctggttgctgtccacagtgattcatggttggtttctgtggccttttaccttggggctcgtcttaaccgcaatgaaaggtatgatctagtttga

SEQ ID NO: 46100 - DNA, 246 bp, Glycine max
  Peptide Sequence Number=SeqID_162878
atgatattgcttcaacctttgtccgctcactacccatgtcctgtcaagatccttagattgaggatcacaaagctccactgccccatatggtcggactttcttgatgctttgaagattcataagcagttaatctcatctcttccaacttgtcgcaacctacccttcggcgggagggcgacgcgggactcgcgggatgcgtgttccacaaaagcaatacgcgcggagtcgccaccaacgtttatttga

SEQ ID NO: 46101 - DNA, 411 bp, Glycine max
  Peptide Sequence Number=SeqID_162879
atgaagttgactaacaagattggttgggtctccttgaataatgtgtccaagaagttgtttgagtttgactcaaatatctttgctcgcttcaaggatcgtttccttaaggtcctggctactgatgtcgtgattgatgttgctgttgctcctactgctatagaagggggtcaacctactgttgaggtttgccctattattggtgattctgaggtcacccttgatggtccttccttcattttggccaagaggaagcaagatgattgtgctggggtgcaagctgtagggttgacacctcttgtagaagcaagcttcatgatgatgaatcaagttgattcaagtagttttgatgatgacaaaaagctcaagagaatgatttcaagattgagtcaacaagttcaagatcaagattaa

SEQ ID NO: 46102 - DNA, 300 bp, Glycine max
  Peptide Sequence Number=SeqID_162880
atgatgcacgagagatgtaccctatcgtgtgttcattcagcaattgaagtaggtgtaccttctactggtaccacaaaggatgtacgctccaatgtgttaagaaaaagttctcaggcgggaagaatcaaaagaattctcagactgtgtcttattgaattctttgacaagggagaagggagacaccaaagaattcaggcgattagtcctttgttcttttggaaaagggagaagggagacacaaaaagaattcaggcggttagtccttggcgaattctttttggcaaagggagaagggaatga

SEQ ID NO: 46103 - DNA, 204 bp, Glycine max
  Peptide Sequence Number=SeqID_162881
atggtgattttcagccatggagttgcagcggaagctaggaaggtagcttcttttggaagcaaggaagaaagcttccttgagaagctagaggttagctactcacacccttccaatagtgaagctcaccccatgccaaaatacattaaaatacaaaaatgtccctactacaaagactactcaaaatgccctgaaatacaaggctaa

SEQ ID NO: 46104 - DNA, 690 bp, Glycine max
  Peptide Sequence Number=SeqID_162882
ggggaccctcaaaagattccaaaggctgttcttcatcaactgtgccagaaatcagggtgggaggctccaaagtttgataaaattcttggcagaggaaagattttctcctatactgtaagtatattgcgtaaagctagtgggaggggcaagaatcgaaaagctggggggttggtgacacttcaattgccagatcagaatgaaactgttgaatctgctgaggctggcagcacagctgcctttgtatggttatcatcagtacccctgtggaggagaccattgtttgatagtgagatagagatgttggtcgcattcatacaagaagttgaagggcacaagatcaggtctgacattgaggatcagtgggtgtgggcggcggagtcaagtggtagttatttggctaggagtgcatacagagtgattagagaaggcataccagaagaggaacaggatagagagttcaaggaattatggaagctcaaggtcccaatgaaagtgactatgttcgcatggaggttactcaaagacatattgccaaccagagataatttgagaaggaaacgggtagaattgcacgaatatgtgtgtcctttatgtagatcaatggatgagagcgcaagcaccattttcatcagcatagtcatgaagtttatcaaggactgcaggggaatagatggaaatggtggtggttag

SEQ ID NO: 46105 - DNA, 345 bp, Glycine max
  Peptide Sequence Number=SeqID_162883
atgagacaaagatctctagattttacaagaaaggtgcaaaagtgcaatgaaagattaatgtctaagaaaaaaggagtagagcccaacccaagagttgaaaggaacaaaagtacaagcaagactctcaaggttcttactcaatataaccctcaaacactcttcgaaaagaaaaacccgaggttcgcacttgcacatttgagaagaaaactcattcgactaggagctcatggaaaatgcccaaagacgattgtgacagatcagtccatgtcattgagttttagtgggatcaacagacccaatggtaacactggtgccttcatcacttgtctgttacaaggtatgtag

SEQ ID NO: 46106 - DNA, 114 bp, Glycine max
  Peptide Sequence Number=SeqID_162884
gtgaaaaatgtcatagaaaagccccataatgatcatctacctctaatagaagccagcaggtgcccagactttctactcaaaacctctcagactaatgtacaagccaatggatga

SEQ ID NO: 46107 - DNA, 588 bp, Glycine max
  Peptide Sequence Number=SeqID_162885
atggttttgaatgtcagcaaggcctctctactccttgctgcttgcaaagtctctactccttctgccactaactatggattgtataaaatgcatgcagttgctcctgctggaggcctctctccacaagcttctccatctccagcacttgctcaagggaacacaacatcaacattatccccaatttcagttggatctttgcttcgtgcgggaggctataggagaactggcctcatctgtccttgtcccagatgcactgtcctcgcctatctttgtcccagttgcacttgtattgtccattgtcccatcattgacttagttgcagtccgtagggttcgatctggtcaagaactgtctttttggcaagacattgtactgcaacaagctaacaacataaataagaagcggaaattgaaattgagatatgcagaaggagtatcggttaaaggcgcatatatacatacttttgtggaagaaagttgttcttggagaggcaagcttgaatgtcacaagcctctttcttgcacggctccttgcttgcctgcgccatcctctctcaaagattctgtgcgtatgccgcctcgggattga

SEQ ID NO: 46108 - DNA, 180 bp, Glycine max
  Peptide Sequence Number=SeqID_162886
atggacaatacaagtgcaactgggacaaagataggcgaggacagtgcatctgggacaaggacagatgaggccagttctcctatagcctcccgcacgctgaaagcaagtgctggagatggagaagcttgtggagagaggcctccagcaggagcaactgcatgcattttatacaatccatag

SEQ ID NO: 46109 - DNA, 429 bp, Glycine max
  Peptide Sequence Number=SeqID_162887
atggagagggagatgataacaatgatagtggacacgttatcggtgttctactatgcgaagatggtgggttacataccttcaagcttcgcagatttagtgtttgttggcgaaatgatcgaagtggtgttgaacgccaattacaatgcgaaacagatgatcattaagtgttttgatgaagaatgcgaaaaatacccaaaaaggggcaaaagggtcttttctttggttttcctagaccctagctcgcctaggctagcctccagctcacctaggccaccaaatagcttcatggtgaagaaaccaactcacctaggcgagctcattacttcagcactaagtttcagctcgcctgggcgagctgcaactaccccaaatgaccctttgcctataaataggcatcctaggggtgttttaaggggttccaagggttag

SEQ ID NO: 46110 - DNA, 753 bp, Glycine max
  Peptide Sequence Number=SeqID_162888
atggattggattggattcgtaaagaatattaaaaagcggaagaaagcagagcagagagggaggtggaaaaagaaaaaggaagaaggaatgagtgcaacagtgactctaactctaaacctatgccgttcttccatcgtcgcttcttgtccacattatagccacaaaccaaaccctaatttcaatgccttttttagcttctctttgtctctgtctctgtctcaccacagacgcatcgttatctacaagaaaccattcccctctagacggacgtggctttatggatatatgaatagagatcgagattatgaattggagaatgggttagccttattcggttctgatgaagaactagcaacacaaattccaactcaggcccagtcacttgttgaaggatcaggctccattcgcatagcggagttcaagcctgttcctgatgttgattatcttcaggagttattggccattcaacagcaaggacctagagctattggcttttttggaactcggaacatgggattcatgcaccaagaactaattgagattcttagctatgctatggtcataactaaaaatcatatatatacatctggagcatctgggactaatgctgctgttattcgaggtgctttaagggcagagaaaccagagttgcttacagttatattacctcaaagtttaagcaaacagcctcctgagagtcaggaactattgtccaaaattttattttctgctagagggctatttgactcttaa

SEQ ID NO: 46111 - DNA, 357 bp, Glycine max
  Peptide Sequence Number=SeqID_162889
atgtatagttactggtacaattgcgattccaactattggagtgctgtctacaagcgcacctatggtaaagatttcaaatttaaagctggttatgattcagagattcgccttggctgggcatctctttgggtagagttgcatacttccaatggtagtttcttagcactgtccttgatccctcatgcagccaatcatcatgatcgtgaccacaatagcttcactcaggttggagatgaaggtgggaaagccaaaacagctccgatgcagatgaaagttcaattcatgctacaagtgccacaggacgacataaaatcttctgctttgatgtttcggattaagaaaagatgggacttttaa

SEQ ID NO: 46112 - DNA, 201 bp, Glycine max
  Peptide Sequence Number=SeqID_162890
atggtcagagggcggcgcgtggttgggattctggcctcgcgacttgtaggggtgagtcacgctcctcgaggcacactcaaccctgaattcgccggaaaaagtggtggccggagtggcggctggcggccggcggtggccggagatggtggcgacttcggagacaatcagaacgggaccgtacccgctctgataccatgttaa

SEQ ID NO: 46113 - DNA, 2226 bp, Glycine max
  Peptide Sequence Number=SeqID_162891
atggtgaaactacagagatggttcctgtggggtggagatgtagaccaaaagaagatcgcttggattagttgggaatcagcatgtctatcgaaggagaaagaaggtctgggaatcaaagatttgaccaagtttaatcgtgctcttctcggagaaaggaggtggaatctgtttcatcgtcatggagagctatgggctagaatgttggactcaaaatacggaggatggaggaacctggacgagaatagaaggaattcagcagaatttgtctggtggaaagatcttagctctatatgccacagccctggggaggaaagctggttcaaagccagaataaaatggagtatgggttttggttcaaaggttaggttttgggaagaagggtggaaggataatgggatcctgctgatggtgaagttccctagactttacctgaattcgaaccaaaaaaaccattacattcagcagttagggagcaattcaggtggagaatgggagtggtctctgcagtggagattactttttgaggctgagatacctatggttgccaattttttggaggaaatccaagggctcaacataaatgctcatcaacaagacaagtgggtgtggttgagtgaccccactgggttatacactgtacgtagtgcatacaaactgcttgacagggattcaagagataagaatatagatggggtaggtcttgaaggaagtgcaatggggcagtggtggctggatacaataggaaaggccttacaagaaggaaaagcttttgagcgcatgggttctaggcagcttgctggcttgcttgtatctctttgggtaagaaagaatcttagaacacatgttggggacattgatgctggggctgtcccgtgtggttttggacgtgcaattggtaataagggaggagtgggtttgagaatcagagtgtatgataggataatgtgctttgtgaattgtcacttggccgcacacttggaagcagttaatcggcggaatgctgattttgatcacatttatcgaaatatggtgttcacccgatcgtccaacctacttaatactgcagctgctggcgtctctacttctgttcatgtgcttcgtggtaccaatgttatgggtgtcatctctgaagaaccaaaacctgatttatctgaagcagatatggtggtattttttggtgatttcaactatcgcctttttggtatatcttatgatgaagcccgggactttgtttcccaaagatgctttgattggcttagagaaaaggatcagctcagggcggagatgaaagctggaaaagttttccagggaatgcgggaagcacttatcaaatttcctccaacatataaatttgagaggcaccaaccaggtttaggagggtatgattctggagagaaaaagcgaattccggcctggtgtgacagaataatataccgcgatactcggtcagctccagtttctgagtgcaatttagactgccctgttgtgtcatcaattttacagtatgatgcttgcatggatgtgactgatagtgatcacaaacctgtccggtgtaaattcaatgtaaaaatttctcacgttgatagatcagtaaggagaaaggagtttggggtagttatgacatcaagtgagaaaatcagatctattctagaagatttatgttatgttccagaagccactgtcagcccaaacagtttagtccttcaaaacctggacacttcaatgttgcttattacaaacagaagtacaaaggataaggctatatataaaatcacttgtgaaggccagtctatagtcaagaatgatggacaggcacctgattatagcccaagaggtggctttggctttcctagatggcttgaggttactccagctgcgggcataattaaacctgagcaaagtgtagaggtttcagtccgtcatgaagatcttcatccctcagaagaatctgcaaatggcataccgcagaactggtggaatgaagacacccgagataaggaagtgattttggttgttcatgtacaaggcagttcttccgtccaaacttcatgccaacaaatccatgattttccttatgcgtcccttttcgaggttgaggatttggaggctagagaagttgttagcaacggtgacaacaaccacagtgtagaagggtttcaattgggaaaggttggagagcgagatgatgaggacaaatttgatgttggaaggaaaggaagttggtaa

SEQ ID NO: 46114 - DNA, 789 bp, Glycine max
  Peptide Sequence Number=SeqID_162892
atggaatcggcagctgaaaaccctaattacccggcggtggactacaagcgaccttccatcttgtcatttcctcggaggcccgccctcagagttacatccgagttcgatagtgaaagcgcagtcttcttccataagatttcctgcaagttgttggacagccttgccaagttcaagttttcgttcaaccacagcggtaagggcggcgacatctccgaacctcaattcagctttgtctccaagcaccttagcctccactacgacctcgaagaccataatgctctcgttaagacctccatcgatcttgctcccagtttgcaactcactgcttctcatgatctcaaggctcaacaaggagaggttaccgtgcttgcaaacctcgccgatcctgcctattcacttcaactatctactccacttccatccgttggattgccaaaagctaccttcagatttcctctgggtgaactttcgctgcaggagaaacaagaggaggaagtcaataatttgttgtcagtcgatggggttcttaaaggacaattgtttaatgggctctgctctgcccattacaaggacgaagaactgaaattaagatatggctataaggacgatgaaatctcatttcttccaatactttcacttccttcaaatgccctgtcatttgcatttaagcgtcggtttggtccttccgacaaattaagtagattcttgactaatgggttccatttatccgatccatacatcataacatgggataacatctttaccaatacagaaagatgtggtatttga

SEQ ID NO: 46115 - DNA, 237 bp, Glycine max
  Peptide Sequence Number=SeqID_162893
atgggggatttcatcagcagactctccttccccgcatgttggcattttagcgaagaaaacaccgagactttttcaagtctcacaagttatccagaactacgtaggtctgagttcctcattggaggatacgtaggagcaagagcctcgcttttgtcgaccacaccgccttttgttgccatgacccaagagctggtagcccgcggagacaccttacggttatccgcaactcgagtgtga

SEQ ID NO: 46116 - DNA, 698 bp, Glycine max
  Peptide Sequence Number=SeqID_162894
atggagagaaaatatgacaatgcaaatatagaagctggtgtggatctgaaggtgatgattgaggaaatggaatccattcatgtgccttcagtgttcatctgcccaatctcccatgaaccaatgcaagaccctgtgaccctttgtactggccaaacctacgacagatccaacatcctcaaatggttctcacttggtcacaaaacatgtccaacaacaatgcaagagctttgggacgatgttgtcactcccaacagcaccctctcccacttgatcctcacttggttctctcaaaagtacttggccatgaagaagaagcttgaagatgttcaaggaagagccttggaaatcttgaacactctcaagaaggtaaagggtcaagccagagttcgagcacttcaagatctaaggcaacttgttagttctcatgtcaatgcaagaaagactctggaggaaaatggtggtgttgctttggttttcaattttttgggtcctttcacttcccatgctgttgggtcagaagctattgggatcattgtgtgtatggatttgagttctgaggtgaagagaagcctcatgcatcctgctgagatttcattgttggtggatatcatgaatgagggaaccattgagaccaaaatgaactgtgccaagttgattgagatgttgttgatggaagggaacaatgaggttgtttcaag

SEQ ID NO: 46117 - DNA, 909 bp, Glycine max
  Peptide Sequence Number=SeqID_162895
atggggcggcgccgccctgctggcgacggagaacgcgccggccaaaaagcgcgcgctgtacggctccttcccgcagttgggcgcgccgatcggcttcttcttcgccaacggcaccttcctgctgctctcctggctgctgagcgaccagcagtttatggattggggctggcgcgtgccgttcatcctctccgcggcgctggtgctgatcggcctgtacgttcgggccggcaaacaggtgaaagtgccgctcggcacgctgctgagcaagcatctgaaagccactatcctcggcaccttcatcatgctggcgacctacacgctgttttatctgatgacggtgtattcgatgacctacggcaccgcgccgcagccgctgggcctcggctactcccgcaacagcttcctgtggatgctgatggtggcggtgatcggcttcggcgtgatggtgccgatcgccggcctgctggcggatgcgttcggccgccgcaagaccatgatcgccattaccctgctgatgatcggcttcgcgttcctgttcccgcccctgctgggttccggcaatcaggcgctggtgatgggctttctgctgtgcggcctgagcatcatggggctgacctttggcccgatgggcgcgctgctgccggagctgttcccgaccgaagtgcgctataccggcgcgtcgttctcctacaacgtcgcgtcgatcctcggcgcgtccgtggcgccttatatcgccacctggctggcggcccactacgggctgttctacgtcggcatgtacctggcggcgatggccgggttgacgctgctggccctgctgttgatgaaagaaacccgccaccggtcgctgtgatcccctgcggccccctcactgcgggggccgcacgcgttgttcgtttactgtcataa

SEQ ID NO: 46118 - DNA, 323 bp, Glycine max
  Peptide Sequence Number=SeqID_162896
atggagctttctgcattttctagcttcaaagcagtttctgatgcttccttgttcccattttcttcgaatcaactttggtgccgatgctctcttcctcttcgtcgccgcgattatggtctctgttggagtcccaagtcaaaaccgtgttttcggatcagaatgtgctcggagaaagcttcgtcgtcgaacggttacggcggaatcgactgcggagaaacaacgaactctgatttcgtcgaagtcattgtcattggctctaggaaggacgctgtttttgatttctgcttgaactcgccgtttcaattaccgtcgccgcggttttg

SEQ ID NO: 46119 - DNA, 1543 bp, Glycine max
  Peptide Sequence Number=SeqID_162897
ccctgttcttgccattgtcttcagttcctatggcgatctctggtcaggttctgaaggtggtattattaagatctggccttgggaatccgtcgcagaatccctttccctctctccagaggaaagacacatggcagccttacttgtcgagaggtctttcatagacctcagagctcaagtcaccgttaacggcgtctgcagcatatcttctcaagaggtcaagtctttgctctgtgatcatgttcgaggtcgagtctggtgcgctggccctctttccttttctctctgggatgcccacacaaaggagctcctcaaagtatttaacatcgagggtcaggtggaagatcgagttgacatgtcatccgtgcagcatcaggatcaagcaattgaggacgagatgaaggtcaagtttgtttccacctccaaaaaggagaaatcccagggtaccagctttctacagcgctcacgtaatgccatcatgggagctgctgatgccgtgcgtcgagttgcaaccaagggagctggggcatttgtcgaagatactaaaagaaccgaagcccttgttcaaacaggcgatggaatgatttggagtggatgttccaatggcttacttgtgcaatgggatggcactggaacccgtgtgcaagattttaatcgccatccttgtgctgtccaatgcttctgcacttttggaacacgcttatatgtaggctatgtgagtggtattatccaagtactggacctagaaggcaatctagttgcagcatgggttgctcataatggtcctgtgattaaattggccgttggctgtgattatgtttttagcttggctactcatggtggcctacggggatggattattgcatctccaggtcctgttgacaacattataagatctgagttggccacaaaggaatttatttatacaaggctgcacaatgttagaattttgattggcacatggaatgtcggtcaaggtagagcttctcagggttcactttcctcatggctgggttccattgcatcagatgtaggcattattgtcgttggtttgcaagaagtggagatgggtgctggttttcttgcaatgtctgcagcaaaagaaactgagagagaaggtttgggagtctgggatttgctgaagttcaattatgctttggttggaaagtggtggtggaacttgttccaccaccatgaagatttgtgggctcaaggggatccaggaggggagtacacagtgggaagtgcatatcgagcacttaatcagtttataattgaagaagatgatgagagggcattctctatcctctggaaactaaaaattcccagcaaggtgtctcattttgcttggagattggttcgggatagattgccaacaaggatgaatcttagaagccggcacatagttatggtgaagtctgctgcccgttttgccaaaaccacgacgaggatgcagaaaggccaaaagaacactttctccagcattctcaatgcattccgagtggtgtttctcaacatagatggtagatttggtggacctctctga

SEQ ID NO: 46120 - DNA, 228 bp, Glycine max
  Peptide Sequence Number=SeqID_162898
atgtgccttggcacaacaaaaaggttgccacttgctaccatgaaccagagaaaacaagcattacatctttgggttaaaaagtttaaagaatgcacgggccaggaagaacataaatgggtgaaatggaaagtaataaatagtagggaagagaatggaataccagaggcagagatcccaccagtcccagggaagatcaagatgggtgccaacaagttatttcagttttga

SEQ ID NO: 46121 - DNA, 357 bp, Glycine max
  Peptide Sequence Number=SeqID_162899
atgacgagagtggtgaagtctgggagtttcagatcttcaaaaatcccaaatcttgtttttattttattccgacgagagggtgacgacattgaaggagaaggcgacgacaaatgggatgaagtcgggggagcttcaggcaacaacaaaggaaggaggagggagtggagggaggggaggttgaaaaagaggaaggagcaactgacattttttggaggctttagccgccagtacctttatcttattaacgacattacctttgaatgcacgctgctggaaggaggtaaacttatggcacaaagtagaccaaatgctaaatggcgtggagagtctaaaagatttgatcttcaagtgtactag

SEQ ID NO: 46122 - DNA, 1875 bp, Glycine max
  Peptide Sequence Number=SeqID_162900
atggatgaaactgaagtggaaaatcccatattcatggaaattaaatctgaagataagagaaatgaaaatcaaggttttgcatcagagaaaggagaaggtagcagtgttgttttctcaagagaagcaccacttatgaggaaagagtcaagaatgtccactccttattgttgcaatgctaagaagctcaaatccagggatgttacaacagattgtgagcttggaagtaatgagaaatttgggttggagaagaaactatgtagacaagacaggattgagttgggtcggttgtttcagagtgcagtgagttcccatgactgggaacttgctgaaagtttgattttggttgctgatccacagacgctcaatgatgccttgtgtatcacactggattccatctggttcttgagcacagagctagagcttaatggaataatgggatttatcaagaagatcattgctaatggtgcttatgacttcacaagagctgctctaaggacttcattccttgcttcatgtgtctctgcctgccagagtagaacaatgagtcttgcggatacagttactgtaatggcccaaaggttgcatgagcgtctccaggaatgcaatggagatgaagtattgaaggcagaagctggtgctaaggttcaaaagtttactgaatgggctctgaaatgtataggcatccattcacgactgcaggatgatagggaaaatgtgatacacagctcagccgttgaaatccagctccggttatctgccttcaagacattccttgatcttgccggcagccgccttacagggaaggacttcagcgaggcctttgatgcggcttgttttcctcttactcttttctcaagctcatttgatccaggttgggcatttggcttgtcagctactgtgatccaagggttgctgggcatgctagtggaggggggtgcagacaatgtcaatcagtgtttcttggaggcttcacgttttggcagtacagaacttgtgcgcatactattgcagtctgctgaaaatttttggttcatatttgtgtaccatgctgtgaatcaaactatgcagattgctcaaagaaacagcttggatgttgatgttgacttggcgttgggttttgcctcccattatggcaagataggaactatggagtgcttggtggaagagggaaatgccatagcctttttgggccctttgatgagagctgctgagaggggttgcatgcaagttgttgagtggtttgtgcagaggggttgccgagacatggaactatgccttgcccttacagctgccacttctagctgccaagttcacattgcagcttatcttctgccgcacgtacctcagcaggtccttgcagcacttagtgttgaaattcttaaggccgctggtgagcgcagcggtggatctcttgatggtgtagcatttcttctccaatctgacttcttaggtgatcctgcagctacttatgctgttgcagatattattgctaaatcagaggatgaggctgttgcgcctgagttgaagacttttcttaaggagcattggtcagaaggagcttacaaggagggattaaggttagggcaagagcattacatgaaccttgtgagaatcattagatggggtgagtctcctatttgcttaagagatcttccggccccactgacggtggcaattgcttacctcccactttatagagagtgtgtcaagacgggtggcttcttgttttcacaacggcttaggggacaactggttgaagccgctagaaggcttggaaatagggtcttggatgaagtgatccatggtagagagctagtggtcgttttggaacagcatcttcctcactttttgctccatcccacccgcattgcttag

SEQ ID NO: 46123 - DNA, 123 bp, Glycine max
  Peptide Sequence Number=SeqID_162901
atgagggaaatgcgggaacgaaggcggggcatactgcaagcttacggacaggaatcaatgtttcctttctcaatcactcgccagagaattgaatgggatcatccaaagcattcacagaggtag

SEQ ID NO: 46124 - DNA, 207 bp, Glycine max
  Peptide Sequence Number=SeqID_162902
atgttggtgcaattgagtttggtggcgacactgaggggcgaatgggtcctagtgacggtgtgcaccaacaaaggtctacgcactctgactcataggcaaaaatgcattttgggtgaagcaaatgttgcgctacacgacgatgacaacaaagtcgtgttgggtcaacacgaactgaatgatggggtggaagtgggtatcaacaagtag

SEQ ID NO: 46125 - DNA, 324 bp, Glycine max
  Peptide Sequence Number=SeqID_162903
atgatagaggcagaatccccatcattttacctggtggcaatgaggagtaaagctctaaacttggttcatgtccttgatagtgctgctgctgctactacaactgcacctgttgttgtctcacctatgagactttggattcatgtccttcatgaaatacaacagaaaagcctcatggatgggttttcccaaataacgggagttcaatacaagttcattctgtttggagatggagacaagaacccaagctactgtgatcttgtcaacatgattacttctgatgtttttgatgctgccgtaggtgacattgcgattgtctctgtctga

SEQ ID NO: 46126 - DNA, 186 bp, Glycine max
  Peptide Sequence Number=SeqID_162904
atggacaaagatgatattttatgggcggatttggtaggtgatgacaacaatgagggagagaaggaagagacaaatatcgagacaaagtccaactgctttcggtgctcgtcatttagaatcgatgttattgatcaaaatgaggtagtgacgacgataatggagtatccacagagcgaggaagcgtga

SEQ ID NO: 46127 - DNA, 381 bp, Glycine max
  Peptide Sequence Number=SeqID_162905
atggatgaagacagacccgagacccacgatggaaggcccaagagaagtaccaagcgacttgagaagccatcagagctgaagcccaatgtttcgctgtctagcgttaaggtcgtgactgatttggtagtggtctttgatgatgtggagccatgtctgattggctctgtcctatttcttggaacaaaattcgttgatagtgatagtgatgtcctagttattgataagtcatttggttttgacactgctgttgaagaggcacaaggagccataaactttgctcatgtggaagcagaaagcactgagaatggtatcgatattgtcaagcttatgggtcgttacagtggtaagtatcatttacattatggtagtttacaattttag

SEQ ID NO: 46128 - DNA, 141 bp, Glycine max
  Peptide Sequence Number=SeqID_162906
atgagagcagaagatgcggaggggcacggagccgccagtgaagaagcggacggagagcgcccgtacaagaaacctatggatgtggaagagttgacagttatcacgggaacccacaacgagagcctcgtctcctgcgtgtga

SEQ ID NO: 46129 - DNA, 204 bp, Glycine max
  Peptide Sequence Number=SeqID_162907
atggcggcagatatcttggaatccaacaaattgtttttgtatttgaaaaatagacaagaagagcaagagagtaaagcagcagaaggggtgaagatagggatggcgggcatgtttggatgtagttgccattggcagtgggcggaggcgaaatccatgggaatgggctgttggttctatacccatccatgcagtgaggcattttag

SEQ ID NO: 46130 - DNA, 393 bp, Glycine max
  Peptide Sequence Number=SeqID_162908
atggagataaccaaatcacttgtctccaacaacaataataaaaagaacaaatgcacaccttccaggttagtagggcctgatggtgttggactgttggtactgcctcgcaaagttgaacttaaggatgactcaagcttgctagttgcaacctatcaaccactaccagcagcattcacaaagcaaagcagctactacaccaaagcaaatagtttctatataacatgctcaaaactaaagtactcaaatcaaaactggagaaacaatgttgggcttggttggaaaaggatgaaagagaggctgagggacaggaaaatgcagagggtacagagaccaacaaagcatgaacaagtgtttggctgctggaaacttgagagagcaaagtgcagagagtga

SEQ ID NO: 46131 - DNA, 312 bp, Glycine max
  Peptide Sequence Number=SeqID_162909
atgcagagcctacaagatagggctctacaaagacccattataacagtggagctgtttatagagaaggtatcctggccaggagcccagccttctcttgtgagggaaggtggaggtcccacagctcaagtacctcagcaggtggaggatgcatcctttgaggccacagtccccgagccatttttttatgaggcaggcggaacacagacgagacaagaggctgctactcctgagaagacaccacaggttacagcagatccaccttcaccagtggtggatctatctcatcctcagcaggcagcagaccttcctact

SEQ ID NO: 46132 - DNA, 525 bp, Glycine max
  Peptide Sequence Number=SeqID_162910
atgccaaatatagatatttacaacgcaatgagattgagttatgatgatctagatcacaaagaacaaaagattcttttagatcttgcatgttttttcatgggattgaatatgaaagtggaccacataaaagttttattgaaagacagtgaaaaagatgattcagtggctgttgggttagaaaggttaaaagataaagctcttataaccatttctgaagataatgttatatctatgcacgatatcaaacaagaaaaggcttcggagattgttcgtctagaatcaattgtagaccctggaaaccgtagccgattgatgcatcccgatgatacttacgaagtattaaaatataacaaggggactgaggccataagaagcataagggcagacttcaaatataatcaagatggatttcctcttcttccttgcagccttcaatctttcccagttgagctaagatatcttgcttggatgcattaccctctgaaatccttggcagagaatttttctgtggaaaacctggcttga

SEQ ID NO: 46133 - DNA, 1213 bp, Glycine max
  Peptide Sequence Number=SeqID_162911
atgtccccgttcattttgtgtctgttgctggttctgctccaaagcctagtggagaaccaactggacaaggctgagaacaagtgtggctgcgtttgtgttaggagacaaggggacacgtgtctcgaggaggagtgcggggttgagcattcggatttggaccaggttgccacgttgccggcaccacagtaccgtgccgtgagaacagattatttcccattttctgattttccaaactcgtcctgccggaggaatggctcttgccctgtcactatgttcttcactggcactaaccaatcttttggagaaattatatctaggaatatgatcccaagtaacttgagttctataaacagttctgatattacggctagtttggcatcaaatgtagtgggatcagattcagagccagagaacaccaattttctggaacctgctttcttttcagaccttcctatttattatctacagaatcagtgcacacagaactctacattctccgtttctcttcagatagcaggcattagcaagcagcaagaactgggagtggggaggggggggggggaggtaatatgtgctcagggtttacgtttatggcgtaatagttcttctgaggtgaacaatgagctatataaaggttatcggagaagtaacacagagagacagatcaatgagatagctgcaggttatgattttttaaattcaaatcggagtatatttaatgtcagcatatggtacaactcaacctacaaaaatgacactggctttaatcaaattgcattggcgcgtattcctcgttctgtaaatttggtatcaaatgcctaccttcagtttctattgggacctggtaccaaaatgttttttgagtttgtaaaggaaatgccaaaacctgagaccccgattaaatttgatttggcttctcttttgggtggtctcttctttacatgggtcatcctacaacttttccctattgccttgacatcgttagtatatgagaagcaacaaaacttaagaatcatgatgaaaatgcatggccttggagacgggccatattggatgatttcgtatggttattttcttgccatatccattgtctacatgctgtgttttgtgatttttggctcagtcatagtacttgcatacataggtgtgtttggaactgggctattagctggctttcttttccaattttttgttcaagacacgtcgtttccaa

SEQ ID NO: 46134 - DNA, 117 bp, Glycine max
  Peptide Sequence Number=SeqID_162912
atggccccctacaggatactaggctgccttgcagcaacgttttccgcttgtccagcgccgggaagggacgacgatctgtcggtcgtgaccctatcctccatttgcatccgtccctaa

SEQ ID NO: 46135 - DNA, 213 bp, Glycine max
  Peptide Sequence Number=SeqID_162913
atggcacgcagcgtgtttgcttcgtgcccctatttaagggacctacaagggagagaactaactaggcttttagcaataatccccaaggtagttatatctctcttgatggtttctagaggtatcatcccctttgaagaacatattgtagcagtagggactactagcaacaataggttttcaaagagaaaagctccagatgagggttcactgtaa

SEQ ID NO: 46136 - DNA, 991 bp, Glycine max
  Peptide Sequence Number=SeqID_162914
atgtatctggacctaagttacaacaacttgcttgggactatttctgatgccctgggaaatttgacttctcttgttgaacttgatttatcacggaatcaacttgaaggaactattccaacttctttgggaaatttgacttctcttgttgaactttatttatcaaataatcaacttgaaggaaccattccaccttctttaggaaatttgacttctctgattagacttgatttgtcatatagtcaacttgaaggaaacattccaacttctttgggaaatttgacttctcttgttgaacttgatttatcatatagtcaacttgaaggaaacattccaacttctttgggtaatgtctgcaacttaagggtgatacgtttatcatatctcaaactcaaccaacaggttaatgaacttttagaaattcttgctccttgtatttcccatggactcacaagacttgcagttcagagttcacaactttcaggcaatctgacagatcatattggggcatttgaaaatattgtgctgctagatttttccaacaactcaattggtggtgctcttcctagatcatttggaaaactttcatcattaagatttctcaatctgtctattaataaattcagtggaaatccatttgaaagtcttggatcactctctaaattgtcatctctttatattgatggcaatctttttcatggagttgtcaaggaagatgatcttgcaaatcttacaagcttgacggagtttggagcatcagggaacaatttcactttaaaagtgggtcccaattggcgtcctaattttcggctttcctatttggatgtgacatcatggcagttaagtcccaactttccatcgtggattcagtcacaaaacaaacttcaatatgttggactgtctaacacggggatctcagattctattcccacctggttctgggaaacaccttctcagatctcgtatttaaacctctcttataatcatatccatg

SEQ ID NO: 46137 - DNA, 171 bp, Glycine max
  Peptide Sequence Number=SeqID_162915
atggagggaccggtttcctttggtttttctaacgttttcctttcaataaatgttggtggcgactccatgcattttcctcctatggaagacgcacccgtgagcctcgccttgctcgcccgcagaagggtaggttgcgacagttggcgactccactggggattgtttttgtga

SEQ ID NO: 46138 - DNA, 846 bp, Glycine max
  Peptide Sequence Number=SeqID_162916
atgcagattgggcaggatcacccatctataggcgtcccacttcaggatattgtgtgcctattggagaaaatcttgtctcatggaagaaatgacacacgtcagactttcctcccaacaagaagttggccagaaaagaaatttgctcaacaagcaactactgcaagcaaagaaaggcttcggaaaaggtttcagccaccacaacaagttcaaccaccacagcaagctcagccaccacagcaagctcctttggcacctcccaggccacaaaaatttttgcatcaaagttccaaagcatgctttcgagagctgctccttaggaaattccatcctaaacgagaagtgaagctaaagcctggggaattccaggaatttcaagatgagattgaggaaagaaaatggacaaagttcctcagtttccctgtgaaatacaacgaagagctactgcgtgagttttacgccaatgctctacctaggcacgaaactggaagcttcaggacttcatgggtgcgaggtgccatggtgagatatgattttgttgcaattaaggaattcctcaagactgattttcaagatcctgaggtgcagctttgtacctactttgagtcgaaggacttggatgattttgacccaaacaagctacctaaggtgctttctattcctagaaaatgttatgtcaaatcaaaggagaatagcaaggcatacaaattcaaaagggatgctttgagaaccatcagtccaatttggatgtcctttgttttctccaacattgctccaaccttgcacacttcaaacctcagtagagtgtgtttctctcatctactgcattttgacttatcaccctattaa

SEQ ID NO: 46139 - DNA, 372 bp, Glycine max
  Peptide Sequence Number=SeqID_162917
atgggtggaatgggaagaggcttgcgcatcaatgcaccaagtgataggacagggggtgtgggcttggacgctatgagatgggttaatagagtgggtcctctccccatagagccaatgtatcactttctgcaattctcccactggaatacgaaaagaagcgcagacaagagatgggaggtcttatggatagcattgtccttgactatttggaatcacagaaacaacttggtcttcaataaccagctcttcaaccctgaaaaagtcatggatgaagccttattccatacttggtcctggttaaggtggatggagaagggattccaaactcattttaacctttggtcaactaacttgaaggatgaactctcttag

SEQ ID NO: 46140 - DNA, 654 bp, Glycine max
  Peptide Sequence Number=SeqID_162918
atgaattgtgagataacatgttgctttgagatcataacattgttattggaattgagtaggttggacttgaatcaggaaggtgagaccctaacggattcttcggagtctaagccttggggtgagagtgacctgacatacccattgtgtggtgtgtcttgttatgtactcctaacaccttgtgagtcctcccccaaatttgaggaagaacttggaagaaataagttgtgtagacaaaagaagtcattatatgggctaaagcaatctccaagagcatggtttgagcagtttggaactatggaggatgatactatcctcacaggttatgatagcttggagctcaaaggtttgaaggagaaacttgccaaagcttttgaaatcaaggaacatgacccattaaaatacttccttggaattgaatttgcaagatctaaggaagctgttgaaacaccaatgaagtccaacataaaactgcaaccagttgaaactgagaatatggtagacaagggaagaccaatcagcagacatcttaacgaaagaattacgcaagaaactcttcaacaacataaccaacaagttgttcatggaagatatcttcaagccagcttgagggggaatgttgacagggtgccaaaagaggataaaatctctatttga

SEQ ID NO: 46141 - DNA, 243 bp, Glycine max
  Peptide Sequence Number=SeqID_162919
gtacgagcagttatgcaagtgggatcagcaactttcattatcagagtaatcaagcacagcggtatctgtagtggcgacagcaaaattctgcaagttgcaagtcgtttccaggatgtcacgacgtctcacgtgacatcagctttctgctccccctgtctccatgctcctactgctgtgaagcagttcactgcggcattctgcaagttgcaagtcgtttccaggatgtcacgacatctcacgtga

SEQ ID NO: 46142 - DNA, 691 bp, Glycine max
  Peptide Sequence Number=SeqID_162920
atggcatcaacaaatcgagtgaagttacagtttggactacaacaagatatccctgttgatcccatgaatcttgatttagttcaccacattgacatgcgaggcaatcattacactgattggatggaatatcatgcggagtggattaatatctggaaaaacaaacacaacgatattttagctggtcaatgggttgaaggaatagtgacacatacaccaacgtacatggaatggtatagaaaaaacactactttgttcttgtctattgaacaacaactacatgatccacgcacgacaattacacaaaatgttgcaaggtcaggtgttgaacaaacacattttgaaattccacatcctcagtcaatgtattctactccttcacctgttcatcaaacttttggccacactggcgagtcagtcaccgcaaccacccatgaatggatgaccgatttatttggcgtcgatttcaatacaccaaattcagcgacatcatatttagctactttacaacagttcgatgcaccgcattcgttaggagaacaaggtgaaagttcttcagctgcaacaaccaacattgaaaatactaacatagaacaacaacatgatcatgacgtggaagaaccagtcatactggaaagaagaaatcctcgacgtaatcggcgtccaccaccttgtgggactggtcatcgtcttg

SEQ ID NO: 46143 - DNA, 984 bp, Glycine max
  Peptide Sequence Number=SeqID_162921
tactctcaccttcgagggctacacgccctcgccttcagaggactacacgcactcaccttcagaggactacgcgtcctcgcctttagaggactacatgtcctcgccttcagaggactacacgtcctcaccttcacagggctacacgctctcgcctttaaaggactacatgtcctcacctttagagggccacacgccctcgccttcaaagggctgcacgccctcgcctttagagggctatatgtctttgccttcagagggctgtacaccctcaccttcagagaactacacatcctcgccttcagagggctaaacgtcctcgtcttcagagggctacacgtcctcgccttcagagggctgcatgtcctcactttcagagggctgcaagtcctcaccttcggaggacaaaacgccctcaccttcagaggactacacgtcctcacctttagagagctgcatgccctcgccttcagagggctgcacgccctcgcctttagagggctccataccctcacctttagagggctggacgccctcgcctttagaggactacacggcttcacctgtagagggctacacgccctcacattcagaggacttcacgtcctcacattcagagggctacacgccctcgccgttagagaactacacatccttacctttagagggctacacgccctcgccttcagaggactacgtgtcctcggcttgagagggctacacgccctcgccttcaaagggttactcgtccttgccttcagagggccacatgccctcgccttcagaggactacacgtcctcaccttcaaaggactacaagtcctcgccatcagaggactacatgtccttacctttagagggctgcacgccctcgccttcagaggactacactttctcaccttcaaagggctgcacgctctcgccttcagagggctacacaccctcgccttcagagagctgcacgccttcaccttcaaaggactacac

SEQ ID NO: 46144 - DNA, 669 bp, Glycine max
  Peptide Sequence Number=SeqID_162922
atggcttctccacctgcctcccctcctcctcctcctctttctcctcctcctcctgatccttccgacacatcggcttcgccgtctgccatgaagcggacacacaaagcctcccgtctacgatcgttgtctactagaccacctggtgctgagagaccagtggtccatgttaatcctgctactggcaagaccgacggtccccacaagaagaaattaagaacatatttggggattgtggcgcgtgataagatggacgtcacctacgagaactggaaggaggtccctactgctcagaagcacttgatttgggaggatattcaggtggaatttgaaatcccagaggcttctgacagtaggatgaaaaggaagttatttcagaccgtgggcgagagatggaggcagtttaaatcagacctcacgagaaaatgggcccttgcagccgatcaggacggtgtggaggacactgtcagtgagaaatacggcatcagcaaggaaaaatgggcccagaattgcgcaaaaaggcacagaccatccagaaacagaacattgcccccccacggtttgtctcgtgggggttatgaatatttggagcagaagctcctggctgagaagacgaagaagaagctggaggaagttgcacagtcaggaagctgcacagtcaagaagcgttga

SEQ ID NO: 46145 - DNA, 270 bp, Glycine max
  Peptide Sequence Number=SeqID_162923
atggacccgggcctaactcacaaaaacactccccagaagagtcgccaactgtcgcaacatgcctttttgcgggtgagcaaggcgaggctctcgggtgagtcttccaaaggaggaaaatgcgcggagtctcctccaacgtttatttgtggaaaacgtctgaaaagccgaaggaaaccgatcataaagaatattccagatttgggagttgtatttacgttcgaggaaggtattagcacctctcacgtttgtcccaaaggacaacaaccttaa

SEQ ID NO: 46146 - DNA, 204 bp, Glycine max
  Peptide Sequence Number=SeqID_162924
atggcattggcagcaagcgaggctcacggagtgaggaagggacactacaatgcaatctgctgctggatggactttatcaacttttcgtctctgtggggacctgctagcagcagctatagctacgtccattattattcgtctctttcaaccttttgttttgtggtgaaaacaaatacagtagaggagaaacaattagaagtataa

SEQ ID NO: 46147 - DNA, 444 bp, Glycine max
  Peptide Sequence Number=SeqID_162925
atggagaaatacttggtttcgcataaacccccaattgaaaaagttcagcctcatcgtcgtagttggaggtgccaatggaagaggggctcggttgaactaaatgggagatttgagcgtaattatcgtcatgagatgctggatctgctaattcgatcgtattctgagacgaatcgattgattggtgaggcaaatggtgatggccatcttccatttagaaagcaaggcatctctgcagtagattttgacaacaagggaatatacttggtgtctgtgacaaaatcaggttgcttaacagttcacgacttcgaagctctttattgccagatacctgaattaacttgcttgaaagaagatgaaagcaagcatttaatgcatctctcactaaatcaacaacttgatgctgtcagatggaatcctcttaatcaggatgaggtgtcagcttaa

SEQ ID NO: 46148 - DNA, 1446 bp, Glycine max
  Peptide Sequence Number=SeqID_162926
atggaccggttatcacagagcagttcagactcatcatccacacgaggagaccccaaagtgttatccatagagtgtctcaagggaagttccaaagccgacgagtggaccggagacatgcttcaaaccggcgacatcgtcgaagagcttcgaatcggaaactctccgaacgcgcttatccgcttccaatcgcctttcaaaaacggcaagagtggcgtcagcagaatcctgcaagactcttacaagaagaaagagacctctatcctcgttcgggttcgccgaggaccccatgagttcgccgagttgcaggcttgtatcgttcccaacgattcttccgggaagaagcactatgttctccgctccatcactgatcctaactacgttgttgggttcttggaccgaactgaaaccaagtgtttccaactccaagcttcaaggaccagcaggatggtgaatgcactaactaggacgcggttacaggatggatatgtctcgtatccatgggagaggaggatgcaggagttgttatcagttcccaattcaagcaattttctttcaatcttacttcttcccaaagtttcagataggatagcttctcgctacaatgatgtggaggacacactagccagagcaaatacgtggctgaatgcaactcaagcttcaggggtccctattgtctttatgaacgtccaaacagagtccctacttaccaagatctccggagagacggcttcttccactgtaaatgcagggtcattatccgacgtatctaaccttgcaaatgcaagcctttatggctttgaggattaccatggagtagacattggtgttgttagagcggttcggctctggtatgctccaatcggcggggagatctcaattgagataaaactaaaagaggatgacacaaaacttggctttgccattagtcgcacagaagagggttttattttcatccaaacagttattgaggatgaccaagaaaatgtaccagccacacgttcaggactaagcaatctgtataaagcagcaaaagatgcttcaaagttgttggtagtgtctaatctttcaaatcaaagagtcctcccatggatggtttcttcaacaggagccattaggtgttatgacactgtttcattgagccagaaactgtccttgcatagacacaccaaagttcctattctccttcatgtcttcctttgggatagaaaattggcttcaagtgtagaaagtacaagattgagtaacttgtctccctcagtgttgccattgccattaccaccagaagttcaattggcacgccatccaaatgagaaccaaatacagccattgccccatgaaggatctgatgcaggtgatggttctcagccaatgcagcttgagagagacacagctggggatctctcattcagattcaacaacttctccgtgtccaacaactgggtatga

SEQ ID NO: 46149 - DNA, 693 bp, Glycine max
  Peptide Sequence Number=SeqID_162927
gtgttaagaacaagacaaacaaccacggttaatggatccagcatacacaaaggtctctctgatgtagcttttacaaaaaatgacacaaggatacttgcttctgatacacatggtgcaattaatgtctgggacagaagagtgaatactctaccttgccttgagcttgcatctgcttcatgtggtacgcttaacagcatccaattaaatgcagataatcagattatttttggtgctgggaaacacgggcttgtgtatgtatgggatattcgtggtggaagagcatctgctacttttcaaagtctcaaagagatatgccatccacctgtaacatcagtgaagttggcaacattgctagagaagattggatctttgaagtttggtgttctagtaagagtagttttcacttcaggcttctctccagactatacagtttgcaataagatgtctggatttcaccatctggcacaggcaaatattgttcccaaggagattcactctattgatattgatccatcatgcccatatcagttagctttccatcttgtggatggctggtcaggcgttttggatactaataattttcaagttacgcatattcattgcccacccccagcttggttaaacgattcctacattcccgctgatctatcatatttaagaaaaccttcatggctatcgacgggttcggcttaa

SEQ ID NO: 46150 - DNA, 1197 bp, Glycine max
  Peptide Sequence Number=SeqID_162928
atgcccttacctctgaaatctccatctactcgatggatttttgtcaagtggttggcactatataaggcccaaggaatttcttctacggttctggccgtacacctcaggggaacagtttttctgaattactggtttgagattctgggtgcaaggattggatcctcagttttactcgatactgttgacatcactgacccatctttggtgtcaattggagatgaagttgtcattgctgaaggtgttttggttcaaatccacgaggtaaagaatggaattttaagtttccatcctattaggattgggaaatgttcttccattggaccttatgttgttatccaaaaaggaagtgttattgaagaaggtgctgagaatgaaaactacctattatcagcaaaactcaatgtgatatcatccaccactttatgggaatctatcttgttggctttctcagctcccttgctgcagtcattgcctacttattatatatttggttctccaagcaacctccatcaccccagcacttcacctttgtttgcatatatggtgccttccattggataccgtttacaatcattgcatatgctaccctgttttctgaagtctcgtcaaatcccatcacctttgccatttcatttaccagcgcctacttgcttcatgcttctctcaggaacagaagccttctgcatatatctatgccttttaggtgcgaaaattggtgaacattgttccattagagccatcaacccagtttcaaatccagagttaatgtcaattggtgctggtgtccatcttggagattttagccgtgtaattacaggttttcattcttcaagtggatatgttggaggaaaaattgaggttcaggacaatttggttagcgggagtcaaagtctaatcctccctggttctctagtccaaaagaatgtcattcttggtgcactttctgttgctccaatgaattctacattccgagagggtggtgtctacattggctcacagtcccaagttgtcataaggaactccgtgaagaattcttatgatgaagggaaagaagagacagacatggtaagcaagataagagttggtaatttggctgcagcattgcacaaaaatgagtcacacaaagtgaccttgaccagaacatggtatcagacattcttcactcagccactgctacaaacagttcaagatttttaa

SEQ ID NO: 46151 - DNA, 1767 bp, Glycine max
  Peptide Sequence Number=SeqID_162929
atggctgcaacaacagcaacctcggcacaggttttcaaagactacaaggacagcaacaatggcaaccctgaaattacgaggcatgaaattcaagccgccatagccaaagctgtggagctaagagctcttcatgcggctttaatgcgaggaaatagccctgccaatgctagattcccatccccttcccctgcttcgcgccctgttgctcacttctctgctcaagattaccctgttttcactcctagctacgaagatgatccactggtggggtacaatcaaaattccatgaaaagcctaacagtatcagaaagttgggatgggagtatgctagaaggaggaaacaacatagataacatcgtagcagattacaaggagagatcaagttcaaggaagggactatatgctggttttgccaaccttgaatctcacatatgccccacggaagacaccaaatctgtgactggctctagcgcaaatcaaattaccgttcttcaaacatcgccaccaaaagactacttcaagtgtaggaggcgaaacagtatggaggatttcaagtctgtatcttcctgcaacaaatgtaaccctgccaccttaactagtgaatttgagaatgcaaggaacagcaagagctccaacattgttgtccaggtcacagattcccgctcatctcttcaatcacaaactaaaaacaagggggtgatttcttggttgtttccaaggttaaagaagaagcacaagaatgagaattcccctaatagagcagaatctgaggatgtctctcaggtgcttaaggacttgggaataatgtcaattgagacactgaagaaagagctggtggaagcaaacgaaaaccgagacatggccttaatggaagtttctgagatgaggaattcattgggggaactgaaacagaagctggagtacttggagagttactgcaaagagctgaagaaagctttgaagcaagccgtgcagccaagggattttcaactttgtgaccaactaagtagtcttcctcagagtaggaaatcatttgaagggaatggagaaaatttgatgcccgtgagtgaagaagtaatggttgagggattcttgcagatagtatcagagtctagattatcagtgaagcagttctgtaagacccttataaaccacattgaagaaactgatcattctttgacagaaaacttgaattttcttctccaaccatataagctgtcactgaattccaagtactcaaaggcagttctataccattttgaagcttttataaaccagtctctctaccaagactttgagaattgtgttttccaaaagaacggttgctcaaaattccttaacccgcagcaggatcgtcaaacacaattctcctcattcgttgcccttaggaatttgagctggaacgaggtactgagaaagggaacaaaatattacagtgaagagtttagcaagttctgtgaccagaaaatgtattgtatcaacactagtctgaaatggacaaggccttggcctgaacagctccttcaagctttctttgtggctgcaaaatgcatgtggctgctacatttgcttgcgttttctttcaatccaccgttgggaattttaagggtcgaagagaataaaacctttgatcctcaatacatggaagatatgtgtccgaggtcacaaggtccaagaagagttaagatcatggtgatgccagggttttatgttcaggatagggtcttgaggtgtaaagttctctgcaggtacaaatctgcggcctag

SEQ ID NO: 46152 - DNA, 2866 bp, Glycine max
  Peptide Sequence Number=SeqID_162930
ttggtgctggtccacatggcttatcagcagcttatgcactgccaggcttggttataagaatatcacagttttggagaaacatcacacggttagtggcatgtgtgaatcagtagaaattgaaggaaaagtttatgatctagatgggcaagttcttgcagcaaccagtacaccaatcatttttcgcttggcaagagagacaggctctgcactagaagaattggactcccacaagcttgctgttattgacccttcctctggagaatatcaagatactaaagttgctgatgattatgtatctattgtgtcacttacattggaaatccaagaaaaggtgaagaattgcgatcggattggggtccatgctgttagtgacattgcttcagacttaactccagaatatcttgagcatcatggactcaaatctgttcctaaatctgtagcttacgatggatatactagtctttggcagaagattgctgaattgcttcctttaaaacttcactgcagcactgaagtattggcaaacaggcggaactctgatggtgtcaccgttaatatcaagagcttaaatcaatttgaaactttggaatttgataagatcataatctctgagtgtgaaacagaagtaatggatgcaagtgaccttgaaaaggatttgttcagcaaagtagagacaaatgactactacaccactgttttaaagattaaagggctagaacatttgcctgttggattttattattttagtgaatatatgaaagatcctagcacaattggacatccagttgcaatgcagagattttatgctgacactaatatattcttattatggtcctatggaaactctgttgatattaagggaccaacagtcatggagctagcaatcaagacaatagaagccattggaggagagaatttgtttcccttgcaagctgagtgccagaaaaagaatcctagagaattaggtgaattgccagaagtgcaatttcctgatttgcctactttgaatagctactttaagcactggggaactcatctaatcactcaaaacaggaatctttatacttggattaatgaagaagggactccagtatgccaaaggacctatggagaactatattttaactcttcttgcattgctcataatctcctaacaagccaaaagccagttatcaagccagctgacaaggttctcatggtctatgcccctggtttggattttattgatgcgttcattggatgcctaagagctaaagtcataccagtccccattcttcctccagatcccatgcaaagaaatggacaggctctaattcaaattgaaaatattgccaagtcatgtaacattgtggcaattttatcaactgtagcttatcactcagcagtccgtgcaggttcaactagtgatgctaaaggagtgatgatcgctcatggtgggctaattcacaatgtaaagttcatgcgaacaagatacaagagcacctcaaggacaatcctagtaagctggctccctcagtatcatgacatggggcttattgggggactttttacatctcttgttagtggtggatctgcagttttattttcaccaatgacatttatcaagaaaccactcttatggcttgaaactattagcaaatatcaagcaactcatagcgctagacccaactttgcctttgagttactgattcgaagattggagtctgacaaggataagcttcggaatttagacctttcatccttgacttttcttatggttgctgctgaaccagtgagacaaaagaccctgaaaagatttattgagctaacaagtccttttggcttatctgaaaaagtgatggctcctggatatggcttagcagaagattgtgtgtttgtcagctgtgcatttggagaacgcaagccaatcattgttgattggcagagaagaatttgttgtggatatgttaatcacgaggatgcggatgttgaaattagaatagttgatccagagacttgtgaagagcttcaggaagatggaaaggagggagaaatatggattagtaatccaagtgcaggcataggatactggggaagggaagaattgagtcaaaaaactttcaggaatgaacttcataatcatcctagacgtagctacgcgagaactagagacttggggcgaataatagatcagaagctattcatcactggaaagatcaaggatctaatcatcgttgctggaagaaatatttactcagcagatgttgaaaagatagttgagacttcatctgaatttcttcgtcctggttgctgtgctatcattggagtccctgaggaaattttatcagcaaagggaatttccattccagatggctctgatcagcctagaaccatcagcaaaacaacatcaggaaaaatcaagggatttgaatgtgtcaaacagttcacagatgaaacactgaacttggtaccacaaggttcaaaaactattttgacaaagaagtctttgttaaggtcattcactacaagaacatggggagaagaaaaaacaccagggccacagcaagtaagaggtagtatacttgctcctagaaaaaggatcaataagaatgaaattgtagagctcttgaaagggcttatttctgagcagactggaatcccagtcaacgacatctcaatcacagacaacctgacatcctatggaattgactcaattggtgtggttaaagcaactcaaaaactctcagatttcttaggcactccagttgcagctatagatgttttcactgcatcctgtattctagaattggctaacttctctaaggatcttctatcaaagtctcagccttctctttcaagcaatccatccaatgttccagaagcttag

SEQ ID NO: 46153 - DNA, 837 bp, Glycine max
  Peptide Sequence Number=SeqID_162931
atggccacaatgatggaggccacgatgagcatgaagaagataatggaagccaatgcggttgcaattgctgcttccagcactgttgctaaggtgaactcgatgcccccatctggcctcaaccaaatgaatcatccaacctcagctatggtaggcaaagatttgggaagtacgggcggcccccattatgcgcaaattcaaaatgagcacgccttcccgccatatggcttgcctcccaactatacgccacccaatgtggcatacactcccaatgagaatacacatgaaattccacaccacaatctagccgactttgagccttgcctcggatattccactgaagggcaagcagttggtggtatacccctacaaaacactttggagggccctcaatatcacccacaaccattcccctcacattccacagcgattaaaaaccctcatgctatggcggaaatgggaaagttggatcatctagaggaaaggctcagggccattgaaggaggtaaagattatgcctttgctaacctagaagagttgttcctagtacccaatatcatcacccctcccaagttcaaggacctaatggttgcctacgttaggcagtatcaatacaattatgatatggttccagataggatgcaactacagaacatgtgcaaaaagggacatgaatctttcaaagaatacacccaaaggtggagggatctagcagcccaagtggcacccccaatgatgggaagggagatggtaatcgtgatggtagacacattaccagtattctactatgaaaatggtgggttacacaccttcaagctttgcggatatggtcttcactga

SEQ ID NO: 46154 - DNA, 237 bp, Glycine max
  Peptide Sequence Number=SeqID_162932
atggccctataccttgcaagcatacaaatgtacatactacagaacaaagatttggacatgacatgtactaatggacattggcgaaaacatgtcaaagctacatatatcatgcttgtattgctagaaggtacagacatgagacatagacatagaagaccccggtcaccagtggccccgttggtgcacgaaaagacagagactagtacaggacttcatgagcatgttttgtttttttaa

SEQ ID NO: 46155 - DNA, 221 bp, Glycine max
  Peptide Sequence Number=SeqID_162933
ggatcacgcccgcaagacatctagtggacccgaagaagtctaatagggtcctagggtttccagctctaattacgggcccctgtcagttctacggagtgcccgtcgaccccaacaagttcatcaggctcctattaatcgggctttcattaagaagtactgtgcccccaggcaagcgcagggcgagacaccacagcagcctagggatggccggcagcgggtaa

SEQ ID NO: 46156 - DNA, 288 bp, Glycine max
  Peptide Sequence Number=SeqID_162934
atggcatctaagaaaaggaaggctccttctacaccttcccaaatcagatttgacagatcaagatttcactctcaagaggcttggaagctgttaccagaaaggaacgtggtagtttattacactaagtttgacgagttcaaggaggaactcgagagaagacacaaggatgaggagttcactgattttactgacgacaacataaatgttgctattgtgaaggaattttacactaacctctatgaccccgaggataaatcacctaagcaggtttgcactcttgaggcctga

SEQ ID NO: 46157 - DNA, 638 bp, Glycine max
  Peptide Sequence Number=SeqID_162935
gtggtttggaggcagtacttggtgtggaagacttcaagtttccggtgaatggcgaagaacaagttggggaagaaaaagaagggctcaacaatgggcttaacaagttgggctcaagctccacggtggagctccaaccaaaagccaccgtagccggcgaggcttccgccggaaaacacatgcctccggcaaatgtcatgactcgtctcatactcatcatggtgtggagaaagcttatccgcaatcccaacacatactctagcctaattggtgtagtatggtccctcgttgcattcagtaataatcaaagtgatcttgtgttcaccttgttgggaataatgccacccgacacgtggggcccgggctataaactaggtcactttgcggaggacaacggttctggtctgtttatggcacttcaacccaagataatagcatgtgggaactctgtggctacatttgccatggccattagattcctcactggtccagcagttatggctgcagcttccatagcagttggcctccgtggcaccctcctacacgttgctattgttcaggctgcacttcctcaaggaattgttccgtttgtgtttgctaaggagtacaatgtccatccagccattcttagtacagcgtaa

SEQ ID NO: 46158 - DNA, 390 bp, Glycine max
  Peptide Sequence Number=SeqID_162936
atggaagaatctattcatgtttcatttgatgagtctaatgctattcctccaagaaaggatattgcagaatcattagaacaaatgcatattcatggacaagattctaaaggaaaaggagaaggaagcaatgaggattctcaagttgatgaaaccaaaacaaatgatgatcttccaaaagaatggaaagcttctagagatcatccccttaacaacatcattggtgatatcttaaaaggggcgaggctcacgggtgcgctttccaaagaaggaaagatgcacggagtcgccaccaacgaaggtattagcacctcttacgtcgacaaaagcggggctcttgctcctacgtaccctccatcaaagaggaaatcagacctacgtagttcttcctaa

SEQ ID NO: 46159 - DNA, 1026 bp, Glycine max
  Peptide Sequence Number=SeqID_162937
atggctaggaccatgctcaatggtaactcaacaaaagttcaagaaaaggtagaagaatccactgaacgcatcaagagaagtaatcatcatgaaattcaaatcattggtgacccagtagatcgtgttcaatcaagatcatcactcaaaatagaagggcacactgcattgatttctgaaatgaaacccaaacacattgatgatgcaatgcaagatgataactcaattaaggcagtgcaagaggaacttgatcagtttcagagaaatgatgtttggaagttagttgaattgccgaaaggaaagaaaccttttggagggatatggatcttctgcaacaaactagacgaaaatggatttgaaagtgaaactcttcctcaatatggttttaagctcaacaaagccttatatggacttaagcaagctcctagagcttggtacgaaaaaataagttcatttatcttgaaaaatggctttgagcaaggaaagtttgaaatgagtatgatgggagagctgaaattctttcttagactacaaataaagcaaacacccaaaggtatctgtatttatcaaaccaagtatgtgaaagaattgctgaagaaattcaacatgaacgatgcaaaagaaatcaagactccaatgcatcccatgacataccttggactggatgaggaatcaacaaaggtggatggaactcgatacagagcaatgtttggcgcactactctgccccattgcgttcagacccaatattatgttcagtgtttgtctatgttcaagatttcagaaagaaccaagggaatttcatctaactgcagttaagctcattattaaatatctcattgaaacttctaatcttggtcttctatttaaaagaaaagaaaggttcaaattcacaagcctttgtgatgttgactatgctggtggtaaagttgaaaggaaaaaacacaattggaagctgtcactttattggtggaaacttagtgacgtggatatgcaagaaccaaggctcaactacattgtccactgttga

SEQ ID NO: 46160 - DNA, 1464 bp, Glycine max
  Peptide Sequence Number=SeqID_162938
atggagaccatgatgagcatgaagaagatattggaggtcaatgcgactgtagttgccgctaccaatgccattgctgaggtggactcgactcccccatctggccttaaccaaataattcatccaacctcagatatggtaggtcagggaggcaaagaattgggaagtacgggcgccccccattttgtgcgagttcaaaacaagcatcccttcctgccatatggcttgcctcccaactatgcaccacccaatgtggcgcacgctcccgatgagaatgtcaataactattctcccatactcattgagagccaacaacctcaagctgatcattcacatgtctctcaacccatgggggagacacatgaaataccccaccacaacctagccgacttcgagcctcgcctcggatatgccactgagggacaagcagttgtgggaaaagtccctcctgctatgatggaaaaggggaaattggatcatatagaggaaatgcttagggccattgaaggaggcggagattatgctttcgttgacatggcagaattgtgcctagtgcctgacatcgttatccctccgaagttcaaggtatcgaacttcgataaatacaaggggacaacttgccccaagaatcacctaaaggtgtactgcaggaaaatgggagcatatacgaaagatgataaattattgatgcatttcttccaagaaagtcttactgggacaactgtcaccttgtacactaatctggaaccttcccgagtccattcttggaaggacctaatgattgatttcattatgcagtatcggtataattttgatatggctctagatggaatgcagctacagaacatgtgcaaaaaggagcacgaatatttcaaaggatacgcccaaagatttaatcttgccgatgaaaggatcgaagtgggtctgagaagaggcaaatttgatcatcctgctttgacaaataaaaagcctggggaaaatagagagaatgagaaagaggaaggaactcatgttgtgactactattcctacatggccaaattccccaccagctcaacaatatcattactcagccaatatcagcccttctcattacccaccatccaatcagctacaaaggccacccctaaatcatccaatgccaaacaccacctttaacacaaaccaaaacactaaccagggaaggaattttccagcgaagaagtctatagaattcacccaaattccgatgtcatacgctaacttgctctcatatctacttgataattcaatggtagccataaccccagctaagcgacctacgctcttgagtttgactttcaagcctgttgtcgcaacatgccctttggcgggcaagcgaggcgaggctcacgggtgcgctttccaaaggaggaaagatgcgcggagtcgccaccaacatttatttgtggaaaacgtcggaaaaaccgaaggaaaccggtcaaaatga

SEQ ID NO: 46161 - DNA, 243 bp, Glycine max
  Peptide Sequence Number=SeqID_162939
atggcaaatgaagaattgaagttgcaggatccacgatgtcggatacaatgtcctgacatcctgctcgagaatactggagttgctatacaatgcaagataaaaatttttcagaagaagatagatctcctccagcatcaaggagttgcagcccagaatcgtacacggctatataatcatggaggctgcacgagttctgtaccaagtccgggattgaagagttattttgtgagttttgggacttga

SEQ ID NO: 46162 - DNA, 2148 bp, Glycine max
  Peptide Sequence Number=SeqID_162940
atgcagaaggcaccacttgcacattccaatgagtttgccttgaaggagacctctcccaagattggtgcaggggcagtaacaagagacaagctatcatgcacctatgaccttgttgaacagatgcagtatctctatgttcgtgtggtcaaagccaaggatttaccttcaaaagatgtcactggaagtctcgatccctatgttgaagtgaagcttggaaactacaagggactcaccaagcactttgagaagaagtccaaccctgagtggaatcaggtctttgcattctccaaagaccggattcaagcctcggtgttggaggttattgtcaaggataaggatgttatttcagatgattttgtagggaggatgtggtttgatctcaatgagatcccaaaacgtgttcccccagatagtccattggctccacaatggtacagattggaagatcgaaagggcgaaaaggtgaaaggagagataatgcttgcagtttggatggggactcaagcagatgaggcatttcctgattcttggcattctgatgcagcaatggttggctctgaagcagtttcaaacataaggtcaaaagtttacctctctcccaagctttggtatgtcagggtcaatgtgattgaagcacaggacttgataccaggtgataaaacccggtttcctgaagtttatgtgaagattaatctaggaaaccagtttttaaggactagagtgtctcaaagtaagaccatgaatcccatgtggaatgaggacttgatgttggttgctgctgagccttttgaggagcctttgattctgagtgtggaagacaggcttggaccaaacaaagatgaagtattgggaaggtgtgtgatccctttgcagattgtgcaacggaggctggaccataagcctgtgaacactaggtggtttaatcttgagaagcatgtggttgttgaaggggaaaaaaaggagattaaatttgcaagcaggatacatttgaggatgtgtttggatggtggtttccatgtgttggatgaatcaactcattatagtagtgatcttaggccaactgctaagcaattatggaagcctaacattggaattctagaagtggggattataagtgcacaagggcttatgccaatgaaaacaagagatggtagaggaaccacagatgcttattgtgtggcaaaatatggacaaaagtggatccgcactaggactcttgtggatagctttactccaaagtggaatgagcagtacacttgggaagtgtttgatccatgtactgttattaccataggggtctttgacaacggtcatatacaaggaggaggagagaaaggtggtggtggatcaaaggattctaggatagggaaagtgagaattaggctatccacacttgaagctgatagagtttacacacactcatatcctcttttagcacttcacacttcaggtgtgaagaaaacaggagaactgcaattggctgtgaggttcactaactcatctttcatcaacatgttgtatttgtattcccagcctttgttgccaaagatgcactacatccatcctctatctgtgattcagctagacagtctgaggcatcaggcgatgcagattgtatcaatgaggttgagtagagctgagccacccctaagcaaagaggttgtagaatacatgcttgatgtggattcacacatgtggagtatgagaaggagcaaggctaatttcttcaggataatgaaagttctaagtggtttggtagcatttggaaggtggtttgatcagatatgcaattggaaaaaccccatcaccaccatactaattcatgtccttttcataatattggttctctaccctgagctaatactccccacaatcttcttgtacctgttcttgattggaatttggaacttcagatggaggcctagacaccctccacacatggacactagactgtctcatgctgatgctgctcatcctgatgaactggatgaagagttcgacacattcccaacttcgcggtcatcggatatcgttaggatgagatacgatcgtttgagaagcattgcagggagagtccaaagtgttgtaggtgacttaggtacacaaggagaaaggttgtgtcacttctcattggcttctttatgctaa

SEQ ID NO: 46163 - DNA, 275 bp, Glycine max
  Peptide Sequence Number=SeqID_162941
tttgtgcgcttagtgagtatgtcctgctaagcgaggcaccagcacgctcagcgagacataggaatctggaagagaatctcccgtgcaagcacgcgctcaacacgttttcgctcactaagcgagtcgttcgtcatcttccaggcaaagatttccatataaaacctgaaaacacagaattggaggagagtttggagtgtgtggacccagaggcgactgagcataccaaaggaggcatcttgaagagctttgaaagagtttttttgagagattgtgag

SEQ ID NO: 46164 - DNA, 360 bp, Glycine max
  Peptide Sequence Number=SeqID_162942
atgagtgtctctaccagttcagcctcagtcagtaggggcagggtttcgctccttttgcaagccctactccagagcagtttggggctgaggtcacatgggccagagactggcccgaggcccaggcaggggaggagcccgcaggatcccccggtgaggcagaggaggcccgggcagggtttcgctccttttgcaagccctactccagagcagtttggggctgaggtcacatgggccagagactggcccgaggcccaggcaggggaggagcccgcaggatcccccggtgaggcagaggaggcccgtatggatgaagaaatgactgacttgctcgatttcttgggaggaagcgaagccacgtga

SEQ ID NO: 46165 - DNA, 225 bp, Glycine max
  Peptide Sequence Number=SeqID_162943
atgaccactcttacacagatatgggtgatgttgctacttggcaacattctgcccaacgaccacaatactgatcttctccccctacggaaggtgcccgttcccccagcaaggtcataccatcgtgacatagggatcgcgcccgcaagacacccagtggactcggagaagtccaacagggccctagtgttggatcaaggggcccctagtggatgtaccctccactag

SEQ ID NO: 46166 - DNA, 606 bp, Glycine max
  Peptide Sequence Number=SeqID_162944
atgacggaagggtgtggtgaagggttttgccttgcaaaccttcccggtgatgcttttagtctatgggggaacttctttgaggcaaagaaacaaatgatggctgatgccaagtttgcggggctgcttggtcttggcaagccgttggttgaaattttgccccccggtcaacttcgtggtttttgcccgttgttggcttggctagggtcggcggtgctgggttatggccccgtgctaagtttcggattggttggccccctcctcccccccgtgatcagttttgttgccaggattttgccaactttggcttgcgccccgttggctaagtctgtgcctcggattctacccgccgctcgatgggaattgcgcttcaaggcgtctcgtagggctaatccgcctcacgagggtcaccaacggcacgtgcctttggggggccgaggccccctactgctggtcggcaaacggacggcgggcgcacgcgtcgcttctagcccggattctgacttagaggcgttcagtcataatccaacgcacggtagcttcgcgccactggcttttcaaccaagcgcgatgaccaattgtgcgaatcaacggttcctctcgtactag

SEQ ID NO: 46167 - DNA, 587 bp, Glycine max
  Peptide Sequence Number=SeqID_162945
ccattgatgagcttcactcgctgcagaagaagaaatccgcgcccaccactcccgttacggggtttcaggctccgttcgccaccctcaccgaagaagaacgtcataagcaacaactccagtcaatcagtgcatccctggcatcactgactagagaaactggaccgaatctggtgaagggagacccagctcggaagtcagatacccagaaggttactcacgtgcaccaccatcatgtcagtactcccaccattgctgtcagcgacagtgctttgaaatttactcatgtcctctacaatctctccccagctgaactttatgaacaggcgattaagtatgagaaaggatcgttcatcagttccaccggagcattggcaacactttctggggccaagacgggtcgctctccaagggacaagcgcgtcgtcaaggatgatcttactaagaacgacctttggtggggaaagggttctcctaacatcgagatggacgagcacagtttcatggtgaacagagaaagagctgttgattacttgaactccttggacaagcttaaaaattacacggtaaaccaatccgaaatcacgtaa

SEQ ID NO: 46168 - DNA, 240 bp, Glycine max
  Peptide Sequence Number=SeqID_162946
atggggacattgtttttcttccattcaccgattcctcgcttttcactcccttccatgccaaaacctattgcacttcctcctctttcttgtctgaggaataatggagatgtcaataaaattgtggacatgccccagtccatgtatgatgataaccagaatgtgaaacaagataatatttggcaattgtccaaagaagctcaacagaacatactaaaacaaacaacaccttggggccattaa

SEQ ID NO: 46169 - DNA, 246 bp, Glycine max
  Peptide Sequence Number=SeqID_162947
atgccttgggttctccaactacaacatccagattttgtggtgtggttctcccaaggttcttatcaattggtatctaagtcttctccatcatgtctctcagctgcaaacgagtggtgcgggtggtcactagcattacagtgttcgcctggaacaagtcaaagggctagtgcacaaccaacccgtgtggactccaggactgcaaagtgtggtgggatgttaggattcaattcaaggtacaggacttga

SEQ ID NO: 46170 - DNA, 234 bp, Glycine max
  Peptide Sequence Number=SeqID_162948
atgacaccattggtccctagaggatcagtagcttcatatgtgaccggcatatctcgtgcacttcacagaaagggccatctggtggagcttatattgccaaagtatgcaagtttaaacctagatggagtgcaagggttgcatgaagttaatgtagaggttacctcgtattttaatggtcaattacacggaaatagaatttggactgggttagtttggctttctttgtctgtttag

SEQ ID NO: 46171 - DNA, 966 bp, Glycine max
  Peptide Sequence Number=SeqID_162949
atgatgaacactgttggggtgacaatggtgtctccaacattgaaggtggttgctatgccaaatgcattgacctctcacgggagaaagagccagatatttggaatgcaatcaggtttggcacagtgttggaaaatgtggtgtttgatgagcatgatcgagaagttgattactctgacaagtcagttacagttgtcctcatacttgcaagatcttattgagaagcaacagctaacctattttataatgcaagaaaatactcgtgcagcttatcctatagagtacattccaaatgcaaagttaccttgtgttggccctcacccaaagaatgtcatacttttggcatgtgacgcatttggtgtactcccacccgttagcaagctaaacctggcacagaccatgtaccatttcatcagtggatatactgctttggtggctggcacagaagaaggtattaaggagcctcaggcaactttttcagcttgttttggtgcagcattcattatgctacaccctacaaagtatgcagcaatgcttgctgaaaagatgcagaagcatggtgctactggatggcttgttaacactggttggtctgctggaagctatggtaatggaagccgtattaaactacaatacacaaggaaaatcattgatgctattcactccggaagtctcctgaatgcagagtacaagaagactgaaatttttgggcttgagattcccaccgaagtggagggtgtcccttcagaaattctggatcctatgaacactgttagttatcctagagctctctacctatttttttttctatcctttgatatgtggtcaaacaaaaaggcctacaaggagacactattgaagttggctggattgttcaagaacaattttgaaaccttcaccaactacaagattggcaagggaaacaacaacctgacagaagagattctcgcagctggtccaatcttttga

SEQ ID NO: 46172 - DNA, 462 bp, Glycine max
  Peptide Sequence Number=SeqID_162950
atgcaaagctgtatttcttccaaattcaagtctgtgaatgtgaagcacttttgggttcaatgtgagagtgagactttccttcagaaggtcgttcaagagcaaggaaggggtagaattatggacaccatcaatgagattcaagagaagcatgatgttgtcaaagagatacaaaagaatctcaaggagttgcaccaagtgttccttgacatgacaatgttggtgcaacatcaagctccttcgtttgtgcgcaccggagctgagcagttgcagactgcatggaagcaccaaaagaacaccaggaaatggacctgctattgtatcatgcttcttttggtgatcatcttgtttgtggtgctatccattgtgaagccatgggaaaataccagtagtggcagaaataggggtggtcagcctgcaccaactcaaacacctccatcaccttcacctcttgttaatgcttaa

SEQ ID NO: 46173 - DNA, 892 bp, Glycine max
  Peptide Sequence Number=SeqID_162951
ggttgaaggtcgaatcggtagggttagtgtcgagcgagtggaagagttgaagggcttgttggaggttgttgttgtgtgcgtgaaaggagatgatggtgttccaaatgacgatgtttcgggaggtggggaggaaggggaggttgagggcagtgcaggacttgagggtaagggagaagagctgacacagtctaggtgtcgacatcctaagcaatggaaacttctaggaatggaaataacttattctaatcctagcagactcaagaggcctatcaacactcttaactggtttgaattgaaccagattgtgaaggaagctcttgagaagcagaacaacccaaggaggtttggtgtaacaaaggatttatggggagtggaccggcgtgagggtggacagtgtcgggtaaaccctaaagtcattggaaggttttccagtacaggatgtcagtggaactgcttggtcgataaagacactggacaccatgaagtttgctatgatgatgaagacaaccacaggattgtcttggttgatgcccttgaagtccctgtccataaagctggactatcctccataggaaaaactaccaatgatggtattgattacacctcttatgtgttgggcaaattccaactttggaggaggtcgtcgctcacgctgttgttcttgcccagtagtctccagtgttgtgaccaatactgcggtgataccagcaatgatcggttgcgactgaccttagcctgggaagtttcatttggggtagccgcatgggtacctccagacttcattctggaatctggacatttcttccatctggatgtagcccttggttcattcgcacagttcatccatgctaccgagtggttttttgcagaggttgtctatgaacttgctagg

SEQ ID NO: 46174 - DNA, 183 bp, Glycine max
  Peptide Sequence Number=SeqID_162952
atgattagcattcggtctagcctcagacgtgagacccccctcattgactcccatcctcgtccaatagctatggcaaacacatacactctacaacaactccaaaaccgcatcacggagatggaacgatgccacgaggaagagtcgacaaagctaaaggatgatcatgaccagctagaggctcgt

SEQ ID NO: 46175 - DNA, 681 bp, Glycine max
  Peptide Sequence Number=SeqID_162953
atgcacgatataccattatgtatccattcacttcaaccggcaatcaccaagagcaaacccggctccaagtacaacaaactcttccaaaggttccagtcgattttccggtgctttcctatcatcatgccatcatgcaagatgccaacaatgaatattggaaaccgcgggaatgaggtatacatccatggcggcatgaggatcaccggaaccctattcgggcaccggaaagcaaggatcaaccttgctttccaagaaaaccccaactgtcagccattcctgctattggagttggccatccctacgggaaagctgctccaagacatgggaatggggcttaatagaatcgctttggagtgcgaaaagccctccaacaacgacaagattaggatcattgatgaacccatttggagtttgttttgcaatgggaagaaaatgggatatggggtgaagagagaggctacggatgatgacttgaacgtgatgcaattgttgcatgcagtgtctgtggcaattggtgttcttcccaacgagatgtcagaccctcatgatggtgaactctcgtacatgagggtgtattttgaacgtgtggttgggtccaaagattccgagacttattacatgatgatgcctgatgggaacaataatggacctgagctcagtgtgttcttcgtgagggtttga

SEQ ID NO: 46176 - DNA, 189 bp, Glycine max
  Peptide Sequence Number=SeqID_162954
atggagaagttgttcaccagtcaaggctacttatatgttccaagcagtgatcgtgtctggggaaaaaagatggtgaccaggacgagttttgatgtagctccatgtggagcttgtaggccttggatctttttcatcaatgaagtcctttgcttcttgaagatcaatggcagtgaaatggagaaggagtaa

SEQ ID NO: 46177 - DNA, 222 bp, Glycine max
  Peptide Sequence Number=SeqID_162955
atgggagttgccaatgggagttgcaacttgcactcaaatcgcaagttgcagttgcaactcccctttaggcctgcagttgggcaactcgccactacgagtggcgtttttcgtgccacgtggctgtgcccagcaaactcgccactaggagtggcggtttgctatattatccatgcaaagggatccatcaccagagctatgcctaagatactccaagaagattag

SEQ ID NO: 46178 - DNA, 382 bp, Glycine max
  Peptide Sequence Number=SeqID_162956
ggtggtggtgacaaggactacaaggaggtacccccacctcctttgtttaaacctgcagggggacacatcaaccaagctgtgaccttcaatagatcttattacaagaacacgtttatgtcaacgacggtgctgtatcgtgaccgtagtagtattaacaccgtctcttacgacggtcgtccgcaacaaaacaccgtagtagtaataggaccattctacgatggttctcaggagacaaccgtcgtagaacaagattatgtctacgacggtgttgtccccatggctgtcgtagtctttcgttacttctacgacggggctgatacaaccgtcgtagaacaagattatgtttacgacggtgttgtccccatgtccgtcgtagtctctc

SEQ ID NO: 46179 - DNA, 1206 bp, Glycine max
  Peptide Sequence Number=SeqID_162957
gactctttggaagagcaaagcaggcagggcagcattgtgccttcgggacgtgatgatattttgaacatggctattggaagaccggagcatcctggtcgtgtacgtggggctgggataggggttacaattatgcagtactttggtccagcatcgcgtcggtctaccacttcatcaaacatcactgtagaacagttggctgatataattggtaacctaaaagaagaatggcaaagacaggttgaacaagaaaacattaaaagagaggaggtgtggatgaggagggtagaagaggaaaaacagcgcactatggacacatttaaaggacaaatacaagaagctatcaagttggagttgtcacaaattgcatcacaacattcagccccacttcagccaaatgatatacaagtattagcagcaagggtaagcacgaagggaagctgtgcagcaacagagacaaatgcattagctaaaaaaccctctaagttgaatggtgacaacgtcgggctgcatgtaactgccgagaactccaacaaattagtggcagtgggcaaacagtgcgacagttttggcaccatccacaatgtgccctatgctgatgatgttgttcccgtgagtatggtggaagttatttttggtgatgcggaggaagcagagaaggatgtgagctcaccattgaagactgttgaggaggaaaaggtagctgaggttattgatccattgggagagttggtgaagaacttgttcgacatttaccaaaggcccgttgaggtgtcatgggatggtgctaaatttgggatcaataatgtcaaagatggcttcttcatcatacacgctgatgtgagcgagataatattaggagacaagtgtttaaacatctccattctactgctatggcttatgtttattcatgattggagtgcgagcattggttatggagcattgtatgggttccttgaacctcagtgtatccacaatgcaagcagtagacgtcaagagtgtgaaaattacattggaaggtggttgaaggaagcaggaaaacaaatttacatagcaccttatttaaaccaggcccattggcagcttgttgtattgtgcccaggcgacaatctagtggtttggttttgttctttgcgaaagaagccggatgttgccatcaagggtgcagtaaacaggttagtgtgcctctaccgtgcctcaatgacataa

SEQ ID NO: 46180 - DNA, 1230 bp, Glycine max
  Peptide Sequence Number=SeqID_162958
atgggcttttgtgaagggtggatagggtggattaggagttgtgtggaaaccgcttctatgtccgttttggtgaatgaaagtccaacggtgacaggcataaggcaaggtgatccccttgccccttttctctttattttggtggcagaagggttggggggtatgatgagggaggcaacaaggaaagatttattcgaagaagtctctatatgtgatattggggtctccattttacaattttcggatgacactctattccttggcaagccaaccgtgagaaacattcttacattgaagagtattttaaggagctttgaattagtggaggggctaaatgtgaacttccataaaatcaagataggtggggtggcattggaatcacaacatcttcaaagtttggtggccattttgaattgtagaataatggaggtgcgaatccaagacgaagagaggcatggaatccgctccagtatgtgtggtgaaggagttggaaaggatacaacggaacttttatggggtggacttggggaggagaggaaaactgcttgggatcatgtctgggtaggtgagagttttcctaggttgtatgctgtttccttgcaaaaggaagcacatattagagagttgggtcagcttgtaaacaataggtggtgttggtcattttcttggaggaggaaccctttcgaatgggaaaaggaaagtttggtacaattgctgggatctatacaatcgttcagggggggaggagagcccggaggatcaatggagatgaaaagatggcacaggaaattcatatcgcgtgaaagaagtctatcagaacttatgtgcagtgttagagctccatcaaaagctctggcatatacatggaggatcatgcaggatagaattcaatcaagaggcaatcttcttcgaaggaatattgcagtattggagggtaactataactgtccaatctgcaattctgagttgcagaccacttctcacgccttgttcgaatgcacgatggtctatgatatctggatgcaatgtgggaactgtggaggaggagaaatgatggaagtggaaactgtcgtagagttaattaaagttaatgcatggaggtggataaaagcaagacagagatttcatggtgcagcatggtcggtggtgtcaggaaccattcttgctaagttgagcatgcagttatgtagaggaagggtagaagacaatacttattactgctttttggtttaa

SEQ ID NO: 46181 - DNA, 894 bp, Glycine max
  Peptide Sequence Number=SeqID_162959
atgggagatgtggcaaaggacctaacagctgggactgttggaggggcagcacaattgatagttggacacccatttgacaccatcaaggtcaagctccaaagccagccaacaccactccccggccagtttcccaggtattctggtgcaattgatgctgtcaagcagacagtggcagctgaagggccaagaggtttatacaagggtatgggagccccacttgccacagtagctgccttcaatgctgccctgtttacagttaggggacaaatggaagcattactgatgtcacatcctggtgctaccctcacaataaatcagcaggttgtttgtggagctggagctggagttgctgtttctttcctagcttgcccaactgaattgatcaaatgcagattacaggcacaaagtgtgctagctggtactggaacagctgcagtggcagtgaaatatgggggacctatggatgtggccaggcaagttctcaggtcagaagggggcgtaaaaggtcttttcaagggcttggttcccaccatggcacgtgaagtacctggaaatgctgcaatgtttggtgtatatgaagcattaaagagattacttgccggtggcactgatacctcaggactgggtagaggttctctgatgctttctggaggcttggctggagctgctttctggctcgcagtttacccaactgatgtcgttaagagtgtgattcaagtagatgattacaaaaacccgaagttctctggttcaattgatgctttcagaagaatttcagcttctgaggggatcaagggcctttataagggttttggtcctgcgatggcccgaagtgttcctgccaatgcagcttgcttcttggcttatgagatgacaagatcagctctgggatga

SEQ ID NO: 46182 - DNA, 753 bp, Glycine max
  Peptide Sequence Number=SeqID_162960
atgacacgcttgctgaagatcaagccttgctcaaaggatccaattcatgcaatgcagttctggcactattacagattgatagccttgtcaggagtcaggagtcaggagtcagggtacatagcatacaattttgtcattggagcttactcatactggggcccaaaggcaggatacagcatttaccatatgaataatgctgacttgttatttggaggcattacaattgtttgtggtattgttgggacattagctggaggcttgtttcttgacaggatatcttcaaccatctctaatgctttcaagcttctttctggagcaacatttcttggtgcaatcttctgcttgatcgctttccttttcaagagcttgtctggtttcatagtcttcttctctatgggtgaactactgatttttgtcactcaggctcctgtaaattatgtttctctccgttgtgtaaaacctagtttgaggccactgtctatggctatatctactgtttcaatccatgtctttggtgatgtgccttcctcaccacttgttggggtcctgcaggatcatatcaacgactggaggaaaacagcactttgtttaacatccattttctttcttgctgctgtaatatggttcataggaatctttttgaaaagtgatgtatatgacaaagatgatgaggagcaatctgccacaactagaggaggaaaactgacgccattgcttgacggcagcagtgacactacatccagtcaagtttaa

SEQ ID NO: 46183 - DNA, 234 bp, Glycine max
  Peptide Sequence Number=SeqID_162961
atggatgaccccaaactaccctctcatggctcctccatctctctcattgctaggctggaccatttggagttcattatgaaatacttagaaagaaaacaaagatatggtagcaatgttccggctgacaaagacaaacaatctttggatttgtccacgaaagaggctttctttaaaggaacattgttggatcgagtggcctctcttgaacacagactttttaaggttaaaaattaa

SEQ ID NO: 46184 - DNA, 708 bp, Glycine max
  Peptide Sequence Number=SeqID_162962
atgggagaaaaaggaaaaagatttgtacatggaataaaatcgagcagaaaaagcttgcttgcttcctcaccgcgagtgtggcttaccgtcaccgtcgccgttggttccttcggtgacggacgcgagcttctggaggttgagcttgacgacggtgtcggcgaagagacgcgtgtcctcttcggtgttgccgtcggggacgtcgacaacgtaggattcgaggacgacggtgtagatcttgccgtcggcggaggcgttgtcgtcgtcgaaggagtggacggtggtgacggagcggtagttacggaggcggtgttcgccaccgatgatgctgaagccggtgacgcggcggacgtcgtcgaggaagtcgaggcgctcggtactcgtggctgcggggaggccggagatgacattgacgtcgcgagtgacgccgacggccatgtggaagggctctttgacggcgcagctcttgatgaagtgcttgtaggtttggggcttgtcgaagcgtcggacgaaggaccagacggcgtctggaggcgcgtggacgcgctgggcgaggagggaggagcattggccggggccgacgaggtaggagtggtgctcggcgacggaggggacgagggaggcgaactcgagcggggtgaggccggagggagggttgaggtggtggttcgtcgggtggcggtggtggttgtcgtcggagtctggctctga

SEQ ID NO: 46185 - DNA, 1984 bp, Glycine max
  Peptide Sequence Number=SeqID_162963
tcagcgaatgaatctgtggacggacgagaactcctcggtgatggaggccttcatgccatcctccgatctctcctccatctggccccctcccgctcctccgcagccgcaatccacggcggtcttcaatcaggacaccctccagcaccgcctccaggccttaatcgagggcgcccgagagacctggacctacgccatcttctggcagtcctcttacgactattccggctccactctcctcggttggggcgacggttactacaaaggcgacgacgacaaagccaaggcaaaggccaagtccaaagccacctccgccgccgagcaggaccaccgcaaaaaggttctccgggaacttaactccctcatctccggctcctcctccgcttccgcctccgacgacgtcgacgaggaagtcaccgacaccgagtggttcttcctcgtctccatgacgcagtccttcgtcaacggcggaggactgcccggacaggccttcttcaactcgacccccgtttgggtcaccgggagtgaccgtctctctgcctcgccctgcgagagggcgaggcagggacatatgttcggcttgcaaaccttagtttgcataccgtccgcgaacggcgtcgttgaactgggttccaccgagttaattttccagaactcggatctgatgaacaaggtgaaggttctcttcaattttagcaacaacaacttcgacatgggttcttcttggcccgccaccagcgccgatcaaggcgaaaacgacccttcctcgctctggctcagcgatcccgaagttagggattccgttaacactgctgctgctaccccttcggtcatggttcctgcacagactcaggggatttcgatttcaaagacgatgcagttagagagttctattcaaacccctggttcgagtactttaaccgaaacccctagttctattcacgcgattccgcagaaccagagcgtgttctccagagaattgaacttctctgagtacgggttcgacccaaagagtgggaacaatcagaatcaccattctctgaagccggaatccggcgagattctcagcttcggcgagagcaggagaacctcctacggcggcgtcaatgggaatactaataccaataccaattccaattcccattttttctccggccagtcaccgtttgttgctgctgtggatgaaaacaagaagaataacatgagcaacaacgggaagaaaaggtcaccgaattcgcgtggcagcaacgacgatggaatgctttctttcacctccggcgtgattattccggccacgaatttgaagtccggcggaggcggcgattccgaccactcggatctggaggcttcggtggtgaaggacccggtggtggagccggagaagcggccgcgtaagagagggcggaagccggcgaacggaagagaggaaccattaaaccatgttgaagcagagagacagaggagggagaagctgaaccagagattctacgcgcttcgtgctgtggttcccaacgtgtcaaagatggacaaagcgtcgcttctgggcgacgcgatatcttacatcaccgagctgaagtccaagcttcagaccctcgaatctgataaagatgtattgcataagcagcttgaaggagtgaagaaggaactcgagaaaacaaccgataacgtttcttctaatcacgcgtgtaataataacaataacaacaagttgtcgtcgaatcagccggcgttaattgacttggttgagatggacgtgaagatcattgggtgggacgcgatgataacgatcacatgcagcaagaagaaccaccccgcggcgacgttgatgacggcattgatggagttggacttggacgtgcactacgccaccgtaacgttggtcaacgatttgatgatccaacaagcaacggtgaagatgggaagtagattttacacgcaggagcagcttcgagcggcgctgtcggctaaggttggggatgtacgatga

SEQ ID NO: 46186 - DNA, 231 bp, Glycine max
  Peptide Sequence Number=SeqID_162964
atgaatggtagtattaacggtaaaaaacagggcatcgaatactactttagtcccaagttgtctgtgtacgaggctcatcaaaggcaaatgtgttcaatgctttgcagtgctaacatagtgcatggccacaattatagaaaacgttcaagcttaaagggtattgataagaacggacctagaccccgaagaatatccagaagaccctcaggatgggaggagttcatccattag

SEQ ID NO: 46187 - DNA, 1380 bp, Glycine max
  Peptide Sequence Number=SeqID_162965
atgccgttaatcaccggcgtttccaggcgcaccagcgcgcgcgccacgttgaacgcgcagccgccgatttgccgcgcctgcggctgggcttcgatatcttcgccgctggtcggcaggcgcggcagcgtcatcaccagatcgccgaccgcgcccccaatcaccaggacaggtgttacagcttcccactcactcattgatactcaccgcgaacgacacaaacagccccaggctggaatcggcgaacaagcctttggccagcgggccgtcgataaaaccggttttggtgaccagcaggccgcacagggcgccgaggaaccagcagaacagcggggctttgcgcacgccgcggttctggccatgcaggccgtacaaagcgttgccatcatacccgtggcggcggcgcaggcacaggtaatcgagcaggaaaatcgcctcccaggccgccaggaagacgccgcagaacaccaggaaggagatgaacggccccatgaaatcaccggagatgaacagcacatacagggcgatacccaacaccaccaccgcgtcgatcgataccgccagccactgcttgacctgcacgccgatggtcagcaggttaaggctggcggaatacaggctgagcaccgcgatggtgacgatgccggcggtagcggccagcagataaggaatggccatccaggcgggcagcaccgagcctatcagcgcgatggggttggcggcgctggccagatcgggcagctgcacggaaagcaggatgccggccagcatcagcagcatcagcggcaaacaggcgccgcccatcaccgcggcgaaaatgcttttgctcgacgagctcgggctttgatagcggctgtaatcggcgccggcgatcgcccaactgatgccggtgccggcggcgatcaccgataccgccggcaggaagccggtcaaccagctgccggaaggcagcgccagcacctggctccactcggtgttgaacaggatatagagcaccacgatcagcgtcatggtgccgaagatgcggctgaaccagctttgcatccagaccacggtattttgccccagcaggctgacgacgacagtgagcccgccgaacagcagcaggctgagcgcggtcagcaggtggctgctacccaacccgaaggcctcgaacagcgccgccagcgtcagggtgccggtgatcacgttgactgcttcccagcccatcaggttgatccaactgaacagggtgggcgccacgttgcccttcaggccgaaaatcacccgcgagagcgtcagcgtagaggtgcgcccgcgcttgccggcgaagctggtgaggccgaccagcacgaagctggcgacgccgaccagcgcggcgagtaccgattgcaggaaggataa

SEQ ID NO: 46188 - DNA, 816 bp, Glycine max
  Peptide Sequence Number=SeqID_162966
atggatagccgcaaggcggcggtgtggggcatcaacggcatgtatttggggccgacggtgcgggtttacagcggcgacgacgtcaaactgatctacagcaaccgcctgcaggagccggtggcgatgaccgtcagcggtctgcaggtgccgggcacgctgatgggcggcgcgccgcgcatgatgtcgcccaacgtcgactggtcgccggtgctgcctattcgccaggcggcggccacctgttggtaccacgccaatacgccgaaccgcatggcgccgcacgtttacaacgggctggccgggctgtggctggtggaggatgccgtcagcaaagcgctgccgctgcccaaccactacggcgtcgacgatttcccactgatcattcaggacaagcgcttcgataacttcggcacgccgcaatacgatgcgccgtcgcagggcggtttcgtcggcgatacgctgttggtcaacggcgtgcaaaatccgtatgtcgaggtgtcgcgcggctgggtgcgtttgcgcctgctcaacgcctccaacgcgcgccgctataccctgcagctcagcgacgggcgcccattcaacgtgatcgccagcgatcagggcttcctgcccgcgccggtcgcggtgcagcagctgtcgctggcgccgggcgaacgccgggaagtgctgatcgacatgtctaagggcgaggaggtgaccatcaccgccggtgaagcggcgggcatcatggatcgcctgcgcggcctgttcgagccgtctagcattctggtgtccaccctggtgctgacgctgcgcccgaccagcctgctgccgctg

SEQ ID NO: 46189 - DNA, 675 bp, Glycine max
  Peptide Sequence Number=SeqID_162967
atggaaaccaatttaggccaactgcaaggaataaagttcataacagaattaacagcatatgcccagaagatcagacaagaatggattactgaaggagctgttaaccagaaccctcatataactaatactatgagaacaatgtgtataagatgcagaagagaaatttggattgtaaagggttgcaaattggtcattcgaatgacgacaccccctccatctcccacacaggccgagattccttctgatgggacgtctaggaaaactagacaagccactcggctaagaaggttgacaacaagaacattggagcaagcaagggcaacagtcaatgtgaatccagcgactggtacaggatctggacctcataaggatcagtttcacagttaccttggagttgtggcacgagacaagattccaattgttcacgctagctggaatgatgtacctgaaacactgaagaacatgatatgggataacatattggcaaaattcgacatccccgagggtgataatgctaaaaagaaggtgatgtcaactgtggcaacgcgttggaggcaatttaagttggcgttgacaacaaaatatgtgtatggtaacactgacggccaagcaaaagatgagcctttggttaaatatggcattaatgaaaaagattgggccgagttgcaaaaatga

SEQ ID NO: 46190 - DNA, 1263 bp, Glycine max
  Peptide Sequence Number=SeqID_162968
atgccacaaaatattgctcctcctaatgtgtactccacttcaagatccatggggaacaataaggacgtcaacatgggtttcaatctcacgtggatcttccaagttgatccgagttccatgtaccttacaaggttgcatttttgtgactatttctattccaaagtgaatgaaattgttttcaaaatcttcatcaacaatcaaacggcggaggctgaagctgatgtgattgggtggacaggaggtaaaggcgtgccaacttatacagattatgtgatatatgtgaaagatgaggcaggtgatgatcaactctggcttgctttgcaccctgcacttgaaacaaagccagaattttatgattcattgctgaatggggtggaggtgttcaagctcaatgacacagacttatctggttttgccttagtggctgcaatacttgttgttgttcaacaccaaaagaaaaagaaagctccaggatcatacaacacatcaagctggctacctatttacaggaattcacacaccgcaggcaccaaagcctctgggtcagggaagagtgttggtagtgccaacatatcagccatggctcaaggattgtgtcgttatttctccttacaagagatgaaacaagcgaccaagaattttgatgagtcaaatgtgataggggtaagagggtttggaaaggtttacaagggtgttattgataatgggttcaaagtggctatcaaaagatcgaatccgcaatcagaacaaggagtaaacgagttccagactgagattgagatgctgtccaagttgagacacaagcatttggtgtccttgattggtttttgcgaggagggtaatgagatgtgtctggtttatgactacatggcacatgacaccatgagggagcacctttacaaacgaaacaagccattggacacactatcttggaagcaaacgttggagatctgcataggagctgcaagaggccttcactaccttcacacgggtgcaaagtacaccatcattcatagagatgtcaaaacaaccaacattctccttgatgaaaattgggttgccaaggtttcagattttggactttccaaaacgggcccaaacatgaaccaaggtcatgttagtacacccttgaaaggtagctttggatacttggatcctgaatatttcaggaggcatcaattgaccgagaaatcagatgtgtactcatttggggttgttttatttgaggcactttatttgaggaaggtagctttggatacttga

SEQ ID NO: 46191 - DNA, 204 bp, Glycine max
  Peptide Sequence Number=SeqID_162969
atgaacaaaaccattccttatatcccagaggagaagaaggtgaggattaagagacataagaacaagagaaaccagaggaacttctgcaagaaaattaagactgttggtgtattgcaagttgcaaccgatcctgaaatgtgtgatttgagaagcaagaaaaatcttttcacatatttgtctcattctatagggttatctagctag

SEQ ID NO: 46192 - DNA, 969 bp, Glycine max
  Peptide Sequence Number=SeqID_162970
atgcgacgctggactcagctgccaaacatgtcctgccaatggaaatacccgaccaagatgttcgcggacacaacctttgagccccacctccaaggcttagcgtttaaccggtattcatggctgacgactcataactcttatgctctggcgggggcgagatcggccaccgggtctgtcattgtggcccctatgaaccaagaagacaaagttgatgaacaactcaaaaacggagttagaggatttatgttggatatgtatgattttcaaaacgacatctggttgtgccactccttccaaagcaaatgtttcaacttcactgcatttcaacctgccataaacgtgcttaaagacatgcggacatttctagatggaaatccatcagaaattatcacgatcttcattgaggactatgtcacagctcctcagggcctaacaaaggtcttgagagattcagggctgagcaagtacatgttcccagtgtctcgcatgcccaagaatggtgaagattggccaaccgtcgatgacatggttcagaagaatcagcgcctagtcgtcttcacttccaaatcagccaaggaagcttctgagggcattgcttatcagtggacatacgtagtagaaaaccaatatggagatgatggcatgaaagctggttcttgtccaagccgtgcagaatcacccgcaatgaacacaaagtctagatcattggttctggtcaactactttcattctgctccaaatcgatctcaggcctgcgctgacaattcggctccactacttgacatgatgaagacttgtcacgaagcagccggcaaccgttgggccaatttcattgctgttgattattaccagaggagtgatggcggaggagcaccactagccgttgatgaagcaaatggtcatctcacttgcgggtgtgacaacattgcctattgcaaggtttggtttctcccaccttatgcattgtaa

SEQ ID NO: 46193 - DNA, 539 bp, Glycine max
  Peptide Sequence Number=SeqID_162971
gctactacgccagtgcaaaggtagaaaggataatccttagtcactcacaaaataacaaaagcagagcaagcagcactaagaccttcaagcataatcctcaagagccatttggcagggacgagaatcgtaaagatggtgaagaggaaggggtggttgagccctgtgtccttgaccacgacgacgtcacttatcaaacattcagtgaaagtgaagtaagacaacgtggttctattacactagttagtggcgatgatttcggcacaatggtgttgccacaccccgacacagaagtaggaggtaccagaatcaattttgatagcgggaccgtctccttttctagccatgggcagcaaattcaacaaggggagtttcaggaggatgacatcgagcttggagtccatggaagctttggtcgcggcgaagcaaagttaagtggcaacgagtttggtcatggcggcctcgaggcaatccaagccagtggaggaaggttcaactttcaccgttggaggacaataggtcaaaccaattgttatgagtga

SEQ ID NO: 46194 - DNA, 945 bp, Glycine max
  Peptide Sequence Number=SeqID_162972
atgaaggacttgaaaactttaaaggaattggtggcaagcattacagattggaagtcgcttgagaagatgtcttgcaaaccctttaagccttccattttgcatttggcaatatcaaaagatgcgccccagttatatcgcgaagaagagttgattcaattaaagaatttcagcaaactactttcaagtgttgaatcgaagccaaagactaacaatactggtcagaggatgaccagaaaaagacaaattgaagagatgcctaaagaggaaagagtcacaccagcaatgattaaaaaaccaagaaggataatcttggtacagaacggaccatcaccagatttgcctgcagaattcaaggatcgagtctctgagttgagtggccatgatcttaaatttctcatgcacaagagactcttctgctcagatgtgaagtcgaatagcaaccgtatgtcaatgcccataaatgaaattaagtgtgaatttctcaccgaagctgaaattactaaattggatgaaagagatggtccgaatggtaaaggacgacttgttggtgtggagaattcaagaatcgagtctgagttgagtggttatgatcttaaatttctcatgcacaagagactcttctactcagacgtgaagtcgaatagcaaccgtatgtcaatgcccataaatgaaattaattgtgaatttctcaccgaagctgagattactaaaatggatgtaagagatggtcctaatggtaaaggacgacttgttggtgtggagacgactgtgttggacccatgcctgagagaatttactttaccattgaagaagtggagcatgcaaaggactgacacctacaacctcgtaacaaattggaatagtattgtatctgttaataagtttgaagaccaagaactccaaatttggtctttcaggttgataacaagctatatcttctattaa

SEQ ID NO: 46195 - DNA, 231 bp, Glycine max
  Peptide Sequence Number=SeqID_162973
actgctcttggaacagtcgtgggtgctccaagctcaaagctttctacgctgccagttaacaagttgattgtgctttacgtggttttcaagcttgacgagagttacacgccgagcaaagtttccatccttgccggtgatggttttcacaacttgaaggagattaagaccgtggaactcgtgaagccaactgggtgggtatatctatccttgtctggagctgatcctaggtaa

SEQ ID NO: 46196 - DNA, 264 bp, Glycine max
  Peptide Sequence Number=SeqID_162974
atgagcatatggattgagaatagcaaaatggaggttggaataacaattacaagaataaatccaattacttttaaagagagattagaacgaacacttttctatcagaaaaacggacctcatttcatgtcagtgggtaactatgatgcaatcttccctaggaagggaccagtcactagagccatgagcaagaggttccaagaggattgggctagagctgatgaagaaggccctagggttctcatgaacctcaggatagatttctga

SEQ ID NO: 46197 - DNA, 1057 bp, Glycine max
  Peptide Sequence Number=SeqID_162975
atgaattgggttcgcggagagcctctcggcagtggcagtttcgccaccgtcaacatagccataccgacaaacacttccactcagtttctttcttccaccgccgtcaaatcctcctatgttcacacctcgtctatgctgaaaaacgagaaggaaatactcgattgccttggagcttccccttatgtcattaactgtttcggcgacgatcacacggttgaaaacggagaagagtattacaacattttccttgaatacgccgcaggtggttctctcgctgatcaggtaaaaaaacacggagggaggctcccggagtcttacgttcggcgttgtacgaggtcgctcgtcgaaggtctaaaacatattcacgacaacggttatgttcactgcgatgtgaagcttcaaaacattctcgttttccagaatggggatgttaaaatcgcggattttgggcttgcaaaggagaaaggggaaaaacaggggaaattggagtgccggggaacaccgctgtttatgtctccggaatcggtgaacgacaatgagtatgaatcgccggcggatatatgggcccttggctgcgccgtcgtggagatgctgactggaaaacccgcatgggatgttcgcgggtcgaatatctggtcgttgttgattcgaattggagcgggagaagaattgcccaagattccagaagagttatcagaagagggaaaagattttcttttgaagtgtttcgttaaggatccaatgaagaggtggagcgctgagatgcttttgaatcaccctttcgtcaacggtgaaaccgtttcgtttcagaaagttaatgagccgttgccgttaccgtcgccgtcaccgaggacacactttgatttaactcactgggcttccaccgtaacggcgttgcttccgtcttccccggattctgatgagtggcgtatgtgggaatccggacgccggcgaattggtcagaatcggatggctggacaagcgttaggtgaagtacttggaagtgcagcgttgattgttccatggtcatcagatcttacggctcacattcgatcac

SEQ ID NO: 46198 - DNA, 456 bp, Glycine max
  Peptide Sequence Number=SeqID_162976
atgttgctcctggaaagcaatgacataggaaaagcaattttggacctcagctctattcttaacataaccaagattgtcatcgaaatcaacaaactgccctacacaaggcacaaaaacaaattgagcaagggagagtttgtaaagaaacatgcaccgagttccagtgaagttaccttgatttataatgacgaggtgttagtgtctgacccatacatggatggcttggtatcctatggcctagcatcacaaaataaaattcactctaaaaacttcattcagtgcatgtacttttgttgtatgggggaagctccacgtggagcttgtaggccttggatcttcttcatcaatggagtcctttacttcttgaagatcaattgcagcggaatggataaggaagaaagattggagacgccacttcaagtagaagatgagttaagaacaagctcaccaccatag

SEQ ID NO: 46199 - DNA, 138 bp, Glycine max
  Peptide Sequence Number=SeqID_162977
atgaaaaggcaaagtaaaacggaaagatgggaatacgataaggaatgtgtcagaggaggatacaatgcactatacagaaggtggcaaggtgcagagataatgcatatgctgatagcaaggtgccccgtggtgctttag

SEQ ID NO: 46200 - DNA, 201 bp, Glycine max
  Peptide Sequence Number=SeqID_162978
atggctcgctcaacgggccaattctcgctaagcgtaattccctcttgggttggaattgtgcttagcgcgcccttctctcttagcgagacatcagaagttgttgttttcaaaatcccaatggttagactttgtaacaattccttaggaagctctacacaaaatttgaagataatccaacggttaacgaatctgggatcgtga

SEQ ID NO: 46201 - DNA, 219 bp, Glycine max
  Peptide Sequence Number=SeqID_162979
atgagactccactacatcacctccctccaaattggtgcttgtttagtggctaggcttggccctgaggactctacttacgaaaattgggatgatatgcaacaagcctataaccttgaggacaaggttattcttccagctgggggtgttgatagcaacaacaccactcgagctaacaggcccagaaaaccaccaacaactcacttcaatgattatgtgtaa

SEQ ID NO: 46202 - DNA, 573 bp, Glycine max
  Peptide Sequence Number=SeqID_162980
atgccagattttcaagaaaagcccacaacccaagtcttggttgttttggacaagcatgaggaccgcgatacttacgtggtggctttccgaggaacggaaccctttgatgcagatgcatggtgcactgaccttgacatctcatggtacgggattcccggcattggaaaaatgcatggtggcttcatgaaagccttagggctacagaaaaatgtggggtggcctaaggagattcaaagggatgaaaatcttcccccctttgcctactatgttattagggacattctaagaaaaggtttaagtgaaaatcctaatgcaaagttgattattacgggtcatagtttgggtggggcactcgcaattctctaccctacgatcgtgttcttgcatgatgagaagttgctgatggagaggttggaagggatctacacttttgggcaaccaagagttggagatgaagcatatgcacaatttgtttattgcaatgatatagttccgaggttgccctatgataacgacttgctcttcaagcactttgggatctgccttttctttaacaggcgctatgaactcagg

SEQ ID NO: 46203 - DNA, 525 bp, Glycine max
  Peptide Sequence Number=SeqID_162981
atggaggaacaatttcaacagctcattcatagctgcttgaaatgtagagggtccgctgcagaggccgaatggcattaccttgaactcaatggccctgtggcattggggaggccgtgggaggggaataaaatcgagcatcgtggcgatggtcataaagtttgtcttcctataatttggccaaggagatggcctgcgaaagggacatgggttgtagggcctggacttcacggtgcaactcgagagggctggaccttcaatgtagaaggagatgatagtgagatgctctgcatcaggatcctggccataaaaccgaggaacctcaagtctcatatcgacgcaagggtagggacaagacggaggggatttgagcgaggtaagggtgattgtaattgcagcaagttgttccaatatggaattaattttgctattgagagttttatgggcctaggagagggaagcatggttctgagtgaggatatgttggtcctacgtgaggcagtttatggcttcttccaggcggtctga

SEQ ID NO: 46204 - DNA, 276 bp, Glycine max
  Peptide Sequence Number=SeqID_162982
atgaattggtaccgagcaaattcaaaaatttgtctaacacagtttgcaactcatccaaaaattgccgccacatctcgttcagctccaaacatggaaactgaacaacatcctcaacaacaaagtccaccagtcattgccagcatgcatgatgaaggactacaaccacatgctcaatcatatgaattcacgccagaacctcaatgtttacgccccggtgttacttgttattatggatgcgtaaatctaatcggcaagtgtaccgagtcgtgcaagtaa

SEQ ID NO: 46205 - DNA, 291 bp, Glycine max
  Peptide Sequence Number=SeqID_162983
atggggtgtagttatgagaaccctcgggccttcttcaacaactctagtccaatcctcttggagcctcttgctcatggctctggtaactggtcccttcctagggaggattgcatcaaaaccactaagctggaggaattgctagtacaattcatgcagaggaccgagtcacatcagaagagtaccgatgcagcaataaaaaatctagaggtacagataggccaactagctaagctagttgctgaaaggcctaccgaaacctttggggtcaatactaagatgaagcccaaatag

SEQ ID NO: 46206 - DNA, 453 bp, Glycine max
  Peptide Sequence Number=SeqID_162984
atgtcacaaacgaatgctatgaattatagtcccagaaattcaattccgacgagggataaagaggtgaattggttcagggagtcaccagatatatttgacaaactcttccagtggttgtttggtgtcattgccttcaagaccacaccaatgagagaagctttatacatagcacaccccaatgtcatgatggctatggttttgatgattttcttgtacttctcactgtggctgctgggaacaatgcttcctcagcgtagtgggaccttcctcataataatcttagtctgcatcatgatggtgattgcaaggtcatgtcatggggttggcatttttgctttgtctgcttactactgttatcaagtgctctatgcattggttgtgcgtgcaatttcagatacaatcaagcaattgattgatggtaacaggacacagagtacaaggttgccggtctag

SEQ ID NO: 46207 - DNA, 2097 bp, Glycine max
  Peptide Sequence Number=SeqID_162985
atgccaagtttttccaccctcaaaccgttatctggagagatcaatagtctgaaaattgatgatgtttggtgtactgatgaggatgttctaaaaagggaggccattaattttttcaggaaactttttcaagatcagagtcactgtaatcccaatggaattgagtttgataatttcaagatcagggatgttgacaaccctactagtctcaatgatttccgtcccatccgcttgtgcaacatacttctcaaagtcatctccaaaattattgtgtcgagaatccgacctttccagagcagttttattcccgacagaggcactggtgataatgctttgatagcacaggagattgttcacaatatgcataagaaaaaagactatcttgcaaagacaggagctggtcaagtctcgcagcttgtaatcttggaatcctgtcctgctgttcttaagcctaagttattagcagatgctttaggcacttactttgttacaccggccttggtgaggaaatcctcgagggtcatcgcaggagcctcgcttccgttggcattgacgacgttggtggagacgacattgttgatggggtcttgcggcgacgatcttgcgatagcaacaatggtgtgggatggaggggaagatgatgcggtggtggtgtcggaggggatgaagaaatcatctgcttggacttggaacgacgccgcagtggccaccggaggtggaaaagctaagaagggaggaggggatgcaactgtaatggaaactgaagaagttagaagtcggttcaaggcgaaacccggtaacgggtctggagcgaaaaagcgtcacgagcgagagaggaaggaagagaagagagatagggagagcgagcgtgagaggaagatcttcgatttagggttttcaatttcgtattcagcaaggtcaattccattgccccaagagaaggaagaggaggagaagcgttccgttcctttccactgtgatttgttgacgtttctgatggagcagcgaaagcttgtggttttggggattccgtgggatgtcgatactgagggattaagggaatatatgagcaagtttggtgagctggaagattgcattgtcatgaaggagcggtcaactggacggtctcgtggttttggatatgttacatttgcttcagtggatgatgctaaggaagtactatcaagtgaacatattattggtaataggacgctggaagtcaaagtggcaacaccaaaggaggaaatgagggcaccagtcaaaaaagttactagaatatttgttgccaggattccacaatcagtaacagaagctactttccgaagtcattttgagaaatatggtgaaataacagatttgtacatgccaaaggatcaaggctccaaaatgcatcgtggaattggtttcatcacttttgcaagtgcagattctgtggagaatttgatgtcagaaacccatgaactgggaggttctgctgtggtggttgatcgagctactcctaaggcaagagatgatgactttaagccaatgggcagaatgccgccgccgccaccgccaccgccacaaggaggaggatatggtgcatacaatgcttatatctcagcagccactagatatgcagcacttggtgctcctactttgtatgaccatcctggcccaatttatggaaggggagatgctcggagaactagtaaaaaaatttttgtcggccgtcttcccccagaagcaacttctgatgatcttcgccaatattttggaagatttggtcgtatattagatgtttatgttccaagggatcctaagagagcaggtcatagaggttttggatttgttacttttgctgaagatggtgcagcagatcgcgtctctcgaaggtctcatgagatttgtggacatccggtggcaatagattcggctactcctgttgatgatgcagggcccagtgggaattttatgatgaatagtatggaatcttttgggggatatggtggtcctgtgcgatcttatgggaggatgtatggtagcttggactttgatgattggggttatggaattgggagaccatcaagagcagcagattggaggtatagaccatactag

SEQ ID NO: 46208 - DNA, 156 bp, Glycine max
  Peptide Sequence Number=SeqID_162986
atgaggacaaatgtttctagcttcagtctatcccatggattaggaaggcctaaagagccgaaaccagctgagaatgtctattacagagccgaaagcatcatgattcatggaaaatacaaaaaacctttgaccattattagaattcaagcgcaataa

SEQ ID NO: 46209 - DNA, 201 bp, Glycine max
  Peptide Sequence Number=SeqID_162987
atgtcttgggtcaggttccgtgatggtcaggcccatggttttggacttttggggcctggacttgcccaagtctggagggagattctgaggtggcctattgggcctggattcatattctgggcttcataccgtgttaaggtgacaagatctgcttcaagtgagtctgaaaaggaaggaacaaaactttatcagaaagtatga

SEQ ID NO: 46210 - DNA, 1311 bp, Glycine max
  Peptide Sequence Number=SeqID_162988
atggaggccaaggctgctgctccatttacatcagacagatctaatttgttgcagcctgctgcaagcaaaggatcttactcgcaggtcaggttttcttatgatgggaatggaaaagaagaaactcatatttcagatgatgaagataatgataacgaggaagatgaagatgatgaggatgatgaggattttaatagtgatgatagcaatgatgaaggaatggaaataattgcaaaagaatatggggttaaaaggtatggttggcttgtttacatggataagaaggctaaggaggaagaaaaaaggcaaaaagagttgatcaaaggtgatcctgcaattaggaagctgagtcgtaaggaaagaaggaaggcttctcagattgaaagggagagagagagagaagccacacggatatctggaactcgtgtgctgcatcatgacccctaccgggaaacaaggcaaagtcctacatatgaagcctattctcgatctagaaggtcaaggtctagatcgcggtcatactctccgtcgcactcaaggcgttattcatgcagtggtcattctgatgatattcaccgaagcaaaccaaggactcctaaaatagagtacattactgaatttgggggctctggagcagcagcagatgaacccaggcctgaaggattttctccaccacgatctcctacatctcaagttgatttgttaaaccggccaacatctagttgcatacttgaggcattgcatgttgatcctgcttctggtgtgtcaattgataaggataagggcactaaagtcttgaaaccatcagtaagtggttcttcagcattagcaaaattaaagactggtggttctggagggcccttaaaacaacaaggggagaagaaagaaactcctcaagaaagacttaaaagaatcatgaacaagcaactaaacaaacaaattaagaaagatactgctgctgaacttgccaagaaaagggaacaggagcggcagaggcaggaaaagcttgcggaaactagtagattgagtcggtatagacaccacagccgcagccgcagcaggagtttcagccgttcccctccaagaagatacagacgcagtagaagtccaagtagtagaggttccagaagatattattctagttctcgttccccttctcgcccccgttcccgctcacgttctcggtctccttattctcgatctcccagcctgattcagaagatgacatttcaggataagaaatcgatcaaggcactgatggaatgctgtatacgtgtagaaaggctgacgaagttttgtgccatttgtttataa

SEQ ID NO: 46211 - DNA, 282 bp, Glycine max
  Peptide Sequence Number=SeqID_162989
atgtgtcctaaagtttcgctgcaacgacaatgtcgacgacgtcggggagtggtggtgggtggtgcgtctgatctgaaaaagaaaaacaaatacagaggaaacgaaggatcgttggggagtggtggaagtcatagcaaatgctctacataccaatttggacaaagttttgacacagcatggctgaatggcggccgtagaggagactcaagcggcgcaaagatggacgacgcaaagtgtcctattgtaggatcattaaaaaggattgtaaagaaatgtgtataa

SEQ ID NO: 46212 - DNA, 519 bp, Glycine max
  Peptide Sequence Number=SeqID_162990
atgagtctgatggatagaaacattcttgactctctgttcctaaacatccactttcatgggcttgacatgaaagaaggatcaattccaatagcattaatctataggattcagtacaaggttatgaatacttgtgcgtcaagagtccttctaaaaccacaaagaggagaaacaaccttgtttatcaccgatatgacaaaggccaatgtttctctcccaaaaacaatgaaatgggatgaggtaactcttcttgaaaaaagggtcatggacaaggccacatcgttagtcccccgacccgctccaaccatagaacaaattaagcaagataactccggtaaggtagaaataacctttaataggagaaattctttttcatcaagaatagaagccttaagatccgaatacgagtcggcaagaaggtattttttggtaagaacccgatcaattccagtaggattaactagatctgagtcacaatcagtttcctgctgtaaacctccaaggattggatacaacctctag

SEQ ID NO: 46213 - DNA, 366 bp, Glycine max
  Peptide Sequence Number=SeqID_162991
atggctgctatttcttctcttccgcttgatcctcacggccctttcttcatccaccatgcggatcatccgagccatagtattacccctttgaatggtgacaattttggttcttggcgtcgtgctgttgtcattgctcttgaatccaagaacaagatgggattcattgatggcttaatcttgcaaccacaagacccaacgaaactctctttatggaaaagaaacaatagcattgtccgatcttggcttctcaactctgttaataaagaaattgctactagtgttatctactcatccacgacagcaattttatgggatgatttaaactcccgaattgacaacataacgggcctcgagttttccaattga

SEQ ID NO: 46214 - DNA, 1095 bp, Glycine max
  Peptide Sequence Number=SeqID_162992
atggtggagcctcttaatcaatcgactcctaggacgaaaaaaatgaaacacaagcgaaatccgattcatgactcgaaaatgacgaggaaactgcgcatcatttgcaatgatcctgatgctactgactcttcatctgatgaggatgagtattttgggaatgttaggaagatgaagagaactgtgcttgagattgctcttccacctgttccggttaaccctgtggttgcagatgaaactagtactgagagcacaaacaatgatgaattgaaccagacgaagagggttatggcgaaaaccccctcagtgaagaggcaatcttgtgggaaatacaaaggtgttcggatgcggaaatggggcaaatgggccgcggagattcgtgaccctttcaagggcacgcgaatctggttgggcactttcagcactgcagaagaggcttctcaagcctatgagaccagaaggcttgagtttgaggtcatggccaaggctctatctgatgagaagagcaacaatggcagcagcaacaacaatgttgttgcttctgctgaaactgaaactgtggctgcccctgaaaataacagttcaaactattatgtttcttctgctgcaggttctgtatcagactccaagtctgcttttatggatgaatcagagagtgtgttgtcacacacatcaccatcttctgtgcttgaattggatacatctgcttccaatttgattgggagtggtaaggtttcaagcaatgaaattgttgagactaaagggttggaggccgaagttgctgagactaaaagtttggcagctgaatttgccgagctggaaatccaagatttgagtatgctgaatgtaccatccccatctgctgttgctgctgctacgtctgagtatgaattggatttgttggcatttgacagtttcaaatatggatttgattatgaacatggctttgatgatgattttgctgccctggaagacattcacatttgcagttttgatgataatgagcctagcgagcttcctgattacgattttgatgactttggtgctgatgagtttgctggttggattgaagaacccctcaatataccttgcgtatag

SEQ ID NO: 46215 - DNA, 804 bp, Glycine max
  Peptide Sequence Number=SeqID_162993
atgctacctaaggcaacgggaacctccctacggggaggtagaagtacaggtaaaggcttcaaattggctctaccagagccaaccatcaaaaagagttcctcaacttcttctgggtcaccaacccaggttgggtcatccacccagaaatcaaaaattgaagggtcatcgacccaaatagttacaatcaaacctgagtcatccactcaggaaaccccaaaacctgcaaccgcaaaacaaaccaaggctgactatgtctggtcagtacaaacacttcaaggccttcaagaaatgggtctagccaaacttccaaaattaaccaaaaagacttgggcagacattgcctcagaatctaatgatgattctgaaatagacttacaaagtatgattcaaaattccaaacaatccaaaacacttattaatccaaaagggaaacaagtgttatcccaacaaaaaccaccaccaccaaaaaatgctaacagttatatttacaaaaataaattttcaactgttttgcagatggagccaaaattttgggataaaaaccccttcaaggcagcaccagatcaagtaaaaatctggtttcaagcccatttgaaattcctgaaagttgctgatccagagacttctttgttcctcaatcaaaagtctcaattagctactttcctagccagctccagattaaaagaaagtctggctcaaaatttaaaagaagtcctacaaattcttcaacaacaagaagaagaaggcccatcctccaaaaaggaagataacaattcctcagaagaagaagaagatccgttttag

SEQ ID NO: 46216 - DNA, 498 bp, Glycine max
  Peptide Sequence Number=SeqID_162994
atggaaatccaacaaacagtgattgaactggtggctcgacgtccatgcttcctcatcgtggtctgctgcagcacgcgcaacgacctcgactctctctgctctccccttcctttcgtcttctgctctgctctctctcaaactcattttcttcctcgtaatttacacgcgctacagtgttttcctaattcgctcttgtttcctccgtttccatttcccacgtgtcagtacagtgaccttggcgaagacgagcgcgcttttatcttaaagaaattccgacagggtaaggctgcgtacaacatccctcccccataccttcgcatagcgaagagcctctgggcaatgggggtacatggaattgtcattaatatggttgttggtggggaagtggtaactctaaaaagcatagaagaaagcagtactattgtcatgcaagaaatgcctatgcaaattcttgactttatgaagacaatattactgcttgcatttgtgaatggctga

SEQ ID NO: 46217 - DNA, 719 bp, Glycine max
  Peptide Sequence Number=SeqID_162995
atgaagagtgtgagaatccccaagtttctggacttggagtggttttctcagcaagggtttaacttgcctaatctgctcgaagcacagggtttgtccaagtttgtgcaggtgaaaggaactttctacccggagttgttgattgtgcttttgccaatatggaaggcagtagctagactggacatgggtggagtctgcaagtttgaagaatctactgatggttacaacaagatgcaaacttacaaaggtatgctccttgagccaacaaggaatatgaggaaccgcctagttgtaggtggtttaactgttgaagacagaatgctcgtttatctcataacctacattgtcacaccaaggtctagcaaccatgcacagatggttgacaatgatttacagatcgtgtatggtctaaaatcaggtattcaaatgaattgggtacttcttattgaagacatcatgttgaaaagttgtcgagccaccgcaacagcaatcatggaccaaatggaagaagaagcggaagatgaagctcagcaagagcctgcacaccaatgtagtccttttgagtctcttatgattcagaagatggatgccatgcttcaccttcatcaagagcactcagtcgatgttaatagcaccttagaaaacatcaccactaggctagagaacatagaaacaaggataacccttagtaaccttcttaactcagataaggatgaagcgtg

SEQ ID NO: 46218 - DNA, 204 bp, Glycine max
  Peptide Sequence Number=SeqID_162996
atgacgggagtaaatgctagagtaatggagtttttgatgaggtgtcctagaggtgttttaaagggttctaaggttcaaaagtggagggaattgagagaactaagaaagaagaagaagaaagaagaggaaacgaagccgaggcgctgccgaatcatgactatgatcaatctctacatcgttccttgttcagtgttcttcgtgtga

SEQ ID NO: 46219 - DNA, 618 bp, Glycine max
  Peptide Sequence Number=SeqID_162997
atggcatgcttagaaatgtacaacaactcagagcacaacaagaacaacaagggtgataatcatcaccatcatcatcaatgcgctccaatgagcccaagaatctctttctcaaatgattttgtggatgtgcaacaagccatgaagctgcaagaacaaagaggtggctcatccagatcagacacgccagtgtcttcagacttcgagttttcagtggcaaactacaccatgatgagtgctgatgagcttttcttcaagggaaggttgatgtcgtccacttatgttaacacggacaacaacaaccagcagagggccaccaccactctcaaggaagagcttcttataaatgatgatgaatatgatcataatttttctctcaggcctcccaagccttcctcaactaggtggaagggacttttgggtcttagaaagtctcacattggctccaagaagcctcacaaaagtactgaagctagttcttcagaagcatcaaggtctgcattcgtcaacgagggacctccaactagtatcactttctcagatttagagtgtttgctttgccggttgagatacggtggcgcaaagcccaacacgtattcaccgcaaaaacaaggaatgtga

SEQ ID NO: 46220 - DNA, 135 bp, Glycine max
  Peptide Sequence Number=SeqID_162998
atgcaggaagcaattggaggtgcagaaaacaatagcgcagaacaaatggtatcactgcaaaaaggttacatggggctgctagctttgtggaacatgaagttagacattgataaaaaatatgggctaaccggcaaa

SEQ ID NO: 46221 - DNA, 222 bp, Glycine max
  Peptide Sequence Number=SeqID_162999
atgcacctcggtgggttgaaccccaagagtaatgtgcaaagtggagggtttgagtgtggatattatgtcatgcactggatgtggtgcatcgtgactgccggtttaaaggatgactggcataagtggttttctgatggctcatcgttagacgtggaggccatcacaatagttcgacagaaatgggcaacttactttttatcttttaggaaaaacagttgctaa

SEQ ID NO: 46222 - DNA, 255 bp, Glycine max
  Peptide Sequence Number=SeqID_163000
atggcttggctacacccttggtggtgcactatcaatgctaccagccatctcaaagaaaataaggatgcaattgagctggtgcagaaagcatttgatgaaatccttcttccagagcctgaagacctcttttctgatgatcaattcaaatttgaaggcattgattcagatgaggtacacttagaaaagagtgtttcagccagcaatttaatcaccaaaactcaaattcacaataaacacaatcataaggaaacctaa

SEQ ID NO: 46223 - DNA, 606 bp, Glycine max
  Peptide Sequence Number=SeqID_163001
atgttggaacctacagaacttaagtcgtatccaaatttcagtgattccaaacacaatctcttgtgctctaaacttaagcagctatatgtggctataactcgtacaagacaaagattgtggatatgtgagaatacagaagagtactctagacctatgtttgattattggagaaagaaaggtcttgttcaatttaaagaactggatgattcacttgctcaagcaatgaaagttgcaagtagtcctgaagaatggaggtcacgcggcaaaaagctatactatcaaaataactatgagatggcaacaatgtgttttgaaagagcaagagactcttactgggagagaaagtctaaggcttctagtcttagggcaaatgcaaaccgtttgtgtgatttgaatcctgaggattcaaatgcaatgcttagggaagttgctgaaaattttgaaggcataggaatggcagaatctgctgcccagtgtttttctgatttaggggattataaaagagctgggccagatcctctaccagtagaagggttgacgtggacagttggtcgtggagaatctggtggtggaggggacctcaggggtgttgccatgcctgcatag

SEQ ID NO: 46224 - DNA, 297 bp, Glycine max
  Peptide Sequence Number=SeqID_163002
atggcgagcaatggtgagttagacgaaaggccatatcgaggttcactaagggagcagctaagaaagatcttcatcacttatgtacaaggggaagttatcagtatacactccaaacatggtaacatcccacgacacttgcaaaggcttgagaaaaagccatgggatggtctttgctatcagatccattcaaacaagattaaagaatcaagaagattcaagagaagactcaagatatgcaagagcctcaagaaaagcatcaagtggtttttgaacgttggatttcaaacctcaacatga

SEQ ID NO: 46225 - DNA, 353 bp, Glycine max
  Peptide Sequence Number=SeqID_163003
cttcaaagagttccctgatgatgattttccactatggagatgcagcagaagataaaggagaagaggagtttcaccaccaagagagtgccttggataagaagcttagagaggaagattcaatggaggaaaagaaagagagagagaaagagaggggggagcacaagattgaaggaggaaaagagggagagaagttgaactttgaacccaatcctcttagagtcttctatccaatacccttgggggtaggattgcttaatcttgctgattcctcccagtggaagaagattaatcatctgtatccagatttcgggaaagagacaagaaatcttaggcttggacttgccactgattga

SEQ ID NO: 46226 - DNA, 1005 bp, Glycine max
  Peptide Sequence Number=SeqID_163004
atgttgaaagtgtattttctaatagtgttgggtgtggccaatagggtttccaaagtcaaagacctactaggtaataaccagtggctccaaaactccaatgcccttgacaaaaataaaattgaagctttttaccacttcgatgccctcaccacctttgatccccccaccctacactacgtgctgggagtagatggcttattcttgctggccttgcttcacagagacgctgctggttccaaccattcctacttcttaactggaaaacgagggatgctcctggtcgacgcagctggtgtagaagtgacgttggatgatattgtgagggacgttttcgtgcttgaaaaccaaatacccattcacgtgcttatggagataagcaaagtgaatatcaacagcagggaaagtgggggaattatagaggagcataacctgggtgaaagcatgctaaatttctgtaggccgctctgtccacttgttcatacagagcaagtctcctcaaggaaagcagaagaccgtgctcatttattggatcttgtgtaccatttgactgcacctcagcttgtgccggcgtcggagtctgaacagaatccccagcctctgcttattcatttcattataatttttgcatacatgattttatgggcgtgcttgttattatgtatcataccattctattgcattacgttcttcctgtacctactgattttccaggtgatagttcctttaattcaacgggtggtacgccatgtatttgatgacataacaaagtttcctggtttaggctactttaagagccttgttatagtacttggatttccattcctcaaaagaacacttcagttggaggactcaacagactcttctgaggaagttgtaacaattccatctgccttgaaacttgaagatattggcgtcaaattcatacctgctgaaggtagcatcacatcatatagatatgaaacaacaccgctcccaatgggatacgaaatgctaccgctcccatga

SEQ ID NO: 46227 - DNA, 369 bp, Glycine max
  Peptide Sequence Number=SeqID_163005
atgggacctatccgtgggcaaccaacggggaggtcagtggttacaaccagaaggcacatctttacaactgatgtcacaccatacatggtgcaacacaacttgcctttggttattccagcaactgcttcaaattatttgtttggctcaaaaaaatatattcctgtccactgtggttatggtagacataaccagtggcagatcaccattcaagatggtctgccatcccttgcagaaccatggtttcagtacctatctgaaaataacttaatgcctggagatgaagttgtcttcttcttcaagtttgacgaacatgcgtgggaattgctatttaggaaagaagtcatatgggatgacaccctttccagttga

SEQ ID NO: 46228 - DNA, 342 bp, Glycine max
  Peptide Sequence Number=SeqID_163006
atgatttcacgtctctccctctcaaaactccaaaccaccctagaaactcctcctctaccacccatgaccaccaatgaccaccacgagctgccattgcttgccgtcagatcaccacatggggaggaacttcttaatcggagtggaatcctcagagtccacctcaaggattcaatggagaacaagctctcaatcctttcttttgtagttcctctgagatgcagcggaagacaaaggagaagaggtaagaggcggcgccatccactagggaataagccttggaagaaggagcttcaccaccaagatgagccttggataagaagcttggagaggatgcttcaatag

SEQ ID NO: 46229 - DNA, 603 bp, Glycine max
  Peptide Sequence Number=SeqID_163007
atgtcttccaggaaaagaaagagtggcggttcaaggcccaccactcaatatgatacaagaagatttcactcttttgaggcctggaccagatatattgtcaaggtgttgggaagacacatattagctgagaggaaagtggaaatctatcacacagagctagatgaattcaagggcgagctagagaggcgtaactttcacaagcacttcaccaacttagctgatagtagcattcacctcgtgttggtgaaggagttctacgccaacctctacagtcccaaggggccttcacctaaacaagtcagaatctggggccacttaataaggattgatgcagatagcctcaatgcctttctagaaacacctatggtgcttgctgagggtgaatctttgcccgcctactcaagatactgcaggatgcctactgacattagagaaattgaggatgcactatgcatacccggccgagggtttattctaaatgttgaaggtcacctgaggaagatcctcagaaaagatctaaccacccttgctcaggtctggagtgttctatcctactccaacctagctccgacctcccacacatcggatctgactgtggattga

SEQ ID NO: 46230 - DNA, 594 bp, Glycine max
  Peptide Sequence Number=SeqID_163008
atgtccaccctatcacgcgccacaatccccaaatatgttcttaatttcttcatgtggggaccgtcggccttgttggtagcaggatcaacatggaccacaggtatctcaacaccaggtggtctagtagacaaggatcgtagacatgaggctttgcgtgttcgcttcacggcagacggcgaagcttatgtgtcagaaggaggaggaggcgaggctggtggagaagccataatcctttatctgatagggaatctgttcctgttgaaaataaaggctggcaacaaagagagaactcaaacacagaaggaaaaattatcaaatgaagaagttagtgccacagataagggaaacaaagagagcactgaaacacacaaggaaaaattatcaaatgaagaagttagtgccacaaatgagggtagtgcagagaataacatcaaaagaaactataatgaagtcagtaaatttgaagataaggacaaagaacaaagcatacaaaattcaaaaatgaaaactgagggtggttcagagaataatgtcaagaacaaagatgttgaagatggtgacttaaaaaaaagcatacaaacttcaaatgtataa

SEQ ID NO: 46231 - DNA, 1257 bp, Glycine max
  Peptide Sequence Number=SeqID_163009
atggagttgtatcctggttttgctttatatcgtgggctatatgagttttcgcaatatgcctttagtggggatgctttggggagcgatggtatgcgctggagcgatctgagtgatagcacaaatggcatgaaggaggtcttaattatcatgttcgtggagtggctattggtgcttttgtttgcttattatatcgatcaagttttgtcttcaggaagcaggaaaagtcctctttttttcttgaaaagatttcagaaaaagcctcattcatcttttcggacgcctagtatccaaaggcaaaaatctaaggtttttgttcagatagagaaacctgatgtcactcaagagagggagaaggtggagcaactgctacttgaaccgactattaatcaagcaattgtatgcgacaacatgagaaaagtctatccggggagggatggcaacccggagaaacttgcagtgagagggttgtcccttgctttgcctcaaggggaatgctttggtatgcttggtcccaatggtgctgggaagacttcttttatcaatatgatgattggtctcaccaagccaacctctggtaccgcatttgttcaaggtcttgacataagaactcatatggatggaatatatactagcatgggtgtatgcccacagcatgacttgctgtgggaatccctaacaggaagagagcacctactcttttacggcagacttaaaaatcttaaaggttcagccttaacacaagcagtggaagaatcgttgaaaagtgtaaacctttttaatggaggagttgctgataaacaagctggaaaatacagtggaggaatgaagaggaggcttagtgtcgcaatttcattgattggagatcctaaagttgtttatatggatgaaccaagtactggattagaccctgcatcaagaaacaacttatggaatgttgttaagcgtgcaaaacaggatcgtgcaatcattcttaccacacattccatggaagaagcagaagtcctatgtgatcgattaggaatatttgtagacgggggcttgcagtgcataggcaatccaaaggagcttaattggttagagcgtcgtactaataacgtgaaagtcacagctttcataataatatgtgaaaagaggggaagaaaaaagataaaagatcgagaagactttgaagagaagaggaagggtgcaaggagggtgagggtgaaggtaaaagataataggggggttgaagaggtgcaaatactgatattcaaataa

SEQ ID NO: 46232 - DNA, 1309 bp, Glycine max
  Peptide Sequence Number=SeqID_163010
atgccaatgcaccatcttctcatttccttccttatcttctctctcactcctactccgacaacctccctcaactccgacggcctctccctgcttgccctgaaagccgccgtggactccgaccccaccggagttctttcctcctggtcggaaaccgacggcaccccatgccactggccgggagtctcctgctccggcgacaaagtaagccaagtttccctcccaaacaagaccctgagcggttacatcccctccgagctgggcttcttaacctccctcaaaagactaagccttccccacaacaacttctcaaacgcgattcccccttctctcttcaacgccacgtcactcatcgttctcgacctctctcataactctctctccggttccctccctacagagcttcgctccctcaagttcctccgccacgtggacttatccgataactccctcaacggttccctccccgaaaccctctccgatctcacctccctcgccggaaccctcaatctttccttcaaccacttctccggcgggattccggcgtccctcggtaaccttccggtgtccgtcagccttgacctccgcaacaacaacctcactgggaaaatcccacagaaagggtcccttttgaaccagggtcccaccgcgttttctggtaaccctggattgtgcgggttcccgttgcagagcgcttgccctgaagcgcaaaagcctggaattttcgcgaaccctgaagatgggttccctcagaaccctaatgcgcttcaccctgatgggaatgatcagagagtgaagcagcacggtggcgggtctgttgctgttcttgttatctccgggctctccgtagcggttggggcggtttcgctttctttgtgggttttccggcgacggtggggcggcgaggaagggaaattgggagggccaaagttagaaaatgaagtggatgggggagaggggcaagagggtaaatttgttgttgtggatgaagggtttgagttggagttggaggatttgctgagggcgtctgcgtatgttattgggaagagcaggagtgggattgtgtacaaggttgtcggtgtcggaaaagggtcctcctccgcggcaggggcggcgaatgtggtggctgttcgaagactcagcgagggtgatgccacgtggcggttcaaggaatttgagtccgaggttgaggccattgccagggttcgtcaccccaatgttgtacctttgagagcttattactttgcgcatgatgagaagctgcttatcactgatttcattcgcaatggaagcttgcacactgccttacatg

SEQ ID NO: 46233 - DNA, 490 bp, Glycine max
  Peptide Sequence Number=SeqID_163011
atggcccctagaaagctccccacgaagaggtccaagaaagacaccactggagagggttctagtgcggtcccgcaggacgatatggatttcgatagacaccgattccaaagagaaaccaagaggtggctccactcatttaagggtaacagtctaaaaacatgggaagaagttgttgaaaagtttctgaagaaatatttcctagagtcaaagactgcggaagggaaagctgcaatctcttcatttcatcagttccctaacgagtccttgagtgaagcgttgaaggggtttagagggggaaaaataaagctaaagacccctgaaaaggcaactgggctaattgagaatatgtcagccaatgatcatgccattctgggcgacagagttcatcaacccacaaagaaaagcttgttagaactatcatcacatgacactttattggcacataataagtttctttctaggaaacttgatattttaacagaaacacttg

SEQ ID NO: 46234 - DNA, 237 bp, Glycine max
  Peptide Sequence Number=SeqID_163012
atgacaatttccacacacacactcactaacccttcctttttcaggtgttgctgtgctcgatgctgtgctagagaaactaggggtgaagaaaggaaagaagggaggagtggcgtgagctgtgttttgcatcgtggtggtggcccagtcactgttaatagtgacggggaatctagaaacgggaaatctgacggcgccgttatatggcctgcgccgaagcgtgaccgaatgaacaactga

SEQ ID NO: 46235 - DNA, 366 bp, Glycine max
  Peptide Sequence Number=SeqID_163013
atggaggagatacatggagaagaagatgaagaacaaggaattaaagccttggatcttcttcatcaatggagttctttgcttcttgaagatcaatggcagaggaatggagaaggaggaaagcccctgggcccactaggtgacttaggggagaagcaaccagctcgcctgggcaagaaagttgcttctggagtaagccatcagctcgcctggacgagtttggcggcaagctcctccccctattttgctataaataggtgtgggaagctgaggagaaagggttcagcacccttggcaagcatatttcacttaaaattagtgaggagaagaagaaagaaggagaaaatcaaggccaaggcactttcgtaa

SEQ ID NO: 46236 - DNA, 678 bp, Glycine max
  Peptide Sequence Number=SeqID_163014
atgaagtcacaatctatcaaatttgatgttgaaacgaatggtgggccttccaattcattgccaccaatatcatgggcagcaaggttaaaaatagctcaagaagcagcaaggggcttgatgtatatacacgagttcagtggtcgaaaatatatccatggcaacataaagtcaacaaaaatattgctggatgatgagctccatccatacgtgtcaggttttggacttgctcggctcggtttgggcccaacaaagtctactacaatggcaccaaaacgaaacagcttgaaccagtcttctataacaactgcaataagttcaaaggttgcagcttcctctaaccactacttggcacctgaggttcgctttaccggtggcaagttcacacagaaatgtgatgtatattcttttggtatagtgctgttagaacttttgacaggtaggatgccagattttggaccagaaaatgatgataaggtactagagagttttgtaaggaaagcattcaaggaggagcagccattgtctgatatcatagacccagcacttatccctgaagtttatgctaagaagcaagtcattgctgcattccatatcgctttgaactgcactgaactcgatccagagttgcgacctagaatgaaaactgtgtcagaaagccttgatcacatcaaaatttag

SEQ ID NO: 46237 - DNA, 759 bp, Glycine max
  Peptide Sequence Number=SeqID_163015
atgccccaatcacgtcaccgtcgcgtaaccgtcgtcgacctcgccgcctccttagcccgccgccgcgtctcatttatcttcaacgaagctccgactctccgtacccctccaagaaccgccgccttcggtcgcggaagagctcgcgcttctccccgctcccagaacataccgccatcaactgcgcgacgtggtagaggacgcgttccgttacgctccgtgcttccggcgtggttccctaggacaccactccgtgacattactgctgtcgttcaggcgatcgagaggagaagtgcgaggctaggagaagtcgaaggccagcgaatcggaaacactgatcctgcttcagatcgtttagtttcggaaccttccgaacctgcttctgcttctgcctctgcctctgcggtgaaatcgccgaaatcagttggagtgaaactccgaacgccgttcgggagcaaggtcccgaagatcttcctcgacatatccgagttaccggaacacgacgaatcggaggctctgacgccgcagaagaagcttctcgacaacatcgatcaggttgaggaagcggtgcgcgaagaactgaacaagctgaagagaactccgagcgcgaagaaaacagagagggaaaagcggagccataggcagcagagcaggggtattatagtcattttactctggactgagttgattcagcgggacagtgtttttccggttcgctttgcttgcgtcttcggcttgaagttgcaagatattattctctag

SEQ ID NO: 46238 - DNA, 1116 bp, Glycine max
  Peptide Sequence Number=SeqID_163016
atggattcgaattcgcgctaccaagttcagcagcaacaccaacacaattctgggttacttcgatttcgttctgcccctcccgcaaatctcaaacaacaaggcgaagctgccaataataatgggagcgcgtgggagggttctgaaccgcttttgagattcttgaattccggggacacccatgatacgacgtcgtcgcctaccttacgagaattcgtggataataaggtttctaataatagtaaacctgcgaaggagtcatcatcacctctgagtcgcatgaattcccaacagggttatagtacttctatgttaccctctcggagtactgtaacttcagctatgatgttgggttctatgggaaagaatcagagtgccaaaagctttgattccaatcttctcaggcaaagtagcttccctgctggccatttctctaacaacatctcctttcagaacgggtatgatactatgaaaggtgttggaaactatagtggggtcaatggcaatgatggtgaacttagtctatctatgaacagaatgaagaatcaaataagcttctcatcaataagtccttcttcttccttgggagtgctatcaccaacttccaaaataggcacggagggtattagggtaactagcactgaggatgggaggcagggagggagcaatggtgatgctcgatattttggccctggattctcctatgcttcttggaatgagccttcacaccacaaaagacagcgaagtagtaatgatgagttactttctgattctcaggatggagaactaggaaatcaagttcaaacactttcgcatcatttgagtttgccaagaacgtcgtcggatatgtttgctatggataagctaagagaggctttgctacacatcctcgaagcattgccgaaagggcaagtgagaagaagtcggatcagtgaacgaataagaaaattgcaagagcttgttccaaacatggacaagcaaactagcacagcagagatgttggacttggctgtagactacataaaagatcttcagaaagaattcaagactctgaacgataaacgggctaaatgcaaatgtataaacatgcagaagtcagaagcagatcaagttgcttga

SEQ ID NO: 46239 - DNA, 708 bp, Glycine max
  Peptide Sequence Number=SeqID_163017
atggtgtcgtttctgggtctctacgccctccacaaggattacaaggtcgcgcatcaatcctttattcaacactttgagcccacacctctcacaattcaagatttgggcgattggacatcgttcttcattgggctacagttgcgtcgtttctgggtctctacgccctccacaaggattacaaggtcgcgcatcaatcctttattcaacactttgagcccacacctctcacaattcaggatttgggcgattggacatcgttcttcattgggctacagttgcgtcgtttctaggtctctacgccctccacaaggattacaaggatttgggcgattggacatcgttcttcattgggctacagttgcgtcgtttctgggtctctacgccctccacaaggattacaaggtcgcgcatcaatcctttattcaacactttgagcccacacctctcacaattcaggatttgggcgattggatatcgttcttcattgggctacagttgcgtcgtttctggatctctacgccctccacaaggattacaaggtcgcgcaccaatcctttactcaacactttgagcccacacctctcacaattcaagatttgtgcgattgacatcgtttttcactgggctgcaacgacgtcgtttctgggtctctacgccctccataagaattataaggtcgcgcaccaatcatttactcaacataggtag

SEQ ID NO: 46240 - DNA, 792 bp, Glycine max
  Peptide Sequence Number=SeqID_163018
atggcgaaggagccaacgttagatgtactactgtcagatatttgcatagccacttcggccgctccaacatttttgccggctcattattttacaaaacaagatgaacaaggaaaagtgataaaagaattcaaccttattgatggcagtgtggctgctaataatccgactttatgtgcaattagagaagtgacaaagcaactgataaggaagggaaatgggggaattagtatcaaccctttggagtatagtcgttttcttgttctctcaatagggactggatcaaacaagagtgagcacaaatacaacgctaagatggtgtcaaaatggggaattttaacctggttattcaactctggatcaactcccattttggattgttttagcgaagcaagctttgatatggttgactaccacaactgtgtggtttttagtgcgcttcaatctgaagacaactacctccgcattcaagacaatacattaaagggggatttagcatctgtggatgtagctactaaagagaatttggataatctggtcaaagtgggccagcagttactgaagaatacagttacgcgggtgaatctagatacgggtctctatgaaccagttccagataaaggcaccaatgtttgcaaaattactttcggaggcaagaaaggggagaaagtccaactcacaatgacaagaagatgggaagtaaatgatcgccagctgaatgaagaaaataattgttgccgatattcaaacttaaattctattgatagtataaacattatttccattgttgcctaa

SEQ ID NO: 46241 - DNA, 1083 bp, Glycine max
  Peptide Sequence Number=SeqID_163019
atggttatggtgaatctgggaatgcttcattacgtgttggaccacgtatatggagcattcatgcaccgaaccaaaatgagcaccccattcttctcgcgagggtggggtgggacgaaactagagatgcttgagagggtgataaagcaattgttccccgaagtggaggggcataattggcctccctcaatgattgaaccggtttggagaaccgtttgggagacaaagatggcttctttgagagaaggggtgttcagaaccccttgtgaggagcaactgctgggtgcattgccccctgagagccatactgcaagggttgcattcctcatgcccaagtctgtgccccctcacaaaatggcctgtgttgttcatcttgcaggaactggagaccatacatttgagagaagactgcgtcttggtggacccctgatgaaggaaaacattgcaaccatggtacttgagagtccattttatggacaaagacggcctgtgctgcagcgtggtgcaaaacttttgtgtgttagtgacttgcttttattaggaagagcaaccattgaagaggcacgcagtctcttacactggttggactctgaggcaggttttggcaagatgggtgtttgtggacttagtatgggaggagtacatgctgcaatggttgggtcacttcaccctacacctgttgcaacactcccttttctatctccacattctgctgttgtggcattctgtgaggggattttaaagcatggcactgcctgggaagcactgagaaaggatcttgcagcccaaaaggttgctatgactctagaggaggttagagaacgaatgaggaatgttctgtctctcacagatgtcacacgctttccaattcccaaaaaccccaatgctgtaatctttgttgctgccactgatgatggatacatcccaaaacactcagtcctggaacttcagaaagcttggccaggttctgaggtgagatgggtcacaggtggccatgtgtcatccttcattctccacaatgatgagtttcgaagagccattaaagatggtcttgatagattaccatggaaagagtctcatttgtga

SEQ ID NO: 46242 - DNA, 1080 bp, Glycine max
  Peptide Sequence Number=SeqID_163020
atgagttctgtgaataatcttggaacattgttggctcgtcttacctctatgctgaacacacgttcacctctgattccatgttttcacactcttagaacggttcccgtttcccccaaaagagaatggccaaagctattttcttctgtcaattccactctccccttctcgtctgcgcccaacttcgacttcaaggcctacatgctcgacaagatcaacaccgttaacagagcattggacgcagccgttgcgctaagagaaccacggaagctccacgaagccatgcgctacaccctcctcgccggcggaaagaggatccgcccggtgctctgcctcgccgcctgctctctcgtcggcggcagcgaggccaccgcaatccccgccgcgtgcgccgtcgagatgatccacaccatgtcgctcatccacgacgacctgccctgcatggacaacgacgacctccgccgtggaaagccgacaagccacaagatcttcggcgaacacgtggccgtcctcgccggcgacgcgctcctcgcgctcgcgttcgagcacgtggcggcgtcgacggagggcgcgtatgcggcgcgcgtggtgcgcgcgatcggggagttggcgaaatgcatcggcgcggaaggcgtcatggcgggacaggtggtggacgtgaattcggaagggttgacgttgtcgatgtcggatgaagtggcagttttggagaggttggagtttattcacgtgcacaaaacggcggtggttgaaggtgcggttgtgatgggggcgatactggggggtgggtcggacgaggaaattgagaggttaaggatgtttggtaggtgcattgggttgttgggtcaggttgtggatgatgttctggatgttactaaatcgtccgaggaattgggaaagacggcgaagaaggacttggtggctgataaactcacgtaccccaaggttttggggatacatgagtcgaaggagtttgctcataaattggtgcatgatgcaaacaaaatgttggctgggtttcatcctccaaaggctgctcccctatttgctttaaccaattacattgcttacaggcaaaattaa

SEQ ID NO: 46243 - DNA, 873 bp, Glycine max
  Peptide Sequence Number=SeqID_163021
atggctgattaccaaggctacatcatacttttcatggcatggctagtctccacaatagtggttcgagccatactcagcaaaaaacagaacaagactaatagaccaccaagtccactagccttacccatcattggtgagaaagggtttgggaaaggactaaaggaaattcgggacaggtttgacaccattatggagagggcgatcaaggagcatgaagaggaaaggaagaaaagaaaggaagttggtaatggaggagagggtcaaatcaaggatctagatgtatttatggcaggaacagacactgcagccttaacgaccgaatgggctctaaccgagttgattaaccatccacatgtaatggagagagcaagacaagagattgattctgtgatatataggaaatgggaccccaatcactgggagaacccacttgagttcaaaccagagaggtttattagtgaagagggaagtgggaagggtcagatagatgtgagggggcaacattttcacatgattccatttgggagtgggagaagagggtgccctgaatcctcacttgctttgcaggttgcgcaggcaaaccttgctgctatgattcaatgctttgaatggaaggttaaaggaggcattggaactgctgacatggaagagaaaccagggttaactctttcaagggctcatccattgatttgtgtcccagtgcctaggcttaatccttttcctaatgtgattgtgatcatatcatcatcaatttcacgaaccctgactctgttttgtgcaatatgtacacaggcaagggattatagcctgtataaagaatatcatggaagtgactttctcaataaaaccgggtcttatggtttgacaaaatag

SEQ ID NO: 46244 - DNA, 1503 bp, Glycine max
  Peptide Sequence Number=SeqID_163022
atggatgctgctggtgctacccttttgtgttacatcttcttcatagctttgctcattttcccaatacttttcaagtcccttgtcacacgaagcacaaagaaatttcgaccaccaccaagtccaccaacacttcccatcataggccacctccaccttgtgggctcagtcataccaaaatcattccaagccctagctcgcctctatggccctctcattcagctccgtttaggtgcctcaacatgcgtagttgtctccaacgaccaagttgccaaagaagtgatgaaaaccaacgacctcaatttctgttaccgaccccactttggatcctccgagtacttcttgtacaaaggctctgattttatcaccgccccatatggcccttattggcgcttcatcaagaagctttgcatgacgcagcttctatccagctcgcagctagggcgcttcgtgcacgtccgagagcaagaaattaataaactcttgaaatctgttctagtgtgttccagtgaaggtagggttattgatttgagctttgagctcacttctttgaccaacaatatcttgtgccggatggctatgagcaccagctgtttggatagggttcatgatgctgctgagattcttgacttggtgagggagtttttgcatgcaggagctaagttgagcatgggtgaggtgttgggacctttggggaagtttgatttgtttgggtatgggaagaagcttgtcaaaatagttggcaagtttgatcaggttttggagcgtatcatggaggaacacgaagagaaaaacactgaggttcgtcgaggagaaacaggggacatgatggatattatgttgcaagtttataaagatccaaatgctgaagtgaggttaacaaggaatcatatcaaggccttcttcctagatattttcctagcgggaacagaaacgtcttcagcagcgttgcaatgggcaatggctgagatgatgaacaaggaaggagtgttaaaaagggtgaaggaagagatcgatgaagtggtgggaactaacaggttggttagtgaatcagacattacaaatctacgttacctccaagctgtagtgaaggaagttttaagactccatccaacggcgccgcttgctataagagaatcagcagagaactgcagcatcaacgggtatgatatcaagggccagacacgaacactcatcaatgtctacgccatcatgcgggacccagaagcgtggcccaacccagaggagtttatgccggagaggttcttggatgggatcaacgccgctgatttcagctatcttccgtttgggtttggcaggagggggtgccctggatcttcccttgcattaacgctcatacaagtcacgcttgcatcgcttatccaatgttttcaatggaatatcaaagccggagagaagctttgtatggaagaagcctcatccttctctacaggattggcaaagcctcttctttgttaccctataactcgttttaatcctttttaa

SEQ ID NO: 46245 - DNA, 177 bp, Glycine max
  Peptide Sequence Number=SeqID_163023
atgatttcatattttttcgagttgaaggctgataatcagaggcaccaaaccattcaccgtctgcaccagatcctaacaacgcgtcaagcagcaaggtgttttctggccatagctgagtacttccatcgtcttcgagccctcagttctttgtggctggcacgccctcgccaagaatag

SEQ ID NO: 46246 - DNA, 642 bp, Glycine max
  Peptide Sequence Number=SeqID_163024
atggcgacttacgctgcgatgaagcccacaaagcccggcttggaggagccccaggagcagatccacaagataaggatcaccctttcctccaagcacgtcaaaaacctcgagaaggtttgtgcggacttggttcgcggtgcaaaggacaagcgcctcagggttaagggacctgtcaggatgcccactaaggttcttctcatcactaccaggaagtccccttgtggtgaagttttgaacatggatgccctttgtataaagagtagttttgcaatatatctcttactttttaaggtctggaatgtgctaaatggaaaatttggatggaggattttgaaggaaaaaggaagattaaggatgaacgggaggttttgttttgtcggtaatctatttctttggaggcttgggactctgactgcgtgtctgttgaagaggggaagaatgagactgcaactcataggctgtggcttggttaagggaaaccaccggagctgtagtgaaagtaccaacacatgggacagatttgaacttcgtgtgcacaagagagtgattgacctctacagttccccagatgtagttaagcagattacctctatcacgattgaacctggtgtggaggttgaggttaccattgcagatgcttga

SEQ ID NO: 46247 - DNA, 505 bp, Glycine max
  Peptide Sequence Number=SeqID_163025
atggaaaatccatcttctcccgaagctccggctccaaaatatgagaatctgattacggttctcagcattgatggtggtggtatccgaggaatcattcccggcgttattcttgattaccttgagtctcaacttcaggagttagacggtgaggatgcaaggcttgcagattattttgatgtaattgctgggacaagtacagggggactcgttgcttccatgttagcagctccaaatccaaaggccaacaatcgccctttatttgctgccaatgaaatagtgccattttacctcgaaaactctccacaaatcttcccccagaaaagggggggaatattcgctccgttggtaaacatagggaaagctttgacaggacctaagtacgacgggaagcatttccatgagttgataagaaacaagttagggggcacaaagttgcaccaaaccttgacgaacgttgttattccaacttttgacgtcaagatacttcaacctaccatctttcctc

SEQ ID NO: 46248 - DNA, 303 bp, Glycine max
  Peptide Sequence Number=SeqID_163026
atgggtagagttatgcttcatttccataaagctattatacctttaactccaatgatcatgattattgtgcgtcaaattgagcctctcacggagcaacaaatattgggcatatgtggattgcaacaatctacacaagaagcagaagaggctctctcccaagggctcgaggctcttaatcaatctctctcagacactataacatcagattctcttagttatcctcccaatatggctaactatatgggacagatggctgtagccatgaacaagctctccactcttgaaggtttcgtgagacagtaa

SEQ ID NO: 46249 - DNA, 600 bp, Glycine max
  Peptide Sequence Number=SeqID_163027
atgatgggaagaatgaaaatgatagataatgtgataaaatcaaagaggggaattaaaaaatttaatggaaatgaaaaatatgcaaggaaaaaggattgtaggataatagagctcattacaaaatctagaaaaatgttatacacgcattccacatttatacttgatcaagcaagaattaacggtgtactagttgcctgccatggttctctttttgctcatggaaggcagataaaaccattgaaccaacattcctccttgctaaacacaaaacctacaattctggctccactcagaaccagcattaaattaattgacgcaccaattgtcccaaaattcaaatttgctgatgttgactctggagattcaggtgcagaccatgcaaatgcctttcgacccacaacaccaggaaacagccctggtgttggtcataaaaaatttgaaggagaagataaaggtatgaaagtgatggggacattagttcatagtccagatgttaaagcttctgtggcagatgcaggatcatttgaaaacgatttcagacccacagacccaggtcacagccctggagttggccatcctcgtcaaaacaagattaattaa

SEQ ID NO: 46250 - DNA, 102 bp, Glycine max
  Peptide Sequence Number=SeqID_163028
atgtcacaaggagtggcacctgccataagaaagagttataggattcagtggacaatcgcgaattcggtaaaccagtcaatattcaaagacatttgcaagtag

SEQ ID NO: 46251 - DNA, 411 bp, Glycine max
  Peptide Sequence Number=SeqID_163029
atggtttatcaaaagattacaaagctcaaaaaggttttaagcattctggttgctttgtccaagtttaaagaaaagcattctgcttcttcggattcttttttttgcttggtcaggttccgaggagtatcatctcgagcaactcaaggcaaaaatagcaaaactgaggacacaattattggagcctcaaaaagtatgttgctatttatacggtttattattggtttctacttccaggagagcaaggttttgaagtttttaggatttatgtggaatcctctttcatgggtcatggaagctgcaacaatcatggccattgctttggccaatggaggaacatatacaagtgccaatggcctattttctcgatctactcagttcactcacacatcacgatcaagtcgaaacttttga

SEQ ID NO: 46252 - DNA, 330 bp, Glycine max
  Peptide Sequence Number=SeqID_163030
atggcagctcgtggtggccactggtggtcgtgggtggtggaaaaggtgttagggtttgggtgggagtttggagagggggagagggggaaaaatcgtgtttttcacactgaagaacatatttataatctgcaaatctcacttagcgagctcgtcttgctaagtgggagtccacttttcgcgcttagcgcgacaattcatgctaagcgtaactccctctgcactaattctcgctcagtgcaattccctctcgggttggaattgcgcttagcgagacatcagaacttgttatattccaaatccaaacggtcaaactgtggagaattgtcttag

SEQ ID NO: 46253 - DNA, 273 bp, Glycine max
  Peptide Sequence Number=SeqID_163031
atgcagaagaactaccacttgcagacatggagaaatcaagtgaagaagaagaagcaaaggggagaacctttacagacgagagaagctttacaaaccctatttgaggaacacacacttaagaacaaggagggaattcagaggaaagaagctcttataaaccctaatttgaggaagaaaaagcaagtgaccagaagaagctttataaacacacactttagtgccatgttggatagtctacgtggcactaaaatcaccaacaatgcacctcactaa

SEQ ID NO: 46254 - DNA, 123 bp, Glycine max
  Peptide Sequence Number=SeqID_163032
atggcttctgaatcagaggaaacaacctatgaccataattcatctccacctgccatcggactcgcttgtctctggatagcaaaaagggtgtggatgaccataatggtctttgcgtgccattag

SEQ ID NO: 46255 - DNA, 495 bp, Glycine max
  Peptide Sequence Number=SeqID_163033
atggtgtggatgacactgtctgatgtgcggaaaaagacacaggcgatccagaaacagaacactgccccccataagctgctggctgagaagatcgagaagaagctagaggaaactgcacagtcaggaagcattgatggcgtcatcgaccctccatcccctgtcagacgcctagtgcagtggaagatggcccacaccaagaaaacaagggatataacgactgaggccgcaaaggaaatcgttgagaagatcgattcctttgaggagcaggcgacacagggatccttcgtcccccatggacatcaggatgttctcactactgttattggacgtccaaagcatcctagacgtgttcgtgctgctggagccggggtcaccatcaagcaatactttggatcggctccatggacgtcccacagctcttcctcactgcctcctgaagaattgcaacagctgacccaacaaatcaaggaccaactagaggagtcgattacataa

SEQ ID NO: 46256 - DNA, 411 bp, Glycine max
  Peptide Sequence Number=SeqID_163034
atgactctagaagtgttatcaaaaggggttgtcgggaactacaatggtgccttacaagtgaagaaggccttctggctgcctaattcaagaaatgccaaatggctattcaaagtgataacaaaccaagaagggagaaaaagcatgatgaagctggctgaaagaatggtgataagcttttgtgctggagtgagtgcttccactgctcacacatggacaacactctcagggacaagtgctgatgatgtaagggttatgactcgaaagagtgtgtatgaccctggaagaccccctggcattgttctcagtgctgccacttctttttggcttcatgttcctcctaaacgagtctttgacttcctccgtgacgaaaactctaggaatgaggtatgtgcaaaaattccaaaaagctaa

SEQ ID NO: 46257 - DNA, 174 bp, Glycine max
  Peptide Sequence Number=SeqID_163035
atgaagcaaaatggggatgcttttgtttccattgtgggaacactaggaagcaccataaccgctaaaaagtgggtaccaatgctgcatgaagttggtgggtctttctacaagtccttcagctccttgaggatgcactttgaagccatgggagggacgatacacgttcggatctga

SEQ ID NO: 46258 - DNA, 111 bp, Glycine max
  Peptide Sequence Number=SeqID_163036
atgacttgcaaggcaggggttaacttctatacacagattaagacaataacacaacaatggaaggattcaattggtggtagcaagattaacttggcgacctctcaaaaataa

SEQ ID NO: 46259 - DNA, 612 bp, Glycine max
  Peptide Sequence Number=SeqID_163037
atgaacatgtttccgatgaatcgcatcagaacaatgatgaagggcgaagatcctgatatgcgtgtttctcaggaagcaatgttggccatcaacaacgctgtggagaagttccttgagcaattcacgcaggaagcttatgctttttgtgttcgggaccacaagaaatgcctcaactacgatcatcgaggtaatgataagcttgctctgaatgtgaccactgaacaaggaaagacattgaaggatgcccaaggagataggtggtggaacatgcttgtgggatggcaactctgcaaatgggggagtatgtttccaatgtatcgcatgggattgatacttacagcattagagaaccacttggtgtttgtgttgatgtttcctatggctattacctgtggtaatacctttgttctaaaaccatcagagaaagacccggaattggcattggagggtggtttgcctaaagctccattggagcttgaaggcctaggatcttcttcatcaatggattcctttgcttcttggaagatgaatggcagcggaatggagaaggaagagagagaggagacgccacttcaaggagatgatgagtctagaagaagctcaccaccatag

SEQ ID NO: 46260 - DNA, 450 bp, Glycine max
  Peptide Sequence Number=SeqID_163038
atgatagaaggcaggttccgccacaacagttatcctctccccagaatacgcaaattcggtttgcttaagcctcactgtgctcagagacagcagagccgaacaagcctgagaacatcatggccttcgcttcctttcttgctggggttattttattcctctgttgatttgcttcaactctacctagacgaaaaggtctcgaacagggttcaagaggcaactttagcaaagacaattctctcgccaatgacatggccaggtttcaccttggcatgcattgttgggcttggttgcccattggctgaggttccaattatgaagttcttccacctttggtactatcctcaagcgaatattgaaatctttggccagcctttgacggacacattgtggcaaggcattataataaggccttctagatcaatatatcacactcgtgcattaatgacttag

SEQ ID NO: 46261 - DNA, 780 bp, Glycine max
  Peptide Sequence Number=SeqID_163039
atggagcttgcatcactacacgtcctcgccttcagaggactgaacgtcgtcgcctttagagggctacacgttctcgccttcagaggactacacgctctcgcctttagaggactacatgtcctcgccttcaaaggactacatgttctcgccttcaaaggactgcacgtcctcccctttagagggctacacgccctcgccttcagaggactgcatgtcctcgccttcagaaggcttcatgccctcgccttcagaggactacacatcctcgccttcagggggctacacgccctcgccttctgggggctacacgccttcgccttcagagggctacacgtcctcgccttcagagggctacacgccctcaccttcaaaggactacacgtcctcgccttcagaggactacacgccctcacctttagaggactacacgtcctcccctgtagaggactacacgtcctccccttcaggggactacacgtcctcgccatcagagggctacacgtcctcagctttagaaggctacatgtactcacctttagaggacaacatgccctcacctttagagggctacacgtcctcaccttcaaaggaccacacgtcctccccttcagaggactacacgtcctcaccttcagagggctacacgtcctcaccttcagaggactacacgtcctccccttcagagggctacatgccctcgccttcagagggctacatgccctcaccctcataggactccacatatacgccttcagagaactcaaggtcctccgtccttaa

SEQ ID NO: 46262 - DNA, 969 bp, Glycine max
  Peptide Sequence Number=SeqID_163040
gtatcaagaaaagcagtggaagaactcaatccagtgaggagaacagtttttggcatgctctacaactacaaacttggttggatgaaaaaaggatataaacatagagaagcatcacgtttagccgatttattagccttcagaaaggtcaaagctaggcttggtggtcgtgttcgactaataatatctggtggggcagctttgagccctgaggtggaagaattcctgcgtgtcactacttgtgcctttgtatgccaaggctatggtctgacagaaacatgtggaccaactactcttggctttcctgacgaaatgtgcatgcttggtactgttggagctgtatccatatataatgaaataaagctggaggaggttccagagatgggctacaatcctcttgaaactcctccatgtggtgagatatgtgtgagagggaaaactgttttcactgcttactacaaaaatccagagttaacaaaggaagctattaaagatggatggtttcacacaggggacataggagaaatgcttcctaatggtgttattaagatcattgacaggaagaagaatcttgttaaactttcccaaggagagtatatagcacttgagcatcttgaagatatctgggtttatgggaatagcttcaagtcaatgctggttgcagtagtagttccaaatgaagaatttgccaataagtgggcatattcgaatggtcacatagcttctttccccaaactctgctctcttgatcaactgaagaaatatgtgctatctgagctcaagttgacagctgagaggaataagctgaggggctttgaacatatcaagggggtgatattagagccgcatgaatttgacatggaaagagatttggtgactgcaacactgaagaagaaaagaaacaaactgctcaagtattatcaggtggaaatagatgaaatctaccaaagtttgacagggaaaaaagcataa

SEQ ID NO: 46263 - DNA, 1765 bp, Glycine max
  Peptide Sequence Number=SeqID_163041
attcctcaatttgtttcggaagctttggatatagaaacccctgataaacgtaggaagatgatgattgcgtgtactcagcctcgtagagtggctgcgatgtctgtttccaggcgtgtggctgaggagatggatgtcaacattggagaagaggcaatgacggatccgcttttggaacgatacaaagtaattattcttgacgaagcacacgagaggactttggctacagatgtgctgtttggccttcttaaggaagtgcttagaaatagacctgacttgaagttagttgttatgagtgcaacacttgaagctgagaatttccagggatattttagcagggcccctcttatgaaggttcctggaagactacatccggctgctattaggacggtggtgcagattcacatgtgtgaactccctggagatatactcgtttttctcactgaagaggaagagattgaggatgcatgccgcaaaataaacaaagaaatttccaatatgggagaccagccagctccacctccagttaaggagggagggcatcctggaaggaagattatggtatcaacaaaaatagcagaaacgtccttgacaattgatagtatagtctatgttattgaccctggatttgctaagcagcaggtttataaccctcgaatccgtgttgagtctttgttggtgtctccaatatcaaaggctagtgcacaccagagatctggacgtgctggaagaactcaaccagggaaatgttttagactttatactgaaaaagtttcaacaatgatcttctgccgcagacctatccttaaatccctggatttgctaagcagcagtttcaacaatgatcttctgccgcagacctatcctgaaattttgagatctaatcttgcctacactgttcttaccttaaagaaacttggtatagatgatttagtgccttttgatttcatggaccctcctgccccagagaccttaatgcgtgcattggaagtgttgaattacttgggtgcactggacgatgatggtaacttaacaaagctgggtcagattatgagtgaatttccactggaccctcagatgccaaagatgctcgttgttagtcctgaattcaactgttcaaatgagattctttccgtttctgccgtgctatctggtagtcatcagcaactgtcttctctgggttccatgccctcgttggcatgcaccataggatgccgagtaaatgctgatgcagataattgcagtttctcagtattctctcaatctcttgaagaaaatgcacaaaatgctgcagatgaagcaaaagctagtttaggacacattgatggggatcatctcacgctcttgaatgtataccatgcctacaagcaaaataatgacgatccttcttggtgttatgataactttgttaatcatagggcattgaaatcagcggacagtgttagacaacaacttgtgcgaatcatggctcggtttaacttgaagttatgcatcactgatttcaatagccgtgactactatgtcaacattagaaaggcaatgctggcaggatatttcatgcaggtggcccatctggagcggacaggacatttacttgacagtgaaaaacaaccaggtggtgctcttgcatccatcaaattgcctggaccacaaaccggagtggccccacattactatgatttgtcgaattgtccacaatgtgaagcgaagcgtgttcttgagaggctttacaagaagcgagaaaaggaaaaggaggaagccaggagtc

SEQ ID NO: 46264 - DNA, 720 bp, Glycine max
  Peptide Sequence Number=SeqID_163042
atgcctaagaagatgggtgatccagggaatgtggaagtgaaggaaacccgcatgaccaatccaactgacaaaccgtttaatcagaattctccatggagtggtggagaacatgcttctaaatatgggcaaattcacgctgctcgggaagaactcacatttgatgtgttccaagtcgtgaagcatccaaaaggccagagcaaaaaggaagaattaatagccaacaagaaggaagagaagtccaagttgggtatgaagttcctcccctccaccttgaaatatgtgtttttggagggtgaggatgagaagccagtcatcatcagtagtgcattgacaaaggtagagcaagaaaagctggaagaggttaggcatgagatgttgaagttgttagaagctggtatgatttatcctatctcagatagctcatgggtggaccaaacaaagatagatgtcattgagcaactaccaccaccaagggatgcaaagattgtaaagaacttcttacgacatattgggttttatagaaagtttataaaggatttctctaacattgctagaccttttagcaaattattagctagggatgttccatttcatctgaacaatgaatgtttgaaggattttgagttgctcaaagagaggttagtcacaactcatatcattatagctccaaattggggtcaagaatttgagctgatgtgtgatgtagtgtttacacaatag

SEQ ID NO: 46265 - DNA, 306 bp, Glycine max
  Peptide Sequence Number=SeqID_163043
atgtttaaattgctcatggcaaacacaaacctccgaattgcctgtgttctcctcttgttttttatcttacaccaccaagatctctatgttgaaggaaagaggcacttgaggcttcggttgaacaatcggtgctcgaaagatggtgaaaaattcagcaatgttgtggctcatggtgttggtgatcgtggaaccactgatggtgttgcacaccaaggaagaaaagggcgagtagaatttgaagagaaagattttaggccaacttcccctggtcacagtccaggtgttggtcactccatcaacaattaa

SEQ ID NO: 46266 - DNA, 372 bp, Glycine max
  Peptide Sequence Number=SeqID_163044
atggagaatcctataacatggcaaaataatgataatgatgatggtgatgatgatgatgatgatgaagatgaaggagcggataaagaaagaaagaagcaaagtacagctattaaacgcagggaaggagagagagaagtccgaatggcgccgccacctacaccacctcctccacgcacgccagtatctacaccagttagcacagtgcgcacaacgttggggttgcagatggtgacgttgaggttgcatgaggacgttgaggccaccgacgaggattttctccaccttcacttcaccgtcgctggcgtcaagatttccgcactagcgctccggcggcaccatcgacgtcactggcctgatgcagggcaagactga

SEQ ID NO: 46267 - DNA, 906 bp, Glycine max
  Peptide Sequence Number=SeqID_163045
atggctgatttaggttcagcctcttccaagagaatgtggtgttccgttccagaaagaatgcagcttcacttggccatgttggccttgcagtttggctatgctggattccatgttgtctcaagagctgcacttaacatgggcgttagcaagcttgttttcccagtctatcggaacatcattgccttgcttctgctccttccctttgcctacttcttggaaaagaaggataggccagccatgactttaaacttcgtctgccagttctttcttctggcacttgtcggaatagagcaagtgagattgaaccgaaaagatgggttgggtaaggtggcgggaacagtgctatgtgtggttggagccaccgtgatcacactatacaaaggtccaacaatatatagcccaacaactggtgtgaacataaacaacacaagagtgacacaagtgtttgaattggggtcagtgtcactgggagatgcaaaggggaagaactggaccctagggtgcttatacctcattggacactgcttgtcgtggtctggttggcttgtgttgcaagcaccggttctcaagaagtacccggctcgcctctctgtcacttcctacacctgtttctttggactcttgcagtttctcgtcattgctttgctccttgaaagagacgcgcaggcatggcttttccactctggtggagaagctttcactattttatacgcgggagtggtggcatctggaattgccttcgctgtacaaatatggtgcattgacagaggtggtcctgtgtttgttgccgtctatcaacctgttcagacttttgttgtcgccatcatggcttccattgctttaggagaagagttttacttgggcgggttagtcccttccacgctaattaattattcttctccttaa

SEQ ID NO: 46268 - DNA, 540 bp, Glycine max
  Peptide Sequence Number=SeqID_163046
atggttgtcatcataaaaaaggggaagaatgtaaatcatacagaagaatcaaacaaggttgcttcaaaggataagcattgcttcaagattaatacaaggttgtttcaacaaacaaagccttgcttcaagaataactcaagattaagccttgcctcaaaacaaagtgtttccaagacatccaaggctctaggtgcatgtaagtttcaaagaaaacgccagcagcattggcgacttgaggctacagcgacacgtggagaagaaatcgccactggtactggcgatttcgtgccagctggactcgccactttgactggcgagttagacccagttgggtctcgccagatgcagtggcgacatagccatgcactggtgcagcacaacaggactcgcaggctagggcttagggcttcagagcagggtgtacaggctgcattacgccaataccattggtggtataggtggataacgccaaggccattggcgaaaacgttcaggtacatcatgaattcggttataacagtgttgtatttcaatggaagg

SEQ ID NO: 46269 - DNA, 726 bp, Glycine max
  misc_feature (721)..(721): n is a, c, g, or t
  Peptide Sequence Number=SeqID_163047
atgacggaaccaacggagccatgcacgtcatcctcattggcgagggacccaaccaccgtgattcacccgaggcgcgagcccttcgagcacggcctcttgccaatcccgcgcttcatcttctccgacccggcgcaaaccctaattccgttgaagcagaagcttctcgagttatcctccaatcagcgagtcgactcggcggcaatctccgagtcactgcagatctccattgagcacgccaggctcgtactcgatactctcgcctcggttctgcactccgacgccgaacctctcgtcgccgccaagctcgacgaaatcgattccgtcggcgtcgatgtccatgatctggttttgttcctctacattcaatcctacaagaggctcctcccgcgaacgcacaaggactccgccgccgtcaccgacgtctggccttccacctccgccttcgatggctacttgtctgctctctcgccgcttcagcttgtgcgcagtaacagtcggcggggtatgccatcgcaggttgatgaagaggcgcatcagttgtcgtatctgcaaaaacacctggctaacattgtgtctcttctagcacagcctgtggagggagaaggcgaagaatcgctggatcggtctggattgtcgttgaagatcatggaaacagtgaattatgtatttcaagtgagcgggattttcactgggtttgtgggttgggttccacagcccaatntataa

SEQ ID NO: 46270 - DNA, 180 bp, Glycine max
  Peptide Sequence Number=SeqID_163048
atgaagaagatagcgtaccggaggcggaacatggagagtgagtgtgacagagagtgggagaacccatacgacacagcgttagagggaattttttgggatgttcttagtgtccacacaaacccgatgagtggctctgtgaaaattgctgacaggttggtatgggaaagcccggttcaataa

SEQ ID NO: 46271 - DNA, 732 bp, Glycine max
  Peptide Sequence Number=SeqID_163049
atggaaactcgagggagaaaggcaatggtgactgctgagaaaaccgtgaaaaatgggcgtcgatcaaatagagaaaggaaaatggctttgacacaagatgttgataagttgaagaggaagctcagacaagaagagaatgttcacagagcgttagaaagagcattaacaagacctttgggatcccttcctcgtcttcctccttatcttcctccacagacattagagcttgtggctgaagtggcagtattggaggaggaggtggttagactagaagagcaggttgtgaatttcagacaaggtctatatcaggaagctgtctacatttcctctaagaggaatgcagaaaatttgagggactcaatggaccagaactccatcaggagctccaaacatcaaagatcaaaatctttgtcccaaagtgagcttaattcaactaccatggctaggcctcaactttctcttgctagaagtgcttccagtagaaagctgttctctgacattgtcgttgatcacactggtaagctagtgaacgggaaacaattgcacatgaaacaagattcgctatcatcaatcccagaagagggacagcgaaaagagaatccactgttttatagctctctgaaggataagcaatctccagagaagaaaacggccaaagtcattactccagtgaagaagtctccaataaaaaaagaatcagctgataaatgtgtagatcacttgaagttacag

SEQ ID NO: 46272 - DNA, 570 bp, Glycine max
  Peptide Sequence Number=SeqID_163050
atggatagatttgagcaccttgggtttctaattcagtttggtgataagggatctgaaggaaattcttttagtcaatcttctcccttttttgcaaactcagaccctgatatgcctgctgttcctgttcctgctgctcaagttcatgattggcttctacagaatatagcttctgctttggattatatttctgaacgaacttcttctaaggagaatggcccagctagtgcctctgatcaggatgttgctatggctgatgcatgcactgcctcagttaacaaggtctcgacaagtactagaagtgcaagtttcattgaagggatctccaaatcgtcatatgtgaagcatgcatctgacattaaaggttcctctgttaaggttctaaattgccatgagtctgctatatacatcttagcacctttgagatatgcaactgtctatggatgttcagatgcaacaatagttataggagcagttggcaagcagtgttatcaatggcggaaggccaaaattccaccatataaacatgccattgtggcctatggtgccgccatagtggtcctccctttgtaa

SEQ ID NO: 46273 - DNA, 192 bp, Glycine max
  Peptide Sequence Number=SeqID_163051
atgacaggatacccaccttccaggcttcgtgttggtgaattcacatctctgtcgcaacatccgtggcatgatctgggatccccatttgcgcatttccagtttgttctagtgaacgttcgcattctcaatggatggaaatggaatatacttcaacatagttgcggaaccgatatgcgatcatatatcaaataa

SEQ ID NO: 46274 - DNA, 741 bp, Glycine max
  Peptide Sequence Number=SeqID_163052
atggcaagctctgtctcctcacgaggcaatattgctgctatagtcgggagattgtctggagtggcggaagagatagcgagggaggagaaagcacaggtgtttgcaatacgtatcgactgctccgactccaaaagcgtcagggatgcattcgaaggagtgctctcgctcggattcgtggaggttcttgtttacaacgctaatcaccaaccccaatccctctctccaaaccccacttccttccaaaacatacctctcgacactttccaaaaatccctagctgtttccgccgtcgctgccttccactgcgctcaacagtgctttgatattccagttttggatatattagctgtcatggtgttgacggggatggtggaaaaagggaagggcacaatccttttcacgggctgttcagcgtcactatatggcattgccggatactcccaactatgctgtgggaaattcgcgttgagagcactagcgcaatgccttgcgaaggaatttcaacctcagggagtgcacatagcacatgtaatcattgacggtgttgttgccccacccaggaggagaagatcatcatcatcaagttcagttagggatgaaagcataagcagcggagaggatcatgagggcacaatggacccagacgcagtggctcaaacatattggcacttgcacgttcaggaccgaaccacttggacccaggagatcgacctgcgttccaacaatgctacattcttttag

SEQ ID NO: 46275 - DNA, 895 bp, Glycine max
  Peptide Sequence Number=SeqID_163053
attagaagatgaagaaacagctgagagattagatgataatgtgtcagaagttgacagaacacccaacagaatttcagaggatattgtcaagtgcttgtgtagaatatttgtgagaataggcacattcaaggaaaaactaggagaatcaaaaacacctctcagttctacatctgcatgcagcaagggaaaggatcactgttcagaatccaaaatgagggatattggtacatacaatagtttgtgtgagattaaagcctccaatgttgacctcaatcgaacaagatatgtagtgtttctgatccataggttaaagtttctactcgggaaacttgcctctgtgaacataaaggatcttactcatcaggagaaacttgcattttggataaacacttacaattcctgcatgctgaatgcatatttagagaatggcatacccgagagtcctgaaaggattgtagcattaatgcagaaggcaacaatagaagtggggggcctgcagctcaatgcaattacaatagagcacttcatcttgagacttccttatcacctgatgtttacctgcccaaaagctgcaaaacatgacgagatgaaattgcgaagcatatttggcttggaatggtcagagcccttggttacatttgcactttcctgtggaagctgttcttcacctgcgggaagcagcagaccacagagcaaaggtgcaaacagaacaatcagcagaggtgcaagcaggacatacaagggtgcagatcaaggaaaagcccaaaaggagagtcacaagactaaattaccttcgagactatgcttgagggcaggaagggaattgagtagcaatccttatcgtgtgatgctgttgctagagcaggggacaagcttaacggatttgattctgtaa

SEQ ID NO: 46276 - DNA, 2980 bp, Glycine max
  Peptide Sequence Number=SeqID_163054
atggcattgttccgcaaattcttctataagaagcccccagatgggcttctagaaatcactgaaagagtttatggcatacatattacttgtgggaggaatggagtctttgattactgctttaccacggatgttatggaagaagatgaatatagagtgtatataggaggaataattgggcaacttcgtggtcacttccccgatgcttcatttatggtgttcaacatgcgggagggagatagccaaagccagatttcaaacattttgtgtgactatgatatgactgtgatagactatcctcgacagtatgaaggttgcccgctacttaccatggagatgatccaccatttcttgagatcaggtgaaaactggcttcaacttgggcaacaaaatgttgtcttgatgcactgcgaacgaggtggttggccattattagcgtttatgctagctgcactcttgatttatagaaagatgtttacaggggagcagaaaacactagatatgatatacaagcaagctcctcgggaacttttgcagttgatgtcaccgctgaatcctttaccttcacaattgaggtatcttcagtacatatcaagaagaaatgttggctcagaatggcctcctcttgatagggcacttactttggactgtgtaattataagactcgttcctaatatgggtggagagggtggctgccgtcctatatttaggatatatggacaggacccttttattcctgcagatcgaactcccaaagttctcttttcaactccaaaaaggagcaaacttgtccgctattacaagcaggtggctgattgtgaactagttaagattgacatccattgtcatgttcaaggtgatgtcgtttttgagtgtattcatctgaacagtgatttagagcatgaagaaatgatgtttcgggtgatgtttaatacagcattcataagatcaaatattttgatgcttaaccgtgatgagcttgacatattatggaatgctaaagactactttcctaaaaactttagagtggaggttcttttctcagatatggatgcttcgtcttctgttatttcaattgatctgcctcatgttgaggagaaagaaggcctaaccgttgaagcatttgctaaggtcaaggaaattttcagcaatgtggactggctagattcaaaggcagaggtagcaagtgtgctccaacagatcacagcatcaaatatctttcttgaaagactggacagtgggatttctgcttcaacaagtggcttgcaaaaggagtcatctggaaaatctaaacttgattcgaaggaacacagtgactcaaagaatctgacttcaacagttcaggagaaacattctacgtcctccttgggatcatcagttgatgttcctatggaaaataagacagaactattacaattaaaggcattgtcaggaaataacgttgagagtcttgaatgtttaggtcagggggaccaacctattccctcatttgggccctcaacagattcagattctactaaaaaggcacgaaatgattcaaagaatctgacttcaacagttcaggagaaagtttccacatcctccttgggatcatcagtggatgttcctatggaaaataagacagaatcattacaatcaaaggcattgtcaggaaataacattgagagtcttgaatgtataggtcaggggaaccaacctattccctcatttgggccctcaacagattcagattctattaaaaaggaggttgaatcattagaaacaaaacaatcattagaaaatgataccaagtttactgcatctacggctcacgagaatcgatccatccccttaagtgagccatcaatggatgcaaacttaataaaaaagaagagtggatcattagaatccaaggagaaagatattgagtcattagcatcaaaggcattggtggaaaacaataccaaggttcctacatccatggctcatggggagcagtctatgcccttaattgaaccatcaaaagatgcaaattcaatgaaacaaaagatggaacgattagattcaaaggaaaaggataccaaatcattagaatccaagtcattgttggaaaatgataccaactatcctccatctatggctcatgggaaacaatcttttcccttaattcaaccatcgactgatgcaaattcagtgaaaaagatgggacaattagaacaaatggtattgccggaaaatgatgtcaagagtgtcacatccacagttcagaggaaacaatatggtcccttacttgagccacctgttgatgcaaacctaattaaaaagaagattgaacctcaagaattgcaggttgcacttcagcttcccactcaatctaaaataatttcaccacgggtgcgttcagctgttcgatctgcttcagcttctttttttaactccttgcaaggttcacctgtagctatctcaaggtatcatagtgcaccatcatctcttggaataacatctgtgttgcaggatcatgcaccaatggatatcaaagaagtcactcatgcagtgaaagtatctcctccgccttctactttgcctcctttagactccaaggtgccaaattctttagagcctagttctacaattgttcctccaacatcatcaccaccattgcttccatctttaccattaaaaacttcagttgatgctcttactgccatggaaaagacttttggatccattgctcctgcagctgtcactcctcctccaccaccaccaccaccaccaccaccaccaccacctcctcctcagagcgagcatacttcaaaattgatgcaatctaatgctacacagtaccctgaaaatgcaacgcatgatgaaggtaagaaatcattggttagtcctcctcctcctccgcccctttcaatgccagctcctccaaccaagtctttatcccatcctccagccccttcccttcctggaacatcactttccactgccaaagattcatttaaag

SEQ ID NO: 46277 - DNA, 960 bp, Glycine max
  Peptide Sequence Number=SeqID_163055
atggatcatacgagaagaggaaagaacaaagtgatggttctctcttctgaagaagaagaagaagaagaagaagaagaagaagaagaagaagacagcgattgcgatgaagcgtacgaatccgatgacggcgacgttgatgattcctccctctccgacaaagtcgtcgccctccttcgagtgccgttgaatttctatgtttttcgtttgaatttgctagaaggaaaagatattgaatctttgaaattaaacgaatgcaaagcgtatctacggaatcactgcttgaggatcgcaggaaatagagatgtttgtgttgccaggataaaggagcattggaggttaaaacatggaagtggctacacgatttacccaagatcgtcctttaccattaattgtactggtgatgtttgcatgggagatgttgttctgttcagacagaaggtttatgaaaagtttcataaagttactcggcatggaaaaactctaggaaacagaactgttgctgggagggttgtgaaggagagttatggtgcagctaaacaacaacatacctttactgtgagtctaaagttagctgcaataagttggttacatgaaaaagagtcctgtattgctccttggtcttttattcggacaaacataattggattatatatatactcttgtaaactgagcagagcaatggctatcttggttgaagtattgtggagtagtggggttaggaaattgcctcctctttctccgttgcttgtaaagggccggaatctctataaacagaaaacttaccggcagagatggaaaaatgaagctgatagaattgaggtacttagtgagaagcacaaacgtggtgcagcagcgagatctatgagatcattgaagcgaaaaaagaaaagttgttctgcaaatgaatctaaagtttttcacattattggttacttgttactcatctcttgcaattattag

SEQ ID NO: 46278 - DNA, 1245 bp, Glycine max
  Peptide Sequence Number=SeqID_163056
atgaccactgcaattgctatcgaggatgtgagaagggaagtaaaaatattgaaagctttgactggacacaagaatctagtacaattctatgatgcatatgaagaccacgataatgtctatatagtaatggagttgtgtgaaggaggagagctgttagacagaatattatcaagaggagggaagtacacagaggaagatgcaaaagctgtcctgagacaaatactgaatgtagttgccttttgccatttacagggtgttgtgcatcgtgatcttaaacctgagaacttcttgttcgcatccaaggatgagagctcaaagctgaaggccatagactttgggttgtcagattttgttaaactagatgaaagacttaatgatattgttggcagtgcatactacgtggctcccgaagttctacatagagcttacagtacagaggctgatgtctggagtattggagtgattgcatatattttattatgtggtagccgtcccttttgggcccgaaccgagtctggtatctttcgtgcggtattgaaagctgacccaatttttgatgaacctccttggccttctctgtcagatgaggcaaccaattttgttaagcgattactaaataaagatccacggaaaagaatgtctgcagcacaggcgttaagtcatccatggattagaaacaaggatgtaaaattacctctggatattctaatattcaagctcatgaaggcatatatgtgttcctcatctctacgaaaagcagctttaagggctctgtctaagacgctaactgttgatgagctattttatttgagggagcagtttgcacttttagagccaagcaaaaatggcaccattaacttggaaaatatcaaagtggtcttgatggtaaatgcaacagatgctatgaaggagtcacgcatacctgactttttggcatcacttaatgcattacaatatagaaggatggattttgacgagttctgtgcagctgcccttagtgttcatcaacttgaaacacttgaccagtgggagcaaaatgcacgttgtgcctatgacttttttgaaaaggatggaaacaaggctatagtcattgacgaactagcttcggagcttgggcttggtccatctgtccctgttcatgctgttctccatgattggattcggcacactgatggaaaattaagtttccttggatttgtcaaactgttgcatggcccatctagaagtcttgcaaaagctctatag

SEQ ID NO: 46279 - DNA, 1419 bp, Glycine max
  Peptide Sequence Number=SeqID_163057
aattctttgtctaagaactccgcaaatgttccacctcccccacctcctcttgctgccaatgggttgtcaaaacctgctgttcccggaccaccttctgctccattcggtgcaaagggacgtggcagcctgttgcgtgctaatccaaaaggtcagtctcagactaaaaggagcaatctgaaaccttaccattggttaaaattaacgagggcaatgcaaggaagcttatgggctgagacacagaaactagatgaattttgtagggctccagagtttgacatgtcagaacttgagagtttgttctctgcagctgcaccaaattctaatgatggaaaaggaggaaagatgactcgccgctcctcacttaaagttgacaaagttcaattgattgagctcaggcgggcatataactgtgagatcatgcttacaaaagtcaaaatccctttgcctgatctgatgtgtgctgtgcttgcattggatgattcagtattggatgttgatcaagttgagaacctcataaaattctctccaaccaaagaagagatggaaatgctgaagaactataatggggataaggacaacttgggaaagtgtgaacagttcttcttagaattaatgaaagtgccaagagtggaaaacaagctaagagttttcgcttttaagatgcaattcttaacccaggtttcagagcttaaaagggacttgaatattgtaaatgatgcatctgaacagataaggaattcagtcaagttgaaaagaatcatgcagaccattctttctctgggtaatgctttgaaccatggaactgcaagaggttcggctgtggggtttcgattggatagtctccttaaactcactgatacacgagccagaaacaacaagatgactcttatgcattatctttgtaaggtgcttgctgaaaagcttccagaacttctagatttccacaaagacctagggagtttggaggctgcaaccaagatacaattaaaatatttggcagaggaaatgcaagctgttagtaaaggactggagaaagtagttcaggaattgactgcatcagagaatgatggacctgtgtcagaaaatttctgccagattttgaaggaatttctttcttatgctgaggctgaagtgaggtctttggctcaactatatgccaatgtgggtagaaatgcagatgcattggctttgtactttggtgaagatccagcacgtgtcccatttgaacaagttgtatctactctcctcaactttgtgagaatgttcataaaagcgcatgaagaaaattgcaagcagattgaattagaaaaaaagagagcagataaggaagctgaaagtgagaagtcgaagctagctgctgctaaaaaggagtctgaacagatgttagggaccaccataaagagtgggaatattaaatga

SEQ ID NO: 46280 - DNA, 465 bp, Glycine max
  Peptide Sequence Number=SeqID_163058
atggatgaaaaggtggaaactattaaagctgagttaaaacgagtgagagaggagaacaacactctaagaatgatgcttgaagttctaagcagcaagtacacaaagcttgagacccatcttcaagaaataaacaagacacaacacaagggcatgagttcaaatcaaatagggtcagtaacagtaccacctatgtttcagacaaacaagagaccgagactagagtttcccacagcaaaaaagccattacaaatctttgtcaaaacacaccccaaggatgatagtttgatagtaaaagatggctatcaatggaggaagtatgggcagaaggtcaccaaagacaatgcttcaccaagggcttatttcaggtgctacatggctcccatttgcccagcaaaaaagaagttccctagtcagcaaaaattgacatacggttactcaattagggataaaggaattggtcaatga

SEQ ID NO: 46281 - DNA, 210 bp, Glycine max
  Peptide Sequence Number=SeqID_163059
atggagtggggtattggttggctgagaggacaaaaagtaataatgacaataaagtttccttggtattcattccatcatgtcaaatccatgcacgtgatggactccccagttctcctcccattttctaagtcaacagcgacaaaaagcattaggaaaaaggaaatgacaaggaaggagaattcaagttttggagggttgggaaataattga

SEQ ID NO: 46282 - DNA, 1917 bp, Glycine max
  Peptide Sequence Number=SeqID_163060
atgcgttggttccctaccctcatcttctcccattctcattctcagtctaattcatcaacatcaacttcgtcctcatcttcttcggcgactctaaagtcttccccttcgacgtcctctgcctccgaacccaggaagaacagccgctccgcctggttcttcgggaaaaggtcgacgtcgacgcgttccaggaagctaacccacatcgccgacttagacgcccttgtcgtgccccccttgtctcgctcccccagcaccttcgatcgttcctccacctcatgcgttcagcctcagcctttgcccttgcccagagacgctgattaccgttttccctcgcccaaagatgccgccgtcgacagacctgacgccgccgccgtcgatgtcaccctcagccctggttttcgaatgcgcagtgtttttgcgaggcaagaggcagtgaaaagtgtggagcaggcggagacaagcagtcaaggagatgggtgctggttccctgcaagaagtgctccaacgagtcctttcgccagtccgaaaacttgcattaagaaaaacgatgattttgttccataccattacgtctcacccaaaggaaaccagttctggtcagcaccagagatgcccacattcgacacttcccacccacctcccgctttctttgatttatcagcattacgcaccgataaaattctttctccccaccaaagcccacccggaaaaagcctcgctgccccacatccaaaaagcccaactggcccttcttcttctctatccatcccccccaggttatcccttgacacctccatagcacgtcgtgaaaccaatgctcttctcactgttcaccccttacctttgcctccttgggctgggcctggggcccccatgctttccccatcttcttctaccttttcccctcccttggctaagactgaacccatgcccatgaaaaaccagtggcaaaaagggaaacttcttggccgtggtacttttggaactgtttatgctgccaccaatagaaaaactggagcattgtgtgcaatgaaggaagcggaaatattttctgatgatccaaagtctgcagagtgcataaagcagttagagcaggaaattaaagttcttagccatctgcaacatccaaacattgtgcagtattatggtagcgaaatagtagaagacaggttttatatttatttggaatatgtccatcccggttcaatgaataaatatgttcgtgaacattgtggtgcaataacagaatgtgttgttcggaatttcacgcgccatattctatcaggcttggcttacttgcatagcaaaaaaacaattcatagggacatcaaaggagctaacttgctagttgattctgctggtgttgttaagcttgctgactttgggatggccaagcacctaactggacatgttgcagatctttctttgaagggaagtccatattggatggctccagagctttttcaagcggttgtgcaaaaagataacagctctgaccttgctttcgctgttgatatttggagtttgggttgtacaattattgaaatgttcacggggaagcctccttggagtgagtacgaaggagccgcagctatgtttaaggttatgaaggatacccctcctataccagaaacattgtcagcagagggtaaagatttcctaagactttgctttataagaaatccagcagagcgaccaactgcttcaatgttattagaacatcgatttctgaaaaacttgcaacagccagatgtttcatcttccatgcagctgtataatggaacaaacttgatgtggcattgcagtgcccttctcgctctactattgaagtacttcctttcctcactctctaagtctaaaaactcgcctgcaacactctcaatgagatttctttgtctctgtcaaatatggcaatag

SEQ ID NO: 46283 - DNA, 582 bp, Glycine max
  Peptide Sequence Number=SeqID_163061
atggtgggatcctcgaccaactctagtctggcttataatggagtctctactaatctttctccagatgaagagaataaatacgcttgcaatgcatatggatatggagactacaaagcctactatatggaatggatcccaaacgacaagtatgggttttgtaactctttgggttatgaaatatgtcacttagttgaagccaatggccatgcgagagggaggttgttttctgcggttgatgcttctaggttcatggatatgattgacacttgccatttggttgcttttctaaaggagtttgtggagaatcttagtagagtttattcttaccatgatctgattctaaatgtggtctatggtgcttggggtcacggttcccctaatgctaccaggtgtttaaatggagtgcatgaagatgctactaaatttaacatgaatgtgtttggtagtagtattcacaaatgcaaaagagaggtggaaacaagtcttagggatctgtataaggctcttgaggagagagaaactgatagtctccatagacttgaagttgagttgcataaggagtacaatgatatcctcatctaa

SEQ ID NO: 46284 - DNA, 1760 bp, Glycine max
  Peptide Sequence Number=SeqID_163062
atggtgccttacgtctatatttcagacactcagctttgcgttcgtgatgtttggaggttaaatggtctttgtacagagatccctacactcaggatacctttagctgggtgggtgactattctgggagatacacagccaactcggcctataaatggctttttcggcttagtaatccctatcctaaccctatttggaaaaggatttggcatgcgaatatccaggagaaacttatattctttctttggcagctcctccatgaagctcttcccaccaatggattgtcctcattcgcgtgaattatggccaaggatgggtgtccgttcagtgaatctcctcacatgtgataatacagtagcttggctaagtcatatcctgtctcataaacttattcgagagatgcaagtggattctctttcttggggagcgaaagtggaaacttggaattctaactgcgctcttccgatccatccatttgttaagcttaatgttgatgggagttttatctcggatacgggcttgatgggtgttggtggggtcttgagggatttggtagagaagtggaatgttgactctggtgatcttcgtggtggtaaatctgcctgtatcctccgcttgagaaatgggaagggaggaggcgactttgtgatgcaatcctaccccgcaagggcattggatagaaaactccaagtagattgggccagagatgcaagagaaggccctagggttcttatgagtcttaggggctccataatgaagactcatcttctccttgaagcggcgtctcctctctctcttcctttctccattccgctgccattcatcttccaagaagcaaaggaatccattgatgaagaagatcctaggcctacaagctccaatggagcttgcatcactttgggggttccttgcaaggtctctgataatgggtcctcatacgaagaaggtagttctgggctacacgcaatgatagaatctcccatagctcttacggaggatcaatcctcccctattatgacaatcttgccctcacccccgtgggagaatccagtgatagttgaggccacaggaagagacgatggcaatgaagttagggtttctagttctgaagagacgccgaggagtaggtgttgccatggtggcaatacaccttctccttctccatgcatcaacaatttcaagtgggtgagggatgatgtcctaaagtatcatttgtcgataatgtcttccttgagtgttggtttcttgtggtgtcaacttgacttgacaaagcatagtgatgctcataatatgactttagtggcctgtgaagaagataagtacccttttttatgcatcctacccttgatggtccccattatttctatgtttaccggtattgggcctagcgttcctgtgctcatggcaattagtgttggttgtagattcaaggatcgtttttttaaggtcaaggcaattagtgtcatttctgatgggttgccattgatgtatgaggagagtgggagccttagtgtagaagcaaagcttcatgatgaatcaagattgattcaaagatgttttgatgataacaaagatgataacaaaggtgatgacaaaaagctcaaagaacacttcaagactcaaaaggaaaagttgaagaaatcttcaagattcaagaggaaagttgaattcaagaatcaagaatcaagattcaaggatcaaacctcaagaatcaagatcaagattcaagattcaagaatcaagagaagacttaatcaagataa

SEQ ID NO: 46285 - DNA, 690 bp, Glycine max
  Peptide Sequence Number=SeqID_163063
atggtacatctacttgggttgttgactgaaaacaagagagggtacatctcttgtggaccagatctagtggagggaaaaatgggtgactttgagtggtggcctttagtgaagcaagtcagatctgttgatagtgacgtgtcccctcccccattcagtgtcaatgaaccctataaaggggtaggagatccgattgaagctagggttgaccaatccagtgttgctaatgttgtcgaggttggaggagctgaactatgcaagaagtcgagggatccttttaatcttcgagcccttaagcaagccacggggtccgtgtctggtttaagtcattcctcctcctttcttcccgggactcctaacctacgaagtccaacttcgatcccctcagtcgctcagactactattgctatgaccaatgtctctgatcctcttgctcctccaccttcatccaccctagtggtttcatatgcatcagccactttcgttttttcccctgctgtgtttgctcccatttcttctattgcactgccactacttagtgcagggctgacaacgacaggtgtcgtaacaagcatgcctcctatttcctttattgtgccaccttcagctcctaccgtcccaaattctaggttgccttcttcctcttctcatccaagaatttcgttagattacatatatacttcatgggaatag

SEQ ID NO: 46286 - DNA, 183 bp, Glycine max
  Peptide Sequence Number=SeqID_163064
atgctgtgggcgctctctacctattggaatggggatggtgacttaacggaaagcgagacatctccgacgtcaaattcttacatgaagaggctaacatcatggacaaaggatccatatgccgtggcaagcatttattgtggcattgtggcattatggccatgctctatggaccatataccataa

SEQ ID NO: 46287 - DNA, 306 bp, Glycine max
  Peptide Sequence Number=SeqID_163065
atgtctactatttctgattctgtgttgggcatgggaggaagcgaacctgggggttccgttcgacaacccatggaagagcgggaggtggttccctttggagattcttcattgaggaagaaggttcctcgtgaggtctctgataatgggtcctcttcttttgaaaggttgatgaacttcaaaaatatgggtgagggtagttccgaactatgcacggggatagaatctcccacgactcctacagaggatcaaccttcccttgtcacgataatcatgccctcacccccgggagaatctagtgaccactga

SEQ ID NO: 46288 - DNA, 448 bp, Glycine max
  Peptide Sequence Number=SeqID_163066
atggagaggctcaccaaggatgaaccttggcctttggagattcgaccaggaacatgttcatcttgggtgtggcaagactcaccaaggatagaccttgggtttgacgagcttctagagattcaactaggaagacgtctttggagattcgaccaggaacatgttcgtcctaggcttgccatgaccttgaatgggccttcccaattaggtcctagctttcttgctcgtggaattttccttgcctctcctcagactcaccatactcggtcaccagtctcaaaggtgcggggccggactttggtgttgtatcttcttgaggcatggagcctggtagcttcttccttgattgctgcaatctcttggacttcttctcttatatcaaggatcatggcatctattccatatgtaagacaaaaggagtctccttggttgttgtttggggcgaatagtg

SEQ ID NO: 46289 - DNA, 1011 bp, Glycine max
  Peptide Sequence Number=SeqID_163067
atggtggggcgagggagggcgatgatggaggccctgaagagacattgtggtggagaaacaccttctcattctccatgcattaccgatttcgagttgctgagggatgatgtcctaaagtatcattcgttgataacgtcttccttgagtgttggtgccttgtggcatcaacttgagttgacaaaacttggtgatgcctataagatgaccttagtggcctgtggagaagatgagtactcttttatgtgtctttccattaattgtccccactatttctatgtttaccagtgtatgtttgaagtgttgcatttgacccttcccttgaatgactttcaatgtgctttgctgaggcgcttgaacgtggtcccctcgcaactacatcctaatagttgggcggtggtgagggctttcaagattttatgcccattcttcaacattagctctagtgttcgtgtgctcatcccttatgcatcggccactttcgctcttgaccctgccgcatttgctcctatttcttctattgcactgccgctacttagtgtaggactaacaacgaaaagtgtcataacaagcatgcctcctccttcctctattgtgccacctttaactctcactatcccaaattccgggatgccttcttcctcttcttgtccaattgtttggttagatcatgtatatacatcactagaagataattcattgtggagtataggctataggcctgagaagaggatgcacgcaggcttcgtggccccctttgaagaaaaattgattcgttctatttgggtgcaaaattcgaataatgttgcgaaggtttcccttcagaggaggttagctattttaaaagagaataggaggaagcagaatgaggctatgaacataattggttcctttgagaaggaagtttccaagtggagggccattgtcaggacaatatggcgagtggagcgtgccaaggtggaaaaagctattgttgcctttgctgaggctgtcaagtcgaatcaccaactgtag

SEQ ID NO: 46290 - DNA, 291 bp, Glycine max
  Peptide Sequence Number=SeqID_163068
atggtttatgaatggccatcaaagaggattcttgaacacaaaggaagggttgtccctgtgtggttcagactttgtaaaaggagttttacaaagagagtggaaaatctcaagtgggtagtgtcgcaacatacccttttgtgggcgagcgaaagggaggctcatgggtgcgctttccaaaggaggaaagatgcgcgcagtcgccaccaacgtttatttgtggaaaacgtcggaaaaccgaaggaaaccggtcaaaatgaaaattccaagttcgggagtggtatttacgtttga

SEQ ID NO: 46291 - DNA, 318 bp, Glycine max
  Peptide Sequence Number=SeqID_163069
atgacccctactcatgataccttgctatattacaatgggagatggaacatgtcacgccaaaatgagtttgttggttactcgttcacaggaaagaatcccaaaaagtttgacattcccaccggatgtaccatggatgaactgaaggatttgatcaagcaagttgcgcctcctgggattcccccttatggtattcatgaaacacaaatggtgttgattgagtctaactactggaaaaagattgggccaatagaaattttagatgttttcagtaaacctgtaccggaaatggaagacgagttgtccttgttgcaaaattag

SEQ ID NO: 46292 - DNA, 153 bp, Glycine max
  Peptide Sequence Number=SeqID_163070
atggattcccctgaggcaacaattgcaggaaatgagggtttgatttcaattcagtatcccccagacttcaatagaaatgaaggagatgcacctggctctcgcaatccatccattaggaatcttagccatttgttaagtttgcttgtacagtga

SEQ ID NO: 46293 - DNA, 261 bp, Glycine max
  Peptide Sequence Number=SeqID_163071
atgggtctagaccctcgagtttcttgcatgaaaccccttcaagagattgtattggaaagtcacaaagctaaacacacgggtattttatcgctatatatatatagtccttctgttcttttctcaagcaagacccaagtcacaaaaaggagaaatgtaattgatgatgttctacaatctttcccgcatcctacacatagtgaggaagtgaaggctattgggttcgatactgagtgtcatttgtcagatgaagataatgagtga

SEQ ID NO: 46294 - DNA, 639 bp, Glycine max
  Peptide Sequence Number=SeqID_163072
atgtcatgtctgtgtatgagtgcgcctgcgggtaccgatagattcctagttaggaatgtttctagggttctaccctttgactcaagagagaaagacgttgaatttgaccttgaatgtggtgggaactctagcgatgaggatgtaggcaacgatctttatgttagtgatagagaatcaaagggtgcttttggttgggcgtggaatgggattttgaatgttgatggatcatataagggtaaaagtgggactgagtcatgtagcaattcagcaaaatctggtgatgttgtggttatggatgaaaataatgtggaattgcttgtggacaagggttttgtccaacaccaattttccaatgtaaatggtaatcatgcaaaacagaagactaagctctttatccccaaaaagcctccaaagccacccctgcctccaagaggtccttcactggatgctggtgatcagaagtttatggaggaacttgcggagctcgccttgcagaagcgtgcaagggttaagaaaatgaaagcagtgagaaagatgaaagcgagcaagtcctcatcgtcatcatcaacatataccagtctttatgccatggtcatcactgttttcttcttccttgtcataatacttcacggtaaataa

SEQ ID NO: 46295 - DNA, 209 bp, Glycine max
  Peptide Sequence Number=SeqID_163073
aaatgcagtggaactaggacctttaatttggctgctactgtgatggagaagcctcgtttgagtagtgcttgcggcattgatgaacttggtcttcgaaggcatggacctttgagtgtggctgattttttctcaacaactacggtatcaatggaagagtttgagtttaggttcggtagtaatattcttgtgaagactaacgtggcaaagag

SEQ ID NO: 46296 - DNA, 1684 bp, Glycine max
  Peptide Sequence Number=SeqID_163074
atggatgacttgtactatgcaggtttcagcacagatgacaattctagttcatccaatgattttttctgggataatgagggactgaatgatgtgagaaagtttcaattttctggagtagaagatcatgaagagtatgggggaattgactcattttactcaaattttgggttcttcccagatgatccatcagaagaagggtaccttctatccactaatcaccaaaagtatcaccaaatatttgatgattatggactattggatgataaccttcagtttgacatggtatctccaccactccaatttgatgaacaatatagaaccatggttccattgtgtaactcaacaaaggacatgccacactcaactacccctttagcctcacttgagatcttgaagagctatggcaaaggcttcaagaggttttggaatgaaggcaacaacaccatgcagccaattgatgatgagactttggccacagatgaagttattgctgggagaaacctatcaacagaagatctcatgaggatagcaggaacaaggttcatccaatcatcatcatcgtcttcggactcggaatctttgcctttcttggagaatcacccttttggcttttctttctctggattctctgatgaagagaaagaggatctggaacttgctgagtccctcttggcttgtgctgagaaagttggcaacaaacagtttgaacgtgcaagcaaattgctcagtcactgtgaatcattgtcttccaaaaccgggaaccccgttaagagaattgttcattattttgcagaagcacttcgccagcgaatagataccgaaacaggaagagtttcatccaaggacttgcaaaagggtcaaccatttgatcctgaagaagcagccaaggaactaacccctgctattcttgcatttgttgaagaccttcccttttgtaaagttgcacagttcactgcagctcaagctataatagaagatgtagcagaagcgaagaggattcacattattgatcttgaaatcagaaagggagggcagtggactatcgtaatgcaagcccttcagttaagacatgaatgtccaattgagcttctgaagataaccgctgtagaaagtggaaccactagacacatagctgaggacactggtcagagactaaaggattatgctcaaggtttgaacatacccttctctttcaacatagttatggtatcaggcatgttacatctaagagaagatctttttgagattgaccctgaggaaacaattgctgtttattctccttattgccttagaaccaagcttcagcaatcagaccagcttgaaaccatcatgagagtgattagaaccataagtcctgatgtgatggtggtagctgaaattgaggcaaaccacaactctaaatcttttgtaaaccgtttcgttgaggctcttttctccttcagtgcattctttgattgttttgaggcttgcatgaaaggggatgagaagaaccgaatgattatagaatcaatgtacttcagtcctggaatcagaaacattgtggctgcagaaggagccgaaagaaggagcaggagtgtgaagattgatgtgtggagggccttcttctcacgctttggaatggaggagaaagaattgagcactttgtctttataccaagcggaattggtggctaagagatttcctt

SEQ ID NO: 46297 - DNA, 1341 bp, Glycine max
  Peptide Sequence Number=SeqID_163075
atgacggaaccaacagagccatccacgtcatcttcattggcgagggacccaaccaccgtggttcacccaaggcgcgagcccttcgagcacggcctcttgccaatcccgcgcctcatcttctccgacccggcgcaaaccctaattccgttgaagcagaagcttctcgagttatcctccaaccagcgagtcgacttggcggcaatctccgagtcactgcagatctccattgagcacgccaggctcgtcctcgataccctcgcctcgattctgcactccgactccgaacctctcgtcgtcgccaatctcgtcgaaatcgattccgtcggcgtcgacgtccatgatttggttttgttcctctacattcaatcctacaagaggctcctcccgcgcacgcataaggactccgccgccgtcaccgacgtctggccttccacctccgccttcgatggctacttgtccgctctctcgccgcttcagctcgtacgcagcaacagtcggcggtttatgccgtcccaggctgatgaagaggcgcatcagttgtcgtatctgcaaaagcacttggctaacattgtgtctcttctagcagagcctgtggagggagaaggcgatgagtccctgtgtcttggtagagtggtaaaggttgctgcctcaaatcctggaaacaatttctccgcatgtggatgtattgttgcgtatagggttttaaccatggatagatttgagcatcttgggttcctaattcagtttggtgataagggatcagaaggaaattcgtttagtcaatgttctcctttttttgcaaactcagaccctgacatgcctgctgttcctgttcctgccgcacaagttcatgattggcttctgcaaaatgtagcggctgctttggaatatatttctgaacggacttcttcaaaggaaaatggcccagctagtgcctctgatcaggatgttgccatgactgatgcaagcactgtctcagttaaggtctcaacaggtactagaggggcaagtttcattgaagggatctctaaatcgtcatatgcgaagcatgcatctgacattaaaggttcctctgttaaggttctaaattgccacgaatctgccatctacatcttagcaccattgagatatgccactgtctatggatgctcagatgcaacaatagttctaggagcagttggcaaggtaataactagtagctttgtgcctgcttttagaaagaacataatgattctatcattctatgcatctagaaggaacaattatggaatgtgttttcctaccaaaatattggaagatgatactgatatgatgatagctgtcaagtgggccttcaagtga

SEQ ID NO: 46298 - DNA, 1188 bp, Glycine max
  Peptide Sequence Number=SeqID_163076
atgagtctccaaagcaacctcttatctcttttggttgccttggccgcagtttttgcatctttgaatctgataaatccaattccacagtttctcaataacttcacatattttagtctcacaaccttgtcaccatcatctgcatacttggcaaaacctttaacttggaacttctggagagaccatcatcacaagaaacaccctgacagtggcaataccgattctatttgtgatgattttccaccgggaattccacctccaaataccaataccacttcctatctttgtgttgatcgaaaagggtgttgtaatttcacaacagtacaagcggccgtgaatgcagttccggattttagtgtcaaaagaaccataatatggataaacagtggcatgtactatgagaaggtgttggtgcctaaaaccaaacccaacattacatttcaaggacaaggctacacgtcaactgcaattgcatggaatgataccgcattgtccgcgaatggaacattttatagtggctctgtacaagttttcggctccaatttcattgctaagaacataagcttcatgaatttagcgccaatgcccagtcctggggccgtaggggcacaagcagtagctattagagtatcgggagatcaatctgaatttagcggttgtggattcttcggagcccaagacacccttcatgatgataagggtcgtcattacttcaaagattgctacatccaaggctccattgactttatattcggcaatgcaaggtcactctacgagaattgtgaaatagtgtctatagcgaacccggtacctgcgggacaaaagagcataaatggtgcagttacagctcatggtagagtttcaggggatgaaaacacaggatttgcatttgtgaacagtacaataggaggaaacggcaggatatggttgggtcgggcatggagaccttactctcgtgttgtttttgccttctcaataatgtcagatatcattgcccctgaaggttggaatgatttcaacgacccttcaagagatcagactatcttctatggagaatacaattgctcggggcctggggctaatacgaacttcagggcaccttatgtacagaaattaaatgaaacacaagctttggcattcctcaacacaagttttattgatggcgaccaatggttggaaacttccaaataa

SEQ ID NO: 46299 - DNA, 1524 bp, Glycine max
  Peptide Sequence Number=SeqID_163077
atggtggacgcagcagaacgtaggtacttggaggatgacgattcatcactcatgaaaactattaagggggcaacaactggtttagttgctggcactatctgggggaccgtagttgccacctggtatgatgtccctcgtgtagagagaaatgttgctcttccagggctgattaggactttcaagatgatgggcaactatggtttgacctttgctgccataggaggagtctacataggtgtggagcagttggtgcaaaactataggatgaagagggatttagtcaatggagctgttggcggatttgttgctggtgcaactattctgggttacagaggaaggagcatcaaaactgcactttctgctggatcagcattggcattcacatctgcattccttgatttcggtgatcagacaataaaacatgatactgggaaggagtacgcggcttacaccacaaagaaaagacccagtatgggggagggatgttgtatgcagccttacccttgcatatgcaaagagactgtttccggattcgaacccatggccaacaagtcaccaagacacaactttaccgctgcaccaggacctcgagctgaatcattttacaatttctcgcatcttacgcaggtctctttgattccttttgtgctgaaagaggttgttttcactgacatgaacattcaagttgttggatctcttgagctaaacagctgttactgtgagcctttaccaactgtcatattagagaatgacatcctaggaataggaaatgctttgaaagcctacttcactggcacagatatgagtgacaaactatctcgtacaatggcaggaactggtttctccacctcctgtctttcctcttccagcaacttagggacatgttggttggtattaaaaactcacaatgcaagggccgtgccagggaaactacctggaactgtaaggagaagattgtcattaataaaagcagaagtgaagtatgtgaacgctgaaaaggctaaggaacttgtggaagctgatggatatactgttcttgatgtgcgggacaaaactcagtttgtgcgagctcacataaaatcttgttctcatgtgcctctttttgttgaaaacaaagacaatgatcccggtactattataaaaaggcagctgcacaataatttttctgggttgttctttgggttaccattcactaagccaaatcctgagtttgtgcaatctgttaagagccagtttccgcctgaaagtaaactcttggttgtatgtcaggaaggactgaggtctgctgcagcagcaagtaagttagaagaagctggtttcgaaaatatagcatgcataacatctggccttcaaactgtaaaaccagggtctacagagttggagaatgccggcaaagctggcttggtgacaatccaaggaaaaatctcaactgtgctgggaactattcttgtttgtgcatatatattcgttaccttcttccctgaccaagcagagaagctattccaattggcccctacaggctaa

SEQ ID NO: 46300 - DNA, 459 bp, Glycine max
  Peptide Sequence Number=SeqID_163078
atgaacctatatatgcctgcaataagcatactaaagaagactgttatcaaacttctgattcactttgaaacagctgattttcaaaagggcacctcagtttgcaaccatgacagatggcatataaagggcctcacagtccatattcatttctgtatgaattacctatggttgcactggtcggatgagaatgcaatgagccatgattgctttctgaggtcttcgagtttgggctctcttcacgaattttattcaaacaggttggcaacaaagagtgccaccactgtggccaccagtgttcctccaccaatcatacatgccatgcctccaggacctatacgtttcttcttgtgctcacttactctgagaggagcctcatttactccgggaagagcctcacttaatctagggggagcctcatttactctgggagtagccacacttaccctgggaggggaataa

SEQ ID NO: 46301 - DNA, 1205 bp, Glycine max
  Peptide Sequence Number=SeqID_163079
cggcgtcaatcatattggtggcgatgatggtgatcatggtgatgatcacattggtggtagtagtggtggtgagggtgatgacaacgacaacgaccacggtcatgtgatggtgacagtagagattaacgatcatggtagtggttgcggtggagtttatgatagttatggtggaaacagtcataacatgataatggtcatggttatgatagcaccaatggcttcagacgccaaactctcctcttctgagtccctcaacggtttgaaattcggccaaaaaatctattttgaggatgttggtcttgctactccagccacctctcttacttcttcttcttcttcttcttctgctgctactgttacttcttcttcttcttcaaggaaaggaagaggtgggtctgttcaaccagctcaacctcccaggtgtcaagttgaagggtgcaaagtagatctgagtgatgcaaaagcttactattctagacacaaggtctgtggcatgcactctaaatccccttcagtcattgttgctggtcttcaacaaaggttttgtcaacagtgtagcaggtttcatcagcttcctgagtttgatcaaggaaaaagaagttgccgtaggcgactagctggccataatgaacgtcggagaaagcccccaacaagctccctcttaacctctcgctatgccagactttcttcgtctgcttttgataatagtggcagaggtagcaactttctgatggaattgacttcatacccaaagcttagtctgagaaattcacttccaactcctagatcatctgagctagctcctggaaatcaaacctccacacttagctggaatggcaactcagagacatcatctgaccttttcttgcaaggttcggtgggtgggacaagcttcgccagcccgggacatcctccaggggaaagttacattggggtcaccgacacgagctgtgctctctctcttctgtcaaatcaaacatggggttctagaaacacagcaccaagtcttgggttgagtaacatgataaatttcaacgggacacccttgacacaacttgctgcatcatctcatggtgcatcaatccatcaacttccaaatacctcgtggtttttcaagggcattgattctggtaactgttcgcccgaggtggtccctgatctaggtctcggtcagatttcacagcctctcaatagccaacttcatg

SEQ ID NO: 46302 - DNA, 939 bp, Glycine max
  Peptide Sequence Number=SeqID_163080
atggaaccaacatgcggggatacttcactcgatcttaacgttgatccttctactatgcacatggatggggctttggtagaagagttgcgtcgtctaagttgtgagaacaagaggttgacccacttgtgtgagaactacatggctctgcaaaagcaactgagccaattgatcaacacgaattttgatcagcaattagactacccaattgaatcttcacgcaagagaaaagctgccgagagtgatcaatgttgtaccaacaaatttgttggtgttagtaataataatgctgagtgcagctccatcatcactgaggattcattcaaaaagtacaaggacttcaactcctcgcctaaggtttccaagtttcttgtcaagactgaagcatctaacaatagcttatatgtgatggacggatatcaatggaggaaatatggtcagaaagtcactagggataacccttctcctagagcttacttcaggtgctcctttgccccaagctgccccgtgaaaaaaaagtcttcacaaaacaagatcaagttatcaaatttttctaatgtatctcatcaccgaatgatcatttgggtgcaaaggagtttagaggaccctacaatacttgttacaacgtatgaaggagagcataaccatggtcatcaaagagctgaaatatcacttgtctcaaaccaaagtgaagcccttcctcctcttaaagggtcaagtcctgtttcctcacctaatacagcgacaattcgaagtgctgtttgccccaccgtaacgcttgatttggtcaagtcaggattggttgaatttgaaagtgcccaaaagtcctctatccagcaatttttggttcaacaaatggctacttctttgacaagggatcccaatttcacaacagaacttgccactgccatttcaggaaaaattctagaggcccaatggtga

SEQ ID NO: 46303 - DNA, 4617 bp, Glycine max
  Peptide Sequence Number=SeqID_163081
atggacgaaagaatcgcagctctagaaggagagatggccggagtaaaggcttccttgtcgtcgttagaacagggccaagctacgctcatagccatgttcgaaaagagtttaggcaagaggaaggagggaggagtcatggttgatgaagaaacgccggagacgggatctgggccaggatcgaaacctcatactgaagcctcaaaaacgggaccgagcaacgacgaagccttgttggagtttcgtcaagctgtgaagaaggtcgagctacccatgttcgacggtgatgaccctgcaggatggatttctcgcgcggaggtgtactttcgcgttcaagggacaagaccggaggtgaaggtttgtctagctcaactctgtatggaaggagcaaccattcattttttcaactcgttaatcaatgatgaggaggaattgacatgggagcagttgaaggaggcgttgttggagaggtatggagggcacggtgatggggacatttatgaacaattgacagagttaaggcagaagggtagtgttgatgattatatcactgaatttgagtatctcacagctcaaattcctagattaccagaaaagcagttccaagggtattttttgcatgggttgaaagaagagataaaagggaaagtacggagtatgtcagtcatgggaaatttgtcccgtgcgaagcttttacaggtggcaagggcggtggaacgagagacgacgcgtgatgggtcaagttcgtccagatctaacaaattgggctatgggtcaaaccgatttgggtcgtctgggcccaataagggagggatttctgattgggtgttagtgaaggggagtaaggaagcaacacccagaacaaatggacctgggccccgtggtgaaaggccgggtcaacccgaaagaagaaatgggccaagagataggggatttacccagctttcttacagcgagatcatggagaggcgaaggaaaaatcagtgtttcaaatgcgccggtccgttcagttcaacacaccaatgtcctgacaaaaacttgcgattgctaatcaccgaagatggaggaggcgaggagagtgagctgctagcggtggaagtggaagaaggagatgaagaggtcgaaggagagatgagcttgatgagtttccaccaactcaatcagacgcaacaagccaagccccaatcaattaagctgaagggtactatccatgaggtaccagtggtgattttaattgacagtggagctacccataacttcatctcacaacaattagcccaaaagatgaatttagttaccaccaacacttcacctctcaacatcaggttaggtgatgggtccttgtccagaacgatgggggtgtgtgaaaatttggaggttgatttagaaggattgcagataagggttgatgttcaattatttgagctaggaggaatggatgtagtactggggatagagtggctgcgtacacttggtgatatgatcatcaattggaagcaacacaccatgagtttttggtttgaaaagaggtgggttactttgcaaggagtagatggtaatatgaaggggatggagactttgcttagtgtcattagcaaaccaaaaagaagtcaggaggtttgggggagagaggttgggattaaggtagatggtgtctatcttcatgccttagaggtggagcagtcaaggaaattggaacacttgttgaatttgtgtgcagatgtgtttcaagagcctaaaggattgccacccaaaaggaagaaagagcacgtgattaccttgaaggaaagggaagggccagtcaatgtgagaccttacaggtacccacatcaccacaaaaatgagattgaaagacaagttaaagagatgctagagatgggtatcatacggccaagcactagttctttttccagcccagttatacttgtgaaaaagaaagatggatcttggagaatgtgcgtagattatagagctctaaacaaagccactgtacctgacaagttcccaataccagtcatagaggagttgttggatgagctgcatggcgctaaattcttttcaaagctggaccttaaatctggctaccaccaggtgagggtcaaggaggaagatatacacaagacagcttttcgtactcatgagggccattatgagttcatggtgatgccatttgggttgatgaatgccccatcaacctttcaaagtttaatgaatgaagtttttaggccatggttgagaaaattcgttttagtcttttttgatgatatattggtctatagtggtgactggccaactcacttacaacacttagaagaggtgttgaaactactgcagcaacatggtttggtggctaacaaaaggaagtgcttgtttggtcaaagagtagctgtggaccccagcaaggtagtgagtgtgacacaatggcctaccccaaagaatgtgaagggtgtaagaggcttcttgggactgacaggatactacagaaagttcataaaggattatggcaaaatagccaaacctttgactgagcttaccaagaaagatgcttttgtttggagtaaagaagcacaactagccatggataaactaaagacttgtcttacctctgccccagtattagcactcccaaattttgacaaggattttgtgattgaatgtgatgcttcaggacagggaattggagctattcttatgcaagaaaggagacccatagcttatttcagtaaagccttgggagttagaaacctcaccaaatcagcatatgagaaggagttgatggctgtggtgttagccatacagcactggagaccttatttgttgggaaggaaatttattgtctctacggatcaaaaaagtctgaaacaattgctgcaacaaagggtggtgactgctgaacagcaaaattgggctgcaaaattattgggctatgattttgaaattgtgtataaacctgggagccttaatagaggagcagatgccttgtcaagggtgaacgaggatggagggctgtgtcagatacatacaagggttcaatgggaggaagaggagttagtgaagcaagagatagcagcagatcaacatctccaacagataatcaaagacttacaggaggatgaaacgtctaggcctggatatgaatggaaacaaggagtgttgttgtatgaagggaggttagtattatcaaaacattctacattaattcctagaatgttagaggagtttcataccactccacagggtggccactcgggattttatagaacatacaggaggttagcagcgaacttatattgggtaggtatgaaaaacactgtccaagattttgtgaagggatgtgatacttgtcagaggcagaaatacatggcaagctctccaggggggctgcttcaacccttaccaattccagatcgtatttgggaagatttgtccatggatttcataacagggctgccaaaatccaaagggtatgaggccattttggtggtggttgacaggttgtctaagtatgctcattttgtcccattaaagcatccttatacagcaagagtaatagcagaggcattcatcaaggaggtagttagactgcatgggattcctttaaccattgtaagtgacagagatcctatatttatgagtaatttctggcaagaattgttcaagctccaaggaactaagctgaaggtcagtactgcttaccatccagagacagatggacaaactgaggtgatcaatcgttgcttagaaacgtatttgaggtgtttcattgctgatcagccaaaaacatggagtgtgtggatggcttgggcagagtattggtttaatactagctttaatgctagtacgggcagaactccttatgaagtggtatatggaagggcccctccttctattacacgttgggtacaaggagaggtaagggtagaagcagtacaaagggagttaattgatcgtgatgaggcgttaaagcagcttagggaacagctactaaaggcacaagatagaatgaaacagctggcggacaagaaaaggtgtgataggagttttgaaataggagagtgggtctttgtcaaattgagagcccaccgtcagcaatctgtggtgagcaggatacatgccaaactggcagcaaggtattttggtccttatcctatcatagctcgtataggagcagtggcctacaggctcaaactacctgatgggtctagagtgcacccggtttttcatgtgtctttattgaagaaggctgtgggtaactaccatgaggaggaagctttacccgagttagagggggaaggtggggtattgattgaaccagaagaggtacttgctagcaggactgttcaagtacaaggagaaagagtgaatcaagtactcataaggtggagagggcagatggtagatgaggctacttgggaggacaagattgctatgaagagtcaattcccaacattttgtcttgaggacaagacaatattttctggagggagtattgatagatcccgtactcaagaggagggccctagtgaagccttagcccatcaccattccactatgggcccaaaggtgtggtacatttattctagaaggaagaagaatgttgccaatccaaatgacagttag

SEQ ID NO: 46304 - DNA, 900 bp, Glycine max
  Peptide Sequence Number=SeqID_163082
atgggagggacacaagtggagagagaagagaaggtgtctttggaactcagcgaagaaattcttcagagtatggaagtgggaatgtccttcaaagactataacggtagaattagttcgttggattttcacagggcatccagttatctagtgaccgctagtgatgatgaatccattcgtctgtatgatgttactggtggaacatgtttgaagacaattaatagcaagaagtatggagttgacctggtttgcttcacatctcatcctacaactgtcatttactcttcaaaaaatggttgggatgaatctttgcggcttctatcgttgcatgataacaagtatttgagatatttcaaaggtcaccatgacagggttgtgtctctaagcttatgctctcgaaaagactgctttatatctggatctctagatcgaactgttttactgtgggatcaaagggctgagaagtgccagggacttttacatgtacaaggaagacctgctatatcatatgatgatccagggcttgtctttgcaattgcctttggaggatacataagaatgtttgatgcccgcaagtatgaaaagggtccctttgagatattttctgttgggggagatatttctgatgcaaatgttgtgaaatttagtaatgatgggagactaatgcttttaacaacggcagatgggcatattcatgtgcttgacacatttcgtggcacacttttatccacatataatgtcacacctgtctcatgcaactccacattagaagcttctttcagccctgagggaatgttcataatatctgaatgtatgagagctttgttctattctgaaatgaagaggattacaagggaaatacaaccagagctcagctccgtaggccaggttacacctgcctaa

SEQ ID NO: 46305 - DNA, 1137 bp, Glycine max
  Peptide Sequence Number=SeqID_163083
atgtatcagtacagttcccaaatgtacggaactgattgggagtcctacatggagattagcaacctagccaaggttgtcggatcagaacaactgagttttgagcccacaaaatcacccttcaacattgtgacaactcctcttcaaactccaccaggtttttgtgcaagtgcaaccaaaagccttgtgagttttcaagctcaacaacaacatactcatcaacatcagagtgaagttcccgcttggtgctttgagtttccaaagacgacgacgatgaccacaacaacagcagactcgcacatgctgaatattcgccaagcttctggagataacttcaccaccacaatcaccatcaaacaagatccaccgtcctctcaattcacaagctccttgtgccggccagttgctgaatctttcttttctagcagtggtgcagattgtcgttcttcttctgaaaaatattttaaaattgcttcttattccgaaaaacatagttgcattcagcctgacagtattcaatattacgatctctattcacaagaagatgatacattacttagggatgatgctgccacagatgaagggccccttgaaatttcctttcagagaaaccagcgagaaaagcaagctcctcatcgactttgtggggttgcatgtgtagcttctagcaactctgcttctaggagaggcaaaagaagaataaaatggaccaaagatctgcatgagccatttatgatgattgttaatagccttggtggtcccgaaaaggcaaagcctaaagctatactagatatgatgaaatcagatttgctgtccatttctcacgttaaaagtcatttgcagaaatgtaggtctactatacacatgcacaaagctttgcaggaaagatctaaggaaggacagagaacaaatggggagtctgagcttcaagtcaaaatccatatgcaaattgaggaatcacggcaactacaactagaggtccggaggaatatatgccaacaactagagatgcaacgaaatttgcacacgctaattcaacagcagaaccagcagctcaaagtaatgttagattaccaaaaggaaagaaccaaactggagaagaccctttatacagaaatagaagcgactgtccccaaatga

SEQ ID NO: 46306 - DNA, 1701 bp, Glycine max
  Peptide Sequence Number=SeqID_163084
atggaggacaaagccagagctctccactgcggcgttgacggaggagataagaaacccccgaaatccggtaccaaattcatcggaaaagccgccctcaaagaagcccaagccgcacttctcgagtacctccactccacacgaagcctcaacatcgtcgacgccgaaaacatgtgcagaaactcaccctccttcctccacgacctcctcgccaaatcccaatcccaaaccctaacgcggcacgtcgacaacaacaacaacaacaacagcagcagcagcagcagcaccaccaccaccaccaaacgctccatctcgcgctacctccgctaccaccccatcaacgagttcgagcccttcttcgagagcgccggcctcacccctcccgagtacgcgccctttctcccgcgcgacatgatttacctaaacgacgacgctttgctcatggagaattaccatgccctctgcaattacggcgttccccgcaccaagatggggaggcttttcaaattgacgcctcagttgtttcgttacaaacccggcgttttgatctcgaagcttcgggattacgaaaagctcggtgttgcgcggaggactttggcgtgtgtggttgcttctagcccctgcattttggttgggggtgttgatgttggttttgttaaggttgtggagaagttgaagggtgttgttggaaaggatgttgattggattggggagaatttgttggatatgttgagcgatcagggttgttgtgattggaggatagtgcttcatgttttgtgtttgcttgatagggtttatagtgaggaacagttgggcgattttttcattcgtcaccctagtgttgtttttgaggactctggaggaagtgtgttgtctctgattaactttttgtttaaatttgggttgtctctggaccaggtttctctcatgcttctcgagtttccaaagattcgggtcacgaagtttttgtccaacttgaggcagtgttttctgttcttgaccgagattgagatggaggcattggagattggggagattttgcagtctcagtgcttggtgttgggttccttcactttgaagaaaacgattactttgcttactaacttgaatgctggcaagaagcggttgtgtagagttgtgagggatgatcctctggtaatgaagagttgggctctgggaaggaggattcagcctttcgtgaactcatatttggagtatgaatcaaaggagcagaagaagaagttcatgctcaagttggggtatgtggagaactcaaagaagatgaatgagacgattaggttgttcagaggtaagggagctgagcttgaggagagacttgattttattgttaaggctgggttggattatgaggttgtctgtaagatgattcgagattccccgcggattcttaatcagacaaccgataggatcaacatgaaaattgagaatcttgtgagtttaggatattctatatcggatttagctagttttccttcatttctttcctattcacctcgaagggttaagcttcggtttttgatgtatgattggctcaaagagcatggagctgtagaagcggggcttgctttgagcactataattgcatgctctgataaagcgtttgagaagctgtatgtgaagcgccatccatctggccttcaagtttggcaggatttgaaggcacagatttcttctaagttttag

SEQ ID NO: 46307 - DNA, 270 bp, Glycine max
  Peptide Sequence Number=SeqID_163085
atgtgcgcagtagtcaagaacgggggtggaagagaggaatggagaatagccactgttctttttgggtacggatccaatttgaccgggaatagcaggtcacactcaaaccccccttacccccctcgttcctcgtgcaaggaagggtttcaatttgagattacagaaatgtccctgtgcgttgcgtggtggagagaggatacgggagcgagcggtgacaatagggttgacgcgcacggtacacggacgtgtgctgcagtctgcagttcataa

SEQ ID NO: 46308 - DNA, 309 bp, Glycine max
  Peptide Sequence Number=SeqID_163086
atgccttcacgctccaaactgaacctaaaaatttgtcctgtttcagggaaatctgacaaaagaacccacacaaaggatgtgcatcatcttgatgtcaaaactggcttacaaattagagaggcgcttaagctgcaattagatgctcaaaggcgtcttcatgaacaattagagattcagagaaaattacagttgcgaattgaggaacaaggaagggaactaaaaaaaatgtttgaccagcagcaaaagactaataataacctcccgaatactcagaattcagccactgatgagacaacaattaatcattaa

SEQ ID NO: 46309 - DNA, 239 bp, Glycine max
  Peptide Sequence Number=SeqID_163087
gatacgagaattcgaatgatgtatttccaatatatattggtgatgatcgaactgatgaggatgcttttaaggttttgcgcagtaggggtcaaggaattgggattcttgtttctagagttgcaaaagaaacagatgcttcctataccttgcaagatccatcagaggcaagtgctatatattccatccagttgagcaattcttgcggcgtctggtggagtggaaaagaccgagtactgtga

SEQ ID NO: 46310 - DNA, 1719 bp, Glycine max
  Peptide Sequence Number=SeqID_163088
atgaaagagattgtgactgtccaagttggtgatttcgccaacttcgttggttctcacttctggaactttcaggatgagttgcttgggttggctgaggatccctttgctgattctttcttcaagaatcaggatcttaacatggatgtgctttatcgtactggtgagacacagcagggtatcccttcatatactcctcgcctactttcaataaacttaagaggatcccttggatctatgagttcacgtggtacattgtatacggaggttgcttccacaacactagatgttgtcacctggacgggtggagtttccacccaagcctctgaaccttataaaagaaatttgttcttacaaagtctttatgaagaagaggaaaacttgaatatgataaatgagatccgtggttcaaataatggttctcaaagtgagtatgaggataaggatataactgaatgcctagaaaatggtgtacagttttggacagactactcaaaagtacattatcacccccggagtctatatgaattaaatggagtttgggcagatgttgaggaatttgacaattatggaattggaagggactcctttgcttgggctgcgcaaggggaagaaattagtgacaggcttcgattttttgttgaagagtgtgaccatatacagggatttcaatttgttgttgatgactctggaggtttctctgctgtggctgctgaatttttagagaatattgtagatgaatatacaaacattcctgtcttactgtatgctgtccaaggttctggttcacgcacaaatcttcagagcaggaagcatacagtcttagaggatcttcatgatgctgtatcattttcaagattatcatccttctgtaaacttattgtgcctgttggtctgccctccttaagtaaaagtaaagcttccagattcctccacattgaagatgcgaagcattaccactcaagtgcagtttatgctgcagcactgcactccattagtctaccttttcgaatggttccagttgggcctacttcagatgcttgttctgtttctggtgctgtagatgttcacggagtcgtacaaatgctatcaggacaaggaaggcagaatatggtgtcagttctggatgttgccatgccagcaccagctttaactggggtacagaatgaattgtctctgttagagattttgcagccgttgaccccacaaatagcagaggatgttgaagacatgcaggctattgaacacatgactgtccatggagctcttgcatcagaaggtcatcgcgcttcagttggtcaggtaaaggataccgttgatgctgcttttctatgtgccgatacaaggccaatgttctgccatctatctgttgctcttagtcccttgccaatccccttgccttttccatcaatctttgggaacaatgttggccagcacggtgaattaatgagtggtcaaattactaattcttcaccaaaaggatcccttgtcatccattccattcccatggctgccagattacgatctagcagtattgtgttaccattcttggagagtaagctgcgaaatcttcaccagtatggaatccaacgacgagcagcgggggcagagttacttaggacttggggctttggccaggaagaattggtggaaatggaagaggtgttgtctaaaatggttgcggcattacattctcctcatttgtcatcagattcagattag

SEQ ID NO: 46311 - DNA, 231 bp, Glycine max
  Peptide Sequence Number=SeqID_163089
atggataaagtttatattcaggatgacaacattgatgacaaaaaatctacattggcatacaccatcttccttggtggtaatccaatttcacggctctcaacaaagcaaaaaacaatggcacaatcctcaacgggaactgaatacagagcaattgcaatagagataatctggcaatctcatttgctcattgaacttcatattccactacatagtccaccaaaacaactgtga

SEQ ID NO: 46312 - DNA, 528 bp, Glycine max
  Peptide Sequence Number=SeqID_163090
atggagctgagtttggatttgagtttaggctttgttcccaaacctctttccctgtttttcgccgacgtttctgcgaacagagacaaagtggccacactcgatggcttcgtgcagagattggaggaagaattgaaaaaggtcgaggctttcaaacgtgagcttcctctctgcattcttctcctaaacgatgctatagctagattgaaggaggaaaaagtgaagtgttcgggaatgcaagatccgccactgaaaaccagttctggaggaaacaaaaatgaaagctctgagaagatgaattggatgagttcagcgcagctttggagcactcagaaaaccaaatcgagaaatgaggaagatgataggtctgtgccagcgaacccaattaatgggaattcgtgtgtcctcgagaaggagggttcccaagttccgaggtttggtttgatggctcgtgcttctgaactgagtcatagcaattccaagagtgttggtggagatattagttctggctcctctttgctccgtgttgag

SEQ ID NO: 46313 - DNA, 147 bp, Glycine max
  Peptide Sequence Number=SeqID_163091
atgaaatatttggaaaaagatcttattaccaaagatgaaggcaggcctcctttcaattctgagaagctgtttgtgtggtcatggattgggatcatggttggacgtggacaagataaattcctagatctcgcatgtcggattgggtag

SEQ ID NO: 46314 - DNA, 372 bp, Glycine max
  Peptide Sequence Number=SeqID_163092
atggagactattggggaattgacccgcttcactctaattttggggtcttcccggatgattcatcatcatcaccatgatgttcaaagtcgcaaggtttgtcattcttggaagctcacccttttggtttttctttctctggactctctaatgaaaaagaggatgtggcacttgctgagttactcttggcttgtgctgagaaagtcggccaacaacagtttgaacgttcaagcaaattgccgagttattgtgaatcattgtcatgcaaaactgggagcgattaagagaactgttcattgttttgcggaagaatttcatccaaggatttgcaaaacgggcagtcatttgatcctgaagatgcagccaaggagctaa

SEQ ID NO: 46315 - DNA, 279 bp, Glycine max
  Peptide Sequence Number=SeqID_163093
atggtggttgctgaaattgaggcaaaccacaattctacatcttttgtaaaccgtttcattgaggctcttttcttcttcagtgcattctttgattgtcttgagacttgcatgaaaagggaagtagcagaaagaaatactagaaatctgaaggttgatgtgtggagggccttcctctcccgctttggaatggtggagaaagaatggagcaagttgtgtttattccaagcttttaaagaatggacattgccttcttattgggtggaaaggaacaccgattaa

SEQ ID NO: 46316 - DNA, 299 bp, Glycine max
  Peptide Sequence Number=SeqID_163094
ataaccgctgtagaaagtggaaccactggacacatagctgaggacactggtaagagactaaaggattatgctcaaggtttgaacttaccattctctttcaacattgttatggtctcggatatgttgcatctaggagatgtttttgagattgatgctgaggaaataattgctgtctattctcactttgcacttagaaccaagattctagaatcagaccagcttgaaataatgatgagagctctttccttcttcagtgcattctttgattgtcgtgagacttgcatgaaaggggatgagag

SEQ ID NO: 46317 - DNA, 390 bp, Glycine max
  Peptide Sequence Number=SeqID_163095
atgacttctacggtgaagtctaatttccatgaccggaggttggcgagcttgaccgcagagtggtcggagacaacaaagttgcagaagagaagggaagggatcgatgatatgaaaaagggtggtgacgatgcctgccgaggcgacgttcacagactctacggtgaggtggagaaaaggctcaatggtggcagaaggcgtagttggcaacggcgaatggaaggtggtcggcgtggtggaggtgttacagcatggatgattcgtgttggaccccttcgtcacaagttgaactacttttggaatcacactcccactagagatgtttggtaccattcccagactacttcaaggaaagagattagtctctacagttcttccaccaaggcatttgtg

SEQ ID NO: 46318 - DNA, 381 bp, Glycine max
  Peptide Sequence Number=SeqID_163096
atggttccactatgtgaccaaacaagggacaagccacactcaaactcaactactcctttagcctcacttgaaatcttgaacaactatggcaagggcttcaagaggttacgcaatgatgatgtggctatggccaccacaaatgaagagtcagaatctttgcctttcttggaaactcacccttttggtatttacttttctgggctctctgatgaggagaaagaggatgcgaaacttgctgagttcctcttggcttctgctgagaaagttggccagcaacactttgaacaggcacttcgcctgaggatggatagagcaacaggaagagtttcatgcaaggatttgcaaaagggtccttcatttgatcctctagaggcagccaag

SEQ ID NO: 46319 - DNA, 828 bp, Glycine max
  Peptide Sequence Number=SeqID_163097
atgaagaatgggattttggttttgaaggaattagagagaaagggggttgctaaaggatgggttttcgaccccaaaagtcagtgctttgcctcggttggattgcgcccaaaaacaattctggtgacggtgatggagtttctgttgtttgtgacaagattaggaatgcttcgttaccttttgatgttcttcttattgggcttgggaacccgtgtggagtcacacgaggaatcgggtcattggagctgcgagtccgagtcggagatccgagtcgaggctgagttcaaatacggtgtaatcacactggatggtcacaccgatgattggaaggacattgatgggtcctactttcccctccttcccgcccttgacccagatgctgaaaatgaattcaaagggggaaagatcaccgttaaaagtgtccatgacggccgcgatatcttctttctgctgcaagtagatggtgactatgcctactctaaaggagaaagcaataaatgtccatctgttgctctcatgtttcaaattggagatggtgcctcttatcataatatgggtggctgtgaagaacatccgacctcgtgcactgacaagagctgcaaaggtcatgaagttgacattatgcacttttcaataggaagtgccattccaggacgactttacggtggcaatcccctagacaatagatatggaaatggcggcgataggtttggtcacttggttgatctatatgcttggaatccacattgcagatacttggatggaattggtcctccaggttctggtatgtacaaatgcaacaccattgataagaattatatgcttctatga

SEQ ID NO: 46320 - DNA, 249 bp, Glycine max
  Peptide Sequence Number=SeqID_163098
atgaaaattaaatatttgtccctaaccctcattctatgttaccctaatcttgtcacaaacaacagaaactccatcaccgtcaccagaattcttcaattcagatccaccgcaccgtcaacagtggtagtaattgttgtagcgatctggaagaggtgcaggatcgagagatccaaatttttggatacgtttttgggcgcaatccaaccgaggcaaagcactgacttttggggtcgaaaacccatcctttag

SEQ ID NO: 46321 - DNA, 424 bp, Glycine max
  Peptide Sequence Number=SeqID_163099
atgatgacatgggttcgattccctgaccatgtgtatggaagagactttgttgggagaggcaaaatccactttggtgatctctatgcctcgagtgagaggcctaactcaaccccaaaagatagatcaaggggtgagggttgcccctcacttatatattctaatgtgggattacttttagccgatgtgggacttggattatttccaacagtggtggctgtggtgacaacgacagacagccgtgatagtagtggtgacgatgatagtattgatggtgacgataatggtgacaatgacaatagtgacaacaataattgcggcagcaacgatggtgacaatgatggcagtggcggtggtggcgactatagtgacaatgactataatgatgataatgatggtgacgatgatgagagtgatggtagcattg

SEQ ID NO: 46322 - DNA, 213 bp, Glycine max
  Peptide Sequence Number=SeqID_163100
atggtagcaaaggtagaaacagtggtgaagtgttgtcatagtggagatggcgatgatggtgataaagatgatgacgttggtggtggcattgacgatgatgacaatgatggtggtggagtgatgagagggagggagagagtgactatcctattttgttgctctctaaccaacacactctgtcaggataagaaatacactacaccaataagatag

SEQ ID NO: 46323 - DNA, 420 bp, Glycine max
  Peptide Sequence Number=SeqID_163101
atggaagacgaggcattgaggcattttgataaaatggatgaattgggttatgtcactaattctcaggctttcaagtttcaacaatctgatgatgattgtgttgcagcttacttgaagcagaacacggtggaagaagctgcattggtatttgaggaagctaggaggagaaggagcaaagaacctttgtttagtattaaggaaaagttgatgtcgtatttcttggagatacatgagttggatgatgctgtgaggcacttagaggtggcgttttcagaagtcaagggtgatgatgaatggcgtccttcagtacaaattgtttgggattttctggagtactatgaagaagagatgaatgtcgatggtcatgatgagttgtacaagattaccaaggctatcagttttgatcatgcctggatttaa

SEQ ID NO: 46324 - DNA, 1431 bp, Glycine max
  Peptide Sequence Number=SeqID_163102
atgaattacgcccgtctgatttccggcggaggatggcttctccggcgactgtgcacggcggctgagactcccgcgaaaaagccaaacctctatcgaatgttatcggcgctggacatcaccggaggcaccgtgtcgcaaacgttggaccaatatataatggaaggcaaagtcatcaaaaaaccagaactcgagcggtgcgtcgagcagctccgaaagtatcgccgattccagcacgcactcgagataatagaatggatggagataagaaaagttaatttttcctggagtaactatgctgtgcaattagatcttgtgtccaaaaccaaaggggtggatgctgcggagaattttttcggcggtcttcctcctccagccaagaacaggtatacctacggtgctcttctgaactgttactgtaaggaactaatgaaagacaaggcattgagtcattttgacaccatggatgaattgggttatgtcactaatctggctttcaacaatgtcatgactctgtttatgaaactgggtgaaccccagaaagtgcctcagctagtggagcttatgaaaaagaggaccattcccatgtccccattcacatatcatatctggatgaacagctgcgcctcttcaaacgatcttggtggggcggagagagtctatgaggagatgaaaactgaaaatgaaggccaaattggttggcacacttacagcaaccttgcttctatttatgtaaagtttaaggactttgagaaagctgagatgatgcttaagatgctggaggaacaagtgaagccgaagcagcgtgatgcttaccattgcttgcttggcctttatgcagggactggtaatcttggggaggttcatagagtgtgggattccctcaagtctgtctcccctgtcaccaacttcagctatcttgttatgcttagtaccctccgaaggcttaatgatatggaggggttaacaaaatgctttaaggagtgggaggcaagttgtgttagctatgatgcgaggttggttagtgtctgtgttagtgctcacttgaatcagaacatgttggaagaagctgaattggtatttgaggaggctagcaggaggagcaaagggcctttctttagggttcgggaagagttcatgaagtttttcttgaagaaacatgagttggatgctgctgtgaggcacttggaggcagcgctttcagaagtcaagggtgataaatggcgtccttcaccacaagttgttggggcttttctcaagtactatgaagaagagacggatgtggatggtgttgatgagttgtccaagattctcaaggctaacaattttgatgattcctggattaaaagttgcattactgcatccaaatcgtctcctgaaattgatccaggaatgaaggaagattctcaagtctaccatgcgcaggagaactag

SEQ ID NO: 46325 - DNA, 1044 bp, Glycine max
  Peptide Sequence Number=SeqID_163103
atggagcttcttatcacttatcacttatgtaatgtttttggagagctacctgtccctttaagctcttaccgttaccttaccgttaatgtcgttcttatttccgttaacggtggccaccaccttgccaccaccgctaacagtaacacctccgattcaactcagttatgcccaccttctccactccgagtcccacttcactccctccccgccgttgattttatccctccccccgtagatctgatctggaccgtccctggcgtcgctgatgtcgctgctcgccgcttccacctctttatctggttaatgataggtggattgaaatggtggcttgtgttgttatcttgcatggtttggtttgtggttgattatggtgtgtgtggaagagcactgcagctggaagcaccaccttctttgtctcctgctgcagcacctgttgttgctgttgatgatctgccactgccggtaaatgctcatgggttgaagcatttgcctgcaccgtttccgtcacgcgccaatttcaccaaagggagaggagaattacaacatcctccggtttctgggtttaagaatattgcccctatgcatcccattgctgatgctattccttctgctctcgctcagccaccattgtccccttatgtttccgattgttgcaaacaagacatggtgtggaaacgtggcagtgaggtttgccactgtgcttatcccataaagatagacctgcttcttttgaatgtctctcaaaactccaactggaatgcttttctcaatggtttggccacccaacttgagctgcagactacacaaattgaaattattaaattttatctactcagcttatcaacattgaatatatcggtggatatcactccacataaaggggtcagtttctcggctgaggaagcagctaaaataaactcatcgcttttactgcataaggttcaactagaccgcagattcgtgggtgactacaaagtaatcaatgtaacctggtttaaaccttcacctccttctccgggtaagttcagaactttaaaattctga

SEQ ID NO: 46326 - DNA, 723 bp, Glycine max
  Peptide Sequence Number=SeqID_163104
atgaaggcgctaggcgctgttggtggtggtggtgccccagtgccagtggtggaacaagtgggaattggagctctgaaatctgactacaaacccggtgtgtttgatgacttgtttctcaaattgttccgtaacaaattggtacaggaggtggggtgggactcgaagaaagctggatatgatggactaattgaagttgccaatcgtctaatgatgaagggcactaccaattctgataccgtagaagcagcggtacgaatattgaggtctctgttccctccatatcttttggagctctataaaatgctcatagctcccataggaggaggcaaaattgcagctatgatggttgcaagggttactgtactgacttgtcaatggctcatgggcccctgcaaagtcaattctgtagacctaccagatggaacctcatgcagtagtggggtgtatgtggaaagatgcaagtatctggaggaaagcaaatgtgtgggtatttgcacccacacctgtaagtttccgacacagaccttctttaaggaccatatgggggttccattacttatggagcctaactttgccgattacagctgtcagttcaaatttggagttcttcccccacgggatgatactatcgtgaaggaaccttgcttggaagcatgtccaaatgcaaaacaacgacgaatggttgccagaaatattgatataactgcgtgcccaaagacatga

SEQ ID NO: 46327 - DNA, 789 bp, Glycine max
  Peptide Sequence Number=SeqID_163105
atggtattagagcttatcatggatccaaaaatctacctaactctgtggctttcctcccgatatttttctgtggttactgcattcgatccggtggaagaggaattactaacaactgcctcttcaatcttcatgggggctcctacaattgctacatcaccaacgaaagctcccaagagacgagcacctacaactacattatcgagtacttcagacgggggaaggcattcaaacttgcttattattcttggaattgtcactggcgtactcttcatttccattgtatgtgtacttatactttgcttatgcacaatgaggccaaaaacaaaaacacctcccacagaaactggcctgctactaaggtttgctctcctttctacagaaaattcaaggattgaaagtgcagttcctgctgttgggtctcttccccacccaaccagtacccgctttattgcttacgaagaacttaaagaagcaacaaataattttgaaccagcaagtgtacttggagaaggaggttttggtagagtttttaaaggtgtcttaaatgatggaactgctgttgcaattaagagacttaccagtggagggcaacaaggtgataaagaatttttagttgaggttgagatgcttagtcggttgcatcatcgtaaccttgtaaaactagtgggatactatagcaatcgcgactcatcacaaaatctactttgctatgagcttgtcgcaaatggaagcttggaggcctggcttcatggtaatataatttctcaaatgatggcaccagctctgtaa

SEQ ID NO: 46328 - DNA, 651 bp, Glycine max
  Peptide Sequence Number=SeqID_163106
atggatcaattcaacaaaaccaccattctcttcatcgggaccctctcctgcctcctcctatccatcacggccgtcccctcaactcgcgtcttcgaactcgctcccagccaagccccgaccgtccaacccaaagcctctggcatccgactcttggccaaccttgtggccaaaaacgccaagcaattcagtccagagatccttaaattctgcagcggcaccgagcacgccgccctttgcgccgaaactattgcaccatacctagccggcgaattcgacccgttgaaggctctggagatggagatcaacgcgagcatggagaaggcgaaggagatcggcgggaacatcaagaagatgctggacaacccggccactgagaagaaggccattgacgcgctgggcatttgccagtcgcagtacgatgacatggtggatagcatgaaggagggcgtggatttggtgcggcagcagaacgtggtggatgctcggtacaagctcagctctgtgctttcgtacaaaagcgcctgcgatgacgctttcaccgagtctcccggcgtccacattcccttccctgaagacatcaccaagctgttccagttgaccagcaactgcctcgccgtcatggatgccattgttcacaagcacaagatgtaa

SEQ ID NO: 46329 - DNA, 270 bp, Glycine max
  Peptide Sequence Number=SeqID_163107
atgaggatccacttcttgaggtggattctcccgaggaagtcgtgtcggcatctgaggcagactctacggaggatagcggcccgagggagatggcgatcagcggaggctcttcatcctagtggacagctttttggatttgttttgtatattttgagggtgggtgtatctaggactaactacctgatgtataggcatttgatgattgtatacatgtggctgaagccaccactatggacacctttgctctggatgacactatatcttttgtaa

SEQ ID NO: 46330 - DNA, 441 bp, Glycine max
  Peptide Sequence Number=SeqID_163108
atgaacaaggataagatcttcaagctagcgaaggggttcaggggtagagccaagaattgcataaggatagcaagggagagggttgagaaggccttgcaatattcctacagagaccgccgtaacaaaaagagggacatgcgatccctttggatccaaaggatcaatgctggtacccgcattcatggggagaatgtatgggatgagcaaaccagtgataatgagtctttgaagcaaaatagctggcttggaagcaagattggattcttaggtgaacatgtcaactatgggaacttcatgcatgggctgatgaaggagaatatccaacttaacagaaaggttctgtcagagatatctatgcacgaaccctatagcttcaagtctttggtagatatatcacgaaatgcatttcaccggaaacaagaatgtggtgattcctcctag

SEQ ID NO: 46331 - DNA, 852 bp, Glycine max
  Peptide Sequence Number=SeqID_163109
ggttatttaaatgctgaaggtcaccctaggaagattctcataaaagatctaaccactcttgctcaggtctggagtgttctctcatacttcaacctggctccgacttcccactcctcgaatttgactgtggatagagctaagttaatctttggcctagttactcagctggacatgaatgtcagagctctcatctctggacagatcacatcaatggcccagtctaactcctctagactcgagttccctgctcttatcacagctttatgtaggtccagaggagtcgcttccgacagcttggtctttgaacgtttgagcccggtcattagtttggcctacataaggaaaaactattggaacccggatgatccaacaattattattaggggggccagaagaccaagggcaaggccagctgaggctccttgtacatcagcagctcctcctccagctcgtatgacagcatttcgaagccatgcttcgaagcatacatcaggggcagattattttactgcaaagcctacagctgatcttgctgctcaggtaccccatcacccagaggatgagtcatcagagtcttccactcctgagcccttgatcaggaagaggagggtagttgtaacccaggaagctgcaaccacctctgaaaagtctcttgaagctactccagagccttcggcaccagtggcagataccacttctctgcagcaggcagctgacccttccacgcctgaggatcaaaccaccccagtccagtctccgaatgcctctccagtagctactcttgtacttcatttgttggaagagaaagaggctcagacacaggacacccaggaccaatcacaggacttttaa

SEQ ID NO: 46332 - DNA, 828 bp, Glycine max
  Peptide Sequence Number=SeqID_163110
atggcagaaccattgaagaagcaaaagggttcttcgagtagaagccaacggagctttgggtctcaggatactccaattccaccatccatttcgtcctccacgctattctcatccgaagagcaacatatccggtacacaactctcttctcttcttgctctataatagatcctaagttcatggacatggagttcttttctgatgaaatgtttgagtgtgttcaagcatttcaaaacttcggtcttattccatttatgtctttaaaaattcttgtttatcctgagttagtgaaagttttttattcaaacttagaaattcaagaaggttccttgatttctgaggtatatgggattaaaatggtcatagaccagtcccttttctttgaactcacccagttatccagtgatggtgtaccgtttgaaggtacacttgatgatgattggaagttcgatttttctgtttctgatgcctgccaactggtacctcttgattctgaaccttctgttcaaatcaagaagtccttttccattggggctgcaatggttgcctccttcggttatcgcaaagagcgtgatggctcttggataaagaaggatgctcaaccacatgatgttgagggttgctcgcccgctcgagaggattcttctcttctgcagagtgtcatggataggtttgatagtcttcagacctatgttggagagagatttgactcgttggagagtcgagtagacattcgattcagagagatggattctaggatcacaaagattgatggtgacattactttcatcagagattgcttcgaccttccaccgccaccatccacttag

SEQ ID NO: 46333 - DNA, 180 bp, Glycine max
  Peptide Sequence Number=SeqID_163111
aggatcccactgagacaagcgcagaggagatggccgtggctggctataccctatgccaatgctgcggcttcagttctgccacagacagatgctgatgcggtgatgccaagtgtggtacgatcatcattcatcacaatcgcttcccatacttgtcctcaccctaaacctctctttgtctga

SEQ ID NO: 46334 - DNA, 917 bp, Glycine max
  Peptide Sequence Number=SeqID_163112
cggctgcgcgatcagcgccgcaaccgtctgacgacgccggaacagtcggcggtgggcgatgtgctgtacctgcaggcgctgcagggcggtgcgcaggcgtgcggcgcgccgatcggccggttgcagagcggctatcgcgccgactggctggtgctggacggcgacgatccgtatctagcggcggcgccggacgcctcgatcctcaaccgctggctgttcgccggcggcaaagagcaaattcgcgacgtgttcgtcggcggccggcaggtgatcgagcaggggcggcacgcgctgcagcagcagagcagcgccgagttcctgcaggtgctgaaaacctttcagcaggaggcgtaatgagcctgacccgttttagcttcgccgcgctgccggtcagcccgtggcgcaacggcggtggggaaacccgtgaaatcgtcagctggccgccgggtgcgcaggattttgactggcgcgccagcatcgccaccatcgcgcaggacgggccgttttccgcctttacgggcatcgaccgctcgatcactttgctggaaggcgacggcgtgaggctgttcagcgccgggcatatcgaccatcaactggcgcgtgtcggggaaccgttcgccttttccggcgatgtggcgctggaagcgacgctgctgggcggcgccagccaggatttcaacatcatgacgcgccgcggccggcaggcggccgaggtgcggcgcagcacggcgcccgtcaccttgccacccaaccgggcgggcgtgctgtatgtgctgaacggggtctggtcgctgccggggggcggcgaactgcgggcgcgcgagggcgtctggtgggcggcgcaggcggcgggcggcgaagtggcgccgctgacggccgacggcgctcttctgtgggcgaacatcacagcctgctaa

SEQ ID NO: 46335 - DNA, 498 bp, Glycine max
  Peptide Sequence Number=SeqID_163113
atggcttcgctgaaagacgtcgcaaaacttgccggagtctctttgatgacggtgtcccgcgccatcaatgaacccggcaagctgcggccggaaacctaccgccgcgtcaaacaggctatcgaccagttggactacgtgccggatctgtcggcgcggcgtattcgcggtgacggaaatcgcgtgcagacgctcggcgtgctggcgctggacaccgccacgacgccgttctcggtggaaatgatcctgtcgattgagaaaaccgcgcgcgagcgaggctggaacagcttcgtcgtcaacctgtttgccgacgacaacgccgaacagaccgtcgatctgctgctagcgcatcgtccggatggggtgatcttcaccacgatggggctgcgcgaggtgacattgccggccaaactgctggacaaaaagctggtgctggccaaatgcgtcagcccggcgcattcgatcgccagctacattcctgatgacggtgggatcctctag

SEQ ID NO: 46336 - DNA, 903 bp, Glycine max
  Peptide Sequence Number=SeqID_163114
atggcgaaggtggtggatgaccaaaattttctccgcgtgccttcggacttaattgtctctagatggcgaaggtggcagatgaccataatttttctccgcgtgccattggacttgattgtatctggaaggcaaggaaagtggatgagcataatttgtctccacatgccaataaacttgattgtctctgaaaggcaaggaaagcggatgaccataatttgtctctgcatgccaatggacttgattgtctatggaaggcaaggaaagcagatgactataatttgtctccgcatgctaatggacttgattgtctctggaaggaaaggaaagtggatgaccataatttctctctgcatgccaatggacttgattgtctctggaaggcaaggaaagcggatgaccataatttgtctctgcatgccaacgaacttgatagtctctggaaggcaaaaggagcggatgaccataatttgtcttcgcgtgccaattgacttgattgtctctggaaggcaaaggaaagaggatggccataatttgtctccacatgccaacgtacttgattgtctctggaaggcaaaaggtacggatgaccatgttttgtctctgtgtgccaacagacttgattgtctttggaaggcaaggaaagtggatgaccataatttgtttcagcgtgccaacggactagactgtctctggaaggcaaggaaagcggatgaccataatttgtttctgcataccaacggacttgattgtctctcgaaggcaaggaaagcagatgaccataatttgtctctgcatgccaacagacttcattgtctttggaaggcaaggaaagcggatggccataatttgtcctcgcatgccaatggacttgattgtctcttggaaggcaaggaaagcggatga

SEQ ID NO: 46337 - DNA, 318 bp, Glycine max
  Peptide Sequence Number=SeqID_163115
atggtgttgcgaaaagacaactataaagactctcttggaaaatttgatgcaaaggccaataaggctatctttcttggttttcattgcatagaaaaagattctactcttgaagatgacatcaaggctgaagaacatgaacaaagcaaagaaatctctacaacaatgcctaaagaatttctaagaaagtggagaactcagaaagatctctccttggataacataattggagaaatttcaaagggtgtctctacgcgttctagactcaggattttgtgtaacaacatggcttttgtttctacggttgaccaagaacattga

SEQ ID NO: 46338 - DNA, 138 bp, Glycine max
  Peptide Sequence Number=SeqID_163116
atggctccgaagaagcttttagccaagagttctaggaaggatgccactggagagggttctagtgtggcccagcaggcagatatggactttgatggacacagagaggcgagtctagctgagggacaaggagtatgctga

SEQ ID NO: 46339 - DNA, 948 bp, Glycine max
  Peptide Sequence Number=SeqID_163117
atggcttcgagaaaactttccacaaagaggtctaggaaggacgccactggagaaggctccaatgttacccagccagttgacatgaattttgacaggaaccgattccggagcgctgagcatcagcagctcttcgagagcatcaagggatggtcattcctcagtgagaggcgggttcagctgagggatgatgagttccctgatttccaggaggaggtagcccgcaggcactgggcaccacttgtgacccccatggctaagtttgacccagagatagtcatggaattttatgccaacgcatggcctaccgtggagggagctcgtgatatgcgctcctgggatttcgcctggaccgctgcagggagatgggtgaggatcatgcacaccagcatgaccatgttgacccagataaagatgacgttgctgctcagcaacatcctgcccagtgaccacaactccgatctccctctgccgaagtgccagctggtgtatgccatattggcacatatgagtattcacgtggctgagttgattgctgatgccatctatcagtttgtgggaacggcgcctacgaggcaccctgtggacccagaaaacaaagtcatctggccacctatcaccagagccttcattgagaattactgcactcctaggctggtgcagggtaagatgctcgctaagctagcagattggcttagcgagaagccggtggcagatgctccaccgccacctccagagtctacctctgatcacctgcggagatgggagcgatatatacgacatgtggctgaccagcaggcaagcaaccacaggggtcagcaatttgaggctgtagtagcatggccgaggggttggcccgatgatcagacaggacccaccgacacccctggaggtggggacgaggttgaggacgatcaggacatggcagacatgatagatttcctcctgtga

SEQ ID NO: 46340 - DNA, 363 bp, Glycine max
  Peptide Sequence Number=SeqID_163118
atggagtatgatgctagtaataattcaagagggtggagaacatacatgagaatccgagtgaatattgatgtccttaaatctttgaaaaaagagatcaagttacataagtcaggaaggaagtggcgaatggtgactttcaagtatgagcgtttaggaggaaagagggaatcgatggtggctggtggctatggaacaacatatcaagtgtggaaagtggaagtgcggcttaaggggacgatggaatgtcgagtaacaaaagcaatgctaatagtgggaaaactaaagttaccaattaccattaatggtcaatgccaatatcatggtaagagttatgtggagaaatatttcgaaagggaatcataa

SEQ ID NO: 46341 - DNA, 874 bp, Glycine max
  Peptide Sequence Number=SeqID_163119
atgaattatttgaacaaagtaggggaaaaagcatttggttgcgtgttggacctgggtattcggcatgtggcttacatcttcagttacgggaagaaagttgatgaactaaacaatagtattaaggatcttgggcatgcaaaagagagggtagatcatctacgtgatgaagctaagaagaatctacacaacattgaaggtcaggttacagaatggtttcggaaagtagaagaatgtaagactgaagtggaggagtttgggaacgatgaaggccacagaaagacacggttgctccatgatttatttccttacttgtggaatagatacaggctaggcaaacaagcagtggagatgacagaggatgtcaagaacttaatagatgagtgctccaagtttaaagaagttgcctacagggagaacataacatctaatgatgtcactttgtctaatgctggctatgtagaatttggttctagaaaatctatattggaaggcgtaatggcgcaacttgaagattccactgtcagaatgattggactgcatgggcctggtggtgtgggtaagagcactttaatcaaagacattgcgaagaaatctctagacaagaagctgtttgatgtggtagttaaactagaaataacagccaatcccaatctacaaaaaatccaggaagaaattgcttacgtgttaggattgagattggaaggggaaggtgagaatgtgagagctgattgtctacgaaggaggttaaagcaagagaaggagagcatccttgtaatcttggatgacctttgggacagattagacttgaataagttgggggttccacttgatggtgatgttgatcataatgatttaagcaagaagacacttgatg

SEQ ID NO: 46342 - DNA, 456 bp, Glycine max
  Peptide Sequence Number=SeqID_163120
atgagaaccctagggccttcttcagcagctctagcccaatcgtcttggagcctcttgctcatggctctagtgactggtcccttcctagggaggattgcatcatttggtgatacatttcaccagagatgcgactccctaaaatcactaaggcccatcgacgttgtcaggaagtacgctcctcagaagccgagcgagaggaaagagaaggccatcaacactgactcactttccgccaaagtgaccaatattatcgggataagcagggtgacccacagcggctgcatctttgcagcgcctgacctgccggtacgacccgcgaatgccaaaggaaaagcaaagatgatcgcggaagaggccaacgaagcaaggaggttcgccgaaaaaggggaagactcgatgaaaagtggtgtccttagaggaggccaacgagttcctccgtataatccaacagagtga

SEQ ID NO: 46343 - DNA, 471 bp, Glycine max
  Peptide Sequence Number=SeqID_163121
atggagataagtatgatagatgctgctagtggtggagcccttggagacatgacccctgttgaagccagaaatttaattgagaagatggcttcaaactcccagcaatttagtgctagaagtgatgctattgtcattagaggagtgcatgaagtagccacgaattcatcttcatcagctgagactaagaagcttgaaggtaaactagatgccttggttaacctgcaacctgaagcagttgaacagcctgaagcttatgctgcaaacatctacaatagacctcctcaacctcagcagcaaaatcagccacaacaaaacaattatgacctctccagcaacagaccatacgttcctccaccaagccagcagcaacaacaacaacagcaacaaccccagaaacaacaaacagttgaggctcctccacaaccttcccttgaagaacttgtgaggcaaatgactattcaaaacatgtag

SEQ ID NO: 46344 - DNA, 152 bp, Glycine max
  Peptide Sequence Number=SeqID_163122
aggtcgcgtggcctggggattggcctgacgcccaggcaggagaggcaccagcaggggcaccagcagaggctcccgatggggcagaggaggcccgcgaagacgaagagatgaccgatttacttgatttcttaggagggagcggagccgcatga

SEQ ID NO: 46345 - DNA, 1095 bp, Glycine max
  Peptide Sequence Number=SeqID_163123
gcagcgattgacgcttttttcgcctttcatgaccgcaaggaaagcccagtcgtcgctatcttagccaatctatatgacaccttcgaccgaagatgtgaaaagaatagtataaggattgtttgctatacttcggccttctacgtatggttggtttcacaccttttccgccaagaattgagacatgcttgcccgctagaaggccacctctcatgcacagagaaaaaagaggcaagttgggaccgactcttagcaagtaaagaaggagcgtctatcaactggttcccccgatggaaagaaggaagaaccggggttcttatttcatgcggaggatttccaaatattcccttattggggacaaggggttgcattaattacaatcccatcctcgccataagacaactgggctaccccatgagtggggcaccattaaaggaagacctcacacctattattgcacgaggtttcaataacaccaacgcagaggcacttcagaaggtccacaaggcatgggagatggtgcaaaagaaggacaaggaactcagaggcagtagcaacgggcccatcagtggctaccataggtggttgaaagcctacacgcaaggtctggattggctcccgaatttgagaaccacaaagggggtggaagttgaagctctagaggagaacgaagaggttcaggccctcagggcagaactcgagaaagcccaaacagtcaaaaaaaagttcaaatcagcagctattaggattcgaaaagaaaacgccgaactgagagacgtaaatatagccaccaccaaaaccttggagcaagaaaccaaaagggtccgtagggaagaacatggccagaacaaattccgaggggctctgtggggcagtaacaacgagcttaagctccggagagaggaaagagaccaatcacgagtaggcagtttgatcttgaaagatgaattgaggatttgcctaaggtccaagagaagcttgtctcagcggttatgcgagaccgagaccaacatggtgattgactcgttacatcaagaggcaacgatatggatggacaaatttgctcttacttggaacgggagtcaagaacttccctga

SEQ ID NO: 46346 - DNA, 885 bp, Glycine max
  Peptide Sequence Number=SeqID_163124
atggcagagcacggggttgatgcaacggcgattgggcagttcgccgatctgaacgcaccagagaaagaggaacagaagaagactgctgatgacggatggaacgaggcaaacacaagttccctactggcccagagctttgactatttcatgattgcgtccttagtgaacggtgcagacgcaacctctcgcaaggcgaaactcaggccaatgttcttgcgccatctgtgcgaaaagaatccggcgctatgggattacggacaagaaaggctgccgaactggcgtcactacactgtttcgaagctgtatctgcaggaatgtgacgcaatcgaagcatgggacggagactgggctatgctggccaaacagcgcagggaagccgtgcattggtcttacagcaatgacagcgacgcggttcatccgagcctctttctcgccaacgtgggaatcgcgcttctcgattggatcatggcggacgatggggaattgcgcaacctggccgtgcctttatggaatagactcttcgaatccgtcttgccgtttgcaacccactggagcctcgcagacgacaagtggcgaagcattctccaagcgctgttcgcacgctttccaaccgcgtttcggatcgctggaagcggggctgacgtggatccgctctggccgtatctcgatgctcttggaggagacgacatccttttcacggttgcggttgttcatgtattactgaacggtgtgcatcttaattcactgactcgtaaagacgactcagacccaggcgtggtgcagcgtattcaggcgttcttggactgggacgcatcgtctggtgggcattcagtaggactgcagattctggctgcatgggagagcgcggtcaagagcatgagctga

SEQ ID NO: 46347 - DNA, 379 bp, Glycine max
  Peptide Sequence Number=SeqID_163125
gcaccgatctgtacaacaacgtcaaggcgctgcatttctcgctggggttgtgtgtgattgggttggtggttttgcgggtggttatccgggtggcttcgggtgcggcgcctggcgtgcggccgccgatgccgcggtggcaggatgtgctttcacgggtgatgcattacgcgttgtatgcgttcatgatcgtcacgccgattctggggttccggcgctggtggcgccggataaggccttggcggatcgggtcaaggagctgcatgagaccttggctacggtggggtatttcctggtggggctgcatgccgctgcggcgttgctgcatcactatgtgtttcgggacaacacgttggtgcggatgttgccggggcggcggtga

SEQ ID NO: 46348 - DNA, 306 bp, Glycine max
  Peptide Sequence Number=SeqID_163126
atgtgcttgcccactagcctctttacttctcctagcaatagtaatcatagttttaatcttcacaatatttcgtgtcaagggccccatgatcacaatgaacaccatcaagatcacaaagctccaactggtcaacaccaccatggtgtcttgttgagggaggctagaggaccacctgggagggccaaggccagaagaacattgaggatgaatgtcacaattgatgtcatcacggatcgcgtcgtttctagcccggattttgcaacgcgatttaggttcggggctgttgactatgagcagcttctctag

SEQ ID NO: 46349 - DNA, 1116 bp, Glycine max
  Peptide Sequence Number=SeqID_163127
atggaagcacataagatattccccaacttggagtgtttggttattgactttgacgaagcacagaagtggttattgagcaacactgtgaagcatccaatgcaccgtttaaaagagcttaggttaagcgaagttaatgatggtgaacgtctctgtcaaattctgtacagaatgccaaatctagaaaagttattattgtgggaagctaaacatttgcttaaagagtcgtcggagtcacgtttgggaaccgtattacagctgaaggaattggttttgtcgttgtcaggaataaaggatataggatttgaacgagaaccagttctacggagactagagcttttgagcttatttgcgtgcaagaaattgaggaatttggctcctccctcggtatcagtggcttacttgacaaatttgaatgtaaagtattgtaatggattaaggaatttaatggcatcctcaacggcaaaaagcttggttcaacttaagtccatgaagataagcggatgtgatgaattagaggaaatagtaagcaatgagggaaataaagaagaagagcaaatagtgtttggcaaattgattactatagaacttgagtggctaggaaagctgaaaagtttttgcagttacaagaactgtgaattcaaattcccgtcattagaagtattgattgtgagaggatgccgaataatgcaaagattcacggagggtggcgcaagagcaccaaagttacaaaacatagttactgctaatgaagaaggaaaagaggaagccaaatggcaagtaatcagttgtttgagttcaataaatctggtaccatgcacagtgtctttctccaatctgacatatttgctagtacaaaattgcaagagtctgttatatttgttcacatcctcaacagcaagaagtttgggtcaactcaaaacaatggagataagtgggtgtgattcaatggaagagatagtctctgaggaaggggatgaatcagatgaggatgagataatatttcagcagctcaattgtttggaacttgaaggattaggaaagctgagaaggttctacaaagggagtttaagtttcccgtccttaagagaagagattgagagaatatataaaaattga

SEQ ID NO: 46350 - DNA, 570 bp, Glycine max
  Peptide Sequence Number=SeqID_163128
atggaggttatcctgtgcattcctagcaagggctttgtcctgaacgttgagggccaaccatggaagctcctcagaaaggatcttactaccttggcccaaacatggagtgtcttctcttactccaacctagctcctacctcccacacctcagacttgaatatggacagagctaggttggtttatggcttagtcacagggatggacataaatattggcggcttgatctctagacagataaccggtatggctcaatccaactcttctcacctaggcttcccagctttaatcacagccttgtgcaggtcaaggggagttggatctgatgctcttacttcttataggagcctgaggccggtcattaacttggcctatattaaaaggaaatgttggaatgtgaatgaccaaacagttaattttccaagggcaaggaaaaccaggtccagagcagcaggtgttccctcttctccagcatcaacaacctcatctgcccaaagctcccagacttcagatgctaagttgcagagtttgttagaggggcagattctcattatgcagagcttgcaagaatag

SEQ ID NO: 46351 - DNA, 388 bp, Glycine max
  Peptide Sequence Number=SeqID_163129
atggacatgtccatcatcgactacgacgagagccacacgaggcacgtgtatgaggcgtggcttgtgaagcacggcaaggcctacaatgccttgggggagaaggaacggaggtttaagattttcaaggacaatttgaggttcattgaagaacataatggggcgggggacaagagttacaagttggggttgaacaagttcgccgatctcaccaacgaggagtatagggccatgttcttgggtacccggacgagaggacctaagaacaaggcagcagtcgtggccaagaaaactgaccgttatgcttatcgcgctggggaggagttgcccgccatggtggattggagggagaagggtgcggttacccccattaaagatcaaggccaatgtg

SEQ ID NO: 46352 - DNA, 357 bp, Glycine max
  Peptide Sequence Number=SeqID_163130
atgtatcaatatccttttgaaggtcatcacactgatacttctacaagcaaacattcgttcggtggtgttgtggaaacacatcctcatttttcatggctgactatgaccccttcacaacaacatgatgccccaattccaacacctagtgccctattaggtacacaatggaatgtacccagagcaatacctaatatgggtgacttattaggtgttgatttgcgtcaccaattttctgttgaggttgaccaagtagaagcagagagacatcggggcagaagaaatcctgatcgccaagcacgaagatgggatcgaccatgtgacacatcctcacgtcatcatggacatcataataaatga

SEQ ID NO: 46353 - DNA, 1485 bp, Glycine max
  Peptide Sequence Number=SeqID_163131
gtgtttgccaccattaccgacggctggccggtggccgaagtcccggtgatcatggccggtatggtgggcagcaacgctggctggctggcagtgccttatctcgcctgtccggtggcgctcaatgcattaagcgatcgcctgacctgcgtggaaggaaaagcgtggatcgtgccgggactgagcatcgaacgtgacgacaactacaacgtgatgcgcggagaggaaacccagctgctcggcgcagtcacgctgcagcccgcgccgctgtatgtcatgccgggcacgcacgccaagtgggtgcagctagaacaggatcgcgttattgatttccgcaccgtaatgaccggcgaactgcaccatttactgctgaagcaatcgctgatcggtgccggtttacccgcgcaggaagccagtccggacgcgttccgggacggtttgcagcttggcagccatgacccatccattctggcgcgcctgtttgaagtgcgtgccgcccatgtgctcggcgcgcgcgatcggcgccatatcagtgattttctctctggcctgttaatcggccatgaagtggcgcagatgacgcagcagttaacgcatagccgccagccgattgtcattatcgccggcagcgcgctggcacagcgttatcagcaggcgctggcctttatcggaacagattcagtcacgctggagggcgatcgcgctttccagcacggaataaggactgaagcgcacgtcgcggcgctgatcgatgccggtttcgatgcgattgaaattccgctcaactcgccagagtgggcgaaaagtatcggtgcgatggtgcaaaccttcggcgataaagcgctgatcggtgccggcaccgtgctgcaggcgacgcaggtcgatcagctggcggcgctcaacagcaagctggtggtgacgcccaataccgatgctgcggtgattcgccaggccgtggcgcacggcatgctggttgccgcaggctgtgccaccgccagcgaagcctttaccgcgctgcaggctggggcgcaggcgctgaaaattttcccgtcgtcggcgtttggtccgggctacatcaaagcgctgaaagcggtgctgccgccggaggtgccggtctttgccgtgggtggcgtcacgccggaaaacctgcatgaatttatcgccgccggttgcgtcggggctggcctgggcagcgatctctatcgcgccggtcagccgctgtcgcgcaccgtggagaaggcccgcgcatttattgctgcctataaggacgctgatccggcgcggattaatgatctgtggcaggtgatgtatcgcggcggtttttaccgcggcggcccgattttaatgagcgccattgccggtatcgatcaggcgctgtgggatattaaaggcaaagcgctgggcgtgccggtgtatcagctgctgggcggtctggtgcgtgacagcatcaaagcctatagctgggtaggcggcgatcgtccggctgaa

SEQ ID NO: 46354 - DNA, 216 bp, Glycine max
  Peptide Sequence Number=SeqID_163132
atggctaagatgtatgaatgtgtggattcattggaggaaaaatggatgaactttgaaccaagatggggcatatcacatatggaggagagaatgggacgcatggaagagagacttctttctaagatcttctatggaggctggatctttgagcttcaatggggtcctttaatggtgattttccaccatggagatgcagcggaagacaaaggaaaatag

SEQ ID NO: 46355 - DNA, 351 bp, Glycine max
  Peptide Sequence Number=SeqID_163133
atggctgcttgtgctggtgtgttttgggatgagtttgggaattggatttatgggtttgttaggaacttgggcatgctctcacagctgaattttggtgcatcctttcagccctacaggttgcatgggataagaggtttcgctttgtgcactcagtttggaagtggctgtctagagactagatggtacaactggttaacatttatagggaagccaacattgttgcagatgatcttgctaattggggcatactcttcccttgggttttgcacaagttgtcatctcccccaccaaagttctctcttttttgttagaagatgcagtgggggtcttggtcccttgtttgatctgtag

SEQ ID NO: 46356 - DNA, 765 bp, Glycine max
  Peptide Sequence Number=SeqID_163134
gagcgacccgatctcaagttggtctcccatggtaggaaagtagataaatttgggagaccggctgctgagatcgaaggtatgattgcggccaccggattggatccattgatcaggtgttctgtgatcaccactgatcctggactcatatctgcctttgttgagaggtggcatagggagacgagcagcttccacctcccagtaggggaggtgacgatcactctagatgacatttcgtcgctgctgcacattccgattactggcgcgctacattcatttgagccgctggctacatctgacgcagtcgccctgttgacagagctacttgaggtcaccccagacgaggctacagctgagacacgtcaggcaggtggccctcatgttcggttgtcctggcttcgggacatgtaccagagtaggtgccgggccaggcagtgggtcgctgcagctcggacgtacctacttcatttggttggttgcactcttttcgctaacaagagtgcaacccatgtccacgttgtgcacctgcaggcattcagagacctgggccaagcaagggcattctcttggggagcggccgctttggtccacttgtacgatcagcttaacgaggcgtcgcaggcccctacacggcagatggctggttacatttcactacttcagtgttggatttacgagcactttccatcagtccacaggtctgttgttgacgatggttatgttgaggctagcccacgtgcctgtaggtggcttacgggtaaggcctag

SEQ ID NO: 46357 - DNA, 120 bp, Glycine max
  Peptide Sequence Number=SeqID_163135
atgcctgagagtgaagattttagaattcggcttccaaaccaagtggttttcaaggattgtaggaactggtttcactccaaagttaatctcggttcaaaatctatgcttttgaggccttaa

SEQ ID NO: 46358 - DNA, 108 bp, Glycine max
  Peptide Sequence Number=SeqID_163136
atggctataactcaagctacagggctccaaataaaaacaaggttgaagatgaaatggtggaatgaaagaatcactctttccagcgagggcaacacacaaaggatgtga

SEQ ID NO: 46359 - DNA, 2139 bp, Glycine max
  Peptide Sequence Number=SeqID_163137
atggtgagtagtagtaccaaattgtactcctttagagtaattactttgtttaaatttagcaaaccaataattcttctcggaatcacccatgatccacaatatcacggccatcaaaactttgacgccatttattacgctgctgtaagtaattgttgcggtgctgttttggcaaagagggagagagagagagacccaaaagagactatgctcggggactcagctctgttgggaggaggaggaggagaaggtggtgcctccgccgatgtagtggcggcgaccgccacgcatgatgcgacaacgacgacgacgaccggaggaggcggtggcggatcaaataattcgggggacgatgagaggggtagaatcgaagaaggtgaacgtagcttcggcggtaaccggtggccgcgacaagagactttggctttgttaaggatacgctccgacatggacgtggcgtttcgagatgcaagtgttaaaggtcccttgtgggaagaagtatccaggaaaatggcagagcttgggtatcacagaagctccaagaagtgcaaagaaaaattcgagaacgtgtacaagtaccacaagagaaccaaagaaggtcgaagtgggaaacaagatggaaaaacatatcgtttctttgatcaactacaagcccttgagaaccactctccaacaccccattcccccaacccttcatcaaaaccactacaatcagcaccatcaagagtagtagcaacaacaactgcatcatcaatgtcactaccaattccaacaccaacaacaacagtgccaatgcagccaatattgtccaacactatacccacaagtagtgtccccaatatcactgttccatcaacaacaatactccctataaccatacctcaacccattctcaccaccccatcaataaacctcacaatcccttcttaccctccatcaaaccctaccaatttcccaccgccatcaaaccctaccccaccactctctttccccaccgacaccttctccaattccacctcctcctcctccacctcctccgacgaaacattggaaaggagacgcaagaggaagcgcaaatggaaggatttcttcgagagactgatgaaggaagtgatcgagaagcaagaggagctacaaaagaagttcttggaagcaatagagaaacgcgaacacgacagaatagcaagagaagaagcatggagagtacaagagatgcaaagaatcaatagagaaagagaaatcttagcacaagaaaggtccatagccgcagccaaagacgcagccgttatgtcattccttcaaaaaatagccgaacaacaaaacctcggtcaagcgttgaccaacatcaacctcgtacaaccacaaccacaactacaaccacaaccaccggtacaacaacaagtgacaccacctaatatagtaccagctcctatgcaacaaccactgcctgtgattgttacacagcctgtggtgttgccagtggtatcacaagtgaccaatatggagataatgaaagccgataataataacaacaataacaataataacaactgcgaaaatttcttgccaccgagttcttctcggtggccgaaagtggaggttcaggcattgataaagcttcgaacgagcatggatgagaagtatcaagagaatggaccaaagggtcccctctgggaggagatctcagcctcaatgaagaagctggggtacaaccgaaacgcgaaaaggtgcaaggagaaatgggagaacatcaacaagtacttcaagaaagtgaaggaaagcaacaagcggagaccggaagattccaagacgtgcccttatttccaccagctggacgcgctgtacaggcagaagcacaaagccgaagagagcaccgcggcggcgaaggcggagagcgcggtggcaccgttgatggtgcagccggagcagcaatggccacctcagcagcaggatgatagggacatcacaatggaagacatggagaacgaagatgatgaatatgaggaagagagggaaggagaggaagaagaagaagaggatgaagaggatgaagaaggtggtggtgggaactatgagatagtggcaaacaaaacaagtggcggtggtggtgctgctgcttcagtgggggcttcaacggagtag

SEQ ID NO: 46360 - DNA, 282 bp, Glycine max
  Peptide Sequence Number=SeqID_163138
atgcttcatccttttgtgcctttctcacacacttcactacctccaatcaattgtgatagtaatgatagtgatagtgaaggcgacgatagtaatattggtggtggtggtgggagcagccgaaataatgatgctagtgatgatgataatgacaataataattgtgtccgaaacaacaatggtagtgatagttatggtgactatggtggtgacaacaacaatattatcgatggtggtgactacaacaatataccaatctttcttgagtacagaatggtttgttga

SEQ ID NO: 46361 - DNA, 171 bp, Glycine max
  Peptide Sequence Number=SeqID_163139
atgacaaaacatacaaaacccaagaaagtagaaagttacgagactcctgtctgcaggggaaaaatctcacttctgcagaagaaggtcacttgccagaaacaacaccgaaaccagctagtagagaaacctatggggaaaatcatggtggattttcttcttaataagcagtaa

SEQ ID NO: 46362 - DNA, 384 bp, Glycine max
  Peptide Sequence Number=SeqID_163140
atggccttcatcatgtcctcatttatacatttcattctaaaattcagagattcatgcaaagaatattactcacagcaagtcgttcactcacagttgagagcaacaacttctccagatgacgaatcagaaagatcagcaattcctccaacttgggaagcaggggggtcagctatttctccagctagtgaatcaggaggggcaactgcttcatctaatgatgcattggagatgataatcagaggtggagatgggggaactacttcaaggtcaggagaagaaggtggattcaccactggagattgtgggttagctggctctggatctacctacaaaggtgtgggctcaggcggagcagcctcgttgggtctcaccgatggaagttga

SEQ ID NO: 46363 - DNA, 213 bp, Glycine max
  Peptide Sequence Number=SeqID_163141
atgaatcaccaaaaaaggcccttccagaacattttggaagttgggttgcttaaggaggaagcaactgggcggcaagagtcattgaatggggtttatgtacaaagaacgggcaaacctttatgggttatatccgaagacatggaaagggatgtttttatgtcagcagcagaagcccaagctcacggaattgtagatcttgtagccgttgaataa

SEQ ID NO: 46364 - DNA, 216 bp, Glycine max
  Peptide Sequence Number=SeqID_163142
atgccggaagtcgaaagggagcattgtcgcgcaatgcgtaaagttccgcaacattccagagggtgtgcaactagcaaccagacccacttaggccttccagggtgttccaatagaaggcggtgccttctagtggaagcaacccagctcgccagggcgagctgggcggcaaccaactccctcttttcccctataaataggggaaagagggcagagtaa

SEQ ID NO: 46365 - DNA, 132 bp, Glycine max
  Peptide Sequence Number=SeqID_163143
atgtcgggccggatccaaaggcaaaaaccaatcaagggacggacgcaagtagaggctaggatcacgatcgatagatcgtcatctcatgcccagcactggacaagcgggaagcacagctgggggacagcctag

SEQ ID NO: 46366 - DNA, 159 bp, Glycine max
  Peptide Sequence Number=SeqID_163144
atgtgtctaacaaaatccaccttggtcgtagtcggaagtgatgctgaagctctaggccattatgaattggctatggctctcatggttgatcatgacactcatgaattgaacatggccatggtgaatttaccaacaccttcatcattgacgttgttctag

SEQ ID NO: 46367 - DNA, 756 bp, Glycine max
  Peptide Sequence Number=SeqID_163145
atgggtaccggggattcggattcggaatcgaatggatggaaccgtgctcgtgggttggcgcttaagactctgctactaattggtggcgcacttctcgttaagcgcctccgcaagtccaccacgcgttgggaccacgctcatttcgtctccaactccctcaccggcgaaaaggagcaagcttccagagacccggataactatttcaacattagaatgcttacatgccccgcagcggagctagtggatggttccaaggtcttgtattttgaacagaggctttttatggtgaaaccttgtcctaaagagttgaaatgtgatgttgagttaagtacatatgccattagagacatggaggagtacaaaaatttctgtgatcgaccaagggatcagcgtccacagccggaagaagtcattggagatattgctgaacatttgacaacagtacatcttaagcgttgtccacgtggaaaacgttgcttatatgaaggttcaaccccacctggtggatttcctaattcatggaatggggcaacctactgtacttcagagcttgcgattttaaagaacaatgagatacatacctgggacaggggttatgatgatggtggaaatcaagtttgggggcaaaaagaaggcccttacgagttcaagcctgcaccaacctccagttttaatgatatgttttctcctttgaatttcccccctccaccatccatggagagaagaatagagggttcatttgttttgcaagaatga

SEQ ID NO: 46368 - DNA, 945 bp, Glycine max
  Peptide Sequence Number=SeqID_163146
atgaatgaattaaagaacatccttgaggtttatgaagctgcgtcgggacaagccatcaatctcagcaaatctgaaatgttttttaactccaatgtgattgagttgaagcgcaattcaatctccaatatgttgggtgtctatgcaagaataggggctggaaaatatttaggaatgtcttctaatattggaaggaacaggaagagcactttcgggtttatgaaagaaaaaagtttggaagaagatcacatccatggctgggaaattcctgtccaaagctggttaggaaatcatgataaattcccaacacctgggaattttatcaaagatgggatggagaattgtcgatgttctggacccataagcacggctcctcttgaggcagtaaaagatctcgtggttagtgacttgatgatacaaggaacaaggcaatggaacaaacatcttatttatgcgcttctgccacaaagatccattatggagcaagctagaaatcatcaacaattccaaattgaaggtgattggatgaatatatggagtttaaatgtccctcacaaagttcgagttttcctttggagagtttgtagggattgcattcctacaaaaattcaattagaatcaagagatattgattgttcttcaatccgtctcttttgtcaacaagacttagagaattcttttcattgcttctttaagtgcccaggaagtatatcagtgtgggaaaaggaaggagatgatggaattaattcatgcaaaagttctaagctgttatggagtctagcgaaaaggaggaatgaaaaattgtggaatgaagtggaggaaaatgttatagcagtctgttgtagagcgaactcagtgttacaagattggaggctagctcaagattctcaacaattccagcaatttcattgctctccaaatgttttggtttggcaaaaaccttcctga

SEQ ID NO: 46369 - DNA, 252 bp, Glycine max
  Peptide Sequence Number=SeqID_163147
atggggagtttcagaaacgctgcaatcaacgtcgtcagagtgatcaattccaacaaagccaccatcgctgcttccacaaacccccttcacactctcaggctattatatagaagcaaacagcgagggttcctggaactggatttggtcctcggaaaatgggttgaggacaacattcactccttggatgaaattcggattaaggccctcattcatgttctcgacctggaacttgaatgcctctatctatcctga

SEQ ID NO: 46370 - DNA, 204 bp, Glycine max
  Peptide Sequence Number=SeqID_163148
atgggagaacgaaaaggaatcccaattgctctggggctcttggcgatgctcctcttcttcattgcttcttcctcttcctctcacctcgttcgtgcttccgatgacgccgacgacgcgatcttctacgagtcattcgacgaggattttgacggacggtggattgtgtccgacaaggaggattacaacggtaaacagattctctga

SEQ ID NO: 46371 - DNA, 1386 bp, Glycine max
  Peptide Sequence Number=SeqID_163149
atggatcacgtgctggtggcgctgggggagacgaaggaggagagggaggttcgtattcggagcctgttcaacttcttcgacgccgccaacaacggttacttggactacgctcagatagaggcggggctatcggcgctgcagattccgccggagtacaagtacgccagggaactctgcgaggtttgcgacgccaatagcgacggcagagtcgagtaccacgagtttcgccgctacatggacgacaaggagttggagctttaccgcatcttccaagccattgatgttgaacacgacggcaccattctccctgaagagctctacgaagctctactcaaagctggtattgaaatgaatgacgaggagctggctcactttgtggagcatgttgataaggataataatggaattatcacttttgaagaatggagagattttcttctactttatcctcatgaagcaactattgaaaatatatatcatcattgggagagggtgtgccttgttgacattggagagcaagctgtcattcccgaaggcatcagcaagcatgcaaaccggagcaaatattttcttgctggtggaatagcaggaggtatttctcgtacagcaactgctcctcttgatcgtctgaaggtggtcttacaagttcaaagcgaacgtgcttctatcatgccagcagtaacaaggatatggaagcaagatggtctgttaggattttttcgaggtaatggattgaatgttgtgaaggtagcaccagaaagtgccatcaaattttatgcttttgaaatgctgaaaaaagtaattggagaggcccaaggcaacaagtcagatattggtactgctgggaggcttgttgcaggtggtacggctggtgcaattgcacaggctgctatctatccaatggatctcattaaaactaggttacagacttgtccctctgaaggtggaaaggttcctaagctgggaacacttacaatgaatatatggtttcaagagggacctcgagctttctacagggggcttgttccatctctgcttggcatgattccttatgcagccattgatctcactgcttatgataccttgaaagatatgtccaagagatatattcttcaggatagtgaacctggtcctctagtacaactaggatgtgggacaatttctggggctgttggagctacttgtgtctatccattgcaggcacaaccttccaacacttccgatgcttacaagggaatgtttgatgcctttcggagaacttttcagcttgaaggctttataggtttctacaagggactctttccaaatctcctcaaagttgtgccagctgcaagcattacttatgtggtctacgaaagtttgaagaagaatctggatctggattag

SEQ ID NO: 46372 - DNA, 2631 bp, Glycine max
  Peptide Sequence Number=SeqID_163150
atgcattatcagcttatattcttggctaataaatgtctgatacaggaaatctccaccaagaagatgattggtacaattgatgttgaatctggtttgtacaaactcaagacaacctccggccatcacaacagtacaccccttgctgtcctcaacccatccaattatgccaattcttgtactaaaatactcattgatatatggcactgcagattaggacacttatccaatgaaagaatgttagccatgaaacaatattatcccaatttaaattctgtcaaagagatcatttgtgatgcttgtcataaagccaaacaaaagaaactgatttttcccattagcagttctcattctctttccccttttactttaatacatgttgacatttggggtccttgttcaaccacttctatacatggtcataagtattttattacgattgttgatgatcatactagatttgtttgggttttgccgacgtcttctaaagctgaaactcaatctcttttacaaggatttatcaagtctgttgaaagacaatttgacacaaaagttaaaaccattcgctcagataatggtgcagaatttatcatgagtcatttcttccaagccactggaattattcaccaaacaacctgtgtggaaactccccagcaaaatgggattgttgaaagaaaacaccaacatttactcaatgtaacccgagcccttttgtttcagtctaaccttccacatattttttggtcctatgccttacttcatgctgctaccttgatcaacattattcctactactcataatccacaagctttctctttccctatagattccccttctcctccacctttacctccccaatctgaacctgtacctattgaccagccaaacactgaccacacctcctctgcacccactcctcgtagaactgacagaattcgaaccagacccaccaaatacactgactatcaaaccagtttcacatcagccactattaccaatcatccaggcactaaacaccctatttcttctgtgatttcctataacaagctctcttcatcttatcacagcttcattcttaatatctctgctaattctgagcctaagtcttataatgaagcctgtaaacatgattcttgggttcaagctatgcatgatgaaatttctgctctagagaggaataatacatgggtgctcactgatttacctcagcataaaaatgtgattggttgcaaatgggtgtacaagatcaaacataattcagatggctccattgaacgatataaggctcgcttggttgccaagggctatacccaaattgaaggtctggactatttggatacattttccccagtagccaaaattactacagtccgtcttttgcttgcattagctgctttgaataattggtatctcagacagcttgatgtcaataatgctttccttcatggtggtcttcatgaagaggtgtatatggttctacctccaggtatgaaatctgctaaacctggtcaggtttgtaagttacaaagatctctttacggtttgaaacaagctagtcgtcaatggtatgctcgattgtctacttttcttgcacatcatggctttaaacagtcagttgctgactattctctctttaccttgaaaaaagcaaattcattcactgcattattggtctatgttgatgatattgttctaagtgggaatgacctctctgttatctcttccattacaaaattattggatgacacttttaagatcaaagaccttggcaatttgaaatatttccttggctttgaagttgctcgtggcacctcaggtattaacatttgccaaagaaagtatgctttggaccttctcactgatactgatatgttgcattgcaagcctgtatctactccttttgattactataccagactgcatcaagcctctggttcaatgctttctgactcccaaatctcttcatatagatgtttaattggcaggctcatatatcttacaaatactagaccagatatcacctttgctgtacaacacttgagtcagttcattgcttctcctactactgcacattacacagctctttatcgcattcttcgctacattaaagctgctcctggtttgggtcttttcttcccttctactagtgaactacaactcaaggcatttagtgattctgattgggctggctgtgtcgacaccaggaaatccattactggtttttctgtttatcttgggtcatcactcatatcctggaaatctaaaaagcaagccatagtctccagaagttcctttgaagctggataccgtgctctcacttctgtaacttgtgaaattcaatggctcacatatttgcttcatgattttgatattacttataagcctgctttagtgttttgtgacaataaatcaggtctccacattgcagtcaatcctgtcttccatgaaagaaccaagcatattgaaatagattgtcacatagttcgtgataagctgctttcgggattgatcaagctcctgcccattgcttcacaacaacaacttgctgatgtttacacaaaagctttagctcctggtgcttttcgttttatctgttccaagctgggtatgaatgacattcattctccagtttga

SEQ ID NO: 46373 - DNA, 555 bp, Glycine max
  Peptide Sequence Number=SeqID_163151
atgggcaatgatatcttctgcttgaagagcatcaaagagtcccttagagacccttacaactatttgcaatcttggaatttcaacaacaaaatgaaggctttgtttgtattatgttcaattcataaaaaaaactttcaaatatggatctcaagggccaatttcctcgtcattcaaaattgcacaagcttaactggattagacttttcaattaacactctctctggaaccattccagaaaatactgccactcttctaccatttgtgacatctcttgatcaatcttcaaataaattttctggagcaatacctatgagtcttgcaaattgtaccgaccttaatgcccttaaacttgatcagaatcgactaagttatcattttccccaacagttgggccttctccaacgacccaggacatttactgtgtcaaacaattctttgacggggcctgttccaaactttaccaatggtcatgttgtggtaaattattcaaataatgaagggctatgtggaccttcattgaggccttgccccaataattcaagcactggtcactga

SEQ ID NO: 46374 - DNA, 2997 bp, Glycine max
  Peptide Sequence Number=SeqID_163152
atggcatcaacggcgagtggggccaccggatggtacaggggaagagtgaaggcggttccttccggggactgtttggtcattgtggcgatctccagcaccaaacctggtcctttgcctgaaaagaccattactctttcttctttaattgcacctagactggcgcgtagaggtggtgtggacgagccttttgcatgggaaagcagagagtttctgaggaagctctgcatagggaaggaagtgactttcagagtggactacaacgtgccgtccataagtcgggactttggaaccgtttttgtcggggacaagaatgttgccatgcttgttgtttctcagggatgggttaaggtcagggaacaggggcagcagaaaggagaagttagtccgtacctggcagaattgttgcggttggaagaacaggctaaacaagaaggccttgggcggtggagcaaggttcccggtgctgcagaggcttcaatcagaaatttaccaccttctgcccttggtgaccctagtaactttgatgctatgacttttttaaatgcaaagaagggattgcccatggaggcagttgttgagcaggttcgtgatggcagtacactccgtatctatttgctcccggagtttcagtttgtccaagtttttgttgctggaattcagctaattgttttacctttaccgcagtctccacaaatgggaaggagagctgcacctgaaagtgttgttgaaccagagttgacatctgatgacaccaacggagatgttcctggggaacctcgagccccacttacatctgcacaaaggcttgcagtttcaacatctgctgctgaaactgcagccgatccttttgcacatgatgctaaatttttcactgagatgcgtgtattgaatcgagaagttcggcttgtcctggaaggtgtcgataagtttagcaatttaattgggtcagtgtattatcctgatggtgaatcagcaaaggacctggcattggagcttgtagaaaacggttatgcaaaatacgttgattggagtgcaaatatgatggaagaagaggcaaagcaaaagctgaagactgctgaactgcaggctaagaaagacaggttaaggatgtggacaaactatgtaccaccgccttcaaattcaaaggcaattcataaccagaatttttctggcaaggtggttgaggttgtgagtggagactgtattgttgttgctgatgattccattccatatggtagtcctctagctgagaggcgagttaacctttcaagtattaggtgtccaaaaatgggcaatcctcgtcgagacgaaaaaccagctccctatgcccgtgaagcaaaggagttcttgagaacacgcctcattggtcgtcaagttaatgttcagatggaatattctagaaaggtttctcccacggatggatctgtagttccatcagccgctgattcccgagtaatggattttggatcagtctttctattgtctggtgccaaggttgacaatgatgatgccccatcatcggctccacctgctggaagtcagcaaaatggggtgaatgttgctgagttaatagtgggccgtggctttggaactgtcattagacatcgtgactttgaagagagatctaactattatgattctcttcttgctgctgaatcgcgtgcaatttctggaaggaaaggcacccactctgccaaggatcctccagtgatgcatataactgatttgaccatggcatcggctaagaaagccagagacttcttgcctttcctgcaccgaagtagaagagttcctgctgttgtggaatatgtgctcagtggccatcgttttaaattgttaattccaaaagaaacttgcagcattgcgttctctttttctggagtcaggtgtcctggtcgtgatgaaccatattcagacgaagcaattgctctgatgaggagaaagataatgcaaagagatgttgagatagaggttgaaaccgttgatagaactggaacgttcttgggatccttatgggagtcgaggaccaatgtggcaattacactgcttgaagctggtcttgcaaaacttcatacatcctttggcagtgatagaattcctgattttcatcttctggatcaggctgaacaatctgctaagaggcaaaagctgaaaatctgggagaattttgttgaaggagaggaagtatctaatggtgcagcagttgaaaacaaacagcaagaagtacttaaggtaattgttacagaagtcttgggtggtggtaaattctatgtccagacagttggagatcaaaagatcgcatccattcagcaacaacttgcttctttgaacctgaaggatgctcctgtgcttggtgctttcaatcctaagaagggtgacatagtcctttgttattttcatgctgacaagtcttggtaccgggcaatggttgtcaatacaccccgaggaccagttgaatcacctaacgacttgttcgaagtattctatattgattatggaaatcaagaagtagtaccctacagtcaactacggcctgttgatccatctgtgtctgctgctccgggtcttgctcaactgtgtagccttgcatacatcaagattccaaacttggaagaggattttggccaagaagcagctgaatatttgagtgaactcactttaaacagtggaaaagagttcagggccaaggttgaggagaaagatacttccggaggaaaagtgaaagggcagggaactgggacagtccttgctgtaactcttgttgccgtggatgctgaaatcagcgttaatgctgccatgctacaggaagggcttgctaggacagaaaaaagaaacaggtgggacagaaaagacagacagacagctcttgataatttggagaatttccaggaagaagcaaagaccagcaggcgcggaatgtggcagtatggagatattcagtcagatgacgaggacactgctcctcctcctagaaaggctgctggtggccgtaaataa

SEQ ID NO: 46375 - DNA, 153 bp, Glycine max
  Peptide Sequence Number=SeqID_163153
atgcataaaaatgagagagatgtaaaatggaagaatggtctcaagcttcgcacagtactatctctatcttctcacaaaattgatacacaagaaaaatcttaccaaggtataaagtctcatctgaaaggactactaagatctatcatcacttaa

SEQ ID NO: 46376 - DNA, 175 bp, Glycine max
  Peptide Sequence Number=SeqID_163154
atgggtgaccgcatgcgacaagcagtgagagcaccggtcattggtgaggtcgccgcgacactagaagaggccgtagatgtcgtcagaggaagcggggaaggtgaagttgttgtggttggcaaaggagatggagttgacgagggaggtgaggagcgtgttgacggtgttttcgtag

SEQ ID NO: 46377 - DNA, 501 bp, Glycine max
  Peptide Sequence Number=SeqID_163155
atgccaccttcatcgggtcaaggacgtgatggcggtgccaccaaatcctcactcctcctttttctcgttatctttgacagtgttagtgggtctaggggtcatagtgtagtggatggcttcacacaaacacttcttcactctatgcaccctatttggctcattggctgtcaactttatgtgtctcctaaggcaaagaaggggaagatagatgttaccaacgttgtgcacttgagtattggcacgttcaatgtattcatcccgataacattatatgtaaaagtatacaacatgttcgactgtgtgagaaggagtaccgttaagaaatttttgtcaaagcaacacaggaaaattgattaccagtccttagctctgggtaacctgcaagaagctcaaagcagtggcttgcaggaattatcatcaatttcttgtcaacttttgagaggaagttgcactagtgcaccaccctaccctggtatgcaatgtgtcagactcgctacatag

SEQ ID NO: 46378 - DNA, 630 bp, Glycine max
  Peptide Sequence Number=SeqID_163156
atggatcggaggagaaacgcgagtccggtgtacgcccggcagtggagcggcggttccagcagcaccggttcctcgtcgccggcgatgtcgccggctcatcctcagtcgcgcctcggtcctacttctgccaccggtctctccaccgtcaagcgcacgcaaaacgtggccgccaaagccgccgcgcagcgacttgctcgcgtgatggcgtctcagaataccaccgccgacgacggcgaggacgacgacgatctcgatttccggttcagcgctccgtctccggcctctctttcttccttctccagcaactccggcagtaaccggagtgccagcacgaatgccaccgccattcctccgatttcggtcgccaggcctaacagatctccttctcctgcgttaggtcggaactttgtagagcatactcattcggttcgttcaacatcagctggaagaccagcggtttcagttcgctcagcggcagtggtgccaccgaacaaatccacactccggacgcctatggctatacctcctattgaccctcctaccaatcggaatagagagaaaaggtactgtggagttctgttctaccttaattcttatggttttgtagctgtggtagtaattgacttgtaa

SEQ ID NO: 46379 - DNA, 1392 bp, Glycine max
  Peptide Sequence Number=SeqID_163157
atgtccatcagaccacttaactcaaaagacacaggagatcagcgtgaagcttctgcactccgtgatgaacttgatatgctacaagaagagaatgaggatttattagaaaagctaagacaagcagaggaaaaacgccaagaagtggaggcaagaactagggaacttgagaaacagaatttgggtttaggatctaattcaaccccacaaaactggcttgtgaggttcttcatgtctcaactgcaaatgagcagtgtggttggcaacactgatattgcagtgtttgctcatgactatccaaagtgccagtgcacaaccagcctgcatggtgttagcgctgtgaagtgtggccctgggatctcggactacaacagccagcttttatggcatgattctcccaaggttgcttctcttggagaaggtgtatccctggaagctaaactgctaagcaggaaggaagctgctctgcgtcaaagagaggctgctctcaaggctgctcaacaaacacagagtgggagagatgaggatatcacagcccttcgagtggaaattcagaacctaaaagatgatgctacagcagctttggaacaacagcaagaagctgaagctgaagcaaagtctcttcgcacaatgacacaaagaatgattttgacccaagaagaaatggaggaagttgtcttgaagagatgttggctagcccgctactggggtcttgctgtaaaacatggcatatgtgcagatatagcacaatccaagcatgagcattggtcttctctagctcctcttccttttgaacttgtcatctctgctggacaaaaggctaaggaggaatcctggaacaaaatgcatggaccaggtgctgatggtccagatagaagcaaacttgttcgtgatttgaatgatcttgctggggaaggaaatattgagagtatgctctcagttgagatgggtttgagggaacttgcttccttaaaggttgaggatgctgttgtgcttgcattagcccaacacagacggccaaattcggttcgacaatccgttttagattccaaatcacgtggtgatgccaaatattcagaagcatttgaattaagtgaagaggaagcagaagatgttcttttcaaagaggcatggttaacttatttctggagaagagctttgtttcatggtgtggaagaagatattgcagaagaacgccttcagttttggattgcccgcagtggacagtcaccaagttcacatgatgctgttgatgttgagcgaggcttgttggagttgaggaagctgagtatagaacagcaactttgggaagcatcacggaagggaattgatcagcttcaggggtcagcagatgctaatcataagcatgcctctgactctgatgcctcatcctga

SEQ ID NO: 46380 - DNA, 846 bp, Glycine max
  Peptide Sequence Number=SeqID_163158
atggagtatttatatagccaccatacacaccaataccataggcgaatgcgtgaactgtatcttgatagcgggtggcttccccatccctgctcagctccgaaaacgaaaactgcatctctctccaaagcttctgttgccgttgagcaacagactaaggtcgctctcatcagaattggtaccagaggaaggagacaaaatcctcacacaaccacagatgttcctacttacttgcctgataaaacaattctgccatgtaaccttccgcgagaggatgtcagagatgcatttatatccctgactgcagcttcattagctgatcttccccctgcaagtgttattggtactgcttcgttaagacgaaagtcacagatcctccacagatatccatctctaaatgtgcaggaaaatttccgtggcaatgtccaaacaaggttaagaaaactcaatgagggggttgtccaagctacactattagcattagctggactcaaacgcttaagtatgacagaaaatgtgacttcaatcctatcaattgatgatatgcttccagctgttgcccaaggtgctattggaatagcatgtagaagtgatgacgataaaatggcggaatacattgctacacttaatcatgaagaaacaagactagcagttgtctgtgagagggcctttcttcagactttggatgggtcttgccgcactcctattgcagggtatgcttgcagaaacgaggatggcaattgtttgtttagaggattagttgcttcccctgatggaacccgggtgctagagacatccagggttggtccatatgcagttgaagatatgattgaaatgggtgttcagtag

SEQ ID NO: 46381 - DNA, 2085 bp, Glycine max
  Peptide Sequence Number=SeqID_163159
atgggttcatgcgaagccacaaatgtggttctatcaaagattaaaaattttgatcctgaaaatgcctcaaaaatcatgggttatcttctcatgaaccttgaagagtctgaacttattcgtttggcttgtagtcccgaccctgtgcttcacactctcgttctgagggttaagaaccacttgagtggtctcactctctcctccacgaccccttcgtctccttcgcttcctccttctccccttaaccccacagcgagactcactgctatttcctcaaacccattttcaagaggaggaggacccaccaatggttttgacttcactagaaaccacccgtcttcgccttcctctcactctcatgcttggaacttcccaaacaacaaccccattagtccaaagtccactcctttattctcttacgataacatccgagccctctcaccccgtgtagtcaacgatgattgtggtgattttgttgacgagcagcaagtgaatgagtactttcccttcctcaatgactcctctaagaacgaagatttggtcgatccgcgactcgaatttggcgttggggctcaaaattggcactctggggactcacatttgcaacacagaaggagctactccgccagtgacgttggttttgggtgtgatgaagcagcagcagcagcccctggacttggatacaagccatgcctttactttgccagagggttttgtaaaaatggcaccaattgtaagtttcttcatggtgcttttactgattcactggatgccattgttggctcccctagtaagcagcttgaggggatggaacagcgagaggagtttgttaggttcaacaaggcaccacagcttcaaagaatagcctctggaccttctgcggccgcccgtgagaagtactttgagtttttgattcaggagtcccaaagggctgcagcagcattcataatgggggaagaattctacaattttggctgggataagccagaaaggaatgacttcctagccgcaatttccagcgaaaaatccaactctgcttcacaacagatttatctgacatttcctgccgaaagtacattcaaagatgaagatgtttccgagtacttcagcaaatttggacctgtacaagatgtgagaattccttatcagcaaaagcgaatgtttgggtttgttacctttgtctacccagagacagtgagactcatattatccaaagggaatcctcattttatctgtgattcacgtgtacttgtcaagccctacaaggagaagggaaaagtccctgacaagagacaacaacatcaacaacagcaattagagaggggagatctttcaccatgtttaagtccctctggctttggctctaaagaaccttatgatttccatcttggggcaaggatgttgtataatccacatgatgtcttattgagaagaaaaattgaggagcaggctgaattgcagcaagtccgtgaacttcaagaaagaaggctgaagaatctacagcttccagacttcaagaataatcccattcaccatcaccaacgcagtctttctgttggtattcctttggccttgccccatcaacttcatagtcatattaacgatgcaggtctttctcctgatagcattaaaggagatattacaggctacagtggcagcttctcgtctaccaattctttaggtattgcatctgaccagcagctgccactgaaagaagttgatccagcttgcattgatgactctgagaacgggaatttaaaggagagtggaaataccgaaggtgtagatctcagtaatagcattttgggggcggtcctcattttaatctgccctcgccgaggatatgtgcacttcatttcaaattttctgatattgtgttctttcatgatgctctcttggccctggagaagtgtcgagcaggcccttcctgatagtctcttcgcttcaccaacaaaagcaactggagattatcatgctgacttctctacattggcagaggtaaatgagagtgctgtattctcagctagctcatcttctgaggacaagctagaaccgacaacctcttctagtgacgtggcttcccattag

SEQ ID NO: 46382 - DNA, 1869 bp, Glycine max
  Peptide Sequence Number=SeqID_163160
atgtcattttcttcctcgagttgctgcaaaagaaaattggaggcagctgagctcagatggataaatcatggccaaccagcaggagcaaatgtagcagcaatagctgatgctgcttcaacaagagaagtagtatataccataaggtggatgaaaatcaaaaccatcatggaagaggcacttatggcaagaaagcaagctgctcctttgataccatctaaagggtgtagtttacctggattgagtgatgatcattctgaatgtctgttccttttaacaaaggaaggcactttggtagagagaagattgcatcaaagaaagtggaaatgggtagttcatggacgacaccaagatcaaaatttaacatgtattacaccagcgctacaagatgaatcaagtgaaacatcgtccacttctttattcttcactacatcattgggatctgtctttgaatatcgaattccaaaacaattaggccttgttccaaataatcaatttccaggagcatggaaaagttatcagcatcctctccatgcaaaagcagcaaaaggtatagctggcttgcaattgtacattggcaggatactgtttcctctagatgatggcagaattgcagaattacatccactaggacgcgacggtgaaagttcagggccatctccaccacaaaacatccgaaggaaagcatcaacaaaatacatttggtccgtattagatgtgccagagagtgaaggatggaatgcagaatattgcacagaagaacgtggcctcagaaattgtctcacaggcataaaagatgagtcagaggaatcattagtaagtttagtaacaggtaggagaaagcaaagccaaatacagaatcattatttatctgtaggcacttcaggtggtggtagactgatacaatcttcagaagaatacaatacaccagataactggattagtagtaactttctcctgcgattgatggatgtagggaagtcgttttttttaataacggatgatggtttgatttttgaatacattagtattgagagtgcatggatatggctgaggcatgagagttctacagctatgaaaggtgtatcgagtaactacaatggaagcttattcatggttgatacacaagggagtctgctccttagagaaagaagtggcaaggagttggcatggaggaattgcactgctgtgaggaaaggaagaaatgttattggaggtcaaccttgggatggattaccaggccaagaaaggaaggttacaactgaagatactctcttctttgtcagcaaaactggaagactaatgaagttaatgtataacaaagtgactgatttgtggcatgagcattaccattctcagcatttggttctatcacagtttactggaacagttataagaccatcattaaaaacactctcaggttccctcttcatggtttcaagagaaggtggcgttgttgagtttcaatggagctcatcgtatggatggaactgggtggaacatggaacacccaatagaggcgtaacacttgttggttcacctggtacaagctctgagggcaatcaattattattgataggctcagatggaaaagtataccttagatacatggacaaaatggcatggatgtggaaggattgtggttttccctatgtaggaaataagctggttgaagcacataaacacggaggattccagaaagagaaagtagattgtattgatgaagattctgcatcatacttgaagaaggaccaaggaaacttttgtgacctgaacattaaatgtgactcaaaggtggcttctacaagaccaattccattttctgaaggttctgtcatatttgagctcagagatggcagggttggaacttaa

SEQ ID NO: 46383 - DNA, 1194 bp, Glycine max
  Peptide Sequence Number=SeqID_163161
atggagcatgaccttgctgggctagcaactatacatggcttcaagttaactgaaccacagataaaatgttatatgcagcaactgcttcgtgggcttgaacactgccatagtcggggtgtgttgcaccgtgacatcaagggttcaaatcttctgattgacaacaacggaaatctcaagattggagattttggtctttcaatagtttgtgatcctgataaaaagcagccattgactagccgtgttgtgactctgtggtatagggcacctgagcttttgctaggtgctacagattatggggctgcaattgacatgtggagtgttggttgcattcttgccgaattgctggtggggaagccaatcatgcctggaagaacagaggtggaacaaatgcacaaaatttttaagctttgtggttcgccatctgaagactattggcagagaacaaaattaccccatgcaacaagttttaagcctcaacacccttacaaccgccaagtttccgaaacatttaaaaacttttctcccacggcattggctcttgttgatatgctccttacaatagaaccagaagatcgaggatcagcaacttctgcactcgagagtcagttcttcacgacaaaccccttaccttgtaatccctcaagtttacccaagttttcaccaaccaaggagtttgattctaagcgtcgcgaaaaggaagctacaaggaaaaatgcggaatctattaaaggacgtggaccagcttctgtttataggggagcagcagataccaaagtaatgggttcaccaaagtatattgctcggggagatatttctatgcggggcaagtcaaatactagaatgtcccatgttaaacatcaatcggaagaggatggtgggtctaacgacaatggtgaagcaaccatgataagtctacacaatgcctacacacagatgcagagcagtatggcaggaccatcctcattgaggaagaattcagaattaccgacacatcatgcagcggcagaattttctacctcttccgttaaaaaggaaccgggcatgtctgttcgtgaacctggggtgggttatatgccgaagaaaaataggatccactgctctggaccattgggtggcaacattgatgacatgcttaaagagcatgagcgattaatgcaagatgttttccgtagcgtaaaaaaaaacaatccgtga

SEQ ID NO: 46384 - DNA, 1383 bp, Glycine max
  Peptide Sequence Number=SeqID_163162
atggagcagcggttagcaaacacatggagaatgcctcttaacgacaagaaattcatagaaactgctctcctttccgacctccgactcgacggccgtcgcccctccgactaccgcaagctcaccgtcaagctggccaagcaagacggctccgcggaggttcatttgggccaaacccacgttatgaccttcgtcaccgcccaactcgtccgcccctaccgagaccgccccaacgagggctccctctccatcttcaccgagttctctcccatggccgacccctccttcgaccccggccgcccctccgacgccgccgtcgagctcggccgtgtcgtggaccgtggcctccgcgaaagccgtgccatcgacactgaatcgctctgcgtcctctccggcaaactcgtctgggccattcgcgtcgatatccacatactcgacaatgccggaaatctcgtcgacgctgcaaatatcgccgcgttggcttctctgttgactttccggcggccggaatgctcgttggccggagaagacgggcaggatgtggtggtgcatcctcccgaggagcgcgacccgattccgttgattattcatcatcttcccattgctgttacctttggatttttcagcaatgaaaatctcctcgtgatagatccgacgcaccatgaagagtgtgtgatgacaggccgcatgactgccacgcttaattcaaacggcgacgtttgtgcaattcaaaagcctgggggagagagtgtctctcatagcgttatcatgcactgcttgaaacttgctcatgttaaagctactgatattacaactaagattagggatgccgttgaaatacacaacaatgaaagggctttacggaagattaaacgccattcttcgtctgttgctgtggatgtatgtggggaaaaacaaaatcaattggatgctagtcatttggacaaattgaagctggaagaagaagaagaaagtcctatggaatgtgaagcctcaccatcaggacaagagcaaagtaaggatggagtctcaaagaatttcaccggtggtccctcgagttgggatccctactcagagtgtgtcaattcagatcttctaaaagcttctctagcttcacgcggaccgtcagttcctagtaaacaaaaggattcaagacgtgaaactaagcccaaggaaccaccactagaaattaagacagattctacaccaattaacaaggctctaactgctgggcagaataacaaagcacatttactggataaaagatcaaaagaactcttggaaaacaaattagtgagaaacacatgctcaccaagaaccacttatacagcacagcaggttgttcaatggaatcaacaagcttctgcaacaatggaagacaagtga

SEQ ID NO: 46385 - DNA, 348 bp, Glycine max
  Peptide Sequence Number=SeqID_163163
atgtcctttaggaaagtagaccacacgctcttcttctctaggcatcatcaccagaggacctacacacgtgtgccacaactccctgccgaggaggaggtcgaggttgcaaaggccgacatcagtgtcgatggcgaccacaaaaaagcccaggcaggcgagggagaggccgatgttggtggtcttgtccatgttgcccttactggaggtaatgacaatgatgcacgggatggagccggagagctcggttgggcttgcggttccactggaggagggcggtggggggtttgggggttagggttttggaggggaggagatgggaatgggggtggaggagaggaacgagcatga

SEQ ID NO: 46386 - DNA, 960 bp, Glycine max
  Peptide Sequence Number=SeqID_163164
atgggaagaccaccttgctgtgacaaaattgggattaagaaagggccttggactcctgaggaagacatcatcttggtctcttacattcaagaacacggacccgggaattggagatcggttcccactaatacaggtttgatgagatgcagcaaaagctgcagactcagatggaccaactatctccgacctggcatcaaacgagggaatttcaccgatcatgaagagaaaatgataatccacctccaagctcttttgggtaacagatgggctgctatagcttcctaccttccacaaaggacagacaatgacataaagaactattggaatacccatttgaagaagaagctgaagaagatgcaaagtgggggtgatgatgatgataataatgatgacaaattaaactcttgtaattcacaaataaagggtcaatgggaaagaagacttcaaacagatatccacatggccaaacaagccttgtgtgaggccctatccctcgacaaaccaacccaaattttcccagagaccaaattaccctccacttcttcacacaaccccacaacaacaccaaaccaaacatccttgtatgcatcaagcacagaaaacatagccaaattgttggagaattggatgaagaaatccccaaacatcacaacaataaccgaaacaaaacccttcaacattaataacatggtagccacagggtctagttcaagtgagggaacacaaagcacaatcacatgcacacaggaccatgcccttgactccttgtggagcttcaactctgaacgctcttgtcaatctgaagaaaacaccaacttgggtgagagcaagccacagtaccaagaggcgcaagttcctctcatgttgctggagaattggctcttagatgatgctgcacctcagtgcaatgaagatctaatgaacatgtcactcgaagaaagtacagaagggttgttctag

SEQ ID NO: 46387 - DNA, 1200 bp, Glycine max
  Peptide Sequence Number=SeqID_163165
atgactagaattcctgagtacgaccttgacattgaaagagcttgttgtaggaacaatgctgacacaagaaggacaaggattgctgaagcaaacactgaaataggtgtaatggaggcaatgaagcaaaaccatgagctaaggcatgggcgaatcaacatgattgagaggatgcagttccatggcctgccatctgaagaccatgttcttcatttgaagaaattcttgagactcatagatagaacaaggagcctagctaatgcttatgactacatcaaattggctacttttttgttgtcattagcagggaaggctgaagattggctctatgacttacgaaatcggaacattaccacttgggaccaatgcttaacgtactgcagaggagttgtccacaccatgggcactcaccataaagcttgtccactctttaatggaggactatcacaacataataggtcctgtttggatgctgctacagggggaaaccttatgcataagatgaataatgcaacaatgcacattattgaggccatggcttcccatggatataatgttactagcgacaagaggatcctaatgaggcctagggagttcaccagatacatgattttcaattgccccttttcccaagctttggaagaggtgaactatgctagtggaaggaacaataactatgagccttacaccaaccccttcaaccaaggtgctttgccttcacagactgagcccaaccccaaggaggacttgaaggtggtgagcatcaggagtgagaagccacatccagagtataagaagaagaagaaaatagcttctctagagaaggaaaaagaggttctcactgaacatcaaaggacaaggaagctcctattgagaggagttcagagacagggaaagaaaaggagacctattgtctatcccaatggtgtagttgaggatgtgttggttaaggtggacaagtttatctttcttgctgattttgtggtgctagacatgaaagaggataaggacgtcctgatcatattggggcatccattcatgaatactattgcaagagatcctactaatgctttggtggaagccttattcccaagtgtggaggtcaaggaccccttgaaaagagttcttattaatgaggacttggactgggatttgagtagtgatgaggaggaaatcgaggcaactcttaggctttgttcttaa

SEQ ID NO: 46388 - DNA, 186 bp, Glycine max
  Peptide Sequence Number=SeqID_163166
atggcattgtctgacaaaaataaacagcttcaattgcctgggaaccacattgaaaatcacctgcatcaaggccagcctaatctggggaattcttttctaagtggtataaaacagcgattgctttcattcatattccagggactatggaatgaagaaagagatgataccttggttatagccttatag

SEQ ID NO: 46389 - DNA, 393 bp, Glycine max
  Peptide Sequence Number=SeqID_163167
atgacaaatgtgttaatatttcatgctttcaagcctcaggtgtcccgaaatgctgatcaccacccagcttttgttgctgtatataacatggatacaactgaaattgtatcattttatcagaattcaccagacgagctttatctgttgtttgagcagttctgtgaccacttccatgcaacatcaaggaattcaatgtatatgaatttcatatcttctcattcaaataatatccacgcactggaacagctccggagcattaaagataaggcaagcagctctgcacagtttgtgaagaagatgcttgcctctttgcccttcagctgtcagtcacagagtccttctccttacttcgaccaatctcttttccggtttgatgataaggtttactattga

SEQ ID NO: 46390 - DNA, 243 bp, Glycine max
  Peptide Sequence Number=SeqID_163168
atgggaacaccttccagatcgatggacacaaagtcaagcattatgaggaggtattgcttcaagtgcactacattgtgcatcttcaggtgtgaagttttcctccatgtcacacatcaggctcaagacgttaaacaatcactccctaggggggcaacctatgggttctgtgggtctttaaagactcacatgtatccattatgggtcatagtgtctcagcacgggccatgctggttttcttgttaa

SEQ ID NO: 46391 - DNA, 552 bp, Glycine max
  Peptide Sequence Number=SeqID_163169
atgccttcttcaagttcaagccatgttgttggcgctgcttcttctgcataccgtggcgtccgtaagaggaaatgggggaagtgggtgtccgaaatccgcgagccaggaaccaagacaagaatctggctcgggagtttcgagactcccgagatggccgccgcagcgtacgacgtcgccgccttgcatttcaggggccgcgacgccaggctcaacttccctgagcttgccagcaccctgccgcgccccgtcagcaacaatgccgaccacatacgcatggcggcccacgaggccgctctcaggctccggacaaaccccgccgcgcccaacaccgttggctccgccggctccgtctccgccgcgccgctaaccgtgaggctctcccccactcagattcaggccatcaatgactcgcccatggactcaccacagacttggatgcaaatgccagacactttcatgatgcatgatcagtccatgatgttcgcaaacgggtattcctttgaggacaacgagtgggaggatatgcacaatgattctctctgggatccttag

SEQ ID NO: 46392 - DNA, 1911 bp, Glycine max
  Peptide Sequence Number=SeqID_163170
atgtttataattgtttccacaacttccacttgcttgcttttgaataactcagcttcttcacctttgcttctgtcttgttgtatcgattcagttaaatatggctcgtttgctcttcccaagtttgaaagaagaagaagaagcaaatggagagccgttgatgggagtggcgagaagcaatcagctgttaccgtagcagcaactaccacaagtacttttgatgatgataacgacgttgttgactcagcttcagctgtgttgaagaatttctatggaggaatcaatgcgcatgacgtggattctgtagagtaccttatcgctgagaattgtgtgtatgaagatcttgtctttccccgaccctttgttggtcgtaaggaaattctagagttcttcaaaaaattcactaattctaccagcaaagatctgcagtttgttattgatgatttgtctactgaggactcctcatctgttggggtgatatggcatttagggatcgaagtgaaacctggcaggccatgtccttatcacgctgacaatgtgcgagggaagcttcatgttactcaggctactctaggcattggctcatcatcggagaaaagcattcttcagtgctcttctggacacaaaagtccagttttcttgtgttcattgctaccagataaggttgagtcatgccctttgaatcttgagtttgacgcagatgacttagtggcattctcagttgttggttcacgaagcatccacctttctggaactgagtcagaggagtcatctgaatatgatagtgaagatggatatgctgatgactttattgttgatagtgataccgacatgtacccatcttcgccagtcccaaatagtggagttgtaattgaggagatagtggatgatgataaacctgaaaatggatatgatccaactaagaaattaaagaaaaagaaacaggtagctcaattgaaagagaaagacaacaaaagttctgggcttccaattgtcgctaagggtgatactgaccttgtggaaagtgaagacgaagacggctttccaattcccactgcagagaaaggggtgtctgtctctcagaaggcagaagcagaaacgaaaggagaacaagcacgtaagaaagcagagaaagccaagaaggaaaaagatgttgatcattctgctagcgtaaaacgaaaagttgatactgctgatgaagatgagccacaggatgggaaaaaaaagaagaaaagaaacaagttgaaagagcatattaaaggggaaagtgatcatgcaactggcaatagcaatgagacaaaaattactgaaccagatgaaaagcatcctgaggagattaaaactacaatcaacctgagtgatgtttctcatgcaaaggatgaagatgatggaaagctatccaataacgaggtccttgccgagaagaaaaacaagaagaaaaagaagaaaaagaccaaagagtctgaaggggaagttgctgcaaatcaaattactataactcctgaaaagcagaatttgtccacctcagagaaaaaggggcagaaacaaactgaaaccaagccatcccaagtgagaacttttccaaatggattgattatagaggaggtatttatgggtaaacccgatggcaaaaaagctgctcctggaaagaaggtcagtgttaaatatattggcaaactgcaaaaagatgggaaaatatttgactcaaatgtgggaagggcaccctttaaatttcgcctgggtgtaggacaagtcatcaaagggtgggaggttgggatcaatgggatgagaattggggacaaacgaaggatcacaattccaccgtctatgggatacgcagacaaacgcgttgggagtataccaccaaattcgtggcttgtatttgatgtcgagttggttgatgttgatcgctga

SEQ ID NO: 46393 - DNA, 1233 bp, Glycine max
  Peptide Sequence Number=SeqID_163171
atgccgctactctccaattcctcgccctgctgcaccgccgccgcagtggttaactcctcggaccggaagcccggattcgtctctccttcatggaggaactgcaaggtcacatctccaattcttcgcctctctcagaatgacaaattcaatgtgtctcggttagctcttagccactctaggcggaccatatcaatggcattggtgggagaaactgttggagttggacagaaggggcaggtggccagctcctctggcatcttggcatatgatttgattcagggggcacttgtaaggtggagttctgttatggacagatctttacctgagccaccaacggctgtttttctgcatgggatcctaggttgcaggaaaaactggggaacttttgctaggagattggctcaagagtttcctacatggcagtttcttttagtagacctgcgatgtcatggcgattcagcatcaatcaagaagagagatccccatactgttgcatctgctgctatggatgttttgaaactggttcgagagctaagaataacacctcgtgtgttagttggtcatagttttggggggaaagttgttttgagcatggtggaccaagctgcaaagccacttgctcggccagtgagagcttgggttctggatgcaacccctggaaaagttcgagcaggtggagatggagaagatcatccagcagaactcatatcctttctaagtacactgccaaatgagggtttagggattattagagatatgagaatgaggatgagtgtgagaaacattgtcttgaaggttccttcaaaatgggatgttctcagagctcttattcaacaaggattttccaatgatgtggcacagtgggttgtgactaacctgcgaccttccagctctcctggttcacaatcatcaagcttctcatgggtgtttgacctaagggggattgcagaaataaattacattgttagtgtatttactgatgccaggaaaattgttgaagatgtacctcgtggggtgcatgtgaactttttgaaagcagaaagaagcttacatagatgggctcttgaagatcttcagcggatccatgcagctgaagagcttgctgttgaggaaggaggtggagttgaaatgcatgtccttgaagatgctggccactgggtgcatactgataacccggatggactcttcaggatactgtcatcatctttccaattccagggaggcaagatctga

SEQ ID NO: 46394 - DNA, 282 bp, Glycine max
  Peptide Sequence Number=SeqID_163172
atgaaaaagaccaccagcgccgtccattgcgacgccaccaaatggatcggctgctggttgttggagcaaactggcaggctcttggttgtgcttgggttgatgttggcagtgaatcctcatgcctctgagatttaccccttgatggatggatcagatgagctaatgaaagatgttggttattttgttattacaatcccttgtttgtggcctaaaaagcataaacttgctacagttgccagatcaagcagaaaaattgaactctgcacactaaaattatcatga

SEQ ID NO: 46395 - DNA, 165 bp, Glycine max
  Peptide Sequence Number=SeqID_163173
atgactaatgcaacaatgaaaattattgaggccatggtttcaaatgcctataatggtattagagatggagaccttgatgaaggcacaaattcagatgatgacaaatgttcctccaccccttgtttgcaactagtgtggggagacatgtcatacatgaggagataa

SEQ ID NO: 46396 - DNA, 174 bp, Glycine max
  Peptide Sequence Number=SeqID_163174
atggagatggtgatggtgacaaagatggctaacaagctacccactgatggtggccctgttatggtggtgactgctaaggggtggttgacacctgcgttgaacaacagacatcctcgggacaccttgtcccttttgctggaacctgcaactgggaagagcccccatgacctgcac

SEQ ID NO: 46397 - DNA, 1512 bp, Glycine max
  Peptide Sequence Number=SeqID_163175
atggtgggaatcacgtccaatattctacttcctaacttgggggagcaaaactaccaactgaggcatgggctgatcaacttgattgagaggatgcagttccatggccttccatctgaagacaatgttcttcatttgaagaaattcttgagactcacagatacaatgaggatcctaaccaatgctcttgactacatcagattgacttcttttttgttctcattggtggggaaagctgaagattggctctgtgacttgccaaatcagagcattaccacttgggaccagggaaacctcaagcataagatgactaatgtagcagtggacattattaaggccatggcctccaatgcctataatggtactagtgataaaaggttcctaaagaggtctatgggactttaccaggtagaggtcaactcatccagcttagcttttaaccaaaagttggatattttgactaagttgatggagacattgataaggcttaaactcagaggggacaggcaaggactaggtaggaggagaagagacccctcattgaagggcatgatgatagagcacccgactaagagtgatgagaggttcaaaaccttagaatccatagtgtcaaaccttgttactcttatgtcccaaagatctgaagagaaggaaaataaggctctcactgaagaaagtctagcaaaggacaaaaaagctcctattgagagaagtttagagacagggaaagaaaaggaggtactaacacctcctcaaggagaagttgaggatgtgttggttaaggtagacaaattcatctttccaactgattttgtggtgctagacatggaggaggatgaggacatcccgatcatattggggcgtccattcatgaatacttgtgacacagtcatagaagttaggcaaggaaagctcactctaaggatgggaagagatcccattgatgctttggtgaaagcctcattcccaagtgtggaaatgggcaaccccctagaaagagttcttattgatgatgacttggatttgagcagtgatgaagagtatataatgatgttcctccaagctcagagtaacgccaaactgacgagaaatcaaaggtttgaagagttgaaaagacgtagtgggtcaaagtctaatcccttcattaagaaacctcctatgttggagttgaagtcgcttccttccaacttaaaatatgagatagaagaggaggaacttttgagggtcttacgagacaacaatgaggcctttgggtggaccatccatgaaatcaagggtattgaccttataatgtgcacccattggattcacatggagaaaggaaaggaacccaagcatttacctgggaggagaatcaactgcaacattatggaggctgtgaagggaaaagtgttgaaactgttggatgcagacatcatctaccccatctttgacggtgaatgggtaagtccagtccaatgtgtccctaagaagggagcactattgtcatggagaatgactagaaaaagctcatag

SEQ ID NO: 46398 - DNA, 297 bp, Glycine max
  Peptide Sequence Number=SeqID_163176
atggatcaagaaacagcaacaacatgcaccatgcaagagtgtcatgtgatagccccaacaacaacaacaacaacatcatcgtatcgtggggttcggcagcgaaacccgaagatgccacgtccaacgagttcgaaacccgaagatatccaagtggcagcacaacaagcagcgttgatgttcaaaagactgagagtgggactctccgccacaaaaattcaggccatcaatgagtgcccattggactcaccaaagatgtggatgatgcaaaatggcagaagcactcaggtttgggtttga

SEQ ID NO: 46399 - DNA, 180 bp, Glycine max
  Peptide Sequence Number=SeqID_163177
atgtcacataaagcaagggtagagctatcggaaggagtgcatgctgagatcaatgagatggtggtgagattgaggccaaaaaagaagttgatggatgagaaaagaaagaaaaaaatggaggaaactgctcaatccgaaagcactgacaccatcgttgatcctccatctcctattaaatga

SEQ ID NO: 46400 - DNA, 519 bp, Glycine max
  Peptide Sequence Number=SeqID_163178
atggattcttcttcacacatggcttcgcttccggaagatatcatcaccgacgagcatttacaacagcaaactcaacccgcctcagcctctgctttcgcttccgttcctcagcgcccgccaactaagagctcttcagaaaaatatgcacctttagattggtccgtgtattttgacaaagaagacgatgttgcaattcccgaatcgaacgatgtttttcatgtttacacggcaggaactgagggtcccgttgtattctgtttacacggtggtggttattctggtcagaagacctgcaagctatatgagactgagtgttgggtggtaaagaggcaacaagaaacaagtaaaattaaggagaaagctagggtagttgcaatggacttgagaggtcatgggaaatcattgacagaagatgatcttgacttatctgttgagactatgtgcaatgatgtattggctgttataaaggaattatatagcgactctcctccagccatcattcttgttggtcacaggtga

SEQ ID NO: 46401 - DNA, 3096 bp, Glycine max
  Peptide Sequence Number=SeqID_163179
atggatattcactccgttttctgctctatgcaaatttcactatcatacaatcgtggtaaccctcttctacgcttctctcgtgcaattgttatccaatgtagtaaaaaacacaactttctcaagtcccccaatcgctgggtccgaaacaagggtgtcaaagatgtgggctcagaatttgatagcaaaaccaaaagcataaaaacaacgctttttaggagtcctgatattggggaaaatgaagaactttccagtaatttgtgcagccaattaatttgtgaatgttgcaaagaaggagacttggatagagctatgtctcttctctctcaaatggaagctaaggggtttcacctcagttcaacatcttatgcttgtcttattgaagcccttggaaatgttggaaggacttcagaggctgatatgttgtttaaggaaatggtttgttatggctataaacccaaattgaatttgtaccacagtttgcttagagggtttttgaagaaaggtttgttaggacttgcaaatggggtcttgaaggaaatggatgacttgggcatatggaggagtaaagagacatatcagatctttctggattactatgttggtgctggtaggttggaagatacttggtcaacaatcaatgagatgaagcaaaaggggtttccactcaactcatttatgtatagcaaggttgttgggatttatagggacaatgggatgtggaagaaagcaatagaggttttggaagagattagggagagggggatttctttagacactcatatttgtaacagtattattgatacctttggcaaatatggcgaattagatgaggcgttgaaattgttcaagaaaatgcaaaaagaaggtgtgaggccaaacatagtgacatggaattcactgattaagtggcactgcaaagaaggtgatttcatgaaagcctttcatttgtttactgatatgcaagagcaaggattatatccggaccctaagatctttgtcaccatcattagctgcttgggggagcaggggaagtgggacataataaagaaatattttgaaagcatgaaaatccggggaaacaaagaatatggggcagtttatgctgttttggttgatatttatggacaatatgggaaatttcagaatgctggggagtgtgtacaagcactaaagtccgaaggtgtgctagtttcaccaagcattttttgtgtgttagcaaatgcttatgctcagcagggcttgtgtgaacaggtcattatggtgctgcagattatggaagcagagggaattgaaccaaatattgtcatgctcaatatgttaatcaatgcatttggtaatgctggaagatatatggaagcaatatctgtttatcatcatataaaagaaagtggtgttagccctgatgtggtcacctacactacacttatgaaggcatttataagggccaaaaagttcgatgaggttcccattatttacaaggaaatggagaatgatggatgcactcctgatagaaaagctagacagatgttacaagttgctttaacgctttatactgtttgtgttattggatttgatgatatgtgctggtttgctggagagcagtttgaagaaaggaaattgaggttttctagaatgtcctcccttcttaaggaggtaaatctccatcatgggtgtggcagtctccttaaagggagaaagctcattgatcatgatagattgataataaagactagaatgttattggctgcaaaagatgcaatgacatgccagcttttgattgaatatgggatcctcagacaaattagtctgacaatttcaagaccaaggaaagtcaagttagctcaggataccccgggggtattgatcatcgtgttaatcaaggaatcagttgtgctttgctatccaagcaagcactctggttttggtggaggttatgctcagacaccggatgatgcgtggaccatgttcaagtcaatggagtttcaaaatcttgtatcttggaattcagtgattgcagtgataactgcattgataaaatcctatgcaaatcttggaggacacatttccggctgttatagaatattccatgatacaggtagccaaccggatattgtgtcatggactgctcttatttctgcgtttgcagaacaggatcctgagcaggctttcctccttttttgccaacttcatcgtcaaagttatttgccagactggtatacattctctattgctttaaaagcaagcacatacttcgctactgagcaacgtgccatggatattcactcacaagtaattaaagaagggtttcaggaagatactgttctctgtaatgccttgatacatgcttatgcgtggtgtggctccttagctttgtcgaaacaagtattcaatgaaatgggctgccgtgatttggtttcttggaattcaatgctcaaatcttatgccatacatggtcaaactaaagatgcagtggagctcttccagcgaatgaatgtctgtacagattctgcaacctttgtcgtgcttctctcagcttgcagtcatgttggatttgttgacgaaggagtgaaattgtttaactgtatgtctgatgatcatggtgttgttcctcaactagatcactattcctgcatggttgacctttatggaggagctgggaagatatttgaggctgaggagttaatacgtaaaatgccaatgaaacctgattctgtgatttggagttcattacttggatcttgccggaagcatggcaagactcccttggccaaatcagcagctgataaatttaaagaattagaccaaacaattcattgggatatgttcatgaatttggctctggtggtcaatatcatccaaacacgggcaatgttaagccggcttgagatagtgattggacaactgaaagagatgggttatgtgccagagcttagcttagccttgtatgacacggaagtggagcacaaagaagaccaattgcttcatcacagtaagaagatggcattgcgcactaccttcatacctcaactaggtctatacctgctagaggattctttgggtctacctgctttagttgaggaagcacacaagttctag

SEQ ID NO: 46402 - DNA, 393 bp, Glycine max
  Peptide Sequence Number=SeqID_163180
atgaagaaccaacacggttatgtgccacctgcttacatacctttggggccgtcggattcagaggcagtggatgtctctctgcttcagcgttctagtaccaatggatcaaaccaaatgcaggctcagtggtcttctggaatctgtgcttgttgcgatgatatgcagagttgtatgctacttccttaccctggtgccttggcgcaatggggtaaaggttgttgtcttatgacttatgagtcactggctcaaatcctaaaaacaatctttctacctgtgggagggaagcaccctgtggggattttgttacccatttttgctgccatccttgtgccatttgtcaagagtaccgtgagatacgtgaaagatctggggattgtgaagccacagacttga

SEQ ID NO: 46403 - DNA, 4464 bp, Glycine max
  Peptide Sequence Number=SeqID_163181
atgtctgtccctgtccctgtctctgtctctgtctctggttcagggttacttagttttccttcaattcagcgaccacattccaaccctccacccaaacacgccgcacttccttccacttcccctgaacccgacactgatactaattcctcttcagaacccaacaccgttaaacccgtcaagttcatctacaccagagcatcgccttcaataagatggccccacctcaaactctcccaaacctacccttccacgcaaccccactttccccaaaacgacattttcccctccaaaactccaccttccgagtccccagaagaagaatccccaaaacctgttgtaaacgacgacgacgacgacgaagcccaagaagccttagggagacgcagcaagacaagggttaaaaaaatgaacaaattggcactgaaaagggacaagaattggagggaaagagtgaagtacttaacggacaccattctggcgttgaagtcggaggagttcgtggcgggtgtgttggaagaacgcagagttcagatgacacctaccgatttctgctttgtggtcaaatgggtgggtcaacaaaactggcaacgcgcgcttgaactctacgagtgcttgaatttgcggcactggtatgcacccaatgccagaatggttgcaaccatcttgggtgtgttgggaaaggccaatcaagaagcacttgctgttgaaatcttcgccagggctgagtcaagtgtaggggacacggttcaagtctacaatgccatgatgggtgtgtatgcccgcaatggtcgcttcagtaaggtaaaggagctgcttgatttaatgcgtgagagagggtgtgtgcctgaccttgtcagtttcaatactttgattaatgcaaggatgaagagtggcgcaatggagcctaatttggctcttcagctgttgaatgaagtgaggaggtccgggattaggccggatataataacttacaatacccttataagtgcttgctctagggaatccaatttggaggaggcagttgcggttttcagtgatatggagtctcaccggtgtcagccggacctgtggacttacaatgctatgatttcagtgtatggtagatgtgcgcgtgctaggaaagccgaggagctgtttaaagaattggagtctaaagggttttttcctgatgctgtgacttataattctctcttgtatgctttttctagagaagggaacacggaaaaagtaagggatatttgtgaagagatggtgaaaagggggtttggccaggatgagatgacatacaacactatcatacacatgtatgggaagcaaggccggcatgatcaggcaatgcagatttatagagacatgaagtcttctggtaggaatcctgatgcggttacgtatactgttttgatagattcacttggaaaagcaagtaaggttgaggaagctgcaaatgtgatgtcggaaatgctggatgcaggagtcaagcccactttgcacacgtatagtgctttgatttgtgcttatgcaaaggctggaaagcgagaagaggctgaagagacatttaattgcatgcgtagatcagggatcaaacctgatcgtctggcgtactcagttatgttggatttctttctgagattcaatgagatgaaaaaggctatggggttgtatcatgaaatgattcgtgaaggtttcacgccagataatggtctctatgaggtcatgatgcatgcacttgtgagggaaaacatgtgggatgttgttgacagaattattagagatatggaagaactgagtggtatgaatccacaagttatttcgtcggttcttgttaaggggggatgttatgatcatgctgctaaaatgttgaaagttgccatcagcaatggctatgaattggatcatgaaatttttttatcgatcatgagttcttatagctcatctgctagatattcagaagcatgtgaacttcttgaattctcgagagaacatgctccaaatgatattcaaatgatcacagaagcactcatcattatactttgtaaggctaaaaagttagatgcagccttggaggaatacagaagtaaaggagaacttggtcaatttagaagttgtacaatgtatgaatctcttattcaggaatgtatacagaatgaactcttcgatgtagcttctcagattttctctgacatgagattcaatggtgttgagtcatctgaatgtctgtaccaaggtatggtgtcagtctactgtagaatggacttacctgagacagcccaccatttgttgtatcatgcagagaaaaatggtattattcttgataatgatatatctgtttacattgatatcgttgaaacatatgggaagttaaagatatggcaaaaggcagaaagcttagtggggagtctcaggcaaagatgttcaaaaatggataggaaggtgtggaatgctctaatacatgcttatgcattcagtggttgttacgaacgagctagagctatttttaacacaatgatgagagatggcccttctccaactgtagattccgtaaatggtctattacaggctttaattgttgacaggagactgaatgagctttatgttgtaatccaggaattgcaagacatgggattaaagattagtaaaagttctattcttttgacgcttgaagcatttgctcaggcagggaacttatttgaggtacagaaaatatacaatggaatgaaagctgctggttattttcctaccatgcatgtttacagaattatgcttagattgctgtgtaaatgcaaaagagtaagggatgtagaaacaatgttatgtgagatggaagaggcaggatttcagcccgatcttcaaatttgcaattctatacttaaattatatttaggtattgaagattttaaaagcatgggtatcatttaccagaagattcaagatgctagtcttaaaccagatgaagaaacatataatacattaattataatgtactgcagagaccgtagaccggaagaaggtttttcattgatgaataaaatgagaagccttggtctggagcctaagctggacacatacagaagcttgatcacagcatttaataagcaacgcatgtacgaacaggctgaggaactttttgaagagcttagatcaaatggttataaactggaccgtgctttttatcatttaatgatgaaaacgtatagaacttctggggatcatcggaaagctgaaaatctactggccataatgaaagaatcagggatagagcccactatttccaccatgcatttgcttatggtttcttacggtaaatctgggcagcctgaggaagccgagaatgtccttaaaaacttgagaacaactggagtggttctggatacattaccttatagctctgttattgatgcgtatctcaaaaaaggagattttaaagctggaattgaaaaactcacagagatgaaggaagcaggcatagaaccagaccatcgaatatggacatgctttatcagagctgcaaccttgtctgagggaacaaatgaagccattgttcttttaaatgcactccaagatgctggatttgatctaccgatcaggcttctaaaagaaaaatctgagtcactagtttcagaagttgaccaatgtctggagagactggaacctgtggaagacaatgcagcctttaaccttgtcaatgctttggtggatctcttgtgggcatttgaactccgggctactgcatcatgggttttccaattagcaatcaaaagaagcatttatcgccatgatatttttagagttgctgataaggactggggggctgattttagaaaactatctgctggttcagctcttgttggtcttacgttatggcttgaccacatgcaggatgcctccttgcagggttatccagagtcaccaaaatcagttgtacttataacgggaacagcagagtataacatggtatctcttgacagcacattgaaggcatgcctttgggaaatgggatcgccttttcttccttgtaagacacgacaaggcatccttgtggccaaggctcactctctcaggatgtggctaaaagactccccattttgcttggatctggagttaaaagatgctcctagtctccccgagttaaattcgatgcggcttatagaagggtgcttcataaggcgtggccttgttccagcattcaaggaaattactgagaaacttgagatagtgagtcccaagaaattttccaaattggctttattaccagatgatcagagaagtaaaaccattcaagcttataaggagggaaggaaagagaaattggaaaaaagcaagaaagttgttgaccccaaacggctgaagaagatcaggatgatcaggaagctcaagagaaggaagtattttcgggaacaggccattccaaatgcaattgggaaacagaagactttcaaaccacttggtgccgaacgagcaccgtaa

SEQ ID NO: 46404 - DNA, 285 bp, Glycine max
  Peptide Sequence Number=SeqID_163182
atgatatgtaaactatacaagtggaggggagcatacagtagcggctcagtgtacgacaagaaccctgatgatgagatccagtctgggcaggtcccagacgatgtgatccaggcggcaacacaatccggcaaatactgggccccacatccacagactggggtatttgggccccccggaggaggtgaccaaactgcttctgccattcactctgatgcgctggaggagaaggcctggtttcgccccaccagtctcgaggatttcgagaagcctcacacccttccttaa

SEQ ID NO: 46405 - DNA, 537 bp, Glycine max
  Peptide Sequence Number=SeqID_163183
atggcccagatcatcgaggagttcatcgatggttgggagaggaaagctatctttaataatgattgtgttcagagcacagtcgagatagcaaaagtagggcaggtgtttggaaaaggtgggagtgcttgtcaagaaggccacataatggaggtggatgaacgagggtaccagaagcaactggaccatgttcttggagttggatgtggaatagggtcgctacccgctgtgtggttatcagacgctgtacttggccgtgatgaatctcagatgggtctgcctaaaagtttgagtcaggccacacccaacactatatcagctccgcctaatcctattacatacaaatctaggtcaaacatgtggctcggaatcgaaactgcaacatcatggcaaaccttgtcgcaagtgattttggtgtcgttgcccaccatgacagccagaggaggaatgggttgcgtcaccaagtggaggaagtgggccaaacaatcatggacaaaattgtgcatgttgctgctgtccacgagaataacgacctcgtga

SEQ ID NO: 46406 - DNA, 465 bp, Glycine max
  Peptide Sequence Number=SeqID_163184
atggtaagaggggcttgggaagtaacacctcttcttgttactcttggtttcttgttggaggtggtagaagtcaagccagatcagctaagcgaggcttacccgcttagtgaggaagccagctcgcctagcgagagaagaaccctagagaatgtaaagtcagagagcagcgtgctaagggatgaagggattcccgtgattaatccaaatgtgctccttatagagaaggagattatccctgatcagctaagcgaggctaacccgcttagtgaggaagccagctcgcctagcgagaaaagaaacctagagaatatacagtcagagagcagcgtgctaagggatgaagggattcccgtgattaatccaaatgtgctccttatagagaaggagattatccctggtgttgaactcagggcattgcaggggatcatcgcgaacacgattcatgagggctttgaattcctttga

SEQ ID NO: 46407 - DNA, 330 bp, Glycine max
  Peptide Sequence Number=SeqID_163185
atgagtttgaagatagaaatagtgatggacatcatagtcgatcctgagcaggcgatggtggtggagattgagaaggtggtgataaggatagtggaggtggtggtgttggggataagttcagaggagcagggcttgaactggtggagtactatagttgcattagatacatcaggggtttcgtccatgacacaagtgttggtaagatcaatgatgaccccaagtacaatggtgtcatccatagctttagtagatgcttcaacttggactgaggcaatgtctttttttatagcagcaacaacaacttcttcttatgccttcctcttttgttga

SEQ ID NO: 46408 - DNA, 264 bp, Glycine max
  Peptide Sequence Number=SeqID_163186
atggtcaactttgtcgcctttgccaatcacaacaacttcaccgtctaccacctattccagtgtcgcgacgacctcaccaataatcaatgttctctttgcatgtcacatgcgatcacccaactcaacaacatctacttcatctcttatgacaacacgttgcagttcgacaatggtttcatcaaggcttcacattggtccacggtacaaagagacaataaagtgagaggtgcggaattccgatatgcaacaaagctagtaacctag

SEQ ID NO: 46409 - DNA, 1293 bp, Glycine max
  Peptide Sequence Number=SeqID_163187
atggtcgtttatttttatccatgccttgttgcgacaatcatttgtttcatgcttcttccttttttacacatctcagccactgaaggcaacgatgtgggattcagcgttaacctgattcgaaaaaactcttcccatcatggccatgtcctccctgctctacgtcgtctaatggagatggagttatcagctatggaaaaaactgtctctccacaatccccaatatatgcttacctaggtcattatctcatggaggtctctattggaactccaccattcaaaatctatggcattgcggacacgggcagtgatctcacatggacctcatgtgtgccatgtaacaagtgctacaagcaacgtaaccccattttcgatcctcaaaagtccacctcgtataggaacatatcatgcgactcaaagctatgtcataaactggacacaggcgtgtgttctcctcagaagcattgcaactacacctatgcctatgcatctgctgcaataacacaaggcgttttggcgcaggaaacaatcacactcagctcaaccaaaggggaaagtgttcctctcaagggcatcgtgtttggttgtggacacaacaacacgggtggtttcaatgatcgtgagatgggtatcataggcttaggaggagggccagtgtcattcatttctcaaataggttcttcttttggagggaagaggttttcacaatgcttggtcccattccacactgatgttagtgtttctagcaaaatgagtttaggtaaagggagtgaagtgtcagggaaaggagtggtttctacacctttggttgctaagcaagacaagaccccttattttgttaccttactaggcattagtgtgggaaatacgtatttgcattttaatggttcttcatcacaaagtgttgaaaagggtaacgtgttccttgattcaggaacacccccaactattttaccgacccaattgtatgatcgattggtggctcaagtgagaagcgaggttgcgatgaaacccgttacgaatgacctggatttgggtccccaactttgctatcgaacgaagaataatcttcgtgggcctgtgctaacagcccattttgaagggggagatgtaaaattgttgcctacacaaacctttgtttcaccaaaagatggtgttttctgcttggggtttactaatactagtagtgatgggggtgtttatggtaactttgcgcaatcaaattacttgattgggtttgatctagatagacaagtggtgtctttcaagccaatggattgcaccaaacataaatag

SEQ ID NO: 46410 - DNA, 366 bp, Glycine max
  Peptide Sequence Number=SeqID_163188
atgaaacaatataatgtgcacacgtcttggactaagtcagttgttttgcatactcatggcattcctcataattgcttttcccctatatgcatcactaaagatggtgggtttttgggatcaaatatcatagggacattagagaaacttaatgacaaaggagagctgcttgaggatctcccttatggtcgagctccaaggttgtataaagacaatctacaagttgctacgtatatagagagtctactgacagcgagtgtcatcgatggaaacaaggaaaatcagggtatccattcttcatcgtgcattatggaaaatccgaaaactagtgtctgttatagtggtgatatcaggaaagctggattatga

SEQ ID NO: 46411 - DNA, 357 bp, Glycine max
  Peptide Sequence Number=SeqID_163189
atgggggagatttatccaggattatctcgatttttaaaattaaccaacattaaacactcacttaattctcccttctacaaatcaaataaacttcatatgcatagacctggctcattttaccaagttcccaagaaatcatatgcctcaaatggtcccttcacgagagtgacatccaacaatggtgactatctcatgaagctcacattgggaacaccaccagtggacgtgtatggtttggttgatacagacagtgatcttgtgtgggcacaatgtacaccttgtcagggttgttataagcagaaaaatccaatgtttgaccctctaaaggtccaaaacatatgctcctattccatgtga

SEQ ID NO: 46412 - DNA, 804 bp, Glycine max
  Peptide Sequence Number=SeqID_163190
atgtcagcggtggttgctggttcctcctcttcattctctgccaccttcactaccagaaggagcccctccttaaaaaactctcaactctctcattccaagacactaacttctcctcaatgccagaagacatctttacaaggcctctcacttcatgaagccaaaaggggtgtttcagaatccttcctagttgagaacaagaatggttcctccattgctggaaggagacttgagatcaaagcaagaactgctggggcctcaaagacaattgaggtggaggttgacaagccacttggcctcaccttaggccaaaagtctggtggtggtgttgtcatcactgctgttgatggtggtgggaatgcagcaagagcagggttaaaggcaggggaccaagtcctttacactagcagtttctttggggatgaattgtggcctgcggataagcttggatttactaaaaccgccatccaagcaaagccagactctgtctactttgtcgtcagcaggctaaagatgatattatgtccattttacaatcaattgttgattaagtgcacttccatgcaggcgagagctactcacatttgccttgattgtggatacatatacaccttacagaaatcttttgatgagcagccggacacatacgggtgtcctcaatgtcaagcaccaaagaagaggtttgctcggtatgatgttaacactggaaaagctattggtgggggcttgcctccaattggagttattattggactcctggctggagtaggggcagttggggctttgcttgtttatggtcttcagtaa

SEQ ID NO: 46413 - DNA, 1779 bp, Glycine max
  Peptide Sequence Number=SeqID_163191
atgtcagtcggggattccaacccgcgacctctcctccctcatttatcccttcacccttcctcaactactggaccaagcttatatctccctgtaaaaagcccatcttgtcctgggggtgtagcaagtttggctcgggtagacatgcacattggaatgatggtgatgatgactcaagcattgaagaccattgtgtcatcctatcatgactatgacaagaattcccgtctatgtcctttgcctatcagtcgatccagaagccgtcagtggcgccaatgccgcattggaacctttgctgtagccatagcagcacttcttatatctaccactgcttggctttccgttgtcttctctgatgcaactacctgttgctttcatcacttaaaggattgggaaagtagcccccactttttcaattggaagaagtgcatctctcatcgccttgcgaaagtaaaacctccaccagctctccaatttgagaccatgaatgatcatcttcataatggtagcagtattgttgaagaggaaggcttgtcacttaaacatattgtttttggcatagcaggatcatctcagctttggaaacggaggaaggaatatgtcaaactgtggtggcgtcctaatgacatgcgtggccatgtgtggttagaggaacaagtgcttgaagaacctggagatgatttattgccccctatcatgatttctgaagacacctcatatttccgctacactaatcccgttggtcacccttctggcctccggatttctcgcattgtgagagagagcttttgcctaggcctctctgatgtgcgctggtttgttctctgtgatgatgataccatcttcaacgtgaataacctagttgatgttctcagcaagtataattcttctgaaatgatttacatagggagcccctcagagagccattcggcaaatacctattttagtcattcaatggcctttggtggtagtgggattgcaataagttatccacttgcaaaggctctctctgagattcttgacgaatgcattgagcgatatcccaagctttatggtagtgatgatcgactgcatgcctgcatcactgaacttggcattccactgacatgtgagcacggttttcaccagtgggacataagaggtgacgctcatggtcttctatcctctcacccaatagcaccatttgtatcaattcatcatgttgaagctgttaattccttttatcctggcctgagctctttggacagcctgaaactttttacaaaggccatgaaagccgatcccaaaagctttttgcagcgttcaatatgttacgaccatgcacggcatctaacattttcggtgtcacttggttatgtcgttcaagtcctgcctaacattgtttttcctcgagaactggagcgctctgaaagaacttactctgcttggaatggtattagtcaaacaaatgaatttgatttcgatgccagggaaccatacaaatctgtttgtaaagggcccactcgattcttcttgaaagatactggaagagagggtaatgcttcttggggttcatatgttcggggtagagataaagatgatttcaaaaagagaattttatgctttcctctcctcccccctctgcgcaatgtgggagagatccgggtagcagtgcaacctttgagcaagaattggcatcaggttccacgacgtctctgttgccgacaaagccaagctggcaaagaaatactccaaatctcagttggagagtgtgggaagggaacttttagttctgtctattga

SEQ ID NO: 46414 - DNA, 507 bp, Glycine max
  Peptide Sequence Number=SeqID_163192
atgggtaacctttatgggagcaaaaggttctctcagtgcctggttccttttcatgcagaccctcacacttcaggtaccattagtcttggtgaagccagtgatgtttcaggtgaaggagtagtcacaactcctttggtctctgaagaaggtacaccagaaacatatttaccacaagaattttatgaccgactagtggaggaattgaaggtgcagattaacctaccacccattcatgttgaccctgacttgggcacacaactttgttacaaaagtgagacaaatttggaagggccaatcttgactgctcattttgagggggcagatgtgaaattgctgccattacaaaccttcatcccaccaaaagatggtgtattttgctttgcaatgactggcactactgatggcttatatatatttggtaattttgctcaatcaaatgttttgattgggtttgatttagataaaaggattgttttttttaagccaactgatttcaccaaaccgtag

SEQ ID NO: 46415 - DNA, 429 bp, Glycine max
  Peptide Sequence Number=SeqID_163193
atgggagcttataacttcggtgatgtttcaggtgaaggagtagccacaactcctttggtctctgaacaagtcacaccagcaacatatttaccacaagaattttatgaccgactagtggaagaattgaaggtgcagagtaacatgttacccattcatgatgaccctgacttgggcacacaattttgttacagaagtgagacaaacttggaagggccaatcttgactgcacattttgagggggcagatgtgcaattgatgccaattcaaaccttcatccctccaaaagatggagtattttgctttgcaatggctggcactactgatggagaatatatatttggcaattttgctcaatcaaatgttttgattggatttgatttagatagaaggactgtttcctataaggcaactgattgcactaatcggtag

SEQ ID NO: 46416 - DNA, 540 bp, Glycine max
  Peptide Sequence Number=SeqID_163194
atggcagaggaatgtcttactggtgtctccattgttaattacacaaagtgcaccatccacatatacaagcgagacacaataatttcctttaatgatgaagattggcagggcgtaatatcaaatctaagacccagtgacaatgtggagatttttgtagttcttggtcatggattgacggttgtgaagacagctctctatctaatatatgatgatgagtcaatcactgtgaaaatggagccatcacctaatgtgataatggagtcatcgtctaacatgaaaacagatccatcacctaatgttaaaatggagccattatctaacatgaaatcagagccatccatgaagccaaagaaaaatatttttgctagacttatacagagaatgggagaatgtacatgcatgagggttcggagatgctcgtccgtctacggatgggagaaagagatgatctcgactaggagtcagagggaatctagcggatcttttctaagccaggaagatgcctctgctgaagtagcaagtattggggtttcaaactga

SEQ ID NO: 46417 - DNA, 198 bp, Glycine max
  Peptide Sequence Number=SeqID_163195
atggtggattgtggtatgacccaggttttgtttgagatggattgcaaagtcattgtggatagagtcaatcagttgttctcaacacaggatactacagaccttggagcaattattcttcaatttcatgctcttgcaaaggctgcaatatatcttgctaaactcaatttttcatactactgcttgtatcaacaacactag

SEQ ID NO: 46418 - DNA, 415 bp, Glycine max
  Peptide Sequence Number=SeqID_163196
atggacgacagagtcaaatctgaaaagagaagcagagatcgacacttggaacgtgatgacaaataccatcaagattctgatgatatccgccatcatcgatcagacaggaatcacaagtgtgaccacaaatcaagggacagggatagggatagggcttatgacagagaaggaatcaaggataggaatagggcttatgacagagaaggaagcagggatagggatagggcttatgacagagaaggaagcaaggatagggaaagggcttatgacagagaaggaagcaaggatagggatagggaatacgaaagagagggtagcaaagttaggttgaaggggaagcatgatgaggggagggaagatttggtggagccacgactctcgtcacattctcataagcggaaagagagggagcaca

SEQ ID NO: 46419 - DNA, 597 bp, Glycine max
  Peptide Sequence Number=SeqID_163197
atgccgttttgcaggcgaggctcacgggtgcgctttccaaaggaggaaagatgcgcggagtcaccatcaacgtttatttgtggaaaacgtcagaaaaaccgaaggaaaccggtcgaaatgaaaattctaagttcgggagttgtatttacgtttgaggaaggtattagcacctctcatgtcgacaaaagcggagctcttgcttctacgtaccctccatcgaaggaggagcttgccacccagctcgccgaggcgagcaaggttgcttcctccagaagcaaccgccttctggaggaagaatctggaaggcccaagaaccgatccggaaaacaacacaaattgcattttccagtcaccggaggctccgcacctgacggtgaagaacacattggagaaacggagaattgcactaggcaatcactacgcgtggctccaaactcgttggcgaggatggagaattgcactaagcaatcactacgcatggctccaaactcgttggtggaggaatcaaacgggaaaataacaaagaccacatttcccagtcaagagggtccgcacttgacggtgaagaacacattggagaatggaggattgcactag

SEQ ID NO: 46420 - DNA, 2148 bp, Glycine max
  Peptide Sequence Number=SeqID_163198
atggtaatgataatattagaggcattcatgaggccaaggtcaaggaggaagtcactgatggtgcccatggctcagcttcttccaatggcactgtgtttatccaaaacggttgcttacattcagttactactaactgagggtgccctgggatcacctgctgtggcccccatgagtgtgcctgaaacatctttggctcctcctccttctgttcctatcaaggtatcttcgaattctaccacaaatgaaaataagggcattagtattaccaggtctcatgaggttactggaaaatctagtacagatgggtcatcttcaactgctagaaaaactgggagcctctctattgatgccctagctaaggctaagaaagctttacaaatgcagaaagagttgtcagaaaagctaaagaaaattcctcagttgaataagagttctacccaaaattcacaaggaagctctaacttgggctcaatgaatgaatctgcagtaccctcttctgctgctggagtggcatcaaaaagttccacgtcagcttctttggtccatgctgcaaatatgtcaattttcccctcaactgcttttgctgcttctgctaatactccagtaattggcactagtgctgctggtattccaaatgcaactctgcccaactgggaagctgtcaggcgtgctcaagagcttgctgccaggatgggatttcgtcaagatccacaatttgctcctctgataaacatgtttcctggtcagatggtaacagatgttactctcctgcagaaacccatgaaggcccctgttcttcgtcttgatgctcagggacgggaaatagatgagcatggaaatgttattaatgtgactaagcccatcaaccttagcacattaaaggctagaaactatgtcttaacattccaggtcaacattaacaaacaaaagaaagaagcatttgaaatactacaacctgtattagatgtcgatcctgaatctaatcctcattttgatgcaagcatgggtatcaacaaaacaaagctcctgcggcccaagaggatgaatttccaatttgttgaggaaggaaaatggtcaaaagatgctgaaacaataaaattgaagagtaaatttggagaagctcaagcaaaagagcacaaggccaaactggcacagttggcaaaggcaaaggctgctcctgatataaatcctaacttaatagaaataacagagagagttgtaattaaagaaaagcccaaggaccaaattccagacattgagtggtgggatgtgccacttctgcattgtcgaaattatggtgacattgataatggaaccattggcgaagataaactgaaaatagaaaaaatcactttttatgtggagcatcctcgtccagttgagccacctgctgagcctgctcccccaccacctcaaccactcaagctaactaagcaagagcagaagaaactccggacacaaagacgtatagctaaggagaaagagcgacaggagatgataagacagggtgtcatagaaccaccaaaaccaaaggtcaagattagcaatttaatgaaagtacttggctctgaagcaactcaagatcctactcggctcgaaaaggaaatacgtactgcagctgcggagcgtgagcaggctcacatagataggaacattgcacgcaagcttactcctgctgagctgcgggagaagaaggagaagaagttgttcgatgacccaaatacactggagacacttgtctctctttacaggataaatgacctctcacatccaaaggccagattcagagttgacgttaatgctcaagagaaccgtttgactggatgtgctgtgatttgtgatggtattagtgttgttgttgttgaaggtggaagcaagtccattaagaggtatgggaaacttatgcttagacgtattaattggagtgaagtttcaaaagataaagaagaaaatgaagattcagatgatgacaagcctgccaataagtgtgttctggtgtggcaaggaagtgttgccaaacccagcttcaataggttcagtgtccatgattgcatcaccgaagctgctgcccgaaaagtttttgcggatgctggcgttcctcattattgggaccaagccgtgaactacaaagaagatgaagctatttaa

SEQ ID NO: 46421 - DNA, 423 bp, Glycine max
  Peptide Sequence Number=SeqID_163199
atggcgcctaccagacaccctttggacccggataagtccaacagggccctgagatttcccgcattgatcataggactctgccagtcattcggagtcctcgtcgcacctagcaagagacaggcccagggtgatgctccacaggccgcagacgcgtcgccacctcatcaggctagcccagctgggtcatttgattcggagcagtatttacggcatgtggttcgccagcaggcgaccaaccatcgggcgcacttcagggcagaggtcgcatggcccggagattggcctgaggcccaggcaggggaggcaccagtagaggcacccgcagaggcacccgcagaggctcccggcgaggcagatgaggcccgcgaggatgaggagatgaccgatttgcttgatttcttgggagggagcggagccacatga

SEQ ID NO: 46422 - DNA, 744 bp, Glycine max
  Peptide Sequence Number=SeqID_163200
atggcgtcttcatcttccaacagctactccaaggtcaacgacgtgttcttgaacttcagaggagaagacacgcgcaagactttcgtgtctcatctgtatgctgccctctctaatgcaggaatcaacactttcatcgatcacaagcttcgcaagggaacggagttgggagaggaactgttagcagtcataaaagggtctcggatatccatcgtcgttttctcggctaactatgcttcatcaacttggtgtcttcatgagctggtcgaaataatttaccaccgtagagcttatggccaggtggttgtgcctgtattttacgatgttgatccatctgatgtacgtcatcaaacgggtgcttttggacaacgcttgaaagcacttatgcaaaaaagtaagcccatcgactttatgtttacgagttggaagagtgcactcaaggaggcttcagatttggtcggttgggatgccagaaattggaggagtgaaggtgacctagtgaagcaaattgttgaggacatttctagaaaactagacacccggctgttgtctattcccgaattcccagttggattagaatcccgagtgcaagaagtaattgagtttattaatgctcaatcagacacaggttgtgttgtagggatttggggaatgggtggcttgggtaaaacaaccatggccaaagttatctacaataagattcaccggagattcaggcatagcagtttcattgaaaatattagagaa

SEQ ID NO: 46423 - DNA, 1141 bp, Glycine max
  Peptide Sequence Number=SeqID_163201
atggatgagggaaagcataaatcgaggaaagaaaatcatgaggtgaaagatggggattctaagaggagtcaccgcgatcgtgaccgtgatagaactggagaaaggggtaaggataaaaacgatgggaggcacagggataaggagaagagggatcgtgagtcccgaagacatgagagagagagtactgattctgaagacaggtatgatagagacagggagaagctcaaagataaagataaggatgtggaccgagaaagaggtcgagacaagaaaagggaaagggacagggaaagggagaggactgacagagtaagagagaaagaaagagagagggaaagaaaagaggataaggagaggatcagagagagagaaagagaaaggaaggatcatgagagagagaaggaaaaggaaagagaaagggggaggaaagcacgagggagggagaagcgtagggaagttgatagtgattgcagtgatggtgaatctaaggagcgggatagaaagcggcataggaaagaggatggtgattacaagagagagagggaaaggagtgtcagcaagtcaagcagaaaatctgaggaacatgaaggaagcccaagaaaaaagagtggcggagatgattcagataccaaagatgaagagaaaaaacctacccgtgaagaggagatggaggatgaacaaaagaggttggatgaagaaatggaaaagcggaggaggagagttcaagagtggcaagagctaaggaggaagagggaagaagcagaaagagaaaaacacggtgaagcaagtgctaatgaacctgagtctggaaagacctggacgcttgaaggggaatctgatgatgaagaaggaccaggtactgggaagcagacaggtatggatgttgatgaagatgacaaacctgctgataaggagcctaaggatgtgatggtggtagatactgttaatgggacaattgcatctgatttacaggatggacctgctggtgctcctgaagatgaggaaatagatccattggatgctttcatgaattctatggttctacctgaagttgaaaagctaaacaatgctgtgacatcgtcactttctggtaaagccatcgacgtaaaacccaaggataaagggaatgagcaaaatcgtg

SEQ ID NO: 46424 - DNA, 1539 bp, Glycine max
  Peptide Sequence Number=SeqID_163202
atggttctttgcataggaagtacaattcaggctaatggactggagcaacttggtgtagcacaccaagtaaagaggagcaaatttgtttatctgccagaagaatctagtgattctctggattacaaggagactcctgtcaatgttgcaatgtcccaatttggaggggagtatgcttactgcagttctttagctgaagagagtgagtctgcttttatggatgttgttgaatctgattctcttgaaactggttctgctaatgctgattcagattcctctgaaatggaacttgacaaagatgacgagatgactacactttcagaaattggtcgtgatactgaagaacaagaaagcactagcagtgaggaacttgatgagttggcaatttctggtgacatgcctcacctctatcctcgtcagcatatatcatgtagtgaagctgtatccaaatggaagttaaaaggaaaaaggaataatcgtaatcttgtaaaaaggtctgttggtgctgctgatgggaaaggtgttgttttatatgaagcagatgttgaaggattaagaagccgtttaaatcacaagagattggtgcctagtatgcattattatgggaatggtattagtgatgtttttgatgacaccgatcaaatgtttggttttgaagatgaatattctccaacttccaaagcactagcaaaaggtcaaaacaaaattgatcatggtgttgattgggatgaatgggcttgggaggatcagactgctttgaaaggatattgggaaagtaaagggtttgctccattatatagtgatagatatcattttgatggaaggatcaggtcgatgctggtagatgtagacttgaaggttcaagcaagctatcgtaaagcgcctgtccccattgtttctatcacaagtaagttagatgggaagtcaataatagggcacccaatccaaattgaatcccttaaggatggttcatcggataaacttttttctgcaattgatgactttagtaacgatgggactggctttgagggaagtagtgtacttccaccagcttggaggactgcaaggagaacagcaaattttcgtgttcctcgtccccttgtattgtcatctaatggtgctgatagttatgcagatttctgcattgatcaagaaagaaatattgaatataagaaattaaatggtggaagttccaatcatatggcaagcctttccaggaagagtggctttaacagttctgtgccttcagtagacaagaagtcctcaaaaaagatgccaaagaaagtgagcttgtcatctagtcagaaaactagaactctatcctcattatctattgaaaataatcatggtaaaaagcaattgcatgatagaagtttttatcaaacaaataggttgactaaaccagaggtctctgggctcaccactgttgcttgcataccagtcaaattagtatttagtagattacttgagaagattaataggccacctttaaaagcagctagtaatgcggctttgtcaaatactggtgtggagagaaaataa

SEQ ID NO: 46425 - DNA, 1368 bp, Glycine max
  Peptide Sequence Number=SeqID_163203
atggatgcaggatctttgagttcttccggaaccctcaaaacacgatcacggtaccctcttcaagagcaatttattcaaagaaagagttccaaagaaaatttggacagattcataccaaataggtcagcaatggactttgattatgctcactatatgcttactgaggggaataaaggtaaggaaaacccagatgtgtgttccccctctagagaagcctacaggaagcagcttgcagaatccttaaacatgaaccggacccgaattcttgctttcaagaacaagccacctgcgccacttgacttaatccctcacgagatgtccacttatacccacgataataaaccagccaagcccaaacggtttatcccccagagttcggagaagactttggatgctccggatattgtggatgactattatctgaatttgctggactggggaagcgcgaatgttcttgcaatagcacttggaagcacagtgtacttgtgggatgcaagaaatggttctacttcagaactagttacagttgatgatgaagatggccctgtaacatcggttagctgggctcctgatggacggcatattgcggttggtttgaacaactcagaagtgcaactatgggatacaagttcaaatagacagttgagaactttgagaggtgggcacaggcagcgagttgggtctttggcatggaacaaccacatactcacaagtggggggatggacggtagaattgtcaacaacgatgtaagaattagatcgcatgttgttgaaacctacagcgggcatgagcaagaggtttgcgggctcaagtggtcagcttcaggttcacaattagccagtggagggaatgataatctactttacatctgggatagagctacagcatcttctaattcggcaacgcagtggcttcacagacttgaagatcacacatctgctgtaaaagcccttgcttggtgccccttccaagggaatttgttggcttccggtggaggtagtggggaccgttgcatcaagttttggaatacccacacaggtgcatgcttgaactcaattgacactgggtctcaggtatgttccctgctgtggaacaagaacgagagggagttactcagctctcatggttttacccagaatcagttaacactttggaaatacccctcaatggtgaagatggctgagctcaatggccatacttcaagagttcttttcatggcccagagtccagatggttgcacagtagcatcagcagcagcagatgaaacattgaggttctggaatgtgtttggagctccagaagcagcatctaaggctgcaccgaaagccagagctgagccattttcaaatgtgaatcgtattcgataa

SEQ ID NO: 46426 - DNA, 1395 bp, Glycine max
  Peptide Sequence Number=SeqID_163204
atgaaacgaaaggatgtaagcattgataaagtatatgatgcacgtgcattaagagtagttgtgggagacaagaatggaactttacacggtcctgcagttcggtgttgttatagtcttcttgacattgtacacaggctttggactccaatagatggtgaatttgatgattacatcattaatccaaagcctagtggctatcagtccttgcacactgcagtccaaggtcctgacaactcacctttagaagtacaaataaggacacaggtgccaagttacttcacatgtgttgcagagaggatgcatgagtgtgctgaacatggacttgctgcacattggctttacaaggaaactgggaatccttttttatccatagacagcatggatgaacctgaaactgaagcatcctcctatttctccaaaaatctagaggaaggaaattcttcagatattttatcaagtaaatataagtcattgaaggctggacatccagtcctcagagtagaaggaagtcacttacttgctgcggttatcatcagtgtagagaatgatgaaagagaattgctagttgctgtgagctttgggctagcagcttctgaagcagtagctgacagaagatctttccagattaagcgatgggaagcttatgcacgactttacaaaaaggtgtctgatgaatggtggtttgaaccagggcatggggattggtttacttgtctagagaagtacacactgtgtcgagatggtatgtatcataagcaagaccaatttgggcgcctactcccaacattcatccaggttatcaattttactgagcaagaaaaatctgaatattgggctgttgtatctgctgtgtttgagggcaggcaagtggactggataacatctcggtcaaaatttgacttggttgcatcaacttctgtagaagctggcatcgataacaaggtgaacctgttgagaacaatgctttcttgggaagagcaattgcgctctgaagtaaatttcaagcaaacaaagcatgatgtaaagctttatgatcttcatggttctcttggggaggtggtaattatatgttggcctcatggtgaaattttgaggctaaaggccggtagcactgctactgatgcagctcaaagagttggtttggagggaaagctggttttgattaatggacagctagtactgcccaacacaaaactcaaagatggcgatgtagttgaacttgtcgagaagtattatctgtattgtatttcaagagaagttgctacggcaaggtttcatgcacaagcatccattcccctaaatccttccaatgagaaccacttactgttgactattgcacattacggcaggctgagaaattttgaagtgagcgaaaagaagaaactcaccgcataa

SEQ ID NO: 46427 - DNA, 750 bp, Glycine max
  Peptide Sequence Number=SeqID_163205
atggctgaagattcaaggaaacgcacattggaggctttggagagaagaatagcttttgctaaagttgaagttctccaaaaagaaaagaaaaacaaaaagactataaatgaagatgggaaactacctattcctgcagattctacttctaatgatccttccccacatttgttgcattcatcatcagtctcatccaagaaagggaatttcagtttctctggtcataccactttgcaagacattgaagatggtccagcatatgcccaactttctgtgcctgtaaatggaaatctgctcacaactaatgaggagttttctgctgaaagaggaggttcaattgatggcatattgcatgagcttcttcagaagggagatgcagcacataagtacatgcaaggatctagaaacatgaaaattgacaactggatccttcttgataattatgtacaaggacgggtgctttcctctggttctcaagctagggctttgcaacttcattcaaaacgctctaagaaacacatgtctatgaaacggcataagaaggatggatcattagatcttcctcaagagttccagaaatttgatattttcaagccaatgcacgaaatgtggaaagattacataatgttgcttcttaaatccactggattgtccagcaaagagggaaaaaaattcatgatcctttatattgcaggaaaaatcaattggctcaatgtctccttggtgcagatctacatggtgcttttattttag

SEQ ID NO: 46428 - DNA, 2143 bp, Glycine max
  Peptide Sequence Number=SeqID_163206
aataattcctggtgaagagtctgactcagattatgcagatgatgaagtggagaaggatccattggatgaagatgatgatgagttcatgaaaagagtgaagaagacaaaagctgagaagctttctttggttgaccactcaaagatcgtctatgaaccattcaagaaaaacttttatattgaagtgaaggaggtctcgaagatgactcctgaagaatctgcagtatacaggaagcagttggagttgaagatacatggaaaggatgtgccaaagccaataaaatcatggcaccagactggacttgctagcaaaattttggagacaataaagaagatgaactttgaaaagccgatgcctattcaagctcaggcgctccctgtaatcatgagcggtcgagattgcatagggattgctaaaactgggtcaggcaaaacacttgcttttgttctgccaatgctgaggcatatcaaggatcagccacctgttgttgctggagatggacctattgggctcattatggcccctacaagggaactagttcaacagattcacagtgatataaagaaatttgctaaggtactgggtctgaggtgtgtgcctgtgtatggaggatctggtgttgctcaacaaattagtgagttgaaacgtggtgctgagatagtggtttgtactccaggtaggatgattgacatactatgtaccagtagtggaaaaataactaacttgcatagagtaacttatctggtaatggatgaggctgatcgaatgtttgacatgggttttgaacctcaaatcacacgtattgttcagaatattcgtccagatcgtcaaacagttctgttttctgctactttcccccgtcaggttgaaattctggctcgtaaggtcttgaataaacctgttgaaatacaagttggtgggaggagtgttgtgaacaaagacataacacagctagttgaggtgaggccagataatgaaaggttccttagactcttagaaatattgggggaatggtatgaaaaaggaaagattttgatatttgttcactcacaggagaaatgtgatagtttgttcaaagatctgctcaggcatggttatccctgcctttctcttcatggggccaaggaccagacagaccgtgaatccacaatatctgattttaaaagcaatgtctgcaatttattggttgcaacaagtattgctgccaggggattagatgttaaggagcttgaattggtgatcaattttgatgttcctaaccactatgaagattatgtacatcgtgttgggcgcactggacgagctggccggaagggttgtgccattacatttatttctgaggaagaggcaagatatgcacctgatctgctgaaagccttggagctatctgagcagactgttccaaatgatctgaaagctcttgctggtagctttatggcaaaagttaatcaaggactggagcaagctcatgggactggttatggaggcagtggctttaaatttaatgaagaggaagatgaggtgcggaaagcagcaaagaaagcacaagccaaggaatatgggtttgaagaagagaagtcagattctgaagatgaagatgaaggtattaggaaggctggcggtgatatctcacagcattctgcttttgctcagattatcgctgccactaaaggtaatgttcctgcattgcctactccaatgctcctaccatccttgccagttttgcctgggacagggctacctcttcctgcaaacgagggggcggctcgagcagcagcaatagctgctctaaacttgcaggacaaattagataaaatacgatcagaagcattaccagagcattacgaggctgagttggaaataaatgattttccccaaaatgctcgctggaaagttacacacaaggaaactttaggccctatttctgaatggagtggagctgcaattaccaccagggggcagtttttcccacctggcaaaatcccaggacccggggaacgcaaactctacttgttcattgaaggtcctactgagcattctgttaagtcagctaaagcagacttgaagcgcgttttggaagacatcacaaatcaggctatgcaacttcctggtggaactcaaccaggcaaatactctgttgtgtaa

SEQ ID NO: 46429 - DNA, 717 bp, Glycine max
  Peptide Sequence Number=SeqID_163207
atggttgatgatccacgtgttgtgctcatcaagcttgcagatcgtcttcacaacatgagaacaatttatgccctgccattgcaaaaagctcaagctgttgcagaggagaccttaatcatttggtgttcacttgcttcaagattgggtctgtgggcattgaaagctgaactggaagatttatgctttgctgttctgcagcctcaaatatttcaaaagatgcgagctgatcttgcttccatgtggagtcctactagcagaacaggaaacccgagaagattatcaataaaaggcaacttgatacatttggacgagaacagttcaactgctttctgcaatggatccttgacattcaatgaggatgtaaataggaaggatcttttggaagctgtagtcccatttgatatattgttggatcggagaaaacgggctaactatctcagtagtattgggaataatctagagacatgcaaaaaaccaaaggttgttcaagaggctgggctagctttggcaacaatgctaacaaacagttatcttagctgttctacaaccgacagctctctaactctttcaagggtattttctaacatacacctttcaccatctatttccccctctatcaataccccccccaagatggaccttgtcctcaaggtcaaattgaggaaaaacagtttgtatttcatcagcaagttcccagttatcttcatggtggggtaa

SEQ ID NO: 46430 - DNA, 1761 bp, Glycine max
  Peptide Sequence Number=SeqID_163208
atgaagcagcgattgttgagactttgttactattgggtctctctgattccgcaactattgcgtctcctccaaatgctttgcttcaaattcaaccactttccttggaatcggaaaggcaacaccattactctccctcaaaccttttctcttccctctccgcttccccaatggcctcaaggacaaggttttgcttctggaattgtaaaccttggggagatagaagtgtgcaaggtcactgggtttgagtttgtttggaacagcaacattggaaagcctgttgctttctataaacctgtgcgaataccagatgggttccgtatccttggacactattgtcagcccagtgacaagccgttacggggttttgtgcttggtgttagggaagtggaaactgcttcatctgagacaagcaactgtcacacgttaccagccttgaagaatccccttgactatatgttggtatggtgttccaatgcaggaagtaaggaattgccaattggttctgcttacttttgggtgccccagcttcctgaaggttacagtgcccttggctatttggttactaatgtgcccgacaagcccaatttggatgaaatgatttgtgttcgtgctgacctcactgataaatgtgaaccttaccggttaatgcttgacgctgctcctgtaactccagagtttccatttcaggtgtggaatttgagacctcgtgaccgtggcatgctgggggaaggagtttcagtagggacttttttctgcactagttgttggaacaagggagaagagctacctgttgtgtgcttgaagaacctaaatcctgtgctaccagcaatgccacgcctccaccaaatacatgcacttatagagcactatgggcctactgttttctttcatcccgaggaagcttacttgccttcttctgttgattggtttttcaataatggggccttgttgtaccgaaagggcgtgtccacgggagagaccattgatgcagccggctcaaatttgccaggtgggggaagaaatgacggggagttttggatagatttgccaagtgatgatagaagggattttgtcaagcatggggacttgaagagtgctaagctttatgttcatgtgaaggctgctcttggtggaacttttactgatgttgctatgtgggtgttttgccctttcaatggaccctccactctgaaaattggaattacaagtagggcttttagtaaggttggagagcatgttggtgactgggagcattttacacttcgtatatgcaactttactggagaattgtggagtatatatttctcacagcacagtggtggaaaatgggtggatgcctatgaattggagtatattgatggcaataaagctgttgtctactcatccaaaaatggacatgcaagctacccccaccctggaacatatctccaagggtcttcaaaacttgggattggcattaggaatgatgctactcgtagtcatttgtatgtggattctagcattcaatacgagcttgttgcagccgagtatctaggagatgttgtcagagagcctcaatggttgcaatttatgagagagtggggtccaaaaattgtttatgattcaaaaactgagctggataagataatgaatgctcttcctcgcgggcttcgaaatgcatttggtaacttgattaaaaagcttccggtagagctgtatggtgaggaaggtcctacagggccaaaagagaaaaataactggataggagatgaaagatggtga

SEQ ID NO: 46431 - DNA, 153 bp, Glycine max
  Peptide Sequence Number=SeqID_163209
atgcaggaatgcctatggttttatgggagagccagtgtttatcaatttgaaactaaaaagttgacgttgaaatttcgtgtggaaaatggggagacaaggaaacttctaggatgcacgcagcatacacgccttcacgctaacgcgaaattataa

SEQ ID NO: 46432 - DNA, 906 bp, Glycine max
  Peptide Sequence Number=SeqID_163210
atggctgaaaaagaatgcatagggtcatatgatggtttggtaagaacagaacatagagcaacaaaggaggcaagaacctcccttgatagagaagaaacagagttgtacaactgggagaaagggttctgggtgaaatgcaacacaagagatgcaagcctggaaggcaggcccaatgggctaacatatgaaaatagatttttggttatggtgattcgtgatttattaaatctatgtgaaatcacaaagggaaaagataacaaagctgttattgcaagtaatatcatgtatgttgtggggcagtatccccggtttttaagagctcattggaagtttctaaaaactgttgtgaacaaattgtttgagtttatgcatgagtcacatcctggggttcaggatatggcctgcgacacatttctgaaaatagtccagaagtgcaagcgtaaatttgtaatcacccaggttggagaaaatgagccatttgtttctgaacttctatctggccttccaaatacaattgctgatcttgaaccccatcaaatacacacgttctatgaatctgttggtaacatgattcaagcagagtctgatgcccagaagagagatgaatatcttcaaaagttgatggtgctcccaaaccagagatggatggaaattatagggaaggcacatcaaaatgctgattttctgaaggatcaagatgtaatccgaaatgtgcttaatatattgcagacgaatacgagtgttgcatcatctttaggaacatatttcctgccacaaatcacattgatctttttggacatgttgaatgtgtacagaatgtatagtgagcttatatcaaaaagtattgcagaagggggaccttttgcatctagaacatcctatgtgaaacttctacggttagattaa

SEQ ID NO: 46433 - DNA, 3051 bp, Glycine max
  Peptide Sequence Number=SeqID_163211
atgagtgaaagagatgttgcgagtatgtcgaacagtaaaccttcacccaaaccaccagatggggaggggaaggctggtgtgaccaaggcgatgtggaagttgttaggggtttttgatatgttagatgtgggctttgggttttatatggttaagttcgaccttccgcaagatacaaagaaggtggttagtggaggaccacaaatggtatttgatcactatccgacgtctattcttggcattggcatcagtggtgtggagttcgatcaaagtggatatttgaataatggatgcaaccaaaggcaagtttgcgaggggtttgcatttcgtatgcaagaagtgtgggttgcatggacatattgcaagaacatgtccacaattaaaggaggaggaaggaagtacaccggacagttcctgagagttgaaggccagatggcgacgttggggtttagtcgagaaaactatgggccaattttggtatccaataatgaggaggttcccactttgaaggagccaatgaaaagagagtaccatcatgtttcgagatggcacaacaaagatagtatatgtgagcctaatagtggtgaggcaatgatgaaagaaaggagggaggtaactattacaaagaatcctcaacaggctgaaggggctccggtagggagtagtacgatcatgtcggagcgaatagtggcgccctttagactagggtggaatactgaatcggatctgtctaaagatcagggtgagggggtgcagaataagggtggtgatgagggagtggagaacacgacccagactatggaagtagtggtggatggggatgcaggctcagaaaaatgctctatggtatctcggaatgttagggggtttgctagcaggaagagtcaagagcttattttgaaatatcacccagatcggaaagacactcaggtggcatttgggggatttgttcaaaatggggtatatgtgagcctacattcttcaactaggaagacattatgggggtggaagggtgttctcgcatttgtgagccgccactttaaggtgtgtttggacatatatgctcttgtgaatttagaatactttggaagtaaattcacttggcagaagaggtgtacaagagggatgttaatggcaaaaagactagatagggtgatgagtgacattcagtggaggttagcctttcctgaagcaactatggaacatctagttcgtagacactctgatcacaatcctattttgttaaggtgttgtaatcaggttacaactagagggaagagatcattcaggtttcaagccgccaagtgtacttatgagggttatgctcaagtggtaagtcgggcttggaataaggagagagctgaagtgtttaaagcactgtataatgtatcaaaggagactctggtgttcaataaggaggatttttgtagtgttattggtatgaggaaggatattgaagctcacaaccttttcaacgctcaaatagtgataagaagaaagaagaataagattcacgggttacaccttcttgatggggaatggtgtacgaaggcagagactctaaagatggaagctcttaagtattttaaggcgaggatggtgttgatggcatcagtctcaaaggtggaggttgtgggtgatgatgtatggaaattttttgctagagcatttcagagaggcatgtttgatccaagagtgatgaaggcattattggtgcttattcctatggaggattccctaacaacggttgttagtgtgcatcaaagtagtttcatcctggggcagggaccaaaggataatgcgataatgttacaagaggcaaggtctaatcaggcaaggaaaattgaggagggtgtcctgacaagaataaagaatgagttgtatggggtaatggaaattcactttacgaagcagttgggaaagtacctgggtttcaagatttatcatgggagagtgagacacttaaattttaaggatttgtttgacaaagtaatatccaaattaagtgtctggcagaacaaattacttaataagccaggtcgtttgatgttagcaaatgcggtgttgtcctctctaccagcgtatggtatgcatgttcaatggttcccacaatatgcgtgtgatgctatagacaagaaaaataagagcttcctatggaagggaaataaagagagagggattcatatggtcaagtgggacactataatgagatcaaggggtcatggcagtttaggggcttccactccatgcgatagtccggtcgtggtggtcttcggtggttgtgggtggtggaggaaacagcgagctagtgctgctgaaccagctgttcagcaaatctccaagtccaagtttaaaggtgatccaacagttaacgagttcgagatcgcgttacaggtggaacttagaggtgtgatacacgagtcttcctatggagaatgtggaaggagtgtattcggccaagtgtgcaaacaaatttctcagggacaaggaaaaggttcaggagggaatggaggattgaaaatgggtgtggaaattgaagaatgtgaactagattcaaggctggattatagagagaagcaaggtagtgaggactactattcccatcatcatctagaccatttgaaggtgtttgagctaaaggcaaaggttcaagtcacagtcaaccattcaaaagttgtgttcaatcaggggtctcctcgtgggggctttggagggatctacagagattataggggtttattcccgaggggcttatgtggaaatgtcgggagctcaaatatggtttttgtggaattggtagccttgtggagaagactatggttgtgttgggatgaggggtataaagagttaatttgctatacggatttaagtttagtggtgcaattggtcctaggggtgttggattatcaccatgcttacaacaatgagatcatgcaaacgaaggagcttcttgggatagatttgaggcaatggtggagttttcagcatccaccagaggagctgcgcactcaactgagagaggatgctagtggaatgtctttcactagaagctag

SEQ ID NO: 46434 - DNA, 438 bp, Glycine max
  Peptide Sequence Number=SeqID_163212
tccactcaagagaatatatctgctttgctattgggtcttgaatatcttattaatatctcatatgtggatgatactgaggtttttaaggtctgtctggactactggaatgtcttggtttcagaactgtttgagccacaacgtagtttggagaaccctgcagcagcaaatatgataggacttcaggtgcccggtatgattgatggcattggttcacagcttcttcagcgccgacagctttatgccagtcccatgtcaaagttgagaatgcttatgatctgtcgtatggctaaaccagaagaggttctcatagttgaagatgaaaatggtaatatagttcgtgaaacaatgaaagacaatgatgttcttgttcaatacaagattatgagggagactcttatttacttgtcacatcttgaccatgatgatactgaaaagcag

SEQ ID NO: 46435 - DNA, 765 bp, Glycine max
  Peptide Sequence Number=SeqID_163213
atggccgccgagaagctcagagatttgagccaacccattgatgtgcctttactcgatgccactgtcgctgccttctatggcaccggatccaaggaacaggtcgcgcctcctttccctttctcactctttctcttttcgctttttccttcccgattcaacattctccataattcgcctctttctgcttcaccattatgcttctcgaaacttctactctttcactgccttttcgtctctcccaatgcgtcaaaacagtttaaccgtacggaactaacttgctcagttaggagaactgctgccgatcagattttgcgcgatttgaaaaataatcctgacacgtggcttcaagtcatgcatattttgcagaacactcaaagcctaaataccaagttctttgccttgcaggttctagaaggtgtaattaaatacagatggaatgcattacctgttgaccagcgagatggaatgaaaaatttcatctctgatgttattgtacagctttctggcaatgaggcctcatttcgaacagatcggttgtatgtcaacaaactcaatattatattagttcagattttgaagcatgaatggccagtaagatggagaagcttcattcctgaccttgtttcagcggctaaaactagtgaaacaatttgtgagaattgtatggcaatattgaagctcttgagtgaagaggtttttgatttttcaagaggagagatgactcagcagaagataaaagagcttaaacactcattgaataggtaa

SEQ ID NO: 46436 - DNA, 654 bp, Glycine max
  Peptide Sequence Number=SeqID_163214
atggttagaactagaggattgcattgggctttaagcatagttttaggaaaagccttagggagacaggttagtggtgatgctcaagaagttcctcagcgtcaaaggccaacaacatctgcatgtagacaacggctagctgcagttgttgctgaggatgttaagcatgtggatcattcggctgacgaggttcatgagcaacctcgggagccagttactgatgatgaacgtactcacttaaagttggactctcatgggaggaaggtaaagaaatttggaagacctgcaccaaagattgaaggcttagtggttgctacaagattaagtcctctgattacatgttcgtcggacactggtgacacgggacttatatctccttttgcggagaggtgccacaaggaaactagtagtttccatctttcggtaggagaggtcactgtcaccttcaatgatgtgacatcgttgttacatctacccattacaggcgccttccatacctttgatgctcttgatatagatcaagtcatggacttgataattgagttgcttgaagttagtacacaagaagcaaaaaatgagacatctcaaactagaggggcatatgttcggctagcttggctgcgagacatttatcgtagcaaatgtgatgcaagatag

SEQ ID NO: 46437 - DNA, 159 bp, Glycine max
  Peptide Sequence Number=SeqID_163215
atggaagctcagtttctgtatcgtgaagaaatgatggccatgctggttcaggttacaagttttatagcctggggagtcatttcttacaggatatatatcttgtcctacaggctgcagtattgtttgagtggcatgcctccgacaaatttcatttcgtag

SEQ ID NO: 46438 - DNA, 1395 bp, Glycine max
  Peptide Sequence Number=SeqID_163216
atggcttttcagtcactcttttccaagtataaaatcttaccctctttcttttgcactcttgtccaacacaagcccagctaccatcacttccactctttcccaaccccacaagtctcagggccattattacctgaccttgtgaatgagatatctcgtctactcagtgatcaccgataccctcaccatgatctagaactttctctcaatccattttcagcacaaatatctacaaatttggttgaccaggtgttgaagaggtgcaataatctcggcttctcagcccacagggcatatagccaagctaatttacccgatggtgcaattcggtctttcaatagaatggatgagtttggaattaagccaactattaacgattttgataagcttttgttcattttatgcaaaacgaagcacgtcaagcaggctcaacaattttttgatcaagctaagaatcgtttcttgttaactgctaaaacttacagcattttgataagtggatggggtgatattggtgattcagagaaagcccatgagctgtttcaagcaatgcttgaacaaggatgtccagtggatttgcttgcatataataatttgttacaagctctttgcaaaggaggttgtgtggatgaagctaaaactatttttcatgatatgttgtcaaaaagagttgagccagatgcttttacttattcaatattcattcactcatactgtgatgcagatgatgtgcaatcagctctcagggttcttgataaaatgagaaggtacaacattttgcctaatgtatttacatacaattgtattataaaacgactttgtaagaatgaacatgtggaagaagcttatctgttgttggatgaaatgatttcaagaggagtaagacccgacacttggagttataatgcaatacaagcttaccattgtgatcattgtgaggtcaatagagccataaggttaatgtttagaatggaaaaagacaactgtcttcctgatcgccatacctataacatggtgctcaaattgctgattaggataggaaggtttgataaggtaactaaagtttgggggaacatgggggacaaaaagttttatccttctgtctcaacatattctgtcatgatccatggtttttgtaagaagaagggaaagctagaggaggcatgtaagtattttgaaatgatgattgatgaaggaataccaccatatgttactactgttgagatgctgaggaatcagctcttgggtttagggtttttagatcacattgaaatactggctgctaaaatgaggcaaagcacttcctatgcaattcaagaattggcaaatattatgattggcaatagaacaactcataatactttgagacgcgatgagatggacatagaaagtgactga

SEQ ID NO: 46439 - DNA, 1335 bp, Glycine max
  Peptide Sequence Number=SeqID_163217
atggtggagagcacagaacaaggagggagagggatactcgggttgttccagttccagttactccaccccaaaacgacacccttcgcgtctcacaagacgctcttagcgttcctgtgggtggccacgctggcctcggtgttgttgtggcagagaactacgatcagcgggtttctggtgcagggcggcgtgccggtgagggcgccgccgaagctaaggccggtggttttctgtttgacggagttcggcggtgtcggcgacggcgttacgctcaacacggaggcgtttgagagaggtgttggtgcgatctcgaagttgggagataagggtgggggtcaacttaatgtgccacctgggcggtggctcactgcgccgtttaatctcaccagtcatatgacgctctttcttgccagagattctgtcatacttgcagttcaggatgaaaagtattggccattgatgcccgcattgccttcatatgggtatggaagggagcatcctggtcctcgatatagcagtttaattcatggtcaaaatcttagagatgttgtcataacaggccataatggtaccataaatggacagggacaaacatggtggacaaagtatcgccagaagcttctgaaccacacaagggggccacttgttcagatattgtggtctagtaacattgtgatctcaaatattactctgcgtgactctcctttttggacacttcatccatatgactgcaaaaatgttacagttaaaaatgttactatattggctcctgtttctcatgctccaaatactgatggcatagatcctggcaatgctggcatctcaataggcagtgagatgtctggtggggtatccaacgtcctggtggagaacattcttgtatgggaatcaaggcgtgccatgagaatcaagactgcaccaggaagaggtggatatgtgcgtcaaataacttacaaaaatctaatgttcaaaaacgttcgcgttggaattgtgatcaagacagattacaatgaacaccctggtactggatatgatcctagagcacttccaatactcagagacataagcttcatcaacattcgcggtcaaggagttcgtgtgcctgttcgaattcaaggtagtgaacagattccagttagaaatgtgactttccaggatatgaagattggcataacttacaagaagaagcatatcttccagtgtgcctttgtccaaggtcaggcaatagggaccatctttccttctccctgtgacagctttgatcggtacaatgagcaaggacagcttgttaagcatgctgcttctcagaatgtaacagatatagattatgaaatttga

SEQ ID NO: 46440 - DNA, 588 bp, Glycine max
  Peptide Sequence Number=SeqID_163218
atgagtaaatacaataaagtggaaatacttgagaaagctgaaaaggatttagcagctgtgacagatcagtacatgtcacgactagtcaaagaattgcagggaactgatttttggaagctaagacgagcatactcacctgggatacaggagtatgttgaagctgctacattctatggtttctgtaaaagtggaactcttttgaagcttgatgagataaacaaaacattgctaccacttagtgatccatctcttgatcctctgcagataaatatccttgactatatattaggggttgcagatttgactggagagttgatgcgtttagcaataggtaggatatcagatggtgaacttgagtttgctgagaagatatgcagatttgcacgtgatatatacagggagcttacacttgtagtgccacatatggatgacagttctgatatgaaaacaaagatggatgtaatgctccaaagtgtcatgaaaatagagaatggtaatgcattggttttcaaaacactgtttgctagactgaaagttctatctgttatgtttgatgccttaataccttattactgcaagcacaagtag

SEQ ID NO: 46441 - DNA, 300 bp, Glycine max
  Peptide Sequence Number=SeqID_163219
atggctttagcactttcctccaccgcattgtcaagtcttccaaacagagaaattcgtcaaaagggtttcccagaaagaacacccacatgcttgagcctgaccagaagaacaattgcaaatgctacaaaaggagtctcagctgtctgtgaaccacttcctccagatagaccattgtggttccctggtagctcacctcctgagtggcttgatggcaggtttgaattcaattacaatacactgaatgagatagctcaactctctataatacttctatctgactcacatgattctctccgataa

SEQ ID NO: 46442 - DNA, 267 bp, Glycine max
  Peptide Sequence Number=SeqID_163220
atgtataacacttatggattagcaatccacattcttggagaatccaccatcaatcagccaaggcgccaagctctatctggagctgtggagctaatgggttatgatcatgcaatgaatgaattgtgtagaagcaaagactttgactttgatgttttgatgatgccatatgagcatgatgtgttgatgccatatgaatatgcgcttctcaagttaagatcaagacaaaaatccaagagattcaagatacatcatcaagaagatctctag

SEQ ID NO: 46443 - DNA, 935 bp, Glycine max
  Peptide Sequence Number=SeqID_163221
ggtctgatccagagttgttaaagtggttcgctcaggcagaactaatgcattcaagatgggcaatgctggcagtgttcggaattctggtccccgaattgctcgaaagaatcggctacatcgagaacttctcttggtacgatgctggcacacgagagtattttgtggaccccacaaccttattcgtcgtgcaaatgggcctgatgggctgggtggagggtcgaagatgggccgacattgttaacccagggagtgttgacattgagcccaaagtgccacacgtcacgaacccaaagcccgatgttgggtaccctggtgggctttggtttgacccaatgatgtggggaagaggttcgcctgagccagtgatggttttgaggaccaaggagatcaagaatggaagacttgcaatgttggcttttgttgggttctggttccaagctatttatacaggggaaggacccattgaaaatttgatggcacaccttgctgatcctggtcactgcaacattttctcggagccagttactattgatgtacgtgctgatacacagggtttttcaggtgggcccaaagatacttcagcgttgacagattatgttcatcatgtggcaatcaaagtttggaaaggacaggaatgtactaacttaaagttggcctctcatgggagaaaggtagagaaatttggaagacctacaccagagattgaaggcatagtggaaactagtagtttccatcttctgataggagatgtcactatcaccctcaatgatgtggcatcattgttacatctgtccattacaagcgccttccataccttcgatgctcatgatgtaaaccaagtcgtggacttgatagttgagttgcttgaagttagtacacaagaagcaaaagatgagacatttcaaaccaaagggacatatgttcgcctagcctga

SEQ ID NO: 46444 - DNA, 243 bp, Glycine max
  Peptide Sequence Number=SeqID_163222
atggtgcatgatgatacatttattgtacctgatcctcttcaacaactcatcaacgcaacaactatactagaaccacctgcacctactgatatagatatgcctcgacatgcagtggatgcttgtcaattgatagcaggaattctggaacacatgatcaacacgaggatgattgttgttggaattaaagcatacactttgactaagcattgcctgagattggccaggggtacccctgagtgttag

SEQ ID NO: 46445 - DNA, 1425 bp, Glycine max
  Peptide Sequence Number=SeqID_163223
atgtcgagctcagacacagagaaagagaaagccctgaggttgaagatgacagggaggaaccaccggaccgttttttctaacaaagtgacccgacccgacccgcaaagttcgcaactgagtggttatatactgcccagaaactcacaattaaccatggcggggtcggaggcttctccaaaaatccttttagcaaagcctggactcgtcaccggaggtcccgtcgccggtaaattcgggcgtggtggcggcggcgatgacgactccactcagctccgttctcgtcttccgtctgcagcatccctcaaccttctctccgactcctgggatttccgcatcgatcgctttctcccttttttgactgagaatacggactttactgtgattggagtgattgggtcacctggagttggcaagtccactattatgaatgaaatttacggttttgactcaacttcccctgggatgctaccaccttttgccatacagtctgaagaaactagagctatggcacggcattgttccacgggcattgaaccaaggatttctactgaacgtattattcttcttgatacccagcctgtatttagtgcttctgttttatctgagatgatgagaccagatggctcttcaacgatttcagtgctaagtggagaaaccttgtcagctgaattggctcatgaacttctgggtattcagcttgctgttcttctagcatccatttgccatattgtgctggtggtgtcagagggaatccatgatgatagtatgtggcatttgatgttgacggttgacttgttgaagcatggtatctcagacccatccttgatgacttctctatcacagagctctagttctgggcttgagaaagataagcttcctgaacatgaagaatacatggctactcccgtgtttgtacacaccaagttgcaagatcaagactttactcctagtaattctgtgcagttgaggaaggcactcatgcagtatttcagaccatcctattttgtgagagaacacaccgaaaacaaacctgaagagcatgtttcatcttctccggttcatggcagtcaaatggattctaacatgataaaattttatgcgatccctctcaagaaaaaagacgaaaatccaagagctcagcatgaaagttacgtttctgcactatggaaattgcgtgatcagattttatcaatgaagtcaccatctttcacaagaccagtgtcagagcgtgaatggttaaagaattcagccaagatatgggaactggtaaaaagctccccaacgatattggagtattgtagaacacttcaacattcgggtgatttagaaccaaggccaacccttaatctcaaggcaaaagagccaaggccaacccttaatctcaagacaaaagagccaaggccaacccagccgtaccgaaattaa

SEQ ID NO: 46446 - DNA, 450 bp, Glycine max
  Peptide Sequence Number=SeqID_163224
atggcgtcagtggtgaagaacgtactcaaatcggtcagagaaaagggtttcggcgctttcctcagggagctcaaggatgaaggctacctgcaaaccaagatccacaatattggggcaacacttgttggtgttgataaatttggtaacaagtattatgagaagcttggagacacacagtttggaaggcacaggtgggttgaatatgcagagaagactagatataatgcctctcaggttccagctgaatggcatggttggctccacttcatcactgatcacacaggagatgagcttcttttactgaaaccgaaaaggtatggtattgaacacaaagaaaatttgtctggagaaggtgaacagtatatctatcattccaaaggacatgcacttaatccagggcagagaaactggaccaggtaccaaccatgggagtccaagcctgaaccatga

SEQ ID NO: 46447 - DNA, 774 bp, Glycine max
  Peptide Sequence Number=SeqID_163225
atgatggttttgctttccagtttcgttccattcgagttgcgatccatgacgacaccatcttcttcctcctcctcagctccgcaatcgcaattcacctattccaacccctcctcctacttccctgtgccctttcatctacagcaacctgcaaccactcactatgctgcaccctatgttgctgctccgtccgtgcaaatcccggcacctcccatcgtcggtcctgttgtgccagcaccggtggcaggggtatactccactgtgccacaatatcaggcacaacagttatttgagagggatgcacagataataacgccggaagctcttgagaatgttaaggcagcaattgcaagcagcgatgtcgagcacaaagcagacgccaaaaagaaagcagttcctcgcaaagctgctggccaatcttgggaggatcccatcctcgcagagtggccagaagatgattatcggctcttttgcggcgatcttggtaatgaagtgaatgatgatgttctttcaaaagtattttcacgattcccttcctttaacttggcacgggttgtcagagataaacggactggtaaaacaaaaggttatggatttgtgagctttgccaatcctgctgaccttgctgctgctgttaaagaaatgaatggaaagtatgttggaaatcggccgataaaactacgcaagaaatcacattcaaaagaaaccgaaattgccaaggaaaggcgtgctgcacaagtgacaaaaggccagaatctgtgtaaatcagattactaa

SEQ ID NO: 46448 - DNA, 417 bp, Glycine max
  Peptide Sequence Number=SeqID_163226
atgggaacacaaccccagcaaacatttcgggaggaagaggaggaggagatgcaaggccatggaactacgatgtcaggtcaatcaatgtcaacaagcagaagtgtcgggtctccatccagccggagtgagcagacaatggcaacacctgctagtgatagcacttttcttaggttaaaccatcttgacatacatggtgatgatgctggatcacagggcaccgttgccaagaagaaaaagaggggccaacgggctgttggaggtgataagagtggaagaggtctccgtcaattcagtatgaaaggtcatgatgatatatttccttactggttttatttcccatctattggctgtccagtgtgtgagaaggtagaaagcaagggcagaacaacttacaatgaggtcagccagttaatctaa

SEQ ID NO: 46449 - DNA, 732 bp, Glycine max
  Peptide Sequence Number=SeqID_163227
atgcaacttcctagaatattaactgtttccaacaagttgtattgtaaggaaatgtttctgaaaacagctgatgaacttgtggccgaatttgctgatccaatcaatggtgtttcaactcctgatcagcaacaatatgatgagaaaaacattcgtcgaagggtgtatgatgctttgaatgttctcatggcaatggatattatttctaaggataaaaaggaaattcaatggaagggtctccctcgtactagtctaagcgatattgaagagctaaagtcggagcgtcttgggctaaggaatagaattgaaaagaaagcagcctatttgcaagagctggaggagcaatacataggtcttcagaaacttatacaacgaaatgagcaactatatagctcaggaaatgctcccaatggaggtgtatctttgcccttcattctggtgcagacacggccccatgcaactgttgaagtggaaatatcagaagatatgcagcttgtgcattttgatttcaatagcactccctttgagctgcatgatgataactatgttctcaaggcaatgaaattttgtgagagatctcagaatgataatacaacagataattctacagatggcggtgaaggttctagcatatatgcacaggttcctacttcagtttcaaaccctccaaataggcctccttcatctccaccactccctggaatattaaaggcaagagttaagaacgagcattga

SEQ ID NO: 46450 - DNA, 282 bp, Glycine max
  Peptide Sequence Number=SeqID_163228
atggcggcatcacctggcatcattttttatattttcaattccaaagaagcttctctttatgcattgaatgggatctgctttgctgggaagcacattaagcttgaacctggtcttcccaagattgcaacatgtatgatgcagcagtcacaaaagggaaaagatgaacctgattttggtcgtagtttgagtgacaacatatccttaaggcataaagtattgggtccacacatgcctccatggtatcattggtatatacgggcctgtttggatgcactattgtaa

SEQ ID NO: 46451 - DNA, 750 bp, Glycine max
  Peptide Sequence Number=SeqID_163229
atggatgagaaacaagtagatggagaaattttgtttctaggggtgttggagtatttagatagggaagaatgttactggcattcagtggagactgatttgatgaacatttgggggttacttccattggagattgaagtagatgtgttgggtatgtgtaacacaacttctattgatccggagaaggatgctgtgatggtgattgaggatgatgtgggtgttgaatacaatgggcaagaggtggacactgaaaaatgttcaaatgatatggatcatagtgtgccattgggtgacaaggtgcttgctgaaaaatgtgcagaggatgcccatcataatgtacaagaagaagggggtgtgacttttgttgaggaacacaactatggaagggttgactacggtgtgattatagaagagaggatgatgtttagggctttgaaagttacaagaagcatggatgttaaccatggaatatttcctatagcttatgttgttatggatgtggaagacaaggaaaattggaaatggtttctaactttactacatcaggatcttggtgattactctcaatttggttggaactttatgtttgacttacaaaagggtctgctcccaactatgaaagaggtcttccctggagcttttcacaagttgtgttatgaacttgtggaggaactttttcaaacaatggaaatacaaggagctgaggggattagtctggcaatgtgcaaggactacaacaaaaccaaaatttga

SEQ ID NO: 46452 - DNA, 285 bp, Glycine max
  Peptide Sequence Number=SeqID_163230
atgacgaagcatattgatgttaggcttcacttcataaaagacgtggttgaatttgaagaagttaagattgtgaagattgcatctgaagacaatcttgcttatttgttcacaaaatctctaccaagaagtgtgagaggtattaagattgttgagaaacataaaagaggaaacactaggtacgtagggaagagagagaaacagagtgtgaggcttaggttcatgcagagtgttcttcttgaattcaagggggcagaactaagaaggttctttgttgtatctcattga

SEQ ID NO: 46453 - DNA, 129 bp, Glycine max
  Peptide Sequence Number=SeqID_163231
atgttgggtagtgaggaccatagtggggaggagttccaggagggtcatagaaatagactctgccaagataacctatggaagctagattccatttggatagtgttggacaagtggcctcagatatcttaa

SEQ ID NO: 46454 - DNA, 1134 bp, Glycine max
  Peptide Sequence Number=SeqID_163232
atgacaacggtagctgcttctcttgatgccaaagaggtgtctacctccaaaactgaccaaaaccaagtgtgtgactgtgatccccaaactagccatgtcttcaaatcaaaattaccagatatcccaatctccaaccacctccctctccacgcttactgctttcagaaactatcccaattctccgaccgcccatgcctcatcgtcggacccgccgccaaaacctacacctactccgagacacacctcatttcacgcaagattgccgccggattgtccaacctcggaatccgcaagggcgacgtggtcatgatccttctccagaactccgccgagttcgtcttctccttcctcgctgcctccatgatcggcgccgtcgccaccacagccaatccgttctacaccgccgcggagatcttcaagcagtttaccgtctccaagacgaagctgatcataacgcaggcaatgtacgtggacaagcttcgcaaccacgacgacggcgcgaagctcggcgaggacttcaaggttgtgaccgtcgacgacccgccggaaaattgcctccacttctcggtgctctcggaggcgaacgagagcgacgcgccggaggttgatatccaacccgacgacgcggtggcgatgccgttctcttccggcacgacgggtttacctaaaggagtggttctcacgcacaagagtttaacaaccagtgtggcgcaacaagttgacggagagaaccctaacctctacctcaccaccgaggacgtgctcctatgcgtgcttccgttgtttcacatattctccctcaacagtgtgcttttgtgcgcgcttagggccgggagtgcggttttgttgatgcagaagttcgagattgggacgctgttggagctcatacagcggcaccgcgtgtcggtggcgatggtggtgccgccgctggtgctggcgttggcgaagaatccgatggtggcggattttgacctgagttcaatacggttagtgctgtcgggagctgctcccttggggaaggagctcgtggaagctctccggaacagggtgcctcaagccgttttgggacaggaaattaaagatgaatttgggtttggagtcatcgcaaactacaatttggttcttccaagttga

SEQ ID NO: 46455 - DNA, 714 bp, Glycine max
  Peptide Sequence Number=SeqID_163233
atggcagaaccctctaagaagagaaaagactcaacctccacaaccagcgctgcaggacaacgccaccacgacacttctggtgacccaccagcaccacctaatccttccctttcctccccacggtctttaactctattttcttcccacgaacaacgtcaaagattgcttgttggatcattcacttttgaatgtcatatcatgcattatattctgtgtcgtattttgcttccacattccacaaatcttgctcaggcctctaaggaagatttaattctactatgggctcttcaaaccggtcgtcaaattgactgggcccatcttgcccggtatcgtatgtataagacattacaggccaatgcacctcttccatatcctcaacttgtcactctttttctccatcattttaatgtccctttagatgatgaaccatttgttaaagtcaaccgttcttttgagcatggataccgaaagggtgaggatggccaatgggtgcggaaacaagaccttccacctctgatttctgatgaccgcacaccctccccaccgccacaaagggattcctcgtcttcactgttgcatgatgttctcactgaacttagggatcttcaggcatttgttggtgatcgtttcaatgccatggattcacgaattacgcgtcttgagaatgatatgagctttattcgtcgatgctttgatcctccagcggatccataa

SEQ ID NO: 46456 - DNA, 147 bp, Glycine max
  Peptide Sequence Number=SeqID_163234
atggctctatccagacaaaggtacggaatattaatattcccaaaacttgatcttattgctctcttgaaggaatatagtggtgttatcattgaagaggatgcttttatcaattattccatacctctaacaggattgtaccacgcgtag

SEQ ID NO: 46457 - DNA, 294 bp, Glycine max
  Peptide Sequence Number=SeqID_163235
atggccatatctcaatacctagccgaatctgttgatgttaacaagttaaaatttgatttgaagaaggttgaaagctccttggactcggccttaactgctaacatttctatgacaggggataatgcaaccttgaaggacaagatttccaaacttgaagaaattgctaaggatgaattgatttttgatattaataaggatttatgcaatggggcccttgtggtgattgatgatatccctgtatatgtgcctccaagcaatgctcagtcgtctactcccattggtgagactagataa

SEQ ID NO: 46458 - DNA, 366 bp, Glycine max
  Peptide Sequence Number=SeqID_163236
atgaagttcccatcagtagttaattccataataatagtccatgcctaccaaaagaaggctagtgagtgttacatggctagactacaactaacccatatggcgaaaggcaagtcatacaaagatataaacaatgttgagatgttagcagttgatggcacatcaagacataggattttgagcttcctagatgcttactcagactataaccaaattagaatgaatgtcgaggcaacatatcaatacttaatggacaaggtatttgagcctcagataggaagaaatatagaggtatatgtggatgatgtgataataaagtccaatgacttactgacccatatcaaggatttggaaaaggcatttggatag

SEQ ID NO: 46459 - DNA, 246 bp, Glycine max
  Peptide Sequence Number=SeqID_163237
atgaagccactggagttattgatgcgattgtggtggcaaactgtctacttcatgcttaccgatgtggatgaacatggtggctctcattctcgtaagtgtacctccaatttcttgggttattggtttattggttgcatgttagaatcaaagtcaaaatcccctaataaatcaaaacgagatgtcgcggtggagatcttgttcgcggggaggaagatgatgaacgggatactcgcggctgcacagtag

SEQ ID NO: 46460 - DNA, 3612 bp, Glycine max
  Peptide Sequence Number=SeqID_163238
atgggttctaataggccacttctaatgacagtaccatctccaacaacaacttctagcacctctattgatcctgagcttccaaaatcaaagtcaagttccagcaataacgccttcaacccttttgagaacactctcaacaactcatcatcatcacgcagaagttctgggagcaggagcaacaactctatccatgaagtgagtttgagcagttcagggtccattaaatccaaacctgtgaggtatggctcaaagggtggtgcagattctgaaggactcagcatgtcacaaagggagctcagagatgaggatgcaaggttagtgtacataaacgaacctttcaaaacaaacgaggcttttgagtttgcagcgaactcaatccgcacaagcaaatactccctcctcactttcattccaaggaacctctttgaacaattccacagggttgcttacgtgtacttcctcataattgcaattctcaaccaacttcctcagcttgcagtgtttggaagaactgtttccatcttgccactggcctttgtgctgtttgtcacagctgtgaaggatgtgtatgaggattggagaaggcaccagaatgataaagttgagaacaataggttagcatcagttatggttgatggaggaagaagctttgtggagaaaaaatggagggatgttagagttggtgaggtgataaagatcaaggcaaatgagactatcccttgtgatactgtgttgctctcaactagtgatccaactggagttgcatatgtgcagactattaatcttgatggtgagtccaatttgaagacaaggtatgcaaagcaagagacacatggtaaggaggggtttggtggggtgattaagtgtgagaaacccaataggaacatttatggatttcttgctaacatggaagttgatggcaagaagttgtctcttgggtcctctaatattgtgcttagaggatgtgaactcaagaatactagttgggctattggtgttgctgtgtattgtgggagtgagaccaaggctatgctgaataactcaggagctccttctaagaggagccggttggagacatgcatgaattctgagatcatttggctctctttcttccttgtggcattgtgtacagtcacctcagtttgtgttgcggtgtggctgaagcgccacaaggatgagttgaatctgttgccttattataggaaacttgacttttcagaaggggatgtggatagctatgagtactatggatgggggttggaaattttcttcacatttctcatgtcagttatagtgttccaagtgatgattcccatttccttgtacatttccatggagcttgtgagggttggtcaagcctactttatgttccaagacaagagaatgtatgatgaggcaacaaagtcaaggtttcagtgcagggctttgaacattaatgaagatttggggcagattaagtatgttttctcagacaaaaccggcactctcactcagaacaagatggagtttcaatgtgcaagcatctggggggttgattacagttctaaagagaacaacagcatggagagggatgaggtagttgaacattctgtgaaagtggatggaaaggtcttcagaccaaaaatgaaggtgaaagtcaatccagagcttttgcagctatcaagaagtggacttcaaaatgtggagggaaaacggattcatgatttctttctagcaatggcaacctgcaacactattgtgcctcttgttgttgacacaccagaccctgatgtcaagctgatagattaccaaggagaatctccagatgaacaagcattagcttatgctgccgccgcctatggttttatgctcacagaaagaacctctggccatatagtcattgatattcatggacaaagacaaaagttcaatgtcttgggtttacatgaatttgacagtgacaggaagagaatgtcagttatattggggtaccctgacaattctgtgaaagtttttgtcaaaggagcagacacatccatgcttaatgtgatagacaagtcatttaaaatggacttagtaagagccactgaagcacatcttcactcttactcttctatgggtttgaggacacttgttattggcatgagagacttgaatgcttcagaatttgagcaatggcatggatcctttgaggcagcaagcactgctgtgtttggcagggctgtgatgcttcacaaggtttcgagcattgtagaaaacaatctcaccatattgggagcatctgccattgaagataagctgcaacaatgtgtgcctgaatccattgagtctctaaggattgcaggcattaaagtatgggttctgactggggacaaacaagaaactgccatatccattggctactcctcaaagctcctaacaagcaacatgactcagattataatcaatagcaagaacagagaatcatgcagaaaaagtttacaagatgcccttgtcatgtctaaaaagctcatgtccacatccgatgttgcaaacaatgctggaggaagttcacatgcaactccagtagccttgattatcgatggtaccagccttgtgcatattcttgacagtgaacttgaagaacagctatttcaacttgcaagtagatgttctgttgttctatgttgccgagttgctccgctgcaaaaggcagggattgttgcccttgtgaagaataggacatctgacttgacactagctattggagatggtgctaatgatgtctcaatgatccaaatggctgatgttggagttggcatcagtggacaagagggtcggcaagctgtaatggcatctgattttgcaatggggcagtttaggtttttagttcctcttttattgatacatggtcactggaattaccaacggctcggttatatgatactatacaatttttacagaaatgctgtccttgttcttgtcctattttggtatgtgctctacactgccttcactttgacaactgctataaatgaatggagctccacgttatactcaataatctacagttcattgccaactataattgttggtattctcgacaaggatgttggtaaaaggactctcctaaagtaccctcaactttatggggcaggacagagacatgtggcctacaacaagaaattatttttgttaacaatgttagatactttgtggcaaagcatggttatcttctgggcacccctctttgcatattggagtagcacagttgatgtggcaagcattggagacctttggactttaggagttgttattttggttaatttacacttggccatggatgtcattaggtggtattgggtgacccatgctgtcatttgggggtctatagttgcaactttcattagtgtcatgatcattgatgctatccccaatcttcctggctactgggccttctttgatgctgcaggaactggattgttctggttattgttgcttggaatcatagtggcagcattgcttccacgtttggttgtaagatttgtttatcaatattattttcctaatgatattcaaatttgtagagaagctgagaagattgggtatgagagagttgttgaaagtggacacatagaaatgcttcctatctaa

SEQ ID NO: 46461 - DNA, 243 bp, Glycine max
  Peptide Sequence Number=SeqID_163239
atgagtggtggaggcggttcctccaaccgacatggtagtggagcagggatcatattagaagggttaaacaacgtagccttgccacaatccttatgcttcaagttcaaggcaaccaacaaccacgccgaatatgaggttgtactagctggcctaaggctagcaaaggatgtggggggcgaagggtcaaatgccaaagtgattctccggttgcatcagaacaaattaacaaagtcttccaagtga

SEQ ID NO: 46462 - DNA, 183 bp, Glycine max
  Peptide Sequence Number=SeqID_163240
atggccaagtcccataacatattgagaggcagtgaggtagtttttgagatgcaagcacacgtcctggcaaaagaattttctttaaagagagttttggagtttctaaatttgtttttctacaagaaatctgtggtgactaggggaatggatttcaaattgtcagaagtatttacagcagagtag

SEQ ID NO: 46463 - DNA, 144 bp, Glycine max
  Peptide Sequence Number=SeqID_163241
atggaaaagtcaacaacaaaaggaaaagatgaaatagacaggaaatggaaaggaatgtgccatacccaacatagtgataagtcaagcgaggaatcgccacataggttagaccttcttccacttgaatcaagtgcaccatcttga

SEQ ID NO: 46464 - DNA, 1706 bp, Glycine max
  Peptide Sequence Number=SeqID_163242
atggactttgacgacttagaagaagcgccgataaaggccacgtctcgagtctccaagttcgcgccaaaatcatcaaagctcaaacctaaaccaaaatcagaacctgccccccccaaacctgaaccccaaccacccatctccaaaccagagcctcaggaattcgttgcagcaactgtcaaaaagaatgaagatgatggcgtcgaaacagtgccaccaactcatacgaaacccgaactcgacgccactgtcaaaatggaggaggccgaagacgaaccagaatcagttcgagacgatcccatagacgaagatatccctgaagaagacacagttgtgcgcgaaattgatgtcttcttctctccttctgtcgatgcccagactcagctatacgtctttcagtatcccttgagaccttcttggcgaccgtacgatttggatgaacaatgcgaagaggtaaggttgaagactaaaacttcagaagtggagattgatttatccattgatcttgactcggaccatattgacaaagagtttgccaccaaatacaacatcacaaagcagactttatcaactacgtggaagccatctcatgcaaatggatgtgctgttgggcttcttatgggtgataagttacacctgcatccagttcatgcagttgtgcagctccgaccaacattacaacatcttaattctggtggttcaaaacggaagaacgctgcctccactggagcaaatgctactgtcaaaattgagggctcaaatgaagagaagtctgttgctacatcaaagaagcagaataagcagacaggaccttctattattgagcaaaagagtgatggtgatgagtgctgggttcctctaaagtaccatagctgcaagagtgatatatcctctagatatttgcagcaaatggtgacacaagaaagttctcctataaacttcacaatgagagcgtatgattatgttactgcactgtgtcctggtgggagcagcaacaatttaccaaaaggtctttctaaaaggtatcttctatcattgcccgtggaagagcgtcttaagaaaatgcttgaggatcgtccacttcatcgtttcagtgctattaagcactttgctccagaatattccgagaatgaacttctaggattcctgcagcagcatgcaatattggtgtggggactatggactgcaaaaagttcattgctatatcctgatggtggtgtggaaactttggccagagattattccctactattgtttagcaagagtttgaaagttcagttttctgatgtgagtattcgaggaggtgaacttgttaatcgtgtgagaaactgcctgaagatatttggcgtggaaagaaatgatcttgataaatctactggaaaaccaaatccttactggaagttcagagagcttcctgacgagtcattcaaaaaactctatccagatattgttgaaaaacaggaagaacttttcaaaggtttggaaaaacagttatctggtttttcttcgaatgttggaaaacgtaaaattggtaaaaatgctgtagcaaaccaaggtgtgaacactgaggttcataaatcagaaagttcagatcaacgggtaacaagtctgggcagagtgcctcctgcgaaaatgaccatgtcaaatgaaacccgacatgctctgccaattgccctgaagaaactttttcagactcacaaagtttgcag

SEQ ID NO: 46465 - DNA, 1458 bp, Glycine max
  Peptide Sequence Number=SeqID_163243
atggagggagcatcgaggaatggtagtgtttgtgtggcaccgtttctgagcaagacatacgacatggtcgatgatccttccaccgactcggtggtgtcgtggggcaaaaacaacaacaccttcgttgtttggaacgttccccaattcaccacagacatcttgcccaaacattttaagcacaacaacttctccagcttcgtcagacagttgaatacttatgagttgaagtccggtaagcttgtccgcaccatgattgaaactgcctatgctaggtgtttggttggtttcagaaaggttgacccagatcgatgggaatttgcaaatgaaggatttttaagaggtgaaaaacaacttttaaaaagtatcagtaggcggaaatctgctcatgtaaatggtagtcaacaaccatctcaagtgcataaatcagctgttagagcatgtgttgaagtggggaaatttgggtttgaggaagaggtggaaagactgaaaagggataagaatgttcttatgcaggaacttgttaggttgagacagaaacagcaagggactgataaccaattgaaaaatgttgggcaacgtgtgcagtcaatggagcagcgtcagcagcaaatgatgtcattcctggcaaaggctatgcagagcccatgcttcatagctcaatttgttcagcagcagaatgaaagtagtaaacatatccctgggagcaataaaaagaggaggctccagcgacaagaagaagatagtttagccaccaaggatctccatagttctcttgaaggacacactgtcaagtatcagagttccataaatgaggctgcaaaagcattatttctccagatattgcaaataaacaattctacaacacaatcatcaattaagagccctgatgttttccttattgatgatgttccttctgccattgcatcagatagcagtagttcatccactcaggtttctaatgtgatggttccacctatatctgagctgacatctatggaagtaggatcacagtttcctctcaattgtatgcccagtaacatatctgagttgcagtcttcgcctgctgttttgggtttctgtagaaatcaagggatggagacagaaagcagtttattgaatcatgatctgaatgttatgggggctgatactaggaacatgggggagatagatatgatgtcaactgttttagatgaggcagatgaagctaatcatttttcacctgacacagatggaatttctaaactcccagaaatcagtgatgaattctgggaacttcttttaaggccaagcccacttacagaaggcacagaggaaactaaatgtagctctctaggatgtggtttgactgatgatcagggtttgccttcagaaatggaaaataagcaggaaaattttgataagatactacatgttgaccatcttactcaacagatgggactacatgcattggattactaa

SEQ ID NO: 46466 - DNA, 225 bp, Glycine max
  Peptide Sequence Number=SeqID_163244
atggcggctgaacacgccaaggcagaggcggcgggcggtgggcagcggagagcttgtggtggcagcggactgacgcgtttgacctgcggggtccgtgaggcagggcggggcgaaccaatttatttgatccatgcgagccttgcgcggaacggactaatccgcttaactatccctatttgtgatcacttgcacccatgcttcccactcttgttgacagggttctag

SEQ ID NO: 46467 - DNA, 276 bp, Glycine max
  Peptide Sequence Number=SeqID_163245
atggccataacagtgttttttcgacgcaaggcatcgttgatgtcgatgacaatgtcgagatcaacggggaggaagcggggggggagggggggcttcgagcaactgagagacgagagtgaagagaaagtgaacgagaaggatgtcaggtttagtgttgtgggaggaatagagttgggagaagtgaagaaggtgatggatagcggccatgacttggtgataattggggaagtggatgtggaggggagaaggccatggcggctcaggaggtccacgtag

SEQ ID NO: 46468 - DNA, 1251 bp, Glycine max
  Peptide Sequence Number=SeqID_163246
atggttgtggtggttcctcttgattggctctcttttcagcattgtcttcgcaatcgcacaacccatttgcccctctcctccagattcaccaccaccaccaccacctctctctgcttccactctcccataattcaagccaagttgccttttttcaccaattccgactcctttcaagtgggtcgacccattggcacttatggcttcatcaacgtcaccagctactctgcctttccctctgggcctggcactgactattctcttgaagacttgggaggactgaagactcaagatgttggagaaggcaatgtcaaaatcaggctctacgaagggagggtttctcggggtccacttactggaactccggtaacttttaaggtagtttatcctggaaggcgagctgggggagtcgtggctgatgcactcgctgcaaatgagttgaatacacacttgtttcttcagagcagttctaaaggtattggtcagaatcttgtgctgcttgtaggtgggtttgaaacaacgactggagagcagtggcttgcatttcgtgatgatgggaaatataacgctgcagactatgcaaaacttgcaagtgagagggtatcgagagatcgagaagggtcatcctggaatccctttgagcaaggactgacaaccaaaaggagacaaaattttatcataaagatgctccaaggtgtcatgaagggtctagcttacttgcatgaccacgataggttgcaccagagtctaggaccgttttctgtggttctcaacacaatttcagaaagagaaggttcttatttgattccaagactccgagatctagcattttctgttaatgtcaggtacacagaactagatgattcgggacaacttgtggaggggctttggagaagagcaacaggtgctggtgcattcacacaaatggagaaaagagcttttggaatagctgatgacatatatgaagcaggtcttttttttgcatacatggcttttgttccattttgtgaggctggtgtaatggatagcctttccttgcaaaggcttttggagaacactttccaacttgatcttgaagcaacacgagagtattgtctagcagatgacagattagtaaacgctgtcgagttcctggatctaggcgatggcgctggttgggagttacttcaggcaatgcttaatgctgactttcgaaaaagaccaactgctgaggctgtcctcaatcatcggtttatgactggggcagtcctttga

SEQ ID NO: 46469 - DNA, 267 bp, Glycine max
  Peptide Sequence Number=SeqID_163247
atgatgacaaccccttcaccagccattgtgcaatgtgcaactagcctttatgatggtacgattggatcattcaaaagttcattgagtgaattggctgaggatggccaaacggcaaattatgatgctaaagtggctggtgatggacctacaacttgtgacatagccttaagtaatgcaaagatcgtcaatcctactatttcagctctgaacaaggacatcctgttgattagcaaacttgcatttctagccaccgacaagcttccctag

SEQ ID NO: 46470 - DNA, 1477 bp, Glycine max
  misc_feature (1450)..(1450): n is a, c, g, or t
  Peptide Sequence Number=SeqID_163248
gctcgtccgggtcgatggcgatctgtccgcagcggtagtcgacatcgaccgagccgtcatcgtgcacgaccctggtggcaccgttcgtgaggaacagcagcagcccgttgtcggtcacgacgggggaggcgccgatctcgacgagcgcctcgtcccaggtgcctggcgtcggcgagtacatcggctcggtgtcggccgtcccgggggtccagtggatgaggtcgtcgctggtcgcccagtagatcgccccctcaccgaagtacatccaccacttcccgtgcatctgctgcggcacgatgaccccggccttggaccagttgaagccgcgcgggtccagggtcttgaacgtgtcgaagtcgtcgaacaacggaccgtgcttggtccaggtgcgcaggtcggtcgaggtggccaggcacaactgggcgctgtgccgatcccagcccgtgtaggtgaggtagtaggtgccgtcgatgagcgcgatgcgcgggtcctcgcagccgtaccgctcgtagtcctccgatggcgacaggatcggcgcgtcctcgcgggtgaaggtcaccccgtccttcgaccgtgccaagccgatgtgggagacgatgtcgtcggcgtgcgcgcggtacaggagtaccacctcgtcgccgtcgacgagcgcggcggggttgtacaggttcgccgattcccagctgtcgccgcgagggcgcaggatcgggttgccctcgtagggcgtgaacggaccgagggggaaggaggctccggagaacatgcgggccctttctgggtgaggatgtgcgaagcgctggaacacgatgaacaggatgacgacggggaacgcgagcgctgttgccccggcgaggatggcgccgttggggttcgccgtggactgggccacgttggagatgtagttcgcgagcgacaccgccagcggctgcaggctcgcgtccttggtgatgaggaagggccacaggaactcgttccagggtccgatgaacgtcacgagcacgacggtcaccagcaccgggcggatgagcgggatcgcgaccgaggtgagcaggcggatctccccggcgccgtcgatacgggcggcttcgaagatctccaccggcagcgccttgaagaactgcacgaagatgaacaccgccgtcgtgttgatgaggaacggcaggatcatgcccaggtacgagtcgcccaggccgtagttcctggtgatctgcacgtagagcgggatcatcagcagctggaacggcaccatctgcaccagcagcatcagcacccagatcacgccgcgcccccggaagtcgaggcgggcgatggcgtagccggcgagcagaccgaataccacggtgcccagcagcacccctgccgtgaagatcagcgagttcgcgagcgagccgaccaggtcgatgcgcgagtcgatcgcgacgaagttgtcgacggtccacccgctcgtcgngaacagctcgtcgggggagttcgtcgg

SEQ ID NO: 46471 - DNA, 174 bp, Glycine max
  Peptide Sequence Number=SeqID_163249
atgagtgagatacgaagatttggaggtttgggaatggaggaacgtcgtgagagaaaaaggggctgcgcagggatttctggaaaatgtgatatttatagagcaggacgcgtggctatctgttctagtgtaatcgattacagtattcatgtaatcgatcaccagaacaaagaatag

SEQ ID NO: 46472 - DNA, 354 bp, Glycine max
  Peptide Sequence Number=SeqID_163250
atgtcgtacaggatgtcacgacatcacgcttcagaacatgcagattatatgtgtccgtatgaacaaccactgtttacaaccttctcacctaaccactacccgtgcgacctctacctaagagccactcttagatatgagaaaccccgctcactccctctcaaacactctcccgtgtttacaattaaatcaaagacacaccagagatcaactctgaacaaaagggatcaaccctacacactagagatcaactctacacacaagagatcaactctacacactcaggtccaacacttgatgttagggtaccatcaaggtggctcacaaaacactcaagtcccaaaactcacaaaataa

SEQ ID NO: 46473 - DNA, 660 bp, Glycine max
  Peptide Sequence Number=SeqID_163251
gtggaagaagcaaggaagcaagcttctatcctccaatcatatcttgaacagagaggggttgctctgcctgaaggatacatatcttgcaaagttatacttccaaatcctaaattatgtaccgttccagcagatggttttccatctgaagttattacccatgatcaatggacgcgactgaagccagaaccaaagagcatgctgtctagttgggtaaagggtgcctttcgcagtgggaagaaggatatgcaagaatctgttaatcagaatcttgattttgtcctttgctcagctccaatatgggatagtttttcactaacaaaagagattgtttatagggtgcagcttaaaggcaacaagtatgtactgggggagttcctggaatttaagggcaaacaagaagatgttgaggctttaagacatattagaagatcaaaagttggtcgtatcataatccaaaagacaagcatgtttggactagctccttctaggcttcaagttctatacagcttgcgtgactatagaactgaaggggcatcagaaccagagtggaaagaagtaaccgtcagatcaagtactgagatagtctttcagcctgaaaatgcttcaaaagttcgaaagtttaagctctcttcagtgagctctatgcttcttagcgcttga

SEQ ID NO: 46474 - DNA, 489 bp, Glycine max
  Peptide Sequence Number=SeqID_163252
atggccacacacactaagagacttgtgttcttgacgcctcgtgcttgtgaattccggtccatagacttcaatgcatcagttcacgatgattctgcttcgactgcattgaagctcggttttctgccaaccaaatcttattatgttcgaatcctaggtgttcatgaacaattatcttactcacctgttgcattcgatatggatgtcaggttttttacatttctctatggttttgggtatgactcatcaacagatgactacttggtggttcaagcttccaacaacccaagcttagatgattatacaacccgcctggaatttttctcgctcagagctaatgtgtgcaaagaacttgaagattattgtttgcaagagcatcgattctattgcaatggtccaaatggatacgaggtggctgtgtatactgagtctctactttcactccctacttacatctcccaattggcagtgaagcaagaagaagatgattaa

SEQ ID NO: 46475 - DNA, 599 bp, Glycine max
  Peptide Sequence Number=SeqID_163253
ggggaggattcttctcttcttcagcatcagggtatactaagggtctggcccttctcctcttgggtcagaggagtgacgataaatccatgagagttttgccgtggaaccagttccatttgggccaagaatctgaccacgagctccagctggcttccagaaagaaccgtgtctccagcgggtgtgcttcctttgtatgctttggtcgtgtctctgcagggtttgacactacatctcatcttaaagtgggccctgccaaacatcatgatgtctcttcagggacactggtttccaacaagggcaagtacccttctgctaatgtaaatgatgatagtagaaaggttgcacttaaaagtagcttaaaaaggaaacaaaacaaaaaaccagctcctgttgaggctgctactgaacatgaggcatcatccggtggaaagaggaaagtgcagtggacagatacttgtggtagtgagcttgttgaaatacgggaatttgagcccaggtttcaactccccaagagtcgacatcttgttggctatgcatacgatgctcctctcaaccgcttcatatgtatctctttccaagacattggcaaccaactctga

SEQ ID NO: 46476 - DNA, 273 bp, Glycine max
  Peptide Sequence Number=SeqID_163254
atggagaaaaacaactccctccctaaatactcatgctcctactcagaatttgggttcgctgaacgatcaaactcttacaatttcaacgggccaatccaaaagggaagtgggttttgtgcagcaaatgatccagagcttaagaggaagaagagaatcaaggcttataacgtgttcactgtggaggagaagcttaaaacaagtgttagaaacgggttcaagtggatcaaggacaagtttggtgacattcacagtgggggaaagaaaatagaatga

SEQ ID NO: 46477 - DNA, 381 bp, Glycine max
  Peptide Sequence Number=SeqID_163255
atgaatgagttggattattgtggagaagagccatctatgtcacctagagcaccactgcaacaccagcagtcacaaccagcattgcatgcccctagttttccggtcacttcagcatcttctggtcaaacaatagttgcacaaggactccgctcggaccactgtgaaaatcaatcaaagaattatgtgttttcaaatgctttgtcaagtccaatatgtcgaagccttcaacattatcaaattggtgaaggaggatgctacaccaatggtctctccatggggaatggaaactggaatactgaacctggctttcttcaccagcaaagcagggattcgaatgcaatgagctccaatgattctaacatggatatgcatgcagactag

SEQ ID NO: 46478 - DNA, 3052 bp, Glycine max
  Peptide Sequence Number=SeqID_163256
ggtttgcgttgtgttggtgattatgaggaagagagagttgaacagtcttgcctctcgctctctccaattcttaaaaccaaaacccttttccacatcttcttcgcatcaccctctcccaggactccttcctcctgaagaaacttctccgctcgattcttcccccgatttgtcgcaacactacgcattcctccgcacctctttgctcaattccgccaccacccaaacctctaacgacgccctatccatctcaaacgcaatcagaaccggctttggcgccgaaacccaaaatttcctgaggcagttccggggtaggttaagcgaacctttggttgttgaggtgatgaatctcgttaaacaccccgagttctgtgtcgagtttttcctctgggcgagtcgccaaatcggttactcccacactccggtggtatacaatgcgctaattgagttactgtgttgcaatgccgttaataatgatagagtctctcacaagttcttgatgcaaatcagggatgatgatagggagctgcttcgcaagttgctcaattttctcattcaaaagtgttgcaggaatggaatgtggaatgtggcattggaagagctggggaggctcaaggattttggctacaaggcttctcccaccacttataatgctttgattcaggtttttcttagggctgataagttagatactgcttttttggttcatagagagatgtcgaattctgggtttcgtatggatgggtgtactctgggttgttttgcctattccctctgcaaagcgggaaggtgtggggatgcgctgagtttgcttgagaaggaggagtttgttcctgatacggttttttataataggatggtttccgggttgtgtgaggcttcactttttcaagaagctatggatatcttggatcgaatgcggtctatttcctgcattcccaatgttgtcacttataggattttgctctctggttgtttggggaaagggcagctgggcaggtgcaagagaattcttagcatgatgatgactgaaggctgttatccgaatcgggagatgtttaattctcttgtacatgcttattgtaaatcaagggattactcttatgcatataagttgttcaagaaaatgataaaatgcgggtgccagcctggctatttgctttataatatattcattggtagtatatgtagcaacgaggagctgcctggctcggatctgttggaattggctgaaaaggcttatagtgagatgcttgatttgggggtcgtgttaaataaggtcaatgtcagcaattttgcgcggtgtctctgtggagctggaaagtttgataaagcctttgagattatatgcgaaatgatgagcaagggttttgttcccgatgatagtacgtattctaaagtgattggttttctttgtgatgcctccaaggtagagaaggcttttttgttattcgaagaaatgaaaaagaatggcattgttcccagtgtgtatacatatactattttaattgatagcttttgcaaagctggccttattcaacaggctcgcaattggtttgatgaaatgttaagagacaattgcaccccaaatgtggtgacttatacttctcttattcatgcatacctgaaagcaagaaaggtgtttgatgcaaataaactatttgagatgatgttgcttgaaggttccaagccaaatgttgttacatatacagctttaattgatggtcattgtaaggctgggcagatagataaagcttgtcagatctatgccagaatgcaaggtgacatagaatcctctgacattgacatgtattttaagctagatgacaacgattgtgaaacaccaaatattattacatatggggctttggtggatggtttatgcaaagcgaacagggttgaagaagcccatgaattattggataccatgtcagttaatggttgtgagcccaaccaaatagtgtatgatgctcttatagatgggttttgcaagactggaaagcttgaaaatgcacaagaggtgtttgtgaagatgtcagagcgtggatactgtccaaatttgtatacctacagctctctaattaatagtctatttaaagaaaaaagattggatcttgttttgaaagtgttgtccaagatgctcgagaattcttgcactcccaatgttgttatttacacagacatgattgatggcctctgtaaagttggaaagacagaagaagcttacaggctcatgcttaaaatggaagaagtgggttgttatccaaatgttataacttatactgcaatgattgatggctttggaaaaataggaaaaattgaacagtgccttgagctatatagagatatgtgctcaaagggttgtgcaccaaattttataacctatagggtcttgataaatcattgttgttccactggccttcttgatgaagcacacagacttctagatgaaatgaaacagacgtattggccaaggcatatatcaagttaccgtaaaattattgagggctttaaccgagagtttataacctcgattgggcttttagatgagctgagtgagaatgaatcagtgccagttgagtctttatacagaattttgattgataattttatcaaggctggaagactggaaggtgcattgaatctacttgaagagatttcatcatctccaagccttgcagttgccaacaaatatctatatacttctttaattgagagtctgtcacatgcaagtaaggttgataaagcctttgagctttatgcaagcatgataaataagaatgtggttccagagcttagcacatttgtccacctcatcaaaggccttaccagggttggtaagtggcaagaagcactacaattatcagacagcatatgccaaatggtttgtcacgtttgctctaactttgtaaattacaaaacaacacgagcacttcctttatgcattaagcacttcctgatatccactggcttcatgaagaggtaccaatgcgaattagtttctgatgcacagaactgcagattgaatgggagttctgtaactgaaggaaaatga

SEQ ID NO: 46479 - DNA, 603 bp, Glycine max
  Peptide Sequence Number=SeqID_163257
atgaaatacaagtctcttcattcgggaaaggttcggtaccttgccattgtcatagaaagtgaagaagcttatcagatttccaaagttgttaaactttcgcagtggcttgactctattggtgtaaagaatgtgtgcctttatgacatgaatggtatgaaaagcattaaatcagtgcaggaagttagtgaagtcgtcacactccatgctccagatcacatgactttagaatttctttcttatctggatgggaaggaggcagtggccaaagcagctaacttgatttttgtggaaaactcgaaacgacataacttgggtggagaactagatcttcaaatcttgttagaacctcaaatgaataaagcattgcaaattgttggtagcaaaggccccgagcctgaccttttattggtttatggacctgtgaggagccatcttggttttcctgcatggagacttcgttacacagagatcatacatatgggatcattgaacttcatgagatatggttccttaatgaaagtcattaacaacttcacgaaagtgcaccaaaattatggtaagtattctctttaccgagtcatttactggtctgccatggtttga

SEQ ID NO: 46480 - DNA, 661 bp, Glycine max
  Peptide Sequence Number=SeqID_163258
ttcataccatgatgtgataagggtgtcagagatacaaaagtttctggacatagcaggggtccaaacttacattataaacagtgccaagattgtgttcttgaatgaaaggcctcaacctaggcctggcaaaggagtcaccaacacctgccaagtttgtgagcgcaaccttcttgattcattcagcttctgttcccttggttgtaagatagttggaacctccaagaagttccggaagaagaaaatgttagctgagacagaggggtccaatggtgaagaatcaataaatggcattagcaatgaaagtggaagaaacaaaatccagagcttcacaccctcaacaccaccgccaacagtggtaaattacaggactgctaagaggagaaagggagtcccacatagagctccaatggggggtgacttaccaaaccataattataccctgaaagatacaacagttgtttccagtgccacttccctaagtggcaatatatgccttgtaaaagttacaatacctgagccactgttcactgaggccggtgtagggaaatggttcactatcttgtatagtaggtgtaagaatagcagtaaaatcatacgtattggtatcagatgcgcaatgtacaaagtggcttgtagaaagttgttgtattttacacaataa

SEQ ID NO: 46481 - DNA, 315 bp, Glycine max
  Peptide Sequence Number=SeqID_163259
atggaggttgaggagtcctccaaaggcagccaaaaggaagcgaaagggaagaaaacaactcttgaaacaaagattagagagatgacgagcacaataccagaccattgtgcattccttctcacggccagtctctcaaatgattcaaaaaaatcaaaccaaggatacttccccagctccttgcatctcaaacatggcccaaaaagcttagctgccaagaaaatgaatctggcatgcaaatgcctgatcacaaacagatctttgaaaccaacactgaagctctgttcgcaaatgataggaggaaaaacctcctgttag

SEQ ID NO: 46482 - DNA, 2262 bp, Glycine max
  Peptide Sequence Number=SeqID_163260
atgtcttcaataacttgtcagtgctcttggctgctttccaatgatgccagacatgccaattttgctcaaatcccttcatgggtctctttgaaaagcactcattcttcattcaggacccatcaaaatcaacaaggccaagttgaaaacttgcatttgatttctttagccaaacaggggaagcttagacaagtgcacgaattcattagaaacatggacatagccgggatttccattaatccccgatcatacgaatacctctttaaaatgtgtggaacattgggtgcattgtctgatggaaaattgtttcataatagactgcagagaatggccaatagcaataagttcattgataattgcatccttcaaatgtattgcgactgtaagagtttcacagctgcagagagattctttgataaaatagttgatcgggatttgtcctcttgggccaccattatatctgcttacactgaggaaggacgtatagacgaagctgttggattgttcttgcgtatgctggatttggggattattccaaacttctctatcttcagtactcttataatgtcatttgcagatccttcaatgttagaccttggcaaacagatacattctcagctgataaggattgagtttgctgctgatatttctattgagacattaatctccaatatgtatgtaaagtgtgggtggttggatggtgctgaagtggccaccaataagatgactaggaaaagtgctgtggcttgcactgggttgatggtgggctatactcaagctgcaaggaacagggatgctctgttgttattttccaagatgataagtgaaggtgtagagttggatgggtttgttttttcaataattctcaaggcttgtgctgctttaggagacttatacactggaaagcaaattcatagttactgtataaaacttggcttggaatccgaggtctccgttggtactccactagtggatttttatgttaagtgtgcaaggtttgaagctgcgcgtcaagcatttgagagcatacatgaaccaaatgatttctcatggagtgctttaatcgctggatattgccaaagtggtaaatttgacagggctcttgaggtttttaagacaataagaagtaaaggagtgttattgaattcattcatctataacaacattttccaagcatgctctgctgtctcagatttgatttgcggtgctcaaatccatgcagatgcaataaagaaggggctagttgcatacctctctggggagagtgctatgatcactatgtactcaaaatgcggcaaagtggactatgcacatcaagcatttttggcaatagataaacctgatactgttgcatggactgcaataatatgtgctcatgcttaccatggcaaagcttctgaagctttaaggctttttaaagagatgcaggggtctggtgtaaggccaaatgtggtcactttcataggtttgttaaatgcttgcagtcattcaggtttagttaaagagggaaagcagtttttggattcaatgactgacaaatatggtgtgaacccaacaattgatcattacaattgcatgattgatatatactctcgtgctggactgctgctggaggctcttgaggtgataaggagtatgccatttgagcctgatgttatgagttggaagagtttattaggaggatgttggagccggcggaatcttgagattgggatgattgctgctgacaacatctttcgcctggacccactagactctgctacttatgtgatcatgttcaacttgtatgctttggctgggaagtgggatgaagcagcacaatttagaaagatgatggctgaaaggaacttgaggaaggaagtcagttgcagctggattattgtgaagggtaaagtccaccgttttgtggtaggtgatagacaccaccctcaaacagaacaaatatactcaaaattaaaagaactcaatgtttctttcaaaaagggtgaggagcgccttctcaatgaagaaaatgctctatgtgactttactgaacgaaaagatcaacttcttgatcatagtgaaagactagctatagcctatggtctcatatgcactgcagctgatacccccattatggtattcaaaaatacacgatcatgcaaagactgccatgaatttgcaaaaagagtctcagtagtaactggtcgtgaattagttgtgagagatggcaacaggtttcatcatattaattcaggggaatgttcttgccgtgattattggtga

SEQ ID NO: 46483 - DNA, 303 bp, Glycine max
  Peptide Sequence Number=SeqID_163261
atggggggtggaggaggtgcaattggggtgagaggtctcaatgaagatgatgatgatattggaaagattgaagaagaaaacaagtggccaccatggcttaggccacttctccaaacaagcttttttgttcaatgcaaagtccatgcagattcccacaaaagtgaatgcaatatgtattgcttagattgtatgaatggagccctttgctctgcctgtcttgcttcccacagagaacacagagctattcagggatttgaaccccccaaaagccaaaactcaaggatttggatgcctgtaatctga

SEQ ID NO: 46484 - DNA, 2685 bp, Glycine max
  Peptide Sequence Number=SeqID_163262
atgagacttgaatcgggaacttgcaatgtgtgctcagctccttgttcatcttgcatgcatcttaaccatgctctcatggggtcaaaggctgaagagttttctgatgaaaactgtcgcataggagaggccaattctatggatgaggataatgcatgttctcttaggagcagagcttgtgaaagctcacagcacactgtcagtgaaacaagtaatatgcagagtgttaattcaagtcatgatgctctgtctgaaaatgccgacagtagacaaatcataccgaataagtatcaggattccaagcatttagaaggtcatgatgacaacacttcttgtatcagtagagccagtgatgctaatttagtgaacgatagccatcaaaggaatgaagagagaataataatgcatgtggaaagggattcatgttctcatgtcccagaaaagttgtcagaatgcttcattgagaattctagttcatcattgaccaaagagagggaacctgttgtttctggcaagaaatatattgctgttaaggatggccttattgagagtacttccaagatttcactaaaagtatgtcccaagtcagaagcagatactgatgtctgtgatgctaacaatgaagatcctaaatgtgcagttcaagatggacagtgtgagaaagctgaagagctggttaaatcacctggcaagcaggaacctcaatctgaagacgagagtgatgaatcagatgttgtggaacatgatgtaaaggtgtgtgacatctgtggagatgctggtcgtgaggatctacttgccatatgtagtaggtgcagtgatggtgcagagcacacctactgcatgcgagaaatgctcgagaaagtccctgaaggggattggttatgtgaagaatgcaaagatgcagaggagaatgaaaaaaaaagactggatgttgatgacaaaaaaatggttgaagttagttcaacctcacaagtttctggcaaaagactctctgataacattgaagtagctccagcagcaaaaagacaagctcttgaatcaagtacaggatcaccaaagacatcaagtcccaagagattagttccagtgtcccgagaatcttcatttaagagcttagataaatcaaaagtgaagcctggtcttctgatgcctattcgaaaccactctggttgttatgacacagagattgctcgctctccttccattggttcccggggtcaaaatccaaaaggtatgctgttgaagtctaattcattcaacaacttaaattccaagccaagagtcaaacttgttgatgaagttgttccccaaaaacaaaaagggggtaatgaacatacttcaaagaacatggagatgcctgctcgggtgactggaaaatcaacattattcaaatcctcaagtttggggcgatcaaatgcaactgaatcaaaagtgaaaatgctttcgccaaagtctgcaactactcaggatttgaaaggatctagacatctaaaagaatcaggtgcatttgacaggaaatttccatctaggattgatcgtcctgtggctagttcagttgtttcatctcctaagggtgatcaaaagcttacacctcatgctgaaagcaacaaagcttcagcaatgaacaacaatcgagaattgaaggttaaccaggatggaaaatcaagtgcattatcaaggtcaatgagtaatataagccggaaaagtttggagcctcaagttagttcagagagaacatcaacccgtgttgatgaaactcaacaggatgtgctgcctcgatcacgagagacagcaaatcaggttgagaaaagcagaaatagttctagtgatcgtggaaggccagctgttccgacttcaaaaaaccaattctgccaaaaatgtaaggaattcggccatgctttggaatgttgtacagctgtttctacacaggaatctggtgctgaaatatctgtcactgcctcgagtagttcaaaagaggagatgcataaagacaatacattgaaagctgcaatccaggctgctttacttagaaggcctgaaatttacaagaagaaagaagtatctaatcaaactgacgaggtttctaccgcaggcacagagttgaattgcgaagtgacttcaagagaccaagttttggtttccagcacactgaagaatagcatatctgctgatgaaacccaagaacgagaaatccttgagaattctacctcagattcttccaaatgttcatctgccaatggtttgaagcaacttaactcttgtccaactgacttccggtcccaaccaggaaagtcagattccattggtcttgcaactggaaagcctgtagtgagagacttgtctaataaagctttgacaatgtcaagtgttcctttgaagatgttggcctttcctgaatatgaatacacctggcagggtgtctttgaagtgcatagaaatggaaagcctcctgatatatatactggacttcaggcacatctatcctcttgtgcttctcctaaggttcttggggtagtgaacaagtttctacccaaagtttccctcagtgaaatttctcgcttgagcatgtggccttcacaatttcatcatggtggtgttagtgatgataatattgctctttacttctttgccagggatgttgaaaggcaagcagatggatattattcttatattgacagtagaccatga

SEQ ID NO: 46485 - DNA, 111 bp, Glycine max
  Peptide Sequence Number=SeqID_163263
atgaagtggtcaggccaaaaggcctttcgaacatctcctacaatgaaatttgtagttgatggtgcagaagcagggtctcttaatagctatggacctctctctttcctcaag

SEQ ID NO: 46486 - DNA, 3092 bp, Glycine max
  Peptide Sequence Number=SeqID_163264
aggaagaagtggttttagaggaagaggttgtggtaggaacaatagaggaagaagtggctatgcttctagaagtggaagaggtcagaataatgttgaaaataaacctgatcagtcgtagagaggcaggggcagaggctactatcgaggtggtagcaatggtagaggaagaggtgggacactttgcagatgagtgttatgcgaagaaggattcccaaggtgatgaggcaaatcttgccaaaggtgatgatgaagaaaatgagctagtgatgctcatggtgactactgcagatgaaatgtgcaccattaatgaatggtaccttgacacaggatgttctacacatatgaatggtcataaagaatggcttgtcaactttgatgcaagcaagaaaaatagaatcaagtttgctgatggtagagctatgctagcagaaggagttggaaatgtgatgatcaagatgccgaatggtacacagtactgcatatcaggtgtattttatgtacctggactagagagcaatttgctcagtctaggacaattagtggagaaaggccataaggtgattatggaagataaaaaacttaaactgtttgattcaggtggtaaaaacagtttgatatttgatgtttctatgtctagaaacaggacatttagagccaatctggaagcactttgccataaatgcctagttgcagtagtgaatgaagatgattgggtgtggcatcacagatatggtcacttgaattttagagacttgcatgacttgaatactcacaacatggaaagagaaaagcttgaagtgatatactctgatgtgtgtggcccaatgcagtgtgaatctcttggtgagagtagatactttgtatcattcctagatgatttcactaggaagatctgggtgtatatcttgaagagaaagagtgaagtgctaggagtatttaagaagttcaagagaatggtggagagacaaactggtttcttgataaaaactatagtcactgatggaggaggagagtatactagcaatgaatttgatgaattctgtgaactggaaggtattgtgcatgatgtgacacctccctacactccccaacataacggtgcagcagaaagaagaaatcaaacagtgatgaatatggtcagatgcatgcttaatggaaagaagctaccaaaatttctttgggcagaggctgtctccactgcagtgtatgtgctaaaccgaagcccaacaaaaaggctcaataaaatcacacctgaagaagcatgtgagataatgatactgctgggttatcatgccactggtggttacaaatggtttaatccaataaccaaagaagtgctcgtgagtagagatgtggtagttgatgaatccaaggactggaattgggataaagagatggtagaagagcctacaaaagttgtgattgaagcttctattgatgagccaagtgattcttctgctgcagtaattgatgacagttaccaaggaggagtaaggaaatcacagagagctagacaaccctctagcaggttacaagattatgagttgatacatgattcagcaataggggaggaaggtgagctagtacacttaactctatttgctgaatctaaatcagtgagcttggaggaagcaatgaatgacacaaagtggactgatgctatgaaagaagagctgaaagctattgaaaagaataatacatggcaacttgtgcctctacctgctaagaaaaaatctattgtagtaaagtgggtttataaggtaaaaaagaatccgaaaggagagatttccaagtataaggccaggctagtggcaaagggattcttgcaaaaggctggcattgattttaaggaggtgtttgcacctgttgcaagaatggagacagtgagaattattactgctatagcaagtcaaaaagggtggcatatgcaccatatggatgtgaaatcaaccttcttgaatggtcctttagaagaggaggtttatgtgagtcaaccacctgggtttgaaataaaaggaagtgaagagaaggtgtacagattgaataaggctttgtatggcttaaagcaggcccctagagcctggaacaggcgcattgatggctttctaatgaagcttggattcctcaaatgtacaactgagcatggaaataatgagactgaaattgccaactttaaaggagagatgatgagagaattcgaaatgactgatttggaccttatttcttattttcttggaattgaattcaagagaactgatgagggagtgatcatgcatcaagggaggtatgcaagagatgtactgaagaagttcagaatggttgactgcaattctgcagacacacccactgccactggtgtgaacttggtgaaagatcctaatgaagaagaagtagatgtaactttgtatagacaaatggtgggctcactgaggtatctttgttgtactagacctgacttattgtatgctgttggcttaattagtagatatatggagaatcctaaactttctgacttccgtgctgccaagagaataatgaggtatgtgaaaggtactctcgattatggtattctatttcccagtgctgccaaaaaatgtaatgttctgggatatagtgattctgattggtgtagagataagagtgataggaagagcacaacaggttatgtgttcttctatggtgatgccccaatctcgtggagctcaaagaaggaacaagtggtggctctctcctcatgtgaggcaaaatacattgcagctgctatggcagcatgtcaagctcaatggcttgataatatttttggtgaacttaagatgaaggaaaatggtgctattacactgatggtggacaacaaatctgccatcaatctagctaaacacccagttgctcatgggaggagcaaacacattgaaacacgatttcatttccttagagagcaagtgacaaaaggcaagctaagtgttaagtattgtccaactaccgtgcaagtagcagacatattcactaaaccattgaagattgatcggttcaaagagttaaggagcagattgggagtgattgaagatagatacagaattaaaggagagtattag

SEQ ID NO: 46487 - DNA, 696 bp, Glycine max
  Peptide Sequence Number=SeqID_163265
atggggcacacatcccttttcactccctcttcctctcttaggttcaactctcttcttgtttcctccaccccctcttcttcttcacgctccaacagcgtttctttccccgccctctccaggaacataaggaaatcggtagaagatagaaagattaataaaaattctgctgtgaaagcagtgtatggtgatgaattttggacacctgcgaggagttcacctcaggatatttggtccataaggagtgatttgcaagtcccatcttccccttatttccctacctatgcacaaggacaagggccaccccccatggttgcggagcgtttccagagtgttataagtcagcttttccaatacaggataatccgttgtggtggagcagttgatgacgatatggcaaacatcatagttgctcagctcctgtacctcgacgctgttgatcctaacaaggatattgtcatgtatgtaaattctccaggagggtcggttacagctggaatggctatatttgatacaatgaggcatatccgacctgatgtgtctactgtttgtgttggattagcagctagaagttctctggaaacactgatgaggagagtagattacatggtttttagccgtgtgagaaggggaagagggaaaccaaaaaggggattggaggaaattgttaaaactttaaaggaatctcatgatgaataa

SEQ ID NO: 46488 - DNA, 333 bp, Glycine max
  Peptide Sequence Number=SeqID_163266
atgattcatcaaccgcttggtggtgctcaaggagggcaaactgacatagatattcaggctaatgaaatgctgcatcataaggcaaatctgaatggatatctcgcctatcacactggccaaagtttagacaagatcaaccaggatacagaccgtgactttttcatgagtgcaaaagaagccaaggaatatggactcatagatggtgtcattatgaatcctctcaaagctctccagccattagaggctgcagcagaagagtttatactgacagaaggttctttaatggaacctgaatgtgattttaacttcaagcattcttttgtgatgaactga

SEQ ID NO: 46489 - DNA, 2103 bp, Glycine max
  Peptide Sequence Number=SeqID_163267
atggcagaagatcagtcagtggttggaagaagacgtatatactatgatcaacatggaagtgaagcactgatatgtagtgacagtgaggaggagttaacaggacccgaggaagaaaaacatgaattttctgaggctgaagaccgtgttatatggatggcatttgaggaatatgggttaaacgacgaggtactgaatattgttagcgaatttgttgggggcaccagtttagaaattcaggagaggtacaaaactatcaaggaaaagaacattggcaggttggaccagccttctgaaaactcaggagaatatgaatctattattggcatatgtccagagaaaagcctgagtgccgcattagattcatttgataatcttttttgtcgccgttgcctgatttttgactgtcgtctgcatggctgttctcaacctttaatatatcctagtgaaaagcagacagtttggtctgatcctgaaggtgacaggaaaccatgcagtgatcagtgttaccttcagcagttaaaggtagtaaaaaatgtgacagaagattcaacttctgggtctgatcagaataagagaactacaattacagaagaggcagatgtgaaattggctccctccattatagaggaacctagtaatcagagtatagcaccttttccaacagaagttgattgtcttggatctcttaatttaaatgttcctatctcagtgagtgtggaaaaatggaaagtcccaaatcagtcagacacagcactccgtgactcatcactccctcctgatgattctcagcattcttataaaaagctgaagacaatatctgatgatgtagttactgcaaatagtgattctagcaagaacataaattttggtgcatgtgatgaaagtatacatacaattactagtggacttttggacaaatctgttaaagataattcaaataaattaatagattcttctagcacttgctgtagtgatgagcaggacaaaagtattggggatggaccaaaagatcctacaaataagacagaatttaagaagttgtccaattcaatggaagggaaagttgatgggatgctaagggtttcagattggaaacctctggaaaaagaattatacttaaagggagtagaaatgtttggcagaaacagttgcctcatagcaaggaacttactttctggcctgaagacttgtatggaaatatctagttacatgcattctggaggagtgtcaatgccccatggatctattgttgctcctagttcaatcatggaagacaagggaaaatttgatgcagagtgcacagtgaggggaggattggagatgccatctaggtcacggttgctgaggaaaaggggtaaaacaaggaaatttaaatattcttggaaatctgctggccacccatcaatatggaaaagaattgctgatgggaaaaaccaatcttgcaagcagtatacaccatgtggatgtcagtcaatgtgtggaaaggaatgtacttgtgttaatggtggaacttgctgtgagaaatattgcggacttgacaaatgtaataaattggctcttctaccttcagttgttctaaaagctgcaaaaatcggtttagaggatgccattgtgccaagagtcagtgtagaagtcgacaatgcccatgctttgctgcaggacgggaatgtgacccagatgtctgtcggaattgctggttgtggggatggttcattaggggagccacctcgacgtggagaagggcaatgtggaaatatgaggcttctattaagacaacaacagaggattctcttgtcaaagtctgatgttgcaggatggggagccttcttgaagtatgttcttgatgcttatcgcaaaggagacaagttaaaatttgcaaaccactcgtcaaaccccaattgctatgcaaaggtgatgctggttgctggagatcaccgagtaggcatatttgccaaggaacacatcgatgctagtgaggagctcttctatgattaccgttatggtccagatcaagcaccaccatgggcacgtaaacctgagggttccaagagagacgaatcaacagcttctcaaggcagagctaagaaacaccagtctcattga

SEQ ID NO: 46490 - DNA, 951 bp, Glycine max
  Peptide Sequence Number=SeqID_163268
atggatactaacatggctgttgcatgccatcaaaaaattcctttcaatcaaatgatgcagttttctggggtgcaagccatagtggaaaatgttgcatcaaaaaccaaaattcatctgataaaccttgatattggatgtggagtgcaatgcatggctttgatgcaagcactggctgagagacaggaagagcaagttgagattctgaagataactgccattggacttcaaggcaagaccgagccagaaaagacagggaaaaggttagtgagttttgctgaatccttaaacttgccctttttatataaggtagtttttgtcacaagcatcatagagatcaaggtagagcaatttggcattgaagataatgaagctgtagctgtatattctccttatatgctgaggactatggtgtcggattctgattccttggaacacttgattcgggtgatgagaaaaatcagaccaagtataatgataattcttgagttggaagcaaagcatcattcacccacctttgtgaatcgcttcattgaggcattgttcttctattcagcattttctgactgcattgagacctgcatgaagcaggattatgaatgcagaatgagaattgagggaatattatcagaagggatacgaaacattgttgctatggaagatggagaaaggatggttaggaatgtgaagatagatgtttggagaagattctttgcaagttcattccgaaagcaatctcaggccaatccaaagcaacaaaacacagggacaagtgtaacttcccttaccttgcgtggttttaagtttgggttgcctgaagaggatgagaaagaaaaaggctttaggtccaaaggctatgaagagccacaaatccagtcaagggaaaaggatttctttgattgtgagagggctaacaaatctccaactttaccaaatactacacaaaagatctaa

SEQ ID NO: 46491 - DNA, 672 bp, Glycine max
  Peptide Sequence Number=SeqID_163269
atgagtaagtggcctttcacaatatctcagtggcaggaactggaacatcaagctttaatttacaaatacatggtggctggtcttcctgtgcctcctgatctagtcattcccattcagaacagcttccactccatttcccaaaccttcttgcaccatccctctaccaccatgagttattgttccttctatgggaagaaggtggacccggagccaggacgatgcaggaggactgatgggaaaaagtggaggtgctccaaggaagcctacccagactccaagtactgtgagcgacacatgcaccgtggccgcaaccgttcaagaaagcctgtggaatcacaaactatgacacagtcatcatccaatgtgtcatcattgactgtaactgctggcagcagcaccagtgcaactggaaatttccagaacctttccaccacaaatgcatatggtaatccccaagggactgcttctggaacagaccaaacccactatcacatggattccattccctatgggatcccaagtaaccattggatgtcagaatggcagctttttcctgtttacttcattctaatcactgttctgggccctgatgtctttgtgcagcttttgaattctgtagcgatttatgagaatggtggggttgtgtttgactttggttatattgttgcatag

SEQ ID NO: 46492 - DNA, 198 bp, Glycine max
  Peptide Sequence Number=SeqID_163270
atggctgatacacttgatagtgggggacaagaatgtaacagaatggaaatagaatttccaaggagaacgatgaacatcgaagtgaacgaccaggagctagatggtcgtaacaccactatcctcgaagtgccaacccgtgctggtcgtggtggtggtggagatggtggcgggtatggtggcggacgtcgacgccgatga

SEQ ID NO: 46493 - DNA, 372 bp, Glycine max
  Peptide Sequence Number=SeqID_163271
atggctggtcctaggattgcccatgctaccttgaaaggtccgagtgtggttaaggagatcataattggaataacacttggcttagctgctggtggtgtgtggaagatgcaccactggaatgaacagaggaaaaccaggaccttctacgatttactggaaaagggggtgagccttggtgcaacagtaaggctgttgctttatgacttggaggttgtgggtttaaatcttggtaacaacctctccctttgcaggagtaagacggtactggctgccttttttaatatatggcttcaagtttttgttgcttgcacaaaaatggatagtaattggctggtagcattagctgttagggaatcattctccatctattga
